United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 47

SEQ ID NO: 216564 - protein, 185 aa, Glycine max
  Coding DNA Sequence Number=SeqID_99786
  Gene Ontology: Mol. function=DNA binding; Cellular component=nucleus; Biological process=regulation of transcription
  Homolog annotation: Hit_ID=Q9FLG5; Match level="QueryCoverage=87%, HitCoverage=86%, E-value=9e-55, Identity=58%"; Hit description =Similarity to NAM
  Pfam annotation: Domain name=NAM; Domain location=10-124; Score =111.2; E_value=2.9e-30; Accession=PF02365.6; Description=No apical meristem (NAM) protein
MSTFHPGSIYPTDEELVVHFLHRKASLLPCHPDAIPDLEVYPYDPWELDGRALAEGNQWYYYSRRTQNRVTGNGYWKPTGMEEPVVSSTSNKRVGMKKYFVFHVGEAPTAGIKTNWIMQEYRLSDSASSTRSSKRKPQPKIEYNKWVICRVYERNGDDDNGTELSCLDEVFLSLDDDLDEISLPN

SEQ ID NO: 216565 - protein, 103 aa, Glycine max
  Coding DNA Sequence Number=SeqID_99787
  Homolog annotation: Hit_ID=Q9FHI9; Match level="QueryCoverage=95%, HitCoverage=15%, E-value=2e-12, Identity=31%"; Hit description =Arabidopsis thaliana genomic DNA, chromosome 5, P1 clone:MFC19
  Pfam annotation: Domain name=DUF594; Domain location=41-98; Score =67.5; E_value=4.4e-17; Accession=PF04578.4; Description=Protein of unknown function, DUF594
MLPVGAGLITLRYTVVEAMKFFEQIKVVPQQDSLAETFTKQLIDAEDRLPTWEFVQKLWIEIMSYAGAQCRVDMHAHQLRRGPEFLSHVWLLQAHFGLLDQFQ

SEQ ID NO: 216566 - protein, 50 aa, Glycine max
  Coding DNA Sequence Number=SeqID_99788
MNCFLRFLENAMNSLSEHAALKLAKHAYRAKRGHPLRMNTHPLAELPVAK

SEQ ID NO: 216567 - protein, 74 aa, Glycine max
  Coding DNA Sequence Number=SeqID_99789
MVFSSWEPDLDIWGKKNSCARCRSRVEFPYYFYEARVTMMIWKQRAKLVMATTRWVLKHPVYGICDTKAWDLHK

SEQ ID NO: 216568 - protein, 58 aa, Glycine max
  Coding DNA Sequence Number=SeqID_99790
  Homolog annotation: Hit_ID=Q6Q2Z9; Match level="QueryCoverage=100%, HitCoverage=8%, E-value=3e-12, Identity=49%"; Hit description =Phosphoenolpyruvate carboxylase
MRQAGMEDMAEMLEKQLASEVRKGGNMVLAAKSCDDIFNNLLQDGVSPDELYKTVFKQ

SEQ ID NO: 216569 - protein, 370 aa, Glycine max
  Coding DNA Sequence Number=SeqID_99791
  Gene Ontology: Mol. function=protein binding; Cellular component =integral to membrane; Biological process=protein transport
  Homolog annotation: Hit_ID=Q1GZX5; Match level="QueryCoverage=98%, HitCoverage=53%, E-value=1e-131, Identity=64%"; Hit description =Flagellar biosynthesis protein FlhA
  Pfam annotation: Domain name=FHIPEP; Domain location=5-361; Score =66.3; E_value=1.7e-25; Accession=PF00771.10; Description=FHIPEP family
EKAKQQEILEPKAEDKLAPASEAEEATWNDVLPVDTIGLEVGYRLIPLVDKGQGGELLKRIKGIRKKFAQEIGFLAPTVHIRDNLTLKPNAYRITMKGVEMASGESNYSQMLAIDPGAVTGELDGAKTTDPAFGLPAVWIEPDRKEYAQSLGYTVVDAGTVIATHLNHIISLNAGELLGRQEVQQLLDHLGKESSKLIEEIVPKMITLSSLQKVLQNLLNEGVHIRDMRSILETIADHAQYTQDANDLTAMVRVKLGRAIVQDLFPYSSEITAMTLDGQLEKLLLQALQNNQSSQSVIEPGIAERLSQQTEMAARQQEQMGLTPVLLVAAPLRQALSRFLRRTVPHLRVLSHDELPDNKSIRVTSLIGAQ

SEQ ID NO: 216570 - protein, 64 aa, Glycine max
  Coding DNA Sequence Number=SeqID_99792
MALAVVDDGGDESDADVIGFGKSEVQRRTGGGDGDGDEGIAIGTSKFAIDTSHVGAFGNCQIAP

SEQ ID NO: 216571 - protein, 955 aa, Glycine max
  Coding DNA Sequence Number=SeqID_99793
  Gene Ontology: Mol. function=nucleic acid binding; Cellular component= beta-galactosidase complex; Biological process=DNA integration
  Homolog annotation: Hit_ID=Q1T4S3; Match level="QueryCoverage=71%, HitCoverage=54%, E-value=1e-112, Identity=51%"; Hit description=Zinc finger, CCHC-type
  Pfam annotation: Domain name=rve; Domain location=294-424; Score =64.6; E_value=3.3e-16; Accession=PF00665.16; Description=Integrase core domain
  Pfam module annotation: Pfam domain module=RVT_2::rve; Domain location=590-845::294-424
MDKENPAYAAWEYQDQSLLVWLQSFLSEAILNTRKGERSIVEFLTRIKTIVDSLLAIGQTVSVQEQIDVILEEQRLEKLRESVVAPALNLTRAQTAKAEDTDSDSTPQVQFTQHHDRGRSSNSRGILEMVITEIMEILIAQQYNQNHSGNQNRNYSYHRPNSQPQNNNSQSQHNAQAPQAYLANANPTQQSQNWYIDSGATHHVTASPQNLMNEVPTSANEHVFLSSGQDDLYVFSNLLNSSVKSTVGRAAASVHMSSLSALSSHCNNVNSKELCTACCIGKSHRLPSYPSDSVYCAPLELIFCDLWGPAPMLSSMGFNYYVSFVDAYSCYTWIYSLKQKSETLSVFKQFKSLAELQLICPHTHHQNGVVERKHRHIVEMGLTLLSQASMPLSYWDHAFHTAVYLINRFPSAYLKNTIPYEMTFNKYPDYSFLKVFGCMCFPHPRPFNKDKLDFSFPFSVAKPHVSSPPSSVPSQLLRLGVLPIPTAHPNPPSHSMESIESLSSLSQPVELNSLQLVPTKQAASSIPANDESSPSTLPSTTPPQPQNTHPMQTRSKSGIVRPRLHPTLLLTTAEPTSVKHALSSPEWKEAMRQEYNALMANNTWSLVPLSLGRKAIGCKWVFRVKQNFDGSILKYKARLVAKGFNQIPGQDYSQTFAPVVKSVTIRIMLTIALNHHWSIQKIDVNNAFLNGYLEEFYMTQPLGFADSDKSMVCKLKKAIYGLKQAPRAWYERLTKTLLNFGFVQSMCGPCLLVFKTDSECLYLLIYVDDIIITRSSPVLIQKLMTKLHAVFALKQLGNLDYFLVIEVKHLSNGSLLLSQAKYIRDLLEKAKMVDAKPILTPLPSDLKLTKLGTAKLVSVPVADATLYRSADGTLQYITVTWPELSYSVNKGTIDYGFSLKSAPQGEPYTLEAFFDTDWGMDMSSVARSTTEAEHRSLAVTALELLWIQSLLRELY

SEQ ID NO: 216572 - protein, 95 aa, Glycine max
  Coding DNA Sequence Number=SeqID_99794
LLDLFPLQTCMAIYRKQPLSAGKLAQASCLLRVEGISLPRRVTCLGLKFSLSLGELDASLGEFRVRNLHEKTILPFHLALFSDLTNNHQNLKNYG

SEQ ID NO: 216573 - protein, 84 aa, Glycine max
  Coding DNA Sequence Number=SeqID_99795
MDGEELPSPMNSDQRAELSQVTVRSQDKLTAEINQGTWGRMQVGIGSRPTDRSPFPALNKQRTSLQGSPVSFAFAVSFTIVCFK

SEQ ID NO: 216574 - protein, 103 aa, Glycine max
  Coding DNA Sequence Number=SeqID_99796
MVDEVLIDTPWSYVSYPNCTTTFDPLKIMGVCRSCQNQVSHTVPRYKLVLKWNTMGRKLTFIFGMQRVSKCSGGDEIKVFPECVDDLVGKTLALRFKYRVNMR

SEQ ID NO: 216575 - protein, 77 aa, Glycine max
  Coding DNA Sequence Number=SeqID_99797
MSEIPLSPSSALLSISTGMGGTRGSATVETWSMVVKEKIVRLRIQRYGGNMEHGGGLHFTVAAAPNTQLPQACLFYW

SEQ ID NO: 216576 - protein, 57 aa, Glycine max
  Coding DNA Sequence Number=SeqID_99798
MVDEFGDGILQTLRVGFRADSAIVELNESTNLLGKGKASLGFEGYANNRMDSALWNW

SEQ ID NO: 216577 - protein, 163 aa, Glycine max
  Coding DNA Sequence Number=SeqID_99799
  Gene Ontology: Mol. function=chromatin binding; Cellular component =chromatin; Biological process=chromatin assembly or disassembly
  Homolog annotation: Hit_ID=Q1SAV4; Match level="QueryCoverage=69%, HitCoverage=37%, E-value=3e-21, Identity=49%"; Hit description =Integrase, catalytic region
  Subcellular localization annotation: CTP_CleavageSite=80; ConfidenceScore=5.23e-01
MALNLPTMSLQVEGRPTAPTPEFSVLQRQPRITKGAIRGWQFMQLTGRAFNSFLRITTKASSLIFKTSSTMPNVKVTVMYCGMVRGFLLKVISYGDKLEPEWTEHLCLTIDLRMVGGAHPQGHATEPKQVLLEAAQKQGTMVCDQAPRHAVNFTHDIHEENDN

SEQ ID NO: 216578 - protein, 246 aa, Glycine max
  Coding DNA Sequence Number=SeqID_99800
  Gene Ontology: Mol. function=RNA-directed DNA polymerase activity; Cellular component=chromatin; Biological process=chromatin assembly or disassembly
MRITIGCLEKGRKLNEELLNGRRQGVRDELRGMRVYWCNLEMKLMRSVEMEGCIGVSLKLNQVPFSNEFHGQCVVVCQYRIQRFQPLHIKNKGGLAKEVTIQRMAIAHHYLQGSRYKATWPTRHKVSGARWPENVCKLIWAWSGSWVSGGSGEGSNKGAASSKGLDLVADIGLEARDKVAQKELQWKTDDPVGQILKLRQVGANLVCSAYRNTGQEVQPIEMQHFQLQAMSRRWGCGSWDSYGRGG

SEQ ID NO: 216579 - protein, 443 aa, Glycine max
  Coding DNA Sequence Number=SeqID_99801
  Gene Ontology: Mol. function=RNA-directed DNA polymerase activity; Cellular component=chromatin; Biological process=chromatin assembly or disassembly
  Pfam annotation: Domain name=zf-H2C2; Domain location=365-406; Score =14.1; E_value=0.0048; Accession=PF09337.1; Description=His(2)-Cys(2) zinc finger
  Pfam module annotation: Pfam domain module=RVT_1::zf-H2C2; Domain location=12-186::365-406
MLQNGLIHPSTSLFSSLIILVRKQDISWRFCIDYHAVNAITMKDRFPIPTIDELLDELGGATWFSKLDLLHGYHQLLMHEDDISKTSFHIHHGHFEFRVMSFGLCNAPSSFQAMTNAIFRPYLCHFIIVFFDDILIFNKTLQDHVIHLEKAFQILLREFILGYSSIARPLTRLVSQDTFTWTPVTRLSFNELKQALNTAPIMQLPDFTLPFTVETDASGVDMGAVLSQKNHPIAFSVSHLHPDSIVPPLIQMPEQQTYLAKLMGYDYSIQYRSSKLNSAADALSRIPKTTVGTMLLLSISSMTFLNELKNQLLQHPDFLKLRQEITQHPDKYPEYRIAQDLIMYQSRIWLLVGSPFIPTLLAEYHSSPIRGHIGITKTLARLSENFFWSGMLKDVKSFVAQCLDCQHTKYETKKLAGLLYPLPVPFRPWEDLSLDFIIGLPPF

SEQ ID NO: 216580 - protein, 70 aa, Glycine max
  Coding DNA Sequence Number=SeqID_99802
  Homolog annotation: Hit_ID=Q6ZGV8; Match level="QueryCoverage=56%, HitCoverage=2%, E-value=1e-08, Identity=60%"; Hit description =Eukaryotic translation initiation factor 3 subunit (EIF-3)-like
MLCPFCNQIRHYLLDLLRVTPRDANYTGPGSRFCILRPELITAYCQAQAAKALKSKEKNFQEVDNLATES

SEQ ID NO: 216581 - protein, 770 aa, Glycine max
  Coding DNA Sequence Number=SeqID_99803
  Gene Ontology: Mol. function=nucleic acid binding; Cellular component= nucleus; Biological process=DNA integration
  Pfam annotation: Domain name=rve; Domain location=62-229; Score=-2.1; E_value=0.0089; Accession=PF00665.16; Description=Integrase core domain
  Pfam module annotation: Pfam domain module=RVT_2::rve; Domain location=399-502::62-229
EQVLLHLGVADLDYALRRDEPTELTDSSTSEETALYERWERSNCLSIMFIKMSISASIRGSIPECQNVKDFMKVIDEQFESSEKALASTLMSKLLSMRLNLSRSRSMIHISNTMQDFSSQREPNEALDAFKIFKAEVEKQCGKQIKIVRSDRGGEFYGKYTENGQAPGPFAKFLQEHGIVAQYTMPGSPNQNAKFKTSACLGCSSEVRIYNPNEKKLHPRTISAYFIGYAERSKGYRFYCPTHSTRIIESRNAKFLENDVASGSDLTKGIGLEKNQYEGAVPTSSYKLVVFSDTHQNCVTQAPHQVDHVLEDPVEQHQTQNVEQLFEQHQTQDVEQPVEQQPKGVDVTLRRSTRIKKPVIPSDYHVYSQESQYDFGVENDPESFLQAINSCDSKLWYDAMKDELESMVNNKVWDLVEFPNGIKPIGCKWVFKTKKDSLVKQFLSKNFDMNDMGEAAYVIGIEIHRNRSQGILGLSQKAYINKVLERFRIKDCSANMAPIVKGDRFNLNQCPKNELEREQMRNIPYTFIIGSLMYAQVCTRPNIAFVVGMLERYQSNPGIEHWTAAKKVLIYLQGTKDCKLIYIYQRFDNLEVVGYSDSDFASCVDSRRSTSGYIFMMTDGAISWRSAKQSLVATSTMETEFISLLKRHHRVFGSKVSWSVSKLEAFFAIDECCQIHQGYMGRAVTGGCTEFEPEWFQVLDNIYWKPVILVGRLPSSIGPVGAKSRQDEVIEIALGLEKLKPSFLWVLRLQHGPWDPNVLQLPEGFEERTQ

SEQ ID NO: 216582 - protein, 303 aa, Glycine max
  Coding DNA Sequence Number=SeqID_99804
  Gene Ontology: Mol. function=DNA binding
  Homolog annotation: Hit_ID=Q1RUD8; Match level="QueryCoverage=69%, HitCoverage=43%, E-value=5e-23, Identity=34%"; Hit description=IMP dehydrogenase/GMP reductase
MGSNQAPSFKKRFYHVKIKSLEVAGLQELGQGMGQLQLQAFRKTYGKIWDLAMIELLEENAKALADQGEWASFLDVLALLVFRVILFPNVDGLVDLAAIDAFLVYHHSKESLVIVILADAYDTFDWRCENSSARIVYCTPILYVWLTSHIFRHQSRPVCPLQGHHMCAEKGKANWEQLLAGMEGRAGVLSSCKGFTNVPLMGTRGCINYNPILSIRQLGYPMRGTPSEESIAPFIARGFSDPNAKVLQRVRKAWNTVQRKDKELRGSSNGIVGGYHKWLKARMQEITWLPKLKISSEEEAETP

SEQ ID NO: 216583 - protein, 149 aa, Glycine max
  Coding DNA Sequence Number=SeqID_99805
  Homolog annotation: Hit_ID=Q66PF2; Match level="QueryCoverage=39%, HitCoverage=17%, E-value=7e-09, Identity=41%"; Hit description =Putative UDP-rhamnose:rhamnosyltransferase
TPDAMLNLLQSTITPTHDAIMYYNGKWNIPRQGEFFGYSFTGTNPIRFGILSECGMEKLKDLIKQVAPTGVPLMEFTDHNWLDDCSFDNQRFLENVVGFFEVFKDVVGDVSVGFCVFWKVLDFRQWKVHEIDINNEFGQLKVWDHVTKG

SEQ ID NO: 216584 - protein, 123 aa, Glycine max
  Coding DNA Sequence Number=SeqID_99806
MEGAAAGVSLSLDHVLNEYHLLSETSSRLASKRNLERNLLCKHAPSAQPARPTSHLSLLALSAPGLLSQRSLTRAKCENGAKHAFEDRKPFLKPEMKKKREKRQIKCEEQRIKAQNRARKQKP

SEQ ID NO: 216585 - protein, 315 aa, Glycine max
  Coding DNA Sequence Number=SeqID_99807
MPAAGLMPTAGHLSTAKDVFLAPPAIEALAPLTVEALAAAASTPVIHAPLPLPVVAIQEVALAIVPATQDGIVVVSLPTIVEPLLSAGVAATGASTMMPPSSMTLMAFPSVILAMVASLSSLSCPRVLLGHSYTSSDVDSLWGATYTMEHKTPVGFVSAFDKNLIRSTRVQNATDSAKVGHPKVANAIVAFAKAAKKMDLGGKVESLATEKDGLAKVVVDLEARLKESETRLEESKLWAAKERKVSRELEEELILYKKEVVEQYEKQFQKAIRHVDFFAKDVKEGVLLDEEEINVEEEAADEGQCAAEQGDDACI

SEQ ID NO: 216586 - protein, 178 aa, Glycine max
  Coding DNA Sequence Number=SeqID_99808
MSSFLSDSAIGLGDNNFGGSIEESIMDREQVLLLGEGEDLTPNWCEHFSPSQKGMTLCYFRGACPGYCDPPHSAYEGVRRGSVNGDVRVFPRVQRSKSDGSASSTLVIAGYEWVRDDVLKYKSCLTLATSVVGLQCQVKLANLKDSCKLAAQARGSNDFSVFRAAPGCPPFFFMYWST

SEQ ID NO: 216587 - protein, 84 aa, Glycine max
  Coding DNA Sequence Number=SeqID_99809
MTILASACQSNLGSSNDEVWITVRARNSLAHRILVGVASYPLAGGQRETHRYIFQERKMHGVATNVYWRKTSEKPEKVWSTNFK

SEQ ID NO: 216588 - protein, 363 aa, Glycine max
  Coding DNA Sequence Number=SeqID_99810
  Gene Ontology: Mol. function=methyltransferase activity; Cellular component=integral to membrane; Biological process=peptidoglycan metabolic process
  Homolog annotation: Hit_ID=UPI00005F9F51; Match level="QueryCoverage =51%, HitCoverage=35%, E-value=5e-78, Identity=77%"; Hit description =COG2989: Uncharacterized protein conserved in bacteria
  Pfam annotation: Domain name=Peptidase_M15_2; Domain location=234 -363; Score=224.5; E_value=2.4e-64; Accession=PF05951.3; Description =Bacterial protein of unknown function
STLEDPTYHSVLAGDCRSSGPQNAADAQRAQQCGAQSAVERAHHAGAPGYRAEVIDPSMIDWHMVSAASFPYRIRQAPGASNSLGRYKFNMPSSDAIYLHDTPNHGLFQRDIRALSSGCVRVNKASELADLLLQDAGWNDSRISDTLKQGDTRYVPIRHRIPVNLYYLTAWVADDGQPQYRTDIYNYDNPARSGSQIGFAHSVTDCGLTALQAAVTVRPSAGLSLLPGAALASVSTSRPRVLTLSNMHTGETLKTEFFNGKSYDKDELARLNHFFRDYRANQVKHIDPHLFDQLYRLQTLLNTRKPVQLISGYRTLATNNMLRESGPGVAKHSYHTKGQAMDFHIEGISLSNVRKAALSMRAG

SEQ ID NO: 216589 - protein, 46 aa, Glycine max
  Coding DNA Sequence Number=SeqID_99811
IFRKKDRSPPAQAVAAQKRTWLYNHEGCTSSVPSPGLKSYFVSFGT

SEQ ID NO: 216590 - protein, 90 aa, Glycine max
  Coding DNA Sequence Number=SeqID_99812
MVVDPEAKPIYQRRQKMGAEKGKKSKSKIMRKGTEFKWDEKCEATFQKVKETLSSPLMLVKLEMGKTLYLYLAMENEVISVALDLETDEH

SEQ ID NO: 216591 - protein, 81 aa, Glycine max
  Coding DNA Sequence Number=SeqID_99813
MNFDAYTHREFAKRNLQWLSARKNPEEDELSSSLSASLQVIKRTASAHLLRETSALSQNLLMRAKRCRSVLSAQARTRPPI

SEQ ID NO: 216592 - protein, 167 aa, Glycine max
  Coding DNA Sequence Number=SeqID_99814
MHGGTFTRNEADGKLEYVGGELDVWDKIETNYLNFFLLTNLVKHCRKYNNVGDIHYVMDKEVDLEEGNLNPIPEVEEEGNKDDGDGDVGNDDSNGVDDVDVDVRVGREWWSDIPEYNDEVQQDEAKPVGYESEKLDSPRSFDDEGGFEKEVFPQFNECGKFGNVHLE

SEQ ID NO: 216593 - protein, 84 aa, Glycine max
  Coding DNA Sequence Number=SeqID_99815
MEVRWPNMGRSAQNTPDLVVVRMKGHWSCNGEGVTIAAMVEGEKWTEGEGFSSGCGCKVLEEHSMNGLRTKQVPTPCWLCPKFM

SEQ ID NO: 216594 - protein, 181 aa, Glycine max
  Coding DNA Sequence Number=SeqID_99816
  Homolog annotation: Hit_ID=Q6ZKI2; Match level="QueryCoverage=47%, HitCoverage=60%, E-value=2e-34, Identity=80%"; Hit description =Putative RNA recognition motif (RRM)-containing protein
  Pfam annotation: Domain name=RRM_1; Domain location=92-158; Score =57.6; E_value=4e-14; Accession=PF00076.12; Description=RNA recognition motif. (a.k.a. RRM, R
  Subcellular localization annotation: CTP_CleavageSite=42; ConfidenceScore=5.62e-01
MATRAAVAAPRVFRRFFCTNSASPSFPFVPTPPPGATPTPTRPTAEPNPNLFVSVLGGLGFEEVKTWLKNLEKGFDIPFHYWSSNIRDGFCLSKRTTTERLREEFAKFGEVVHARVVTDRVSGYSKGFGFVQYATIEEAAKGIEGMDGKFLDGWVIFAEYARPRPPPGQSLNNNSPQYGRQ

SEQ ID NO: 216595 - protein, 139 aa, Glycine max
  Coding DNA Sequence Number=SeqID_99817
  Gene Ontology: Mol. function=branched-chain-amino-acid transaminase activity; Cellular component=chloroplast; Biological process =branched chain family amino acid metabolic process
  Homolog annotation: Hit_ID=Q1RSX5; Match level="QueryCoverage=56%, HitCoverage=22%, E-value=2e-21, Identity=64%"; Hit description =Branched-chain amino acid aminotransferase II
MVTSNLTVMVEPFVKDFLSGDKVLGTKIKMNPKRKKEIDLVKKPDVLIEKVGPQSHNFKGPSNMSMEMEYHKIYTSMIDAKANGFSDVLFLDSAIGKYIEKATTCNVFVVKGNFIFTPDMDGTILPGIVRKSIIEIAIC

SEQ ID NO: 216596 - protein, 115 aa, Glycine max
  Coding DNA Sequence Number=SeqID_99818
  Subcellular localization annotation: CTP_CleavageSite=33; ConfidenceScore=5.00e-01
MESSASSRNLGNNTFQQPRINFLRTRDFFCTVVLDLLVVPLLLLPLPVEQICENGTASASSAFGSGGEDAVCGDTDLEGRGMARLQRVRPLAVVARTRSAAAQTWKAKQSKGMEV

SEQ ID NO: 216597 - protein, 73 aa, Glycine max
  Coding DNA Sequence Number=SeqID_99819
MDLDYFYLIIWHLLFLPQFGVCGNKEMLEYKCETSRPLVEVWKSPKHPFMKLNTDEAWLSHNAMGGGGVLRES

SEQ ID NO: 216598 - protein, 217 aa, Glycine max
  Coding DNA Sequence Number=SeqID_99820
DIFQALMRGPEVSFGANVIASNATDDGVNVASSNPDEEVDIFEHIRQKDEATEKGKKCRKIKKREAKRVDTYTSIFLTTKFIIDLKERVKLTYDNNSDWVVVDHCLPSERVEPSGGKGDRPKDKVAKMTKVIHLVDFDKVKGTKEKTLKKQTSLRSDAKKITTEGCGAIDSFLRKQIPSKPNIEKTTTNGGDVVDLGSSTNVEKLTSTPTTLTLKTA

SEQ ID NO: 216599 - protein, 110 aa, Glycine max
  Coding DNA Sequence Number=SeqID_99821
  Gene Ontology: Mol. function=ribonuclease H activity
  Homolog annotation: Hit_ID=Q1SZM6; Match level="QueryCoverage=73%, HitCoverage=28%, E-value=4e-13, Identity=41%"; Hit description =Ribonuclease H
MDAMLWFRHVQGIQQILFDQDHGAHILLHDTKQLHSTKSPMLVRWNPPTPQAMKINTNGSSLGDPCATGFGGIQRDDLGNWIMGFKGYCGFSSNMTRKLFGIFHGLRIAN

SEQ ID NO: 216600 - protein, 81 aa, Glycine max
  Coding DNA Sequence Number=SeqID_99822
MEIRFRGWIHKREFQWQSMIVPNEFNGGIVVPTITLALKLENQLSIYHDVPAIITCSTRFMLYDHTYRVRLVITTRKPTSA

SEQ ID NO: 216601 - protein, 396 aa, Glycine max
  Coding DNA Sequence Number=SeqID_99823
  Gene Ontology: Mol. function=protein binding; Cellular component =membrane; Biological process=defense response
  Homolog annotation: Hit_ID=Q1SXP3; Match level="QueryCoverage=98%, HitCoverage=31%, E-value=1e-112, Identity=54%"; Hit description =Disease resistance protein; Peptidase aspartic, active site
  Pfam annotation: Domain name=NACHT; Domain location=191-343; Score= -33.2; E_value=0.022; Accession=PF05729.3; Description=NACHT domain
  Pfam annotation: Domain name=NB-ARC; Domain location=152-396; Score =121.1; E_value=3.1e-33; Accession=PF00931.13; Description=NB-ARC domain
  Pfam module annotation: Pfam domain module=NACHT::NB-ARC; Domain location=191-343::152-396
MAGVGEALISASVEILLNKIASTVRDFLFSTKLNVSMLEELNTKLWELTVVLNDAEEKQITDPSVKTWLHGLKDAVYDAEDLLDEINTESHRCKVEGESKAFTTKVRSFVSSRSKIFYKNMNSKLEDLSKKLENYVNQKDRLMLQIVSRPVSYRRRADSLVEPVVIARTDDKEKIRKMLLSDDDEKNNNIGVIPILGMGGLGKTTLAQSLYNDGEVKKHFDSRVWVWVSDDFDNFRVTKMIVESLTLKDCPITNFDVLRVELNNILREKKFLLVLDDLWNDKYNDWVDLIAPLRSGKKGSKIIVTTRQQGVAQVARTLYIHALEPLTVENCWHILARHAFGDEGYDKHPRLEEIGRKIARKCEGLPLAAKTLGGLLRSNVDVGEWNKILNSNSWAH

SEQ ID NO: 216602 - protein, 800 aa, Glycine max
  Coding DNA Sequence Number=SeqID_99824
  Gene Ontology: Mol. function=protein binding; Cellular component =membrane; Biological process=defense response
  Homolog annotation: Hit_ID=Q1S607; Match level="QueryCoverage=99%, HitCoverage=64%, E-value=1e-179, Identity=46%"; Hit description =Disease resistance protein; AAA ATPase
  Pfam annotation: Domain name=LRR_1; Domain location=128-150; Score =5.6; E_value=26; Accession=PF00560.23; Description=Leucine Rich Repeat
  Pfam annotation: Domain name=LRR_1; Domain location=152-174; Score =10.1; E_value=3.8; Accession=PF00560.23; Description=Leucine Rich Repeat
  Pfam annotation: Domain name=LRR_1; Domain location=175-197; Score =16.4; E_value=0.1; Accession=PF00560.23; Description=Leucine Rich Repeat
  Pfam annotation: Domain name=LRR_1; Domain location=199-222; Score =5.9; E_value=23; Accession=PF00560.23; Description=Leucine Rich Repeat
  Pfam annotation: Domain name=LRR_1; Domain location=275-297; Score =7.0; E_value=14; Accession=PF00560.23; Description=Leucine Rich Repeat
  Pfam annotation: Domain name=LRR_1; Domain location=327-348; Score =7.3; E_value=13; Accession=PF00560.23; Description=Leucine Rich Repeat
  Pfam annotation: Domain name=LRR_1; Domain location=413-436; Score =10.4; E_value=3.2; Accession=PF00560.23; Description=Leucine Rich Repeat
  Pfam annotation: Domain name=LRR_1; Domain location=527-550; Score =5.7; E_value=25; Accession=PF00560.23; Description=Leucine Rich Repeat
  Pfam annotation: Domain name=LRR_1; Domain location=552-576; Score =9.0; E_value=5.8; Accession=PF00560.23; Description=Leucine Rich Repeat
  Pfam annotation: Domain name=LRR_1; Domain location=600-622; Score =1.0; E_value=1.9e+02; Accession=PF00560.23; Description=Leucine Rich Repeat
  Pfam annotation: Domain name=LRR_1; Domain location=727-750; Score =10.8; E_value=2.7; Accession=PF00560.23; Description=Leucine Rich Repeat
  Pfam annotation: Domain name=SOCS_box; Domain location=670-710; Score= 2.7; E_value=0.1; Accession=PF07525.6; Description=SOCS box
  Pfam module annotation: Pfam domain module=LRR_1::LRR_1::LRR_1::LRR _1::LRR_1::LRR_1::LRR_1::LRR_1::LRR_1::LRR_1::LRR_1::SOCS_box; Domain location=128-150::152-174::175-197::199-222::275-297::327-348::413 -436::527-550::...
  Pfam module annotation: Domain location=552-576::600-622::727 -750::670-710
MAEGFLQQSHGDNRAMESIGDDCFNELLSRSLIEKDKAEAEKFRMHDLIYDLARLVSGKSSFYFEGDEIPGTVRHLAFPRESYDKSERFERLYELKCLRTFLPQLQNPNYEYYLAKMVSHDWLPKLRCLRSLSLSQYKNISELPESIGNLVLLRYLDLSYTSIERLPDETFMLYNLQTLKLSNCKSLTQLPGQIGNLVNLRHLDISDIKLKMPTEICKLKDLRTLTSFVVGRQDGLRIRELGKFPYLQGNISILELQNVGDPMDAFQAELKKKEQIEELTLEWGKFSQIAKDVLGNLQPSLNLKKLNITSYGGTSFPEWLGDSSYSNVTVLSISNCNYCLSLPQFGQLPSLKELVIKSMKAMKIVGHEFYCNNGGSPTFQPFPLLESLQFEEMSKWEEWLPFEGEDSNFPFPCLKRLSLSDCPKLRGSLPRFLPSLTEVSISKCNQLEAKSCDLRWNTSIEVICIRESGDGLLALLLNFSCQELFIGEYDSLQSLPKMIHGANCFQKLILRNIHYLISFPPDGLPTSLKSLEIRECWNLEFLSHETWHKYSSLEELRLWNSCHSLTSFPLDSFPALEYLYIHGCSNLEAITTQGGETAPKLFYFVVTDCEKLKSLSEQIDDLPVLNGLWLYRLPELASLFPRCLPSTLQFLSVDVGMLSSMSKLELGLLFQRLTSLSCLRICGVGEEDLVNTLLKEMLLPTSLQSLCLHGFDGLKLLEGNGLRHLTSLQKLHVWHCRSLESLPEDQLPPSLELLSINDCPPLAARYRGRERKYKFWSKIAHWSKIAHISAIQINDDVTIR

SEQ ID NO: 216603 - protein, 110 aa, Glycine max
  Coding DNA Sequence Number=SeqID_99825
MGLEIYPEVHENPRAFFSSSSPILLEPLAHGSSDWSLPSDMAIGLSWVLWTKHTSTAKRSSSALSATEESGRASSSRPRAKRETSTLSAAVVFRQVQRTTGAKFKSSYLR

SEQ ID NO: 216604 - protein, 131 aa, Glycine max
  Coding DNA Sequence Number=SeqID_99826
LLAGSLAFESRILHYLIVRILLPRSSNLAQASEEDLIVMWAFHKGLQIDWAHLGARHVGEEGHDGEDSYLISKILDRFDGLQTFVGERFDTLELQVDMRFNEMESRITKVEEDVSYIRSSFDLPPPPPPSS

SEQ ID NO: 216605 - protein, 146 aa, Glycine max
  Coding DNA Sequence Number=SeqID_99827
  Gene Ontology: Mol. function=unspecific monooxygenase activity
  Homolog annotation: Hit_ID=O04892; Match level="QueryCoverage=64%, HitCoverage=17%, E-value=3e-28, Identity=79%"; Hit description =Cytochrome P450 like_TBP
VDSRGSHNSLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 216606 - protein, 70 aa, Glycine max
  Coding DNA Sequence Number=SeqID_99828
MMFFLSYTKAKAENAQVRNGLGHGNVAHTPDIFSKIPTGVTPHQYFPLLDLLSSYASSFCLTPAEIPQIH

SEQ ID NO: 216607 - protein, 116 aa, Glycine max
  Coding DNA Sequence Number=SeqID_99829
MMSYNTRCYVHVAQCEPSEEKESSSCIFFQWIDDTEAGNNVFIEGSELVKYVWENEELKLKIASLMEEAKGNAKEITDLRKKIVAAEEECRASLVQIVQLNSKIGRKENNLAIERN

SEQ ID NO: 216608 - protein, 159 aa, Glycine max
  Coding DNA Sequence Number=SeqID_99830
MSGTSKVLPALHSIKSLPPKFKIITGNPTSDLMENHGDAKLRSSDVIGSGSPENDVLIAEVAEEAWDRAGDMGVYDEDSVYNKKCVSLEDRPSIADEDLESIPLPSHQFQSPLGNTGGVIRHLMLRRRCTITTKEYAFKVMSAGLQQYQNILLKFDISL

SEQ ID NO: 216609 - protein, 53 aa, Glycine max
  Coding DNA Sequence Number=SeqID_99831
MDTISGTKLPIHSRKKSKSLRALILLYLCKGMASKHILKELNDLQEDPFTSCR

SEQ ID NO: 216610 - protein, 76 aa, Glycine max
  Coding DNA Sequence Number=SeqID_99832
MVKDLLLQQGSLKALHAIKPTGMDDLHWEELKERVGMTIWECSQGEVSSVSEGESGMWEDTRQGGFWEKTISNRTV

SEQ ID NO: 216611 - protein, 185 aa, Glycine max
  Coding DNA Sequence Number=SeqID_99833
  Homolog annotation: Hit_ID=Q1RTL4; Match level="QueryCoverage=70%, HitCoverage=34%, E-value=9e-09, Identity=26%"; Hit description=Zinc finger, TTF-type
MHDSGYAAIQHVSRSTLAPDTTSKQQNLCLFPIPEASSIGENVIEQSLIDHADNEENVIEQPPIDNTDNGKNVIEQPPINNTDNTNSHNFNQELEYNILEIGVEGNVELNNTSSEVPTNIYDPGLWKNIDGKFRDLMIEKGPIRHDNFQYPKDENNKYFYSSCYQRTLSTGPCKMKGKLGISLRP

SEQ ID NO: 216612 - protein, 98 aa, Glycine max
  Coding DNA Sequence Number=SeqID_99834
METTKSTQRALQSVEIQVGELAEAVTQFMVRQEKSFVEVEAQKKSHVKEHESREKDEEKDGEQAQQQWEKYSTVENQQENILQSNNLPHQLIDKKGRQ

SEQ ID NO: 216613 - protein, 48 aa, Glycine max
  Coding DNA Sequence Number=SeqID_99835
LVNPTGIERVLTEKDLLADSYLDQEASILDEKEFLLLKVREQTVWPYP

SEQ ID NO: 216614 - protein, 77 aa, Glycine max
  Coding DNA Sequence Number=SeqID_99836
  Gene Ontology: Mol. function=DNA-directed RNA polymerase activity; Biological process=transcription
  Homolog annotation: Hit_ID=Q2QWI0; Match level="QueryCoverage=66%, HitCoverage=48%, E-value=2e-17, Identity=75%"; Hit description=RNA polymerase Rpb3/Rpb11 dimerisation domain containing protein, expressed
MGIGFASVYPDEMSIPHPSDNRVNIRVQTTGDPAREVLKDGCQDLMLMCQHVRSTFDNAMTDFKRTQTNTEQEMDTK

SEQ ID NO: 216615 - protein, 116 aa, Glycine max
  Coding DNA Sequence Number=SeqID_99837
  Gene Ontology: Mol. function=DNA binding; Biological process=DNA integration
  Homolog annotation: Hit_ID=Q1S0A6; Match level="QueryCoverage=84%, HitCoverage=6%, E-value=8e-37, Identity=67%"; Hit description=Zinc finger, CCHC-type; Peptidase aspartic, catalytic; Polynucleotidyl transferase, Ribonuclease H fold
MAEDDEKKGDEGVPQILTPYALTSNDNPGNIITQVQLKGENYDEWVRVMRTALRAKKKYGFVDGSIKQPGDDSPELEDWWNVNSMLVSRVFNTIEPALRSTISYMENLKDLWKDIK

SEQ ID NO: 216616 - protein, 83 aa, Glycine max
  Coding DNA Sequence Number=SeqID_99838
MIDGIKKVVEVNDDKETWDTTKETTVREVVNNVNENMKKDEEQVCTQGSSGGCFSWIRKKFSQREKERQQRRDNMFFTHFKVC

SEQ ID NO: 216617 - protein, 165 aa, Glycine max
  Coding DNA Sequence Number=SeqID_99839
  Homolog annotation: Hit_ID=Q9SE03; Match level="QueryCoverage=16%, HitCoverage=20%, E-value=5e-07, Identity=88%"; Hit description =Copper chaperone homolog CCH
MGPTYSDMGCKLALEDKKRVAFRRRHRHEHVDATRHAKPCNCSSLASQQQKACVCCFIKLPCRICHQALRCAQKWACYGSKNNRAGFVNSLAFAKSGEFLVAGVGHVKIFSNCVLLTVVLKVGMSCQGCAGAVNRILGKMEGIFIPASYLYYQIQNENDLVIVAM

SEQ ID NO: 216618 - protein, 138 aa, Glycine max
  Coding DNA Sequence Number=SeqID_99840
  Gene Ontology: Mol. function=catalytic activity; Biological process =trehalose biosynthetic process
  Homolog annotation: Hit_ID=Q45RR4; Match level="QueryCoverage=55%, HitCoverage=58%, E-value=2e-25, Identity=73%"; Hit description =Trehalose-6-phosphate phosphatase
  Pfam annotation: Domain name=Trehalose_PPase; Domain location=1-138; Score=-64.7; E_value=0.012; Accession=PF02358.7; Description =Trehalose-phosphatase
MDATSTLPTLASPTLLCTPPGSSQKKEYTPDISGLCAMSRCFPFPPPGYTNKGYEKEGYNRGRGITDKALAEKVRLVLNEYPQLKLTQGRKVLEICLTIKWDNGKALEFLLESLGYENSNDVFPIYIGDDRTDEDAFR

SEQ ID NO: 216619 - protein, 70 aa, Glycine max
  Coding DNA Sequence Number=SeqID_99841
MVVEEAKSTMGTNAEEEKMVIVRFGDLQIMRRVRTGKRLLMKKKQMVAAAEAEKSLPVSPAGGPQPLPLL

SEQ ID NO: 216620 - protein, 54 aa, Glycine max
  Coding DNA Sequence Number=SeqID_99842
MTTEMEAISIQAVSQRMFLILDSHGDLHLLSLSNSGIGVDITGNVRQLPRIMKV

SEQ ID NO: 216621 - protein, 95 aa, Glycine max
  Coding DNA Sequence Number=SeqID_99843
MVVMASRLGLRLLFCAPDLAKQRTSQARGTPSWAALLLQESALLCEHNSRVLPQMEHPCGHTIGACSLFLAIFPDFTKILELSSKYWFEASKCGS

SEQ ID NO: 216622 - protein, 257 aa, Glycine max
  Coding DNA Sequence Number=SeqID_99844
MASTVEVQSSYSAKKQDDSDFNLTEWAVKDRISRENSNSRRYSSSYIRSFREDTRSFRSNVTISSVASSPGYPLKDEIDPSTYSFTTALKALQARSAYRSWECLSPEGFALNSKWNEAEKYICNPFSGEVPMECLSAKTLSGRSFRNSTTNRITMSAPLVYSSRYMQTKPSSTCNSCTQEEEVALQFHISEKGKEGMTRDAGTQSTPPSLVSSNPSTDLTPSIIKSPIKLSEDSLNSNTKAITEEEGIANQCPKGIC

SEQ ID NO: 216623 - protein, 167 aa, Glycine max
  Coding DNA Sequence Number=SeqID_99845
MDSTVPKIANQTVIKEGPRRCATRLRSALFSQVWRAKEQAQAQSRCHNHHHVDRWTMMLMVGSPAKKVVKALAKNGGGCQKRGSKQKDQLECRKRSSEEERSKRAHRWQWIAGKVTVPDSGWNCHWKRRKGRQKAEASCRNKCDDQKGPPGTYMGRFSLFPQPDSDT

SEQ ID NO: 216624 - protein, 196 aa, Glycine max
  Coding DNA Sequence Number=SeqID_99846
  Gene Ontology: Mol. function=3-dehydroquinate dehydratase activity; Cellular component=cytoplasm; Biological process=aromatic amino acid family biosynthetic process, shikimate pathway
  Homolog annotation: Hit_ID=Q30D00; Match level="QueryCoverage=98%, HitCoverage=36%, E-value=3e-71, Identity=69%"; Hit description =Putative 3-dehydroquinate dehydratase/shikimate dehydrogenase
  Pfam annotation: Domain name=Shikimate_DH; Domain location=63-174; Score=38.4; E_value=2.5e-08; Accession=PF01488.10; Description =Shikimate  quinate 5-dehydrogenase
  Pfam annotation: Domain name=Shikimate_dh_N; Domain location=1-29; Score=-23.2; E_value=0.016; Accession=PF08501.1; Description =Shikimate dehydrogenase substrate bin
  Pfam module annotation: Pfam domain module=Shikimate_DH::Shikimate_dh_ N; Domain location=63-174::1-29
VTIPHKEAAIKCCDEVDPVAKSIGAVNCIVRRPTDGKLIGYNTDYVGAVTAIEDGLRGKHNGSSTTISPLASKLFVVIGADVAGKALAYGAKAKGARVVIANRTFENLLMQIGGDALALSDLDNYHPEDGMILTNTTSIGMQPKVDEKPVSKHALKYYSLVFDAVNTPKITRLLKEAEESGATIVTGLEMFMGRTI

SEQ ID NO: 216625 - protein, 95 aa, Glycine max
  Coding DNA Sequence Number=SeqID_99847
MGTMNLLGHGGARPIKVMSLFIREFKRWGVWTVGVRNTRCFLARAGVISLLKGTICRRFGGRAGHALSSLGWPFYSVFQPRPALQFAAPVLTFLC

SEQ ID NO: 216626 - protein, 257 aa, Glycine max
  Coding DNA Sequence Number=SeqID_99848
MLHKILNEEVDSHASQQDKNNMEGSGSKFSEAKASSWARKVELPSFDRSIQGGTDLKGSSFECDSDPLQFLKLENRSKEGSVINNHTLCGGEETKNDEAKLARENKIEKVMEEEVDPSIKKEKHKENGVTNKGCEDDFIDNTITNLIKKEVKVGDSTKPHCFQNLDFHKKIVMEKQKSFMKVVGTTMVLESWNVNLLGKPLALNFVASMADSLAMVLRQKECIESVKLIEVIWSPPLSLPPSKPLDLCLHAGVVGHS

SEQ ID NO: 216627 - protein, 258 aa, Glycine max
  Coding DNA Sequence Number=SeqID_99849
  Subcellular localization annotation: CTP_CleavageSite=60; ConfidenceScore=5.74e-01
MVVVQGSKVHLPHPSSLSPSPHPLPTTSILFEPSSLSLALTHSDSSLSLYPSFSPQTLTLALTIPSSSKTTHTLPALPPLAGILLRLYRRRRETPSFARVTDVRCSHKDLLRFEPNLGVVLDAKHGAAVRLAGSVNYFALHAPSSNKVWVFAVKDDGDGGGDGNDGDGGVRLMRCAVIECSRPVFSVSVAFGFLILGEENGVRVFGLRRLVKGRSGKRVGNSKPLKNGGRGGGLEAVNCNGDLEGKMERHGGVTTAGR

SEQ ID NO: 216628 - protein, 60 aa, Glycine max
  Coding DNA Sequence Number=SeqID_99850
MPLLSSPPLSHYTVEIITSPDDDNYLIATADNNTLMRTKKKTDNVRFWIRKVKQLRKNQN

SEQ ID NO: 216629 - protein, 156 aa, Glycine max
  Coding DNA Sequence Number=SeqID_99851
  Homolog annotation: Hit_ID=Q0VYL5; Match level="QueryCoverage=45%, HitCoverage=66%, E-value=4e-40, Identity=92%"; Hit description=GASA
MAKFFAAMILALIAISMLQTVVMAANEQGGHLYDNKNEKWGFGILISKGSTSADLSFLIVFFFRANMEVGVSRDTNAHHNARGDVARPNTTSPACFSVRSAAGNACVCPRGIMVIKLCALATTTGRPRKEDPSALELQLHQIVAFHYIFIISLGPI

SEQ ID NO: 216630 - protein, 1473 aa, Glycine max
  Coding DNA Sequence Number=SeqID_99852
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=99%, E-value=0.0, Identity=59%"; Hit description =Integrase, catalytic region
  Pfam annotation: Domain name=rve; Domain location=565-725; Score =161.3; E_value=2.4e-45; Accession=PF00665.16; Description=Integrase core domain
  Pfam annotation: Domain name=zf-CCHC; Domain location=275-292; Score =16.6; E_value=0.0018; Accession=PF00098.13; Description=Zinc knuckle
  Pfam module annotation: Pfam domain module=RVT_2::Retrotrans _gag::rve::zf-CCHC; Domain location=979-1234::81-196::565-725::275-292
MALQNFADFSTNSANPYYLHPNENPTLVLVSPSLTAKNYHTWSRSMHIALISKNKDKFIDGSLPKPPVSDPLYAPWIRCNTMVLAWIHRSISDSIAKSVLWIDTAAGVWKNLRIRFSQSDIFRISDLQEDLYRFRQGTLDVSDYFTQLKIYWDELENYRPIPHYKCSIPCSCGGIDSVRVYREQDYVVRFLKGLNDRFSHSKSQIMMMNPLPDIDHVFSLVIQQEREMLGSNSDSVSEATSDSAMAMQVNSNQSNFNGKGGYYNKGKGSSKGGNRVCTHCGKTNHIVDNCFEKIGYPPGYKTNKSKNSSSSSQANNTSNASALESTQQGSSAQSSFQFTQEMYQGILEALQQSKVGSQPKANSVTTSPFALHSPSSNPNGKNPSLWILDTGATDHITFDLSSLTTYQNIVPVPVSLPNGSQVLASISGSVVISPLITIHHVLYIPCFHVNLMSVTKLASTNNCHLSFTTDLCKILQNHSLETIGTAKLQRGLYVIDTADMIRSCNSISSHSFELWHSRLGHVSNSGMQAISKQFPFIPCKNNMSPCDSCHFSKQKRLPFPNSITTSLSPFELLHADVWGPYSTISLLGHKYFLTLVDDYSRFTWVIFLKNKSETKNHIINFVAYLENQFNTSLKCLRSDNGTEFALNDFFLSKGIIHQKSCVETPQQNGVVERKHQHILNVARSFFFHSNVPLTMWNFCVQHAVHVINRIPSPLLKSKSPYELLFKLPPTLLHLKVFGCLSYATTIQAHRTKFDSRARKCVFIGYKDGTKGYILYDLHSHNIFLSRNVIFYEHCLPFKTVPGPTPSNTPSNFPLYDDPLDISPHPCVDSSPLSTGLIDSTSTSPASIPPIDHTLDSSSLPTPAATAHPTHPTSDLDQNSIDQTSSHITNVPVTLEPPLPLSTRVSTRPKRPPGYLQDYHCNVISSCTNQFSSNVAYPLSSVLSYNNCSPDYKIFCCSISSTIEPKTYNQASKFDYWKKAMDAEITALEVNKTWTVVDLPCGKVPVGCKWVYKIKYHANGTIERYKARLVAKGYTQMEGVDYFDTFSPVAKMTTVRVLLAVAAVRGWHLEQLDVNNAFLHGDLNEEVYMSLPPGYDASSPSKVCKLNKSLYGLKQASRQWYSKLSTALTSLGYQVSQADHSLYVRSDGTSFTALLVYVDDIVLAGTSMEEIKSVKLFLDQQFKIKDLGQLRFFLGLEIARSSSGIFLNQRKYTLELLEDTGFLGSKPASVPLDPHTKLSATDGVPFDDPSGYRRLIGRLLYLTHTRPDISFSVQHLSQYVSNPLVPHYQAATRILRYLKSCPAKGILFSSHSPLQLHGFADSDWACCPNTRRSITGYCVLLGSSLISWKSKKQNTVSRSSTETEYRALASLTCELQWLQYLFQDLNITFPQSASVYCDNKSAIYLAHNPTFHERSKHIELDCHIIREKLQSKLIHLLPVPSQSQLADVFTKPLHSPSFSSMMSKLGLCSIHHPT

SEQ ID NO: 216631 - protein, 335 aa, Glycine max
  Coding DNA Sequence Number=SeqID_99853
  Gene Ontology: Mol. function=endonuclease activity; Cellular component=cytosol; Biological process=regulation of transcription, DNA-dependent
  Homolog annotation: Hit_ID=Q10R99; Match level="QueryCoverage=99%, HitCoverage=60%, E-value=1e-134, Identity=67%"; Hit description =Endonuclease/Exonuclease/phosphatase family protein, expressed
  Pfam annotation: Domain name=Exo_endo_phos; Domain location=16-326; Score=85.5; E_value=1.7e-22; Accession=PF03372.13; Description =EndonucleaseExonucleasephosphatase family
MAHLDVDGRMTSSGTFTVLSYNVLSEAYASNDLYNYCPSWALSWPYRRQNLLREIIGYRPDIICLQEVYSGNTNTIDGCATFFRRDRFSHVKKYEVEFNKAAQSLTEATIPTTQKKTALNRLDNVALIVVLEAKVNNQPFDNAGKRQLLCVANTHVNVSQDLKDVKLWQVHTLLKGLEKIAASADIPMLVCGDFNSVPGSAPHALLAMGKVDPSHPDLAVDPLNILRPHSKLVHQLPLVSAYTSFARTVGLGYEQHKRRLDGGTNEPLFTNVTRDFIGTLDYIFYTADSLVVESLLELLDEESLRKDTALPSPEWSSDHIALLAEFRCCKNKSRR

SEQ ID NO: 216632 - protein, 356 aa, Glycine max
  Coding DNA Sequence Number=SeqID_99854
  Gene Ontology: Mol. function=protein binding; Cellular component =ubiquitin ligase complex; Biological process=ubiquitin cycle
  Homolog annotation: Hit_ID=Q6K3D2; Match level="QueryCoverage=92%, HitCoverage=79%, E-value=4e-71, Identity=42%"; Hit description =Putative F-box protein FBL2
  Pfam annotation: Domain name=LRR_1; Domain location=157-180; Score =10.1; E_value=3.6; Accession=PF00560.23; Description=Leucine Rich Repeat
  Pfam annotation: Domain name=LRR_1; Domain location=209-228; Score =1.2; E_value=1.7e+02; Accession=PF00560.23; Description=Leucine Rich Repeat
  Pfam annotation: Domain name=LRR_1; Domain location=235-259; Score =7.2; E_value=13; Accession=PF00560.23; Description=Leucine Rich Repeat
  Pfam annotation: Domain name=LRR_1; Domain location=292-315; Score =1.5; E_value=1.5e+02; Accession=PF00560.23; Description=Leucine Rich Repeat
  Pfam annotation: Domain name=LRR_1; Domain location=317-344; Score =7.9; E_value=9.5; Accession=PF00560.23; Description=Leucine Rich Repeat
  Pfam module annotation: Pfam domain module=LRR_1::LRR_1::LRR_1::LRR _1::LRR_1; Domain location=157-180::209-228::235-259::292-315::317-344
MRKHLKRYLVSDRKQKQKQEPELTRMEGESKEDVWCRETVPKVLKLVCSTLPLSLSHTNLVSLLLVSPSLHRTLLCSQPLWQSLNFRELNNAGNRLIAALSLPMFDYVAEFYSFFFELPNGAPRYCNVKQINLEFARDVEDAHLILIMDKCFNSLQSLESLNLNGCQKISDTGIEAITSCCPQLKSFSIYWNVRVTDRGLQHIVKNCKHIIDLNISGCKNISDQGAQLVADNYPELESLNLTRCIKLTDDGLKSLLHKCLFLQSLNLYALSRALLLFSFTDEAYRKICLLARLKFLDLCGAQNLSDEALSCISKCKNLESLNLTWCVRVTDEGVISIAKGCTSLEFLRYQKFVALT

SEQ ID NO: 216633 - protein, 286 aa, Glycine max
  Coding DNA Sequence Number=SeqID_99855
  Gene Ontology: Mol. function=DNA binding; Cellular component=nucleus; Biological process=regulation of transcription
  Homolog annotation: Hit_ID=Q1SMW7; Match level="QueryCoverage=68%, HitCoverage=59%, E-value=3e-25, Identity=79%"; Hit description =Homeobox domain, ZF-HD class; ZF-HD homeobox protein Cys/His-rich dimerisation region; Homeodomain-related
  Pfam annotation: Domain name=ZF-HD_dimer; Domain location=2-63; Score= 142.2; E_value=1.4e-39; Accession=PF04770.3; Description=ZF-HD protein dimerisation region
MPAVVTYKECLKNHAANLGGLALDGCGEFMPSPTATAADPSSIKCAACGCHRNFHRREPEDPPITSNTTHVIEYQPHHRHHPPPPLHAAAAARSPNSASPPPISSSYYPSAPHMLLALSAGLAAPPESTAAPSAALSRKRFRTKFSQEQKEKMHKFAEKVGWKIQKRDEDLIHEFCNEVGVDRSVLKVWMHNNKNTFAKKDNNIVISNDINITTSNNINTSIIDDNDANGGDVKVFENPNNNHGSGSGGGEDPAEDPSRNHYGGVNVGANGFYIVNETKMMDDLSA

SEQ ID NO: 216634 - protein, 136 aa, Glycine max
  Coding DNA Sequence Number=SeqID_99856
  Gene Ontology: Mol. function=DNA binding; Cellular component =intracellular; Biological process=DNA integration
MCDASRYKVGAILGQRRNKVFYAISYASKVLSETQLNHATTNKGMLAIVFALDKFHSYLISAKDGPYLFIVGVDNLFKRCVTGAEAKDILGHCHNSPYGGHYNGDRTTAKVLQLGFCWATWFKDAQIMTRVKISVR

SEQ ID NO: 216635 - protein, 155 aa, Glycine max
  Coding DNA Sequence Number=SeqID_99857
MVGAIHQESLVPLPSFAQCKTLASHHRNVIDPSDSHSRTFDSIRIPRSDCKAGGYSGQGYRAVTIVIVFSKKKKKKKKSVKKHAERGARAPALGNSHCRLRAHATNDCGNREPENLEIAENYKQMSIEPKNLVVIDSHFVVADYFLKPWVSMLYI

SEQ ID NO: 216636 - protein, 358 aa, Glycine max
  Coding DNA Sequence Number=SeqID_99858
  Gene Ontology: Mol. function=RNA-directed DNA polymerase activity; Biological process=RNA-dependent DNA replication
MEKKKKRVIEVVGVRARDMSTKEEKLKAKTLITTKLPYPKNPTKKDKERQFACFLDIFNMFMINIPFSEALEQMPTYDKIMKEILTKKKKYIAKDTIKLEPKCSALVHKMLPAKHKDPGSFAIPITIRNLSIGQSLLYLGASINWMPLSMLEQVDVVEVKPTCMTLHLAGEFKLFIQNEEITFNLFDARDHPNDMSGCFQVDMLDEIKEDARIHLHTHSSLDRVLLNHHEGLKEEEKKGGIFFYLKGIDPSYCMHDIHLEKNVKPLAQPQRCLNPIMKEEVREEELNLLEAGMIYHISNSACMSPDQVVPKKGGMKVVRNDNNELVPIRTLTSWRICIDYKRLNQATRKDHFPLLFMN

SEQ ID NO: 216637 - protein, 168 aa, Glycine max
  Coding DNA Sequence Number=SeqID_99859
EPIENGGFKAIKSGKGTKFMNANDLFDDRTSDEDFVPNYEDASEEESLYASDIEKEAKDNNYVYREELLSGTDSKDEDVNVLVYEKSNGPTISKDFKWSIGMKFSSSKEFKEAMSKHSVLNGRQLKFEKNDEVRGIDGCHLKNQFGGIMLVVVARDANEQNLPLALLL

SEQ ID NO: 216638 - protein, 90 aa, Glycine max
  Coding DNA Sequence Number=SeqID_99860
MEGVATCTQQTVKWRNCPSAILLPEEDSSGNFPEKLFPELFRKNLLPEEEFVSSGSTHRQLPEERHPECSRKKLLPEDFHCLPEEASFGS

SEQ ID NO: 216639 - protein, 122 aa, Glycine max
  Coding DNA Sequence Number=SeqID_99861
MVWCCRASGLDDAEMRSYNRAGKEYMPEKGKQLLLILGLVLEYSNYFKFIHVIGSFLGKVDVLVTLWNLDIESSKWPDWHGLTQAMWAKCQKAHRTKNNPHQKAHMAKKPQKPIELGVARGP

SEQ ID NO: 216640 - protein, 119 aa, Glycine max
  Coding DNA Sequence Number=SeqID_99862
  Gene Ontology: Mol. function=serine-type endopeptidase activity; Cellular component=chloroplast; Biological process=proteolysis
  Homolog annotation: Hit_ID=Q1T3A6; Match level="QueryCoverage=98%, HitCoverage=32%, E-value=5e-53, Identity=79%"; Hit description =Peptidase S1 and S6, chymotrypsin/Hap
IYSPSGASSGVGFSIPVDTVNGIVDQLVKFGKGGVLVLDAPANGPAGKAGLQSTKRDSYGRLILGDIITSVNDKKVTNGSDLYRILDQCKVGDKVIVEVLRGDHKEKIPVILEPKPDES

SEQ ID NO: 216641 - protein, 205 aa, Glycine max
  Coding DNA Sequence Number=SeqID_99863
  Homolog annotation: Hit_ID=Q9LIJ1; Match level="QueryCoverage=36%, HitCoverage=22%, E-value=1e-19, Identity=62%"; Hit description =Arabidopsis thaliana genomic DNA, chromosome 3, TAC clone:K24A2
KDELPKSAWLVSKMGRLTAGVQYEPQQGNAKLSNLMNWSCAMGYGVGSGSPLCPSFNFNLELVKSSQFIASFYQHMVVQRRIYIQTYCSSTNMVQSNFFLRVSVDDAIAENNMLDPTFRIGASWQANKNFLLKAKVGPRSSSMALAFKSWWKPSFTFSISGGSRGIFLFNLASVLYTPLPIPFFSVTGTFLFLCMCIRRPTLIWS

SEQ ID NO: 216642 - protein, 90 aa, Glycine max
  Coding DNA Sequence Number=SeqID_99864
MKERSVKEKIVGEKKRWGKNVENKERQWGVDEREKEKECQGRCGEKKRRFAKRKGLIFTVTRLNKGTSRLIISTHSLSMALGAHTEYISK

SEQ ID NO: 216643 - protein, 102 aa, Glycine max
  Coding DNA Sequence Number=SeqID_99865
MVEGTLKILTLDPNLDTVGNCGQMRLDFADEIVRLLSQIWIWGFWSVSSAVEEKLAHHPWIPTYGVDKVNQFYRESSQDYGLMGLRYGSGNLSFGVTLLPFA

SEQ ID NO: 216644 - protein, 106 aa, Glycine max
  Coding DNA Sequence Number=SeqID_99866
  Subcellular localization annotation: CTP_CleavageSite=42; ConfidenceScore=5.27e-01
MSKEESNKVASKDKHGFKINTRLLQQTKPCFKINSRSSLSLKQSAFKTPSKAIYLGGLTMEVLLSPIALKVVFPCFLTQILQGMAPILLSNSLYGNSQTRKQRDKQ

SEQ ID NO: 216645 - protein, 268 aa, Glycine max
  Coding DNA Sequence Number=SeqID_99867
MDPVKYIFEKPTLIGRIAPWQGVRDKRSWVRGQWIPFNEDAINQFLGHPLILEESQRCEYSQRRSQASAGRRVRIMRTSMTNLTQIRMTLLLSNILPNDHNLDLPLSKYQLVYAILTQVSVHVAQLISDAMYQFVGIAPPRNPVDPEKSNRALGFPALITGLCQFYGVPASPAAGGGPAAASCRCATTASTGDTIPGVYLHSPAKDRALDAQDTSPFLWPTPEQFEATIAWPGDEPNFETGAGPAGEPGDDGRAQENDDIVDVLDFFT

SEQ ID NO: 216646 - protein, 374 aa, Glycine max
  Coding DNA Sequence Number=SeqID_99868
  Gene Ontology: Mol. function=protein methyltransferase activity; Cellular component=cytoplasm; Biological process=protein amino acid methylation
  Homolog annotation: Hit_ID=Q9SNQ2; Match level="QueryCoverage=94%, HitCoverage=94%, E-value=1e-100, Identity=52%"; Hit description =Protein arginine N-methyltransferase protein-like
RVNMGTSANAVAGGRGGAPVPKDVDYANYFCTYAFLYHQKEMLSDRVRMDAYFNAIFENKRHFAGKKCFQEREASPGTTGKAAYIPSLSAEPLGTGVGARKVYAVEATKMSEHARALIKANNLQDVVEVIEGSMEEVTLPERVDVIISEWMGYFLLRESMFDSVIHARDCWLKPTGVMPTTRLDAGFGPKEAQYLEGLCLCASVFWASVQVAGCCVSVLVFVHCIITSLWNSLHPHQVIGTAGIIKEIDCLTATVADIEKVRSNFSMSITVENTKLCGFGGWFDVHFRGRSEDPAEHEIELTTAPSVDYGTHWGQQVFLLHPPMRLNEGDDLRVSFLMSRSKENHRLMEVELGCEIHQHSGKILAPFKNKYYIE

SEQ ID NO: 216647 - protein, 101 aa, Glycine max
  Coding DNA Sequence Number=SeqID_99869
MGTRYGDKYGYEYGNRTGNDIHISGYKNGTANDIHIFEYRNRTVNDIHISRYKNGTANDIHIFEYRNGTVNNIHISKYWNGTANDIHISKYKNGTERERGE

SEQ ID NO: 216648 - protein, 188 aa, Glycine max
  Coding DNA Sequence Number=SeqID_99870
  Gene Ontology: Mol. function=oxidoreductase activity
  Homolog annotation: Hit_ID=O23939; Match level="QueryCoverage=54%, HitCoverage=30%, E-value=4e-22, Identity=67%"; Hit description =Ripening-induced protein
MTLLSPSTFLAHLRLQLLLRNLGVDIQIDYTKENFEELAEKSDVVYSRVKTWLIPKRGQSDKALKAIKEEGESCDNSTTFDSTCYAVHYHFRWCCVGEVKALLREWEVSDLSLNLVKIRPMSHSLYKSTSRTKQKQNYTLKEEIPRASDINKERNKIGQEVKMYIGSVVDEPFLESQFAHQLTSLRTC

SEQ ID NO: 216649 - protein, 251 aa, Glycine max
  Coding DNA Sequence Number=SeqID_99871
  Gene Ontology: Mol. function=oxidoreductase activity; Cellular component=chloroplast; Biological process=transport
  Homolog annotation: Hit_ID=Q43677; Match level="QueryCoverage=91%, HitCoverage=72%, E-value=6e-79, Identity=63%"; Hit description=Auxin- induced protein
  Pfam annotation: Domain name=ADH_N; Domain location=39-130; Score =63.3; E_value=7.8e-16; Accession=PF08240.2; Description=Alcohol dehydrogenase GroES-like domain
  Pfam annotation: Domain name=ADH_zinc_N; Domain location=160-251; Score=8.3; E_value=0.002; Accession=PF00107.16; Description=Zinc -binding dehydrogenase
  Pfam module annotation: Pfam domain module=ADH_N::ADH_zinc_N; Domain location=39-130::160-251
MASISSIPSHIKTWVYSEYGNTEEILKFDPNVPIPDIKEDQVLIKVVATALNPVDYKRALGYFKNTDSPLPSVPGYDVAGVVVRVGSKVRKFKVGDEVYGDINEYAVNNPKTIGTLAEYTATEEKLLAHKPSNLSFIEAASLPLAIITAYQGLERVDFSAGKSILVLGGAGGVGSLVIQLAKHVFGASKVAATASSAKLDLLRNLGADFPIDYTKENFEELAEKFDVVYDTIGQMLKLNLNYLFHMKSVWS

SEQ ID NO: 216650 - protein, 102 aa, Glycine max
  Coding DNA Sequence Number=SeqID_99872
  Gene Ontology: Mol. function=ferric iron binding; Biological process =aromatic compound metabolic process
  Homolog annotation: Hit_ID=Q6KAC4; Match level="QueryCoverage=71%, HitCoverage=11%, E-value=2e-16, Identity=51%"; Hit description =Putative X1
  Pfam annotation: Domain name=XH; Domain location=1-75; Score=46.5; E _value=8.8e-11; Accession=PF03469.5; Description=XH domain
EIINDEDGRLKRLKKEMGVGAYKAVVAALIEMNEYNPSGRFMVRELWNNEEDRRATLEEGIEFVLNQTKTKRRKIHQMVDDESGENSEEVSSVRRPSARKDV

SEQ ID NO: 216651 - protein, 162 aa, Glycine max
  Coding DNA Sequence Number=SeqID_99873
MDQYHNESGVYFQSSTPIPIRVPNDYGFETLKSKIHDTLQLTNDQYLDEIYYRQSFVDIGNQFAFWSMQLKNDDDVNTITPDDILNLLQATMTPTHDALLYYNGRWNMSCQDDFVGYSFTGKNPKRFNIPSECSIDGLKDVIKQVAPQGISPYGIHESQTVK

SEQ ID NO: 216652 - protein, 215 aa, Glycine max
  Coding DNA Sequence Number=SeqID_99874
MENHIDLALVKKFYSNLYDPEDRSPRQCKSKVGLWLGHKDGYGFGLYDLRIDFSDSPIQLVSIGLSGSYHRPMLSQRGSRKAKVRAPSADAPVPPPPAPAPVGPSMSSTANNDHIMPMLQSIHHGLYLAQAAEGTPEDEEAAEDTLEAQNTTQEAKEDIGAAEVETDTNYVADVTAAQGTLDPWPTAIYPNFVRGPLFGGMKPSLDRLEILNPHH

SEQ ID NO: 216653 - protein, 290 aa, Glycine max
  Coding DNA Sequence Number=SeqID_99875
  Homolog annotation: Hit_ID=Q1SKC8; Match level="QueryCoverage=26%, HitCoverage=18%, E-value=9e-18, Identity=55%"; Hit description =Integrase, catalytic region
MEHKAYWALKFIDFDEVLSGEKRKLQLLELQEMRLNAYESSKLYKQKVKAYHEKKLLQKNFQPGQQVLLFNSRLKLFLEVNHHPAIARPLEGVIRQASEVKEALTGRKPSFLTLSAFIFNKTWLRSTYPFTKRILCAKRATLYALKCSLSATLALSEQFVTAKRKHNCNRVVTFAPHYNYAFSSPLPLIIHISLILNHYAFQPQASKPVWWLKELRLTSLTFWVCDELAKRGCFANESHSLSHWSLLAKRVSGAKPLLLELCCRAKHTLRAKRLMVTLQDWLSEPCSLSA

SEQ ID NO: 216654 - protein, 77 aa, Glycine max
  Coding DNA Sequence Number=SeqID_99876
MALDAIWDDSDEGQVVVVSGLHLVLDPPRMFTPWYLQKVVMSAENPKVRIWPKSMDLLSMMDGKPLPFWYQMPAWWA

SEQ ID NO: 216655 - protein, 52 aa, Glycine max
  Coding DNA Sequence Number=SeqID_99877
MFLSVLWFSGKQRQLVVAISGGGGGIRVWISLSETSSLSESPLLALSVTFYA

SEQ ID NO: 216656 - protein, 199 aa, Glycine max
  Coding DNA Sequence Number=SeqID_99878
  Homolog annotation: Hit_ID=Q1SX46; Match level="QueryCoverage=39%, HitCoverage=42%, E-value=2e-08, Identity=40%"; Hit description=RNA -directed DNA polymerase (EC 2.7.7.49) (Clone AmLi2)-garden snapdragon-related
MWEYRPISLIRNLYKIITKILAKSMSKVLSSAFDARKSAFLGGRNILDGVVIANKVVKEAKAKKKSCFAFKANFEKEYDSVRLKVNFHKSSLVGIHVDQRDITNYATMLYCSTRIIPKVRDRHEGVRRWDLRWRGRWLQWEDSVAQQLLHNVGEVSPFANLCDGLTWWRGANKNYVVREVYEVIHNMGNQDLERFYKKL

SEQ ID NO: 216657 - protein, 79 aa, Glycine max
  Coding DNA Sequence Number=SeqID_99879
  Gene Ontology: Mol. function=structural constituent of ribosome; Cellular component=intracellular; Biological process=protein modification process
  Homolog annotation: Hit_ID=Q00Y36; Match level="QueryCoverage=97%, HitCoverage=79%, E-value=4e-34, Identity=93%"; Hit description=[J] KOG0003 Ubiquitin/60s ribosomal protein L40 fusion
  Pfam annotation: Domain name=ubiquitin; Domain location=1-37; Score =10.8; E_value=0.021; Accession=PF00240.13; Description=Ubiquitin family
MDQQRLIFVGKQLEDGRTLVDYNIQNESTLHLVLRLRGGMQIFVKTLIGKTITLEVESCDTIDNVKAKIQDKEGIPPDQ

SEQ ID NO: 216658 - protein, 88 aa, Glycine max
  Coding DNA Sequence Number=SeqID_99880
MMERLKRVGTYKPQSYEIIDRYPNESRNLTKRNTRKVGVPVVGAAGPLRLQVLHGEKQNVRVVAGRSSRRDEVVQAIAGALGVYRETI

SEQ ID NO: 216659 - protein, 137 aa, Glycine max
  Coding DNA Sequence Number=SeqID_99881
  Subcellular localization annotation: CTP_CleavageSite=50; ConfidenceScore=5.04e-01
MNQQKKGQGVYLVNKGVQIAIRPTWTFAFWWKQPSSPGRAGKSKPRHFHNASETFPWAISRRFSTVLHRSSFILHHSSVFNRRIELLDTSCRAIQKVFQCFGKEYENTQKGGQKGHLEAFSVPWLAQGSLWLAWAPK

SEQ ID NO: 216660 - protein, 81 aa, Glycine max
  Coding DNA Sequence Number=SeqID_99882
MEVEDGNDTIENTERWRKKLGFAALYRHPMVVGVQHHPPNSQNNENDPPKSWSEKGVNLETFSNVLRMRLTEKTSMKAKVV

SEQ ID NO: 216661 - protein, 129 aa, Glycine max
  Coding DNA Sequence Number=SeqID_99883
  Gene Ontology: Mol. function=carrier activity; Cellular component =extracellular space; Biological process=transport
  Homolog annotation: Hit_ID=Q2N2B2; Match level="QueryCoverage=86%, HitCoverage=56%, E-value=2e-20, Identity=45%"; Hit description=RPGR ORF15 isoform
MTIFVFVCQQARLPLVDEGETKKLTEDFESYEAEDFESSEGEDIEYSKGEDLESSKGKDFESYEGEDFESSKGKDSESYKGEDFESSKGKDSESYEGEDFELSEGEDFEPSEGKDSESYEGEDLESSKG

SEQ ID NO: 216662 - protein, 127 aa, Glycine max
  Coding DNA Sequence Number=SeqID_99884
  Gene Ontology: Mol. function=DNA binding; Cellular component =mitochondrion; Biological process=DNA integration
  Homolog annotation: Hit_ID=Q1SDN3; Match level="QueryCoverage=97%, HitCoverage=11%, E-value=4e-26, Identity=42%"; Hit description =Polynucleotidyl transferase, Ribonuclease H fold
MAGCIDTRRSITGYVIYLGNSLISWKSKKQATVSSSSSEAEYQALASATCELQWLTFLLEEFKILFQQPVVLYCDNKFAHHIAANLTFHERTKHIEIECHLAYTLKALLPGAFQFLYSKLGMSNIHS

SEQ ID NO: 216663 - protein, 93 aa, Glycine max
  Coding DNA Sequence Number=SeqID_99885
MAFGDHPGHHLHFEDENLPLMSAQLFQEFSISWNLLYCIQQREWKRDMQLLFRFTCIEIVRKMLLVEVLDTTFPTSIGHNCSVVADFVAEVKE

SEQ ID NO: 216664 - protein, 190 aa, Glycine max
  Coding DNA Sequence Number=SeqID_99886
MPEIGVDKNRATIKMYVNVPKFKRARSEKSIPEAKRMEHGEQEEQEAPWRRQPYSPLYQGSYAEVVTWNNRNPGSKRTPWKKSQRSEASWSSMCLNIQKTRNKWLNEAWVGRLKNLALFDRVEDDLQWDIGAYVSPKYMGDDMVLLLGLTKAKAQQMMEEEKEGGDTLFYSLEKWNLRLRTGHRMTWVTC

SEQ ID NO: 216665 - protein, 432 aa, Glycine max
  Coding DNA Sequence Number=SeqID_99887
  Homolog annotation: Hit_ID=Q1RTD3; Match level="QueryCoverage=39%, HitCoverage=26%, E-value=1e-24, Identity=34%"; Hit description=IMP dehydrogenase/GMP reductase
  Pfam annotation: Domain name=Exo_endo_phos; Domain location=200-428; Score=8.1; E_value=0.0037; Accession=PF03372.13; Description =EndonucleaseExonucleasephosphatase family
MVDDDVDFVWRLDRARVLIKMPWRPFLQHTVNAHIQGKEYSVHELESKQSDVGMPFKEVGRRSAADDASHFAEGASHYAMDVWQVTVTKHMAEGRRHGVSEGVMQLAAMGKDVVQFVAKGSGPLVAVAPASNEACTSTNTVSSSGTMNHGINSLPNGPNDNQFQMGNDITHCVSSSTNTKQPGDRDIRAMAIFESQPKFHHVVLAGRDANFHKNGDMQSTGNLIPTVRSGLACEKGNCGGEVHCGLSEVSWEAQSASHSASGILCLWSEKSFKLERKFIGSGFIMLVGKWLQEAQQIHIINIYSPCDIQNKRVLWDSVKQLKNQTQEGLWCIVGDFNNIRTPSERSRICQRGSGESNTSEFNDWIEELEVVEVPWVGKKFTWFRPNRAARNKLDRFLVSPEWLDKWPGSTQHTLDRNFSDHCPILLRSKFVD

SEQ ID NO: 216666 - protein, 122 aa, Glycine max
  Coding DNA Sequence Number=SeqID_99888
  Gene Ontology: Mol. function=DNA binding; Cellular component =mitochondrion; Biological process=DNA integration
  Homolog annotation: Hit_ID=Q1SRN1; Match level="QueryCoverage=92%, HitCoverage=7%, E-value=4e-35, Identity=63%"; Hit description =Integrase, catalytic region
KVVARSSTKAEYRSLAPPSVEVAWIQTLLFELQVRHTAPVVFCDNMITVALAHHPVLHSRTKHMELELFFVREKVMEKSLQVIHVPAIDQYVDILTKSLSPSNFTIFKDKLRVVDKTLVNPS

SEQ ID NO: 216667 - protein, 199 aa, Glycine max
  Coding DNA Sequence Number=SeqID_99889
  Gene Ontology: Cellular component=membrane
  Homolog annotation: Hit_ID=Q2QN15; Match level="QueryCoverage=95%, HitCoverage=30%, E-value=5e-43, Identity=46%"; Hit description=Early- responsive to dehydration protein, putative, expressed
  Pfam annotation: Domain name=DUF221; Domain location=1-199; Score= -135.9; E_value=0.0011; Accession=PF02714.6; Description=Domain of unknown function DUF221
MKLEDIEENVRLKQSEASLAGELSVNPTHWITELAPEPRDVYWPFFSESFTRRWISKLVVVLVCTTFTVVFLIPVVIVQGLTNLNQLEILFPFLTSITIKFVSQIVTGYLPSLILQLFLKLVPPAMEFLSSIQGYISHSDIEMSASRKVLWFTVWHVFFATVLSGSILSMLNAVLDPKSIPGKLAVAVPAQDTRGKNIF

SEQ ID NO: 216668 - protein, 52 aa, Glycine max
  Coding DNA Sequence Number=SeqID_99890
MGHLAWADAFVVTTDSVSMISEACNTGCLGSLLNHHHHTANPEECTVQDAHM

SEQ ID NO: 216669 - protein, 125 aa, Glycine max
  Coding DNA Sequence Number=SeqID_99891
  Gene Ontology: Cellular component=membrane
  Homolog annotation: Hit_ID=Q2QLP9; Match level="QueryCoverage=74%, HitCoverage=12%, E-value=9e-14, Identity=40%"; Hit description=Early- responsive to dehydration protein, putative, expressed
MGSATRWSTRVMYNAELLTKSNIWLSASFFITYVVTQGWTSVSSELFRVIPFIFSWITRPFTSQDDEFEVPSTPYHKDIPRVLFFGLLGITYFFLAPLILPFLLAYFCLAYIIFRNQVSIFLDVI

SEQ ID NO: 216670 - protein, 182 aa, Glycine max
  Coding DNA Sequence Number=SeqID_99892
  Homolog annotation: Hit_ID=Q04903; Match level="QueryCoverage=35%, HitCoverage=15%, E-value=3e-09, Identity=50%"; Hit description =Protein farnesyltransferase subunit beta
MSEESEKETNPSSATAAPCPTASQRDQWMVESQVFQIYQLFATIPRNAQNLMLELQRDNHVSKDLRHLNSAFSVLDAKSVVMQLAIVGMKHTPLSRGSSLCEGMREEYCTQPYPYICKEVVSGFKPMTNKSPRHNFTAAPGSPSADFKNIAYKFVNEWRAQEPRFHSIALQQYILLCAQMDD

SEQ ID NO: 216671 - protein, 120 aa, Glycine max
  Coding DNA Sequence Number=SeqID_99893
MGQNTKTSRTLKFIKQFSSEHQLAHVCIPTVIAASLAISCDFSNFSFDCSDRVSKRQREGEEIEASICTVFKKLRCEVYFSQLQHDFKIPNGENARNWVTNLVLKFHDDPTVNELKLSFF

SEQ ID NO: 216672 - protein, 237 aa, Glycine max
  Coding DNA Sequence Number=SeqID_99894
  Gene Ontology: Mol. function=ferric iron binding; Biological process =aromatic compound metabolic process
  Homolog annotation: Hit_ID=Q5ZDL5; Match level="QueryCoverage=53%, HitCoverage=18%, E-value=6e-19, Identity=43%"; Hit description =Putative transcription factor X1
  Pfam annotation: Domain name=XH; Domain location=150-233; Score=7.6; E_value=4.9e-07; Accession=PF03469.5; Description=XH domain
MECIKKEHGLIAKELKESKVLNAIQHKKITAENPEKQRQILALQEAMKLQEGNNNNNNNVFKLTEELKLELEDKHLKGKLDVMKHTEDECMKTVGTLHMKEIEKEGLLKDLEEFNQSLIIKQHESNDELQKTRKKLIESIAGMSSHHGNIGVKRMGEIDIEPVHKALSAKRRYNNKAEAEHRALAMCSLWQKDLEEPNWHPFKIITADGKSKESMDEEDEKLKGLKRNWVLERTMQW

SEQ ID NO: 216673 - protein, 94 aa, Glycine max
  Coding DNA Sequence Number=SeqID_99895
MEFKCRVGQNQETPSPTLCLLPTVAYENSNVSGHSLQVFPRPMSTNANEAFRQGLKKEKIKREIMANEITLAREQEIEKEVRMKKMLEKALEIY

SEQ ID NO: 216674 - protein, 248 aa, Glycine max
  Coding DNA Sequence Number=SeqID_99896
  Homolog annotation: Hit_ID=Q00V20; Match level="QueryCoverage=50%, HitCoverage=69%, E-value=5e-10, Identity=34%"; Hit description=[S] KOG4032 Uncharacterized conserved protein
MREKNERRGLWVFTGELHFNDLGADAGINGEVEGAIVGPRDGEGTNQRGEAMVEKALNPGPNQDVVLLLSSLESIRNPKPLIPNQSQVRIPNFNLFFLNVRRERVKVKGMLDAGKDKAIMDGSRRLLGQSVGVFNEGICLVLSRWSALRSAVENEWGGRESRLKADQLAGDILTWFTQSKEPLYIDDLEDILDQGMLSLNVEVEDGSVEEVAEKLMVMHEEFLEGNFSSFEDLRKANLEQATLPHVTQ

SEQ ID NO: 216675 - protein, 118 aa, Glycine max
  Coding DNA Sequence Number=SeqID_99897
EPFVQVKRSFAIGVGAIILFGYRKDDDGQWVRKQDLPQPIPDERTLSPPPQRVDSSSLLNDVLSELHSLRAFVGDRFDAMDTPLDAMDAHFDGMDTRITRLEDDMSFIRRCFDPPANP

SEQ ID NO: 216676 - protein, 98 aa, Glycine max
  Coding DNA Sequence Number=SeqID_99898
MHLVSSDVDKSDESCICISPFLHMTQIVNEDDSDEDGDHDEKMIVDDNSSNMNPEISTSDSNMNSVNRPVNEPLPKVSGKADDGWVVVSNKRNKGRKN

SEQ ID NO: 216677 - protein, 150 aa, Glycine max
  Coding DNA Sequence Number=SeqID_99899
  Gene Ontology: Mol. function=transposase activity; Biological process= transposition, DNA-mediated
  Homolog annotation: Hit_ID=Q1SC10; Match level="QueryCoverage=64%, HitCoverage=18%, E-value=1e-18, Identity=44%"; Hit description =Ubiquitin-activating enzyme, E1; Transposase, IS4
MSHGGMFWALSLVQVILIAYWNWECVFAHLCEVLMGCLGALDGSYIAVTPSANDRLRYRTRKGGLAKNVLGSCIRDMRFIYVLAGWEGSALDSRILCNAIIRQNRLKWSSGSSGRRAPQNREELFNYRHARARNREMFWPLEETMGYTET

SEQ ID NO: 216678 - protein, 60 aa, Glycine max
  Coding DNA Sequence Number=SeqID_99900
MGAYCNGDVSLPPSYDVASGEDPRLRELKQLGELIPRFLNPINKRKWFRSYFEIQYTCIA

SEQ ID NO: 216679 - protein, 154 aa, Glycine max
  Coding DNA Sequence Number=SeqID_99901
  Gene Ontology: Mol. function=ferric iron binding; Biological process =aromatic compound metabolic process
  Homolog annotation: Hit_ID=Q9LHB1; Match level="QueryCoverage=81%, HitCoverage=19%, E-value=4e-31, Identity=52%"; Hit description =Transcription factor X1-like protein
  Pfam annotation: Domain name=XH; Domain location=68-149; Score=27.2; E_value=6.9e-09; Accession=PF03469.5; Description=XH domain
MEDDEDAEILYKVDTLQKDLRDKEQSLQDLDALNQTLIIKERESNDELQEARQALVDAIKELQSHGNIRLKRMGELDTRPFLEAMKQRYNEEDAEERASELCSLWEEYLKDPDWHPFKVIMVEGKEKFHLVSSKGILYIDPFTSGYVWKLGFGG

SEQ ID NO: 216680 - protein, 404 aa, Glycine max
  Coding DNA Sequence Number=SeqID_99902
  Gene Ontology: Mol. function=catalytic activity; Cellular component =intracellular; Biological process=immune response
  Homolog annotation: Hit_ID=Q9FL05; Match level="QueryCoverage=96%, HitCoverage=86%, E-value=1e-161, Identity=64%"; Hit description =Similarity to intracellular protein
  Pfam annotation: Domain name=HD; Domain location=25-166; Score=41.8; E_value=2.3e-09; Accession=PF01966.12; Description=HD domain
MTLLKSIASQFGFTNMVYPGAVHSRFEHSLGVYWLASQCVEKLKTYQGLELGINRFDIQTVKLAGLLHDVGHGPFSHLFEREFLPQVISGSDWSHEQMSVDMVDYIVDEHHIDVDPQMIRRVKEMILASSEYAPPRSSSEKSFLYDIVANGRNGIDVDKFDYLLRDCRACGLGCNFEFRRLLETMRVLDDEICYRAKDLFLIVPCFWLCNLLDLTIHKMFVTRADLYRTVYTHPKVKAIELMVVDALVHANSYLGISSNIHNPSEYWKFCNEYPVPKDMLDNYKKVTAQDIVCSQKSGGVTLKEEDVAICNVKIDLTRGKHNPLESIHFFKDYESDEKFTIPDDRISHLLPTSYQDMIVKVYAKKPELVEAISEAFENFQLKTYGIKAQAHSTPQKKRRYNPFI

SEQ ID NO: 216681 - protein, 371 aa, Glycine max
  Coding DNA Sequence Number=SeqID_99903
  Homolog annotation: Hit_ID=Q9LHB1; Match level="QueryCoverage=92%, HitCoverage=59%, E-value=8e-85, Identity=45%"; Hit description =Transcription factor X1-like protein
  Pfam annotation: Domain name=XS; Domain location=116-233; Score =216.8; E_value=5.1e-62; Accession=PF03468.5; Description=XS domain
  Pfam annotation: Domain name=zf-XS; Domain location=44-87; Score =94.6; E_value=3e-25; Accession=PF03470.5; Description=XS zinc finger domain
  Pfam module annotation: Pfam domain module=XS::zf-XS; Domain location= 116-233::44-87
MAHSSSDEDTDISESEISEYEDKSYEELKSGSQDVKTSDETFTCPYCPKKRKRDYLYKELLQHASGVGQSSSQKRKARDKANHLALLKYLEKDLMNVDVPSNDSKPEDESDPSVNSNDQFVWPWIGVVVNIPTRRTEDGRCVGESGSRLRDEYRSRGFNPFRVNPLWNFRGHSGTALVEFNKNWPGLHNALAFERAYELDHHGKKDWFTNSGLKSGLYAWVARADDYKINSIYGEHLRRMGDVKTISELMEEEARRQDKLVSNLTNIIQDKDQLIQAYNEEIQKIQLSARDHFQRIFTDHEKLKLQLESHKNELELRKVELEKREAHNESERKKLAEEIEENASKNSSLQMAALEQMKADENVMKLAEDQK

SEQ ID NO: 216682 - protein, 164 aa, Glycine max
  Coding DNA Sequence Number=SeqID_99904
  Gene Ontology: Mol. function=protein serine/threonine kinase activity; Cellular component=membrane; Biological process=protein amino acid phosphorylation
  Homolog annotation: Hit_ID=Q8LQ53; Match level="QueryCoverage=100%, HitCoverage=42%, E-value=3e-83, Identity=89%"; Hit description =Protein kinase 6-like
  Pfam annotation: Domain name=Pkinase; Domain location=2-161; Score =29.4; E_value=2.6e-10; Accession=PF00069.15; Description=Protein kinase domain
  Pfam annotation: Domain name=Pkinase_Tyr; Domain location=1-162; Score=-4.5; E_value=3.4e-12; Accession=PF07714.7; Description =Protein tyrosine kinase
  Pfam module annotation: Pfam domain module=Pkinase::Pkinase_Tyr; Domain location=2-161::1-162
MGTSELQIQTENGHIGMPSNVCCVVVEYCPGGALKSYLIKNRRRKLAFKVVVQLALDLARGLSYLHTKKIVHRDVKTENMLLDKTRTLKIADFGVARIEASNPHDMTGETGTLGYMAPEVLNGNPYNRKCDVYSFGICLWEIYCCDMPYPDLSFSEVTSAVVRQ

SEQ ID NO: 216683 - protein, 125 aa, Glycine max
  Coding DNA Sequence Number=SeqID_99905
  Gene Ontology: Mol. function=protein serine/threonine kinase activity; Cellular component=membrane; Biological process=protein amino acid phosphorylation
  Homolog annotation: Hit_ID=Q8LES3; Match level="QueryCoverage=62%, HitCoverage=20%, E-value=2e-35, Identity=87%"; Hit description =Protein kinase
MEKNKEKEEEEEVEGRSTRSRQEWEIDPSKLVIKTVIARGTFGTVHRGIYDGQDVAVKLLDWGEEGHRSDAEIASLRAAFTQEVAVWHKLEHPNVTKVEILENILGRKYCQNLRLLSLHSMIVIA

SEQ ID NO: 216684 - protein, 97 aa, Glycine max
  Coding DNA Sequence Number=SeqID_99906
  Gene Ontology: Mol. function=serine carboxypeptidase activity; Biological process=proteolysis
  Homolog annotation: Hit_ID=Q9FMX9; Match level="QueryCoverage=61%, HitCoverage=12%, E-value=8e-15, Identity=73%"; Hit description =Serine carboxypeptidase II-like protein
MALCSIFLNLHLLFFVCLTIEALGVAKPSVASYLCQEILAEQEADRVHELPAQPPVKFNNMVVISLLMKLKEEHCSICFSRPLTNQNKNPFFYGSME

SEQ ID NO: 216685 - protein, 49 aa, Glycine max
  Coding DNA Sequence Number=SeqID_99907
MKLHCKNCDDESDEQNDGDSDEVYFVEAFGKRRHREAPFGGGDSDCGAK

SEQ ID NO: 216686 - protein, 206 aa, Glycine max
  Coding DNA Sequence Number=SeqID_99908
  Gene Ontology: Mol. function=nucleoside-triphosphatase activity; Cellular component=cell outer membrane; Biological process=ATP -dependent proteolysis
  Homolog annotation: Hit_ID=Q5H432; Match level="QueryCoverage=83%, HitCoverage=20%, E-value=2e-67, Identity=76%"; Hit description=ATP -dependent serine proteinase La
  Pfam annotation: Domain name=Lon_C; Domain location=1-150; Score =280.8; E_value=2.7e-81; Accession=PF05362.3; Description=Lon protease (S16) C-terminal proteolytic domain
LILTGQLGNVMKESASAALSVVRSRAVGFGIDSDFLQKHDVHLHVPDGATPKDGPSAGAAMVTSLVSMLTKVPVRADVAMTGEITLRGRVTAIGGLKEKLLAALRGGIRTVIIPEENRKDLADIPANVTRDLEIVPVKYIEEVLDLALERPLAPKKARKSAQRVTVRSKAKPTMTESANRFHMAAACRRRAVASLSNKRNPPPKEL

SEQ ID NO: 216687 - protein, 75 aa, Glycine max
  Coding DNA Sequence Number=SeqID_99909
MLLKTKVGKIRTRVIFNERQKHDHNQPINLDLSMKVTAWLFVRYASKTFIVTHGWVGDCSGDESKVGTTIFLDRR

SEQ ID NO: 216688 - protein, 300 aa, Glycine max
  Coding DNA Sequence Number=SeqID_99910
MGTREVYEEKLRTGNLHHDPTINPGLGSARCPRCLSLLNPNSERGEWTITPVLHDATAVAGSGIGGMLGFVHGFNTDLRPDDGCRGEVVVVAGVATDAVFPGFGKINGSARRENDVGEGEGEEVMQSYPARALDRRPQVEWAKDAREGPRVLMSLRISKLIWSTKFRALLSLSLHSSPSSSKLLSMASYGGAKESIDEEDPRPTSSNGACIRRENDVALMCLPLLQNGLKGPKWLPFVVGAKVAVIDSCLVELQESIKAAAMAEGTVRSCLKSLRRLRSRWRDPQQKLTVVVVLLNREAR

SEQ ID NO: 216689 - protein, 93 aa, Glycine max
  Coding DNA Sequence Number=SeqID_99911
MPSATDKFAPVTLPSAIGHHPQIDELSCMAINYLSCLNFQKTWSLTVFKKLNQTCSDPEPELVWSFQTDHLIDNNNIACHQVECIITVKVQLS

SEQ ID NO: 216690 - protein, 358 aa, Glycine max
  Coding DNA Sequence Number=SeqID_99912
  Homolog annotation: Hit_ID=Q39267; Match level="QueryCoverage=46%, HitCoverage=59%, E-value=1e-25, Identity=42%"; Hit description=Zinc finger protein
MDKTSSTTTTSERETHDFMNVDSFSQLPFIRPAPLVREKSGIRLFGIEFAGGNNNSSNNNNNFVVVSAEDSESAEITTAANTNTNINNNKLNSFDLDPSNKEENTPTATSTGTTDTNGESSRRFECHYCCRNFPTSQALGGHQNAHKRERQHAKRAHLQSTMVHGSTFSDAHHVYNLMNYRYGSSIPTPPPPTMPYPTWNNNNNNTRFYGTTTTTSFSHHHQHQQQPINGSPLAFWRIPNGTTINNNNPSFSHERSSTLPPLFATEEIANVRASSQVVVGASGPMTTQNRYVYDSKQRDHVMHVVVSWCGRGGGGEVENCFTRVGIMERKESDISMPLAGTNIALLKLINFFQSLHMW

SEQ ID NO: 216691 - protein, 36 aa, Glycine max
  Coding DNA Sequence Number=SeqID_99913
MGVVQDRSYKRTGGHTRKGRVFYCIKKLDRVLLVLS

SEQ ID NO: 216692 - protein, 279 aa, Glycine max
  Coding DNA Sequence Number=SeqID_99914
  Gene Ontology: Mol. function=helicase activity
  Homolog annotation: Hit_ID=Q2R1R7; Match level="QueryCoverage=31%, HitCoverage=5%, E-value=1e-16, Identity=44%"; Hit description=AT hook motif-containing protein, putative
  Subcellular localization annotation: CTP_CleavageSite=61; ConfidenceScore=5.44e-01
MNVIGTGNAAGKSGRSQRTFQMALADITNTQPNSQHMPTRQRKTINNIFSLRSNLYSDFVAASSASTGLLDNEILDRSFVPQHANDSLHHTNEALSDNNAENAGYVGLGDLSQICAYCQAAMWYQESTRKNRNQANLKYSLCCSMGRIHLPFLKNPPMLFQQLLCEEESCESKNYQQNIRAYNMMFAFNSPGAKIDTSLLKGKVIVGDASQPINRDIILEKKNGRLQRINEFYPGYLGLQYPLLFPYGEDGYRSDIKHRDMNDSHERKRNKLTIRVLVF

SEQ ID NO: 216693 - protein, 379 aa, Glycine max
  Coding DNA Sequence Number=SeqID_99915
  Homolog annotation: Hit_ID=Q1T493; Match level="QueryCoverage=79%, HitCoverage=57%, E-value=2e-30, Identity=28%"; Hit description =Nucleic acid-binding, OB-fold, subgroup
MTRKLNSIMDITAQKAARINIGMILMDENADKIVAQIKDVDPDKWNDVVKVVRSLSWIQKLINLSLWANVIGELVDVLQWSLDGKPKKVVLTMKDKCGTIVNCTLWEDFTFLLKDYLDKHQNGPIILLLHLAKIKEARGAYAVSIQNLMYGFRLFINEDLKDIEDYKNRFDPSQLSLVTCSQRLSQVSYSAQPTSEDRFLYNAQVKSLSELCELKKECVCVAVAMITKFLVGNGWIYESCPKCNKKVECEKFPYTCQGCGNESATIVARLNHAILYRFQLEVRVGQPNETANFTLWDRECNALIKESAKGEFDPKDIVEAIDRILGKKLAFRFKAIWNNTRYSVSQISEDEDLIMLLLKRLPTYELAGIEPEMSDSFVK

SEQ ID NO: 216694 - protein, 148 aa, Glycine max
  Coding DNA Sequence Number=SeqID_99916
MSLHEVTLMQEHDMCNTPYSTNPRFALGESWFSNGLQNTGSALSESRQNPGRMHHWSILQRLIKLPLLDMLGGLTSHIDMQFSHLSRLPHSTSDKHSSTPVGLTNSSPSACQDHYLRHQILSLNTGQSPSTLNNLFSPQAGSELRGLM

SEQ ID NO: 216695 - protein, 84 aa, Glycine max
  Coding DNA Sequence Number=SeqID_99917
MWFWSCWGVSIYGMVVCRGLEPSKGISCLRSDRVLTMDEEDRVDERPRDMIYCDPTVGAKCFYQNPKPWHNRVDMAEWIPNFTH

SEQ ID NO: 216696 - protein, 52 aa, Glycine max
  Coding DNA Sequence Number=SeqID_99918
MESMDRSKGGRNIDVIQGSKGEDSNEKSNQANGILILPFLTILRITLISCFN

SEQ ID NO: 216697 - protein, 92 aa, Glycine max
  Coding DNA Sequence Number=SeqID_99919
MKRWSTKPNDVVDMMNTSGFGWDDTRKCVTCDSSQKHPKVGNHVNKEFKEFEKLQSIFGKDRANGCGAEGCVDGMENEIGENQVGDDDEWLH

SEQ ID NO: 216698 - protein, 272 aa, Glycine max
  Coding DNA Sequence Number=SeqID_99920
  Gene Ontology: Mol. function=zinc ion binding; Cellular component =integral to membrane; Biological process=defense response to bacterium
  Homolog annotation: Hit_ID=Q70ET6; Match level="QueryCoverage=72%, HitCoverage=83%, E-value=5e-60, Identity=56%"; Hit description=Seven- transmembrane-domain protein 1
  Pfam annotation: Domain name=MtN3_slv; Domain location=113-201; Score= 91.1; E_value=3.4e-24; Accession=PF03083.6; Description=MtN3saliva family
  Pfam annotation: Domain name=MtN3_slv; Domain location=2-80; Score =38.7; E_value=2e-08; Accession=PF03083.6; Description=MtN3saliva family
  Pfam module annotation: Pfam domain module=MtN3_slv::MtN3_slv; Domain location=113-201::2-80
MGYLNELCSPTFYKIIKNKAVEEFKPDPYIATVLNCAFWVFYGMPFIHPHSILVVTINGIGLVFEFVYLTIFFTYATNKGRKKLLICLLIEAIFFAAIVLITMLAVHGKHRSLMIGVICDFFNIMMYVSPLTIMQFKVIKTKSVKYMPFWLSLTNFLNGACWTTYALIHPFDLFVLISNSVGVVSGFVQLILYACYCCRENNDDGDDDGAVQKKTTGVPVSESPRFAKKLGRRLKEFIKVEVDSQVIVFHVYREAGAIANRGIGMEEDFFVV

SEQ ID NO: 216699 - protein, 298 aa, Glycine max
  Coding DNA Sequence Number=SeqID_99921
  Gene Ontology: Cellular component=integral to membrane; Biological process=defense response to bacterium
  Homolog annotation: Hit_ID=Q70ET6; Match level="QueryCoverage=52%, HitCoverage=69%, E-value=1e-49, Identity=56%"; Hit description=Seven- transmembrane-domain protein 1
  Pfam annotation: Domain name=MtN3_slv; Domain location=1-71; Score =34.6; E_value=3.4e-07; Accession=PF03083.6; Description=MtN3saliva family
  Pfam annotation: Domain name=MtN3_slv; Domain location=95-168; Score =43.1; E_value=9.8e-10; Accession=PF03083.6; Description=MtN3saliva family
  Pfam module annotation: Pfam domain module=MtN3_slv::MtN3_slv; Domain location=1-71::95-168
PTFYGIVKKKTVEEFKPDPYIATVLNCAFWVFYGMPFVHPNSILVVTINSVGLAFEFVYLTIYYVYATNKGRVVFFAAVALITMLALHGTRQRSLVVGVLSDIFNVMMYVSPLTIMAKVIKTKSVKYMPFWLSLANFLNGACWTTYALIHPFDLYVLALVFKWCRPTASARRQREAAPVAENVPKMTEDVPAPGAKASDGVEGLAGDDAEGFPSRSRDPSMLTSFADEDARRRAEEKKNTKKKGKGISNGIGAISGLIQLILYACYCSCKSKNDEDGDQDLKPSGFQLSNLNGRAAVV

SEQ ID NO: 216700 - protein, 185 aa, Glycine max
  Coding DNA Sequence Number=SeqID_99922
  Homolog annotation: Hit_ID=Q9LSJ1; Match level="QueryCoverage=91%, HitCoverage=87%, E-value=4e-15, Identity=36%"; Hit description =Arabidopsis thaliana genomic DNA, chromosome 3, P1 clone: MFJ20
MEMKREITKEEEHKEDSMHTIVFTAGTFLLMVCLKHFLVEQWRAWVFLILNVILLAILFMSMRPAKLEEDHSSESESSVEEVKSDNKLEKKWPSGGSQEETEKGKDCYIKQCCSSSSSTYALVENEREDDEEEEEEEEEEQVPVLSKEELNERVEAFIAMFRQHLISDVKQAESFRLHKIEVSCC

SEQ ID NO: 216701 - protein, 913 aa, Glycine max
  Coding DNA Sequence Number=SeqID_99923
  Gene Ontology: Mol. function=translation initiation factor activity; Cellular component=cytoplasm; Biological process=multicellular organismal development
  Homolog annotation: Hit_ID=Q9C793; Match level="QueryCoverage=99%, HitCoverage=89%, E-value=0.0, Identity=67%"; Hit description=Pinhead- like protein
  Pfam annotation: Domain name=DUF1785; Domain location=216-268; Score =101.8; E_value=2e-27; Accession=PF08699.1; Description=Domain of unknown function (DUF1785)
  Pfam annotation: Domain name=PAZ; Domain location=276-408; Score =138.5; E_value=1.8e-38; Accession=PF02170.12; Description=PAZ domain
  Pfam annotation: Domain name=Piwi; Domain location=564-874; Score =357.1; E_value=2.8e-104; Accession=PF02171.8; Description=Piwi domain
  Pfam module annotation: Pfam domain module=DUF1785::PAZ::Piwi; Domain location=216-268::276-408::564-874
MAPVFEAGIPRKCYYAPKELQQQSKASLKGDDGKKLIPARKPHAVLVASRPDSGGREGSVISLLANHFLVQFDPSQKIYHYNVEITPHPSKDVARAIKQKLVNNNSAVLSGATPAYDGRKNLYSPVEFQNDKLEFYISLPIPTSKLNSPYGEMPDLKEKHEQLKLFRINVKLVSKINGKELSNYLSNEGDDWIPLPQDYLHALDVVLRESPTEKCIPVGRSFYSSSMGRSKDIGGGAVGLRGFFQSLRPTQQGLALNVDFSVTAFHESIGVIAYLQKRVEFLRDLSQRKTAQLTGEERKEVEKALKSIRVFVCHRETVQRYRVYGLTEEVTENLWFADRDGKNLRLVNYFKDQYNYDIQFRKLPCLQISRSKPCYLPMELCVICEGQKFLGKLSDDQTARILKMGCQRPAERKTIVEGVMRGTVGPTSGDQEKEFKLQVSREMTKLTGRILHPPKLKLGDGGHVRNLTPSRHDRQWNLLDGHVFEGTTIERWALISFGGTPEQKSNVPRFINQLCQRCEQLGIFLNKNTVISPQFESIQILNNVTLLESKLKRIQRTASNNLQLLICIMERKHKGYADLKRIAETSVGVMSQCCLYPNLNKLSSQFLANLVLKINAKVGGCTVALYNSLPSQLPRLFHIDEPVIFMGADVTHPHPLDDVSPSVAAVVGSMNWPTANKYISRIRSQTHRQEIIQDLGAMVGELLDDFYQEVEKLPNRIIFFRDGVSETQFYKVLEEELQSIRFACSRFPGYKPTITFAVVQKRHHTRLFPFETDQSSTQNNFLYENIPPGTVVDSVITHPKEFDFYLCSHWGVKGTSRPTHYHVLWDENQFTSDELQKLVYNLCYTFVRCTKPISLVPPAYYAHLAAYRGRLYLERSESLGLFRSTSTLSRAAPPKTAALPKLSENIKKLMFYC

SEQ ID NO: 216702 - protein, 143 aa, Glycine max
  Coding DNA Sequence Number=SeqID_99924
  Gene Ontology: Mol. function=unfolded protein binding; Cellular component=prefoldin complex; Biological process=protein folding
  Homolog annotation: Hit_ID=Q4TC35; Match level="QueryCoverage=61%, HitCoverage=55%, E-value=4e-10, Identity=36%"; Hit description =Chromosome undetermined SCAF7054, whole genome shotgun sequence
  Pfam annotation: Domain name=Prefoldin; Domain location=2-119; Score =55.5; E_value=1.8e-13; Accession=PF02996.8; Description=Prefoldin subunit
MLHSVNDYCYVWIHLTCSFSTDLRKNIENLEKNSVTSLRTLVNIGSEVYLQAEVPDTQHIFVDVGFGFHVEFTWSEALNYIDKREEKIARQIEEYTQLIASIKAQIKLMLVLRAVNISQLTTHSLRPHEIGKKLIRLKSLQSA

SEQ ID NO: 216703 - protein, 43 aa, Glycine max
  Coding DNA Sequence Number=SeqID_99925
MVLLNIGHFEVTTERIDSKRGSRHVCQADPPIVWTLYDYIKAY

SEQ ID NO: 216704 - protein, 2188 aa, Glycine max
  Coding DNA Sequence Number=SeqID_99926
  Gene Ontology: Mol. function=zinc ion binding; Cellular component =nucleus; Biological process=regulation of transcription, DNA -dependent
  Homolog annotation: Hit_ID=Q7F8S7; Match level="QueryCoverage=42%, HitCoverage=96%, E-value=1e-154, Identity=36%"; Hit description=PHD finger-like protein
  Pfam annotation: Domain name=C1_3; Domain location=1263-1292; Score =9.5; E_value=0.039; Accession=PF07649.3; Description=C1-like domain
  Pfam annotation: Domain name=C1_3; Domain location=80-113; Score =10.9; E_value=0.027; Accession=PF07649.3; Description=C1-like domain
  Pfam annotation: Domain name=FYRC; Domain location=614-675; Score =6.6; E_value=0.004; Accession=PF05965.4; Description=FY rich C -terminus
  Pfam annotation: Domain name=MBD; Domain location=268-338; Score =18.2; E_value=0.00048; Accession=PF01429.10; Description=Methyl-CpG binding domain
  Pfam annotation: Domain name=PHD; Domain location=1264-1312; Score =55.2; E_value=2.1e-13; Accession=PF00628.19; Description=PHD-finger
  Pfam annotation: Domain name=PHD; Domain location=81-136; Score=28.7; E_value=2e-05; Accession=PF00628.19; Description=PHD-finger
  Pfam module annotation: Pfam domain module=C1_3::C1_3::FYRC::MBD::PHD: :PHD; Domain location=1263-1292::80-113::614-675::268-338::1264 -1312::81-136
MELSDSTGADRNPNAPPPHSNQNQDARSGLGIDLNEIPSPSSSFPETLPDSVAVDVVRAYHDNPAPPPGGPAALPRGGSSPCAACAKPSPAAVNHHQLVVCDGCERDFHLSCAGIRGGGRQAANLDEWVCGECVAAGVKSKRWPLGVKQLLDINAPPPSDGGDEEVQDSSLKLNPLRRFFSEDVGNEWHGLLVSKNEEVLRVAGSMWVHTLGDNSFGANPFGAPATNSNFNNGNAIGFQKASGVVTHAVRVGFEDITQFTRSFEEALRDFVSERRGVLEEGWRVEFRQSVSNSELYAVYCAPDGKIFDSVYEVAYYLGLAPLPSLGGPLSKKRKLTRTTAANGSMEKRGTLMNSNCKDPPSDGLNVECASARGNIPKLSEIGGKEDCHSHPQQSADGLPLQFKDFFVLSLGKVDARPSYYDANLICPGGDSGPIFRIRRCSCSEFPVPVGSTILSMSKLCQVVSQTNEEGEGKTNGSMDLDDDESLQMMLLDPCVPMENDILSCFPSCSTEEHDTHTSDVLHPVASSVQDNARNSLADNLGFNDGIGEILVEERSSFSAWTVISQKLVNACKDICKQKGNLNFYCNHVDKWDLRNGKSDTYFTSMDKFCGSLGAVGIPNVIYADNDVEGIYEALGKWLEQDRFGLDAEFVQEVLEQLPGVQDSLQYELLNTRNNSSSLPTVENGFLVVEWRDGSKYQEETVQALYGRSKKVTEKSIKEGRHPPLGKPVCSRAPGELIGDIFQSWELLKRFHEILDLKEPLTLDELEKELINPWFDELDFLEKSERDMDESQVLISQGADGNCRPLLSPRCEADPSGSIESSHAFIQVETEAMKEAAQVKFASFTYARCFGVALTKAHNSLLRVLIGELLSKVASLVDPNSEPGESRTRRGRRKDMDSAVPAKRTKLNMLPINELTWPELARRYMLAFLSMDGNLESVEITARESGKVFRCLRGDGGLLCGSLTGVAGMEADAQLLAEATKKIFGSLSRESDALTMEEEESNAKGVSEIFLANDGNVPEWAQMLEPVRKLPTNVGTRIRKCVYEALEKNPPEWARKTLEHSISKEVYKGNASGPTKKAVLSVLAKVGGEGFQSNPNKGQKKKIVISISDIIMKQCRIVLRRAAAADDSKVFCNLLGRKLTNSSDNDDEGLLGSPAMVARPLDFRTIDLRLATGAYGGSHEAFLEDVHELWNNVRVAFGDQPDLIELAEKLSLNFESLYNEEVVSYVQKFVEYAKVECLSAEMRKEVVDFIESTNEIPKAPWDEGVCKVCGIDRDDDSVLLCDTCDAEYHTYCLNPPLARIPEGNWYCPSCVDGKRATQDVTERTKIIGKRQSKKFQGEVNSLYLESLTHLSSVIEEKEYWEYSVGERTFLLKFLCDELLNSSLIRQHLEQCAELSAELHQKLRAHSAEWKSLKTREDILSTKAAKMDTFSVNTAGEVGLKEGFTGKCPVQPHTAVDNPSNFGVFVDSLPSEEVTKERYRFDSVDKSISVTNSDSDSQNMNSIDVEGQFRNVSAAVESQCTDKSPKSFPSPNHMSQEINCAGGEAHVQGNHQKCEGTDRPIPVSYQQGGVPVDVPQIGLNESEPYHLELNAIKRDISLLQDSITSVVSQLLKLSVRREFLGIDSIGQLYWASALPGGHSRIIVDASAALLHGRGMPFSRDYAEKFSVLQHCALSDKDSSLMSQPSNSLGNRSPWIAYETDAEIEELLGWLDYSDPKERELKDSIMLGPKSRFQEFINAQTEDQGEDQGHISMPRNREKTVSNSLVTKATSLLEKKFGPFVEWDNVEVLKKQNRKARTTNDEKLYRCECLEPIWPSRKHCTYCHKTVVSDVEFDGHNDGKCIAGLPAVEKKKDKNGSSKGRGNLKCDASHEKFRADAETAVTSVSGSSKLSSRLIKFSNEESTCPFSFEDICSKFVTNDSNKELVREIGLIGSDGIPSLVPSVSPFVSEYTLSAQKDERIVGGVSKASESQVSQGNTDGAGTCLDRKSSISTGRLAANESNKSNKSSSREQRDGKLSFCNPASGMGADGYCVVPSPSLRPLVGKASHILRQLKINLLDMDAALTAIALRPSKAESDRRQAWRTFVKSAKTIYEMIQATFTLEDMIKTEYLRNDWWYWSSFSAAAKSSTLPSLALRIYSLDLAIIYEKMPNSSFTDSSEPSAIVEPKPPMHLDAEKSKASRKSTRKRKESDC

SEQ ID NO: 216705 - protein, 73 aa, Glycine max
  Coding DNA Sequence Number=SeqID_99927
MNEMGAVSASKSHNLGHAKRLKIQVHVNQVTQPNKKISNFRIAELARSHDFTNKISSICNFSHGTECDRVARL

SEQ ID NO: 216706 - protein, 162 aa, Glycine max
  Coding DNA Sequence Number=SeqID_99928
MTFGRLQVTLRATNCRCPIMLNLHPRHIIIVHLNIQAKSEVSKEEEHLLLRSMLKVKWKAEPEVASHGVEEVEGHVEGEVQSSYMGKLLQNDGHVPFSAFEGRCFGVSELELSLPKLVDEDISRFKECKPWKGSFMVNVLCKNVGFVFFKEVEERLDEEMLY

SEQ ID NO: 216707 - protein, 265 aa, Glycine max
  Coding DNA Sequence Number=SeqID_99929
MEMSKSNIPNQYKGSRLVVLNKDGEGAKTKSKRNRPMSNPNKNGGGNKVGCENGQKLTQVQFKAKKEKAMKVTQPVKQVTRKKNMIIPNGTVNRTKKGIRNMQGGTRNLDKVPREIEKDKSNEHSRKELDLILAYQKLGVSFMVRQEMYNGVVFPNVEMDDTRRQSVKGSSIEIEDMSVCQTENSGGFASLVKEISKEHKASFVGLSDVCGGLMLGRVILTPSCTHQREVEESELLSKRNERFLTYGVVVSPIGYGVNKATIYLE

SEQ ID NO: 216708 - protein, 78 aa, Glycine max
  Coding DNA Sequence Number=SeqID_99930
MVHTKRRNHLHQKKMNDLVYVINLSDSTLDVFGIDNLVLIDDVGDHFSTEEELEDDGDEDDDGGGDIGDDLIRGLMDI

SEQ ID NO: 216709 - protein, 523 aa, Glycine max
  Coding DNA Sequence Number=SeqID_99931
  Gene Ontology: Mol. function=aldehyde dehydrogenase (NAD) activity; Cellular component=mitochondrion; Biological process=metabolic process
  Homolog annotation: Hit_ID=P93344; Match level="QueryCoverage=92%, HitCoverage=90%, E-value=0.0, Identity=72%"; Hit description =Aldehyde dehydrogenase
  Pfam annotation: Domain name=Aldedh; Domain location=59-513; Score =742.9; E_value=2.1e-220; Accession=PF00171.12; Description=Aldehyde dehydrogenase family
MAISNKFQPIIERVLERECLCSHWHRSISGIGASAAADVEPSIAPVQIDHSQLLIDGQFVDAASGKTFPTFDPRTGDVIANVAEGDTEDVNRAVRAARKAFDEGPWPKMTAYERSRIILRFADLLEKHNDEVAAIETWDSGKTYEQAAKVEIPMVVRLFRYYAGWVDKIHGLTVPADGPYHVQTLHEPIGVAGQIVPWNFPLLIFSWMAAPALACGNTVVIKTSEQAPLSALYVSKPFLEAGLPPGVLNVITGFGATAGASLCSHMDVDKDLLALQSEVTLELGGKSPFIVCEDADVDAAVEAAHFALFFNQGQCCCAGSRTFVHESIYDEFVEKAKARALKRVVGDPFKNGVEQGPQIDSAQFEKIMKYIRSGVENGATLESGGQRIGSKGYYIQPTVFSNVQARYLQLTMDNMLIAKDEIFGPVQSILKFKDLEEVIRRANATSYGLASGVFTQNMDTANTLMRALRVGTVWINCYDVFDAAIPFGGYKMSGQGRVRGIYSLRSYLQVKAVVTALKNPAWL

SEQ ID NO: 216710 - protein, 206 aa, Glycine max
  Coding DNA Sequence Number=SeqID_99932
MEEEHQCSRSGEEPQTQELDGEDQQLQHQCQQPGAEEKLVLQFMDSMDNYLSLFDVVSSTLRQGWFDLASARHSMGASRINSSLLDLKLHSAATTLKITNYDGTQPRFMLHKWVSSEHESTQLEDENVQSQDSSSVKSSGMQCMLAISHFIICLVVRTAEVTMAKNSSGLADNAEVQNERSKSLSVFGVLISPKLRASQLSFEKGG

SEQ ID NO: 216711 - protein, 184 aa, Glycine max
  Coding DNA Sequence Number=SeqID_99933
  Gene Ontology: Mol. function=metal ion binding; Cellular component =integral to membrane; Biological process=ubiquitin cycle
  Homolog annotation: Hit_ID=Q7X843; Match level="QueryCoverage=54%, HitCoverage=34%, E-value=3e-13, Identity=37%"; Hit description=RING -H2 finger protein ATL3I
  Pfam annotation: Domain name=zf-C3HC4; Domain location=72-113; Score =25.2; E_value=0.00024; Accession=PF00097.15; Description=Zinc finger, C3HC4 type (RING finger)
  Pfam annotation: Domain name=zf-RING-like; Domain location=72-113; Score=4.3; E_value=0.047; Accession=PF08746.1; Description=RING-like domain
  Pfam module annotation: Pfam domain module=zf-C3HC4::zf-RING-like; Domain location=72-113::72-113
MGYILPKPNTEKGKVKRKGKEDEEEQRARRGSMVERRANGGRSMSIDDLEKLPCYDYVDNSKGNNTSSPVDCAVCLENLITGDKCRFLPVCKHSFHAQCVDAWLLKTPICPTCRCNAHSHSGNQVVGNNNDYSVAPNSGSRESQSQQHDNMVLVQLRESQENVPSRNVDRENPTLGSHNLVREE

SEQ ID NO: 216712 - protein, 589 aa, Glycine max
  Coding DNA Sequence Number=SeqID_99934
  Gene Ontology: Mol. function=RNA-directed DNA polymerase activity; Cellular component=intracellular; Biological process=RNA-dependent DNA replication
  Homolog annotation: Hit_ID=Q5Z8I3; Match level="QueryCoverage=70%, HitCoverage=87%, E-value=3e-94, Identity=44%"; Hit description =Pentatricopeptide repeat-containing protein-like
  Pfam annotation: Domain name=PPR; Domain location=261-294; Score=3.1; E_value=3.2; Accession=PF01535.11; Description=PPR repeat
  Pfam annotation: Domain name=PPR; Domain location=295-329; Score =21.8; E_value=0.0024; Accession=PF01535.11; Description=PPR repeat
  Pfam annotation: Domain name=PPR; Domain location=330-364; Score =47.2; E_value=5.4e-11; Accession=PF01535.11; Description=PPR repeat
  Pfam annotation: Domain name=PPR; Domain location=365-399; Score =17.5; E_value=0.049; Accession=PF01535.11; Description=PPR repeat
  Pfam annotation: Domain name=PPR; Domain location=400-434; Score =33.0; E_value=1e-06; Accession=PF01535.11; Description=PPR repeat
  Pfam annotation: Domain name=PPR; Domain location=435-469; Score =19.8; E_value=0.0095; Accession=PF01535.11; Description=PPR repeat
  Pfam annotation: Domain name=PPR; Domain location=470-504; Score=6.6; E_value=1.2; Accession=PF01535.11; Description=PPR repeat
  Pfam annotation: Domain name=PPR; Domain location=505-539; Score =12.8; E_value=0.23; Accession=PF01535.11; Description=PPR repeat
  Pfam module annotation: Pfam domain module=PPR::PPR::PPR::PPR::PPR::PP R::PPR::PPR; Domain location=261-294::295-329::330-364::365-399::400 -434::435-469::470-504::505-539
  Subcellular localization annotation: CTP_CleavageSite=49; ConfidenceScore=5.49e-01
MASKSMKQSKYLHLFCNFNFNSNPLTHQRFSRLDSTREKSTIGLRQLVRSFSTTEHVNLDKLQVEREMGIKVKSQTRTMFYKHSINGDDCSDGKKSPIFFLNPIDTPESCSQATVDVDTLTRTINDHPFPLQPLQPTLLHLLPPSTFSTSLVENILGRLFASHSNGLKALEFFNYSLVHSHFPLSPASLNMTLHILTRMRYFDKAWVLLRDIARTHPSLLTLKSMSIVLSKIAKFQSFEDTLDGFRRMEDEVFVGREFGTDEFNVLLKAFCTQRQMKEARSVFAKLVPRFSPNTKSMNILLLGFKESGNVTSVELFYHEMVRRGFSPDGVTFNIRIDAYCKKGCFGDALRLLEEMERRNVVPTIETITTLIHGAGLVRNKDKAWQLFKEIPSRNMVADAGAYNALITALVRTRDIESASSLMDEMVEKCIELDSVTYHTMFLGFMRSRGIEGVSKLYQKMTQSNFVPKTRTVVMLMKYFCQNYRLDLSVCLWKYLVEKGYCPHAHALDLLVTGLCARGLVHDAFECSKQMLERGRHMSNASFLMLERFLLQASDMDKLKELDQMIKKLQTVLPPSRGHATGISTSGVIM

SEQ ID NO: 216713 - protein, 48 aa, Glycine max
  Coding DNA Sequence Number=SeqID_99935
MNDNTFTKVPSSVLEYDIGGGAGGIVDDELMGSSNELFQFTSASTNIF

SEQ ID NO: 216714 - protein, 44 aa, Glycine max
  Coding DNA Sequence Number=SeqID_99936
MSSKISLATADGGRLQRQQMKADSDGHEEDVTLYEVEHLDKISN

SEQ ID NO: 216715 - protein, 80 aa, Glycine max
  Coding DNA Sequence Number=SeqID_99937
MTKEGCGRPYIVSACHRTCRLWMTKCADNHKVCPRATGPSGHDSRIETFSRSRRKDVDISEKGVDDHIGLCMSTGLLAFS

SEQ ID NO: 216716 - protein, 100 aa, Glycine max
  Coding DNA Sequence Number=SeqID_99938
MEEFEEILGCPLGGRKPYLFSGFYPSMARIAKVVKISVQELDQVKQNRNGVVGILRKHLEGKAEALANQDLAVIDDFLAYHHSKESSVVVVLADAYDTFD

SEQ ID NO: 216717 - protein, 150 aa, Glycine max
  Coding DNA Sequence Number=SeqID_99939
  Gene Ontology: Mol. function=protein serine/threonine kinase activity; Cellular component=chloroplast; Biological process=protein amino acid phosphorylation
  Homolog annotation: Hit_ID=Q9LFP7; Match level="QueryCoverage=90%, HitCoverage=27%, E-value=3e-43, Identity=58%"; Hit description =Serine/threonine specific protein kinase-like
  Pfam annotation: Domain name=Pkinase_Tyr; Domain location=50-150; Score=-154.5; E_value=0.0055; Accession=PF07714.7; Description =Protein tyrosine kinase
  Subcellular localization annotation: CTP_CleavageSite=31; ConfidenceScore=5.42e-01
MVTHQSDTQRTSSTKRSKGSLSTNLNQKIIEASSLRRFTFNDLKLATRNFESKNVLGEGGFGTVLKGWVNEHGNFAARPRMGIPVAVKTLNPNGFQGHKEWLTEINYLSELHHPNLVRLIGYCIKDDKRLLVYEYMCRASLDKHLFKSMS

SEQ ID NO: 216718 - protein, 422 aa, Glycine max
  Coding DNA Sequence Number=SeqID_99940
  Gene Ontology: Mol. function=nucleoside-triphosphatase activity; Cellular component=HslUV protease complex; Biological process =protein folding
  Homolog annotation: Hit_ID=Q8PPP7; Match level="QueryCoverage=94%, HitCoverage=87%, E-value=0.0, Identity=87%"; Hit description=ATP -dependent hsl protease ATP-binding subunit hslU
  Pfam annotation: Domain name=AAA; Domain location=15-352; Score=9.2; E_value=4.2e-05; Accession=PF00004.19; Description=ATPase family associated with various cellular activities (AAA)
  Pfam annotation: Domain name=AAA_2; Domain location=139-299; Score =173.7; E_value=4.7e-49; Accession=PF07724.4; Description=ATPase family associated with various
  Pfam annotation: Domain name=AAA_5; Domain location=15-158; Score= -16.1; E_value=0.03; Accession=PF07728.4; Description=ATPase family associated with various
  Pfam module annotation: Pfam domain module=AAA::AAA_2::AAA_5; Domain location=15-352::139-299::15-158
MQLVPELRNEVMPKNILMIGPTGVGKTEIARRLATLANAPFVKVEATRFTEVGYVGKDVEQIIRDLADTAVKLYREQAKVRVRTQAEERAEDRILDALLPRRSGGIGFDPEVARNEPSAQDNETRIKFRKMLRNGELDEREIELDLAANVSMDIMTPPGMEEMGQQLKSMFANLGGGAKAHKRTLTIKAARPLLVEEEAGKLVNEDDIRTAAIEACEQHGIVFIDEIDKVAKRGDNVGGGDVSREGVQRDLLPLVEGSNVSTKYGTIKTDHILFIASGAFHLAKPSDLIPELQGRFPIRVELGALSKGDFVRILTEPKAALTKQYEALLATEGVKVSFTADAIDRLAEIAFQVNERQENIGARRLHTVLERLLDSLSYEAPDRDGETLAIDSAYVDAHLVSASAVCGRPAASGRSPRWCGRR

SEQ ID NO: 216719 - protein, 149 aa, Glycine max
  Coding DNA Sequence Number=SeqID_99941
  Subcellular localization annotation: CTP_CleavageSite=64; ConfidenceScore=5.28e-01
MASFFFRALKFGSLLFLHRHWHPPLNSFVRFFRHPDEGSSARRTFFRACGRGSWILKRKKEFFRGNLRKKGEKVLLRVPAEEGSEGSSAGTRRRTFSPFFRRFPRKNSFFRFNIQLPLPHARKKVLLAEEPSSSTSATTHHSCRLSDGH

SEQ ID NO: 216720 - protein, 143 aa, Glycine max
  Coding DNA Sequence Number=SeqID_99942
  Homolog annotation: Hit_ID=Q8RWU5; Match level="QueryCoverage=45%, HitCoverage=10%, E-value=7e-09, Identity=45%"; Hit description =Putative F-box protein family, AtFBL3
  Subcellular localization annotation: CTP_CleavageSite=53; ConfidenceScore=5.39e-01
MLCISILKSLSPYFSLHFSSLFFFSSSQNTTHSPLLFLSPHTKISLPQFDPPVAADDRPDKRLKTDARGLCENDPSITTGPIMVVHGDWAAKPQRTVRALGGAEHPRRCCDGACAEPAEVVASEVQDGDEYGDWMYCDGVQEA

SEQ ID NO: 216721 - protein, 532 aa, Glycine max
  Coding DNA Sequence Number=SeqID_99943
  Gene Ontology: Mol. function=nucleic acid binding; Cellular component= beta-galactosidase complex; Biological process=DNA integration
  Homolog annotation: Hit_ID=Q1S4N1; Match level="QueryCoverage=99%, HitCoverage=47%, E-value=0.0, Identity=55%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=RnaseH; Domain location=396-517; Score= -26.5; E_value=0.017; Accession=PF00075.14; Description=RNase H
  Pfam module annotation: Pfam domain module=RVT_2::RnaseH; Domain location=104-344::396-517
VKRDKLDKKAEAGIFVGYSSTSKAYRIFLPQSNKVIVSRDVLFFEEEKWSKESEKLQVQEESEEDVDDQPVRGTRSLSDIYQRCNVAVMEPVDYNEAATDSKWLTEKPKDKNVIGVKWVYRTKLNADGSINKHKARLVVKGYAQMFGVDFSETFSPVARLDTIRLLLALAAQKGWIIHHMDVKSAFLNGHLEEEIFVEQPEGFVVHGQEEKVYRLKKALYGLKQAPRSWYGRIDAHLISLGFEKCLSEFTLYVKKTDVGIVIVSLYVDDLLMTGSSKELIEEFKGGMKEAFEMTDLGKMSFFLGMQVQQDRGEVFVNQEKYAKEILRKFKMEEYKPISTPMNQKEKFSNEDGAEKVDEKLYRSLIGCLMYLIATRPDITYAVNSDWAGSNDDMKSTSGYCFTFGSGVFSLRSKKQDVIAQSTVEAEYVAAVAAANQAIWLRKLMADLHMEQKESTQVLVDNQAAISISKNPVFHGKTKHFKIKLYFLREVQKQGDVQLLYCKTENQLADFLTKSLPQARFEYLRQKLGVCYH

SEQ ID NO: 216722 - protein, 275 aa, Glycine max
  Coding DNA Sequence Number=SeqID_99944
  Gene Ontology: Mol. function=isomerase activity; Cellular component =cytoplasm; Biological process=carbohydrate metabolic process
  Homolog annotation: Hit_ID=Q9LVC5; Match level="QueryCoverage=92%, HitCoverage=97%, E-value=1e-98, Identity=60%"; Hit description =Apospory-associated protein C
  Pfam annotation: Domain name=Aldose_epim; Domain location=30-255; Score=96.3; E_value=9.4e-26; Accession=PF01263.10; Description =Aldose 1-epimerase
MSSEKSPSSASASASSSSSYELSKGINGLDKVILRDPRGSSAEVYLYGAHVTSWKNEQAEELLFLSSKGGREDLIDFRSDLIEFSNLGPLDSHGFARNRFWTIDDSPPPFLTNTPSKAFVDLILKPSEDDIKIWPHRVALGSGGDLMMTSRIRNTNIDGKPFSFTFANHTYFSVIYLSTPTKIAILDHEKKRTIVLRKDGLPDAVVWNPWDKKAKAMSDFGDDEYKYMLCVEAAAIEKPITLKPGEEWKGRLELSTVPSSYCSGQLDPKKVIQGS

SEQ ID NO: 216723 - protein, 293 aa, Glycine max
  Coding DNA Sequence Number=SeqID_99945
  Gene Ontology: Mol. function=transferase activity; Cellular component= nucleus; Biological process=flavonoid biosynthetic process
  Homolog annotation: Hit_ID=Q1T1I0; Match level="QueryCoverage=83%, HitCoverage=60%, E-value=1e-72, Identity=53%"; Hit description =Transferase
  Pfam annotation: Domain name=Transferase; Domain location=1-291; Score=62.2; E_value=1.7e-15; Accession=PF02458.6; Description =Transferase family
PFYPLAGRLHWINNGRLELDCNAMGIQFISSTLEDNLGDFSPSSEYNYLVPTADYTLPIHDLPLVLVQLTRFKCGGVSIAITFSHAVVDGPSALHFMCEWARLASGEPMQTVPFHDRKVLRAREPPSVPTTECHAHTEFDEPPLLLGQIESTEGRKKKTAMAITGHIYMEKCIKARGHKEDQPTALTVIVDSRGRMEPPLPKGYFGNATLDTVATSLADDLVSKSLGYASSRIREAVERITYEYVYMIPATHDFDEDFVLLPGPDGDGSLLVVLGLQVGHVDAFKKHFYEDIE

SEQ ID NO: 216724 - protein, 872 aa, Glycine max
  Coding DNA Sequence Number=SeqID_99946
  Gene Ontology: Mol. function=actin binding; Cellular component =cytoskeleton; Biological process=cytoskeleton organization and biogenesis
  Homolog annotation: Hit_ID=Q6Z3N3; Match level="QueryCoverage=98%, HitCoverage=96%, E-value=0.0, Identity=64%"; Hit description =Putative villin
  Pfam annotation: Domain name=Gelsolin; Domain location=139-219; Score= 32.1; E_value=1.9e-06; Accession=PF00626.12; Description=Gelsolin repeat
  Pfam annotation: Domain name=Gelsolin; Domain location=24-107; Score =86.9; E_value=6.3e-23; Accession=PF00626.12; Description=Gelsolin repeat
  Pfam annotation: Domain name=Gelsolin; Domain location=254-329; Score= 32.5; E_value=1.4e-06; Accession=PF00626.12; Description=Gelsolin repeat
  Pfam annotation: Domain name=Gelsolin; Domain location=402-481; Score= 19.0; E_value=0.0088; Accession=PF00626.12; Description=Gelsolin repeat
  Pfam annotation: Domain name=Gelsolin; Domain location=528-625; Score= 5.3; E_value=0.2; Accession=PF00626.12; Description=Gelsolin repeat
  Pfam annotation: Domain name=VHP; Domain location=837-872; Score =72.6; E_value=1.3e-18; Accession=PF02209.10; Description=Villin headpiece domain
  Pfam module annotation: Pfam domain module=Gelsolin::Gelsolin::Gelsoli n::Gelsolin::Gelsolin::VHP; Domain location=139-219::24-107::254 -329::402-481::528-625::837-872
MRDLDPAFKGAGQKAGLEIWRIENFNPVAIPQSSYGKFFTGDSYVILKTTASKSGALRHDIHYWLGKDTSQDEAGAAAIKTVELDAALGGRAVQYREVQGHETEKFLSYFKPCIIPQEGGAASGFKHVEAEEHKTRLFVCKGKHVISFARSSLNHDDIFILDTESKIFQFNGSNSSIQERAKALEVVQYIKDTYHDGKCEIASIEDGKLMADSESGEFWGCFGGFAPLPRRTVSDDDKPADSHPPKLLCVDKGKAEPIESDSLTKELLDTNKCYILDCGLEVFAWMGRNTSLDERKSASGAADELISGTGRPKSHIIRVIEGFETVMFKSKFDSWPQASHATMSEEGRGKVAALLKRQGLDVKGLVKSEPEKEEPQPHIDCTGHLQSFNIIIQVWRVNGPEKILLPATDQSKFYNGDCYIFQYSYPGEDKEEYLIGTWVGKNSVEEERASALSLASKMVESMKFLPSQARIYEGSEPIQFHAILQSCIVFKGGRSDGYKNYIAEKEIPDETYNEDGVALFRIQGTGPDNMQAIQVEPVASSLNSAYCFILHSGPTVFIWSGGLATSDDQELVERMLDLIKVDSKSRMQALTIGEKFLEHDFLLEGLSREAPIYIVKEGSEPPFFTRFFKWESAKSAMLGNSFQRKLAIVKNGGTPLMVKHKRRASVTYGGRSSGAPDKSQRSRSMSVSPDRVRVRGRSPAFNALAANFESSNARNLSTPPPMIRKLYPKSMAQDTAKLATKSSAIAHLTSSFELTSARENLIPRSQKASSVTPKSNPETSDEEGSLSSRIESLTIQEDAKEGEAEDDEGLPVYPHERVNTASTDPVEDIDVTKREAYLSSAEFQEKFGMAKNEFYKLPKWKQNKLKMAVQLF

SEQ ID NO: 216725 - protein, 61 aa, Glycine max
  Coding DNA Sequence Number=SeqID_99947
MALINLMCLIKFNLINDDVWEEYMCSFLILSLSDLYCKESRAPYSSHSLCPVEAYKYLRAD

SEQ ID NO: 216726 - protein, 286 aa, Glycine max
  Coding DNA Sequence Number=SeqID_99948
  Gene Ontology: Mol. function=potassium ion transporter activity; Cellular component=membrane; Biological process=potassium ion transport
  Homolog annotation: Hit_ID=Q19A13; Match level="QueryCoverage=92%, HitCoverage=36%, E-value=1e-107, Identity=76%"; Hit description =Putative high-affinity potassium transporter 1
  Pfam annotation: Domain name=K_trans; Domain location=35-286; Score= -94.1; E_value=1.3e-17; Accession=PF02705.7; Description=K+ potassium transporter
MDLESVIHRNTIKHDHGGGDVMIAGRIMEDGVDFGLSKLGDTNEEIYGVLSFVFWTLTLIPLLKYVFIVLRADDNGEGGTFALYSLLCRHARVSLLPNTQLADEDLTEYTMDNGTVPVDKKNVGLGLKNLLEKHRVLQRVLLVLALIGTCMVIGDGVLTPAISVFSAVSGLELSMSKEQHRYVEVPVACVILIFLFALQHYGTHRVGSLFAPVVLTWLLCISAIGVYNIFHWNPHVYEALSPYYMFKFLKKTQKGGWMSLGGILLCITGSEAMYADLGHFSQLSIK

SEQ ID NO: 216727 - protein, 364 aa, Glycine max
  Coding DNA Sequence Number=SeqID_99949
  Gene Ontology: Mol. function=protein serine/threonine kinase activity; Cellular component=membrane; Biological process=protein amino acid phosphorylation
  Homolog annotation: Hit_ID=Q1T642; Match level="QueryCoverage=93%, HitCoverage=49%, E-value=1e-158, Identity=81%"; Hit description =Protein kinase
  Subcellular localization annotation: CTP_CleavageSite=31; ConfidenceScore=5.35e-01
MNTQNLIPLIILLLFIPFSVSFSPTDNFLLSCGSYSNASLFNRVFMGDSTNPGSTFLSSDDSISLTYQKPPQNLSTLYHTARVFRSTARYRFNMKKNGTHLVRFHFSPFKAQSTFDLKSAKFNVFLNGVSVLSNFQPPNDVLLKEFILKIESNVLEILFRPVGESGFAFVNALEVFTAPVDFVIDVGARLVGPSGVEEYRNLSSQVLETVHRINVGGLKITPFNDTLWRTWIPDEDYLVFKGAAKPAVSTHTPNYQKGGATREVAPENVYMTAQQMNRENSSLASRFNITWNFPVSPGGGVPHLVRLHFCDIVSPALNLLYFDVYINGYIAYKDLDLSALTIHTLASPVYVDFVTNSVDSGFVQ

SEQ ID NO: 216728 - protein, 232 aa, Glycine max
  Coding DNA Sequence Number=SeqID_99950
  Homolog annotation: Hit_ID=Q00Z49; Match level="QueryCoverage=68%, HitCoverage=37%, E-value=1e-11, Identity=33%"; Hit description=[S] KOG0324 Uncharacterized conserved protein
  Pfam annotation: Domain name=DUF862; Domain location=2-146; Score =31.4; E_value=7.6e-07; Accession=PF05903.5; Description=Eukaryotic protein of unknown function (DUF862)
MVKVMLHIYDVTNGSESKKRTIVGINNVLYGTIGLGGIFHSAVQQVYGDDEWSFGFCEGGDTGVFRCPAGKNTMYKYRKSFVLGDTNFNFFQIPMTPCPKTATTSVMNSVQGWVWKNFLYILMTGWVNRFANAGDVTRERVENAALRFRKAKTNIVSASKVAYRFLFGGFTKNNVKTDLDSSPRKSNRGGGSPRVQAVLLKSLISRTKPFRCLSSSWKRSELEPQQQTRNKI

SEQ ID NO: 216729 - protein, 92 aa, Glycine max
  Coding DNA Sequence Number=SeqID_99951
MVKAVLMRCGHQLCAGKGVLESECSCGVQIDYYSCVGLFRMGKCKGCGQIGRMGTTNGSMSSYEFSLMLSPVVSFWDCMFRKMRYSYRPEWV

SEQ ID NO: 216730 - protein, 102 aa, Glycine max
  Coding DNA Sequence Number=SeqID_99952
MVQRRKMLRFWDVTRSLDGCPMVVRRNIDLGKKGVEKGWWRRWHFLRWCVGFLKVVLDGPLIKVVHPKHCQQKILNFDGLIKFTELNFFVLGPTELGLSELD

SEQ ID NO: 216731 - protein, 57 aa, Glycine max
  Coding DNA Sequence Number=SeqID_99953
MVLREARSKILANKQEGMKFYCDPNLKQVVQFAKKMEKITRNVGADSTVPCGNPSAK

SEQ ID NO: 216732 - protein, 162 aa, Glycine max
  Coding DNA Sequence Number=SeqID_99954
  Homolog annotation: Hit_ID=Q51613; Match level="QueryCoverage=34%, HitCoverage=64%, E-value=2e-16, Identity=92%"; Hit description=, complete genome
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTHIRPSKIRQGRATYVASQNPNTSAPCKTPTRFSSHVARATLQYYFSVIVMGIL

SEQ ID NO: 216733 - protein, 90 aa, Glycine max
  Coding DNA Sequence Number=SeqID_99955
MSAANEKDADVGGNTTSVELERKNLITYIENITGETKKKTSFTLNKYYRPAYVRKIAQCRLKNINRGFTTTDVGYCIFYSIPDKYLDDVY

SEQ ID NO: 216734 - protein, 171 aa, Glycine max
  Coding DNA Sequence Number=SeqID_99956
  Gene Ontology: Mol. function=chitin binding; Cellular component =extracellular region; Biological process=chitin metabolic process
  Homolog annotation: Hit_ID=UPI00006A17C9; Match level="QueryCoverage =80%, HitCoverage=99%, E-value=1e-10, Identity=33%"; Hit description =UPI00006A17C9 related cluster
NPIKAQRSSLHRSPTSKLPSSGNQSTRELHALAFKGLHVLAIRGLHAITFRGLHVLGIRGLHVLTVKELHALTFRGLHVLTSRGLHTLTFAGLHVFAICGLHLLAIRGQDVLAIEAARRRHQRLHTLSIRGYTSSPSEGYTPSPLEDYTSSPLEDYTSSPLEDYTSSPSEA

SEQ ID NO: 216735 - protein, 201 aa, Glycine max
  Coding DNA Sequence Number=SeqID_99957
  Pfam annotation: Domain name=Transposase_23; Domain location=136-201; Score=-11.2; E_value=0.019; Accession=PF03017.5; Description =TNP1ENSPM transposase
MYNRVFSMQDSFEEQATQGSFVPHGQHPGRVRAAGAGVTIKQYFGSAPRTSHSSSSLPPEELQQLTQQIRDQLEESITEKVTRQLMASFSQMQSQIQSHMQSQGLALPPKPLVGPSGPHVSTKGSCVDPLGNDPETGDSNRCGLYIKANPNCLIALGRVYEGSTIVHNTPLLPGQVKVGVEEVKDADAPVPVPTDEVSLVG

SEQ ID NO: 216736 - protein, 117 aa, Glycine max
  Coding DNA Sequence Number=SeqID_99958
  Gene Ontology: Mol. function=polygalacturonase activity; Biological process=carbohydrate metabolic process
  Homolog annotation: Hit_ID=Q1T650; Match level="QueryCoverage=96%, HitCoverage=23%, E-value=2e-39, Identity=75%"; Hit description =Glycoside hydrolase, family 28
MKLCSQVIGAISLVLILGSLNVKVVECKVGRGLKNTEYYAINCRKHSAVLTDFGGVGDGKTSNTKAFQSAIRKLGQYASDGGAQLIVPPGKWLTGPFNLTSHFTLFLHKDAVILASQ

SEQ ID NO: 216737 - protein, 386 aa, Glycine max
  Coding DNA Sequence Number=SeqID_99959
  Gene Ontology: Mol. function=metal ion binding; Cellular component =integral to membrane; Biological process=ubiquitin cycle
  Homolog annotation: Hit_ID=Q9FL07; Match level="QueryCoverage=98%, HitCoverage=96%, E-value=6e-78, Identity=47%"; Hit description=RING -H2 finger protein ATL5I
  Pfam annotation: Domain name=zf-C3HC4; Domain location=151-192; Score= 38.2; E_value=2.8e-08; Accession=PF00097.15; Description=Zinc finger, C3HC4 type (RING finger)
  Subcellular localization annotation: CTP_CleavageSite=54; ConfidenceScore=5.53e-01
MAWVKHQIRQKDGYLSYSPPLLSSSFSSPPYPLGATFHKDSSLPSSTPPPPPPSSGTRISPAVLFIIVVLAVLFFISGLLHLLVRFLIKHPSSASAQSNNRHQELSTSDALQRQLQQLFHLHDSGLDQAFIDALPVFQYKEIVGLKEPFDCAVCLCEFSEKDKLRLLPMCSHAFHISCIDTWLLSNSTCPLCRGTLLTQGFSVENPIFDFDDLREDEMCPWNGENGFNTRQKTVVVEESVEKEKGVFPVRLGKFKKLSSVEGGGESEVGETSSSNLDARRCFSMGSYQYVVGNSDLRVALNHDEISKGQVTRLNKGMELDDGKLSVEDVEGKKISSVSKGDSFSVSKIWLWPKKGKLPTSLDGQIGMPMPSFLNTDFPRMRDTEGA

SEQ ID NO: 216738 - protein, 115 aa, Glycine max
  Coding DNA Sequence Number=SeqID_99960
MAPDRTQQQNMCKKEHESFKEYAQRWRDLAAQVVPQMVEREIITMIVDTLLVFYYKNMVGYTPSSFADLVFTGEMIEVGLKRGKFEHPTLTNKKPGANREDEKEKGTHVVTVVPT

SEQ ID NO: 216739 - protein, 129 aa, Glycine max
  Coding DNA Sequence Number=SeqID_99961
  Gene Ontology: Cellular component=membrane
  Homolog annotation: Hit_ID=Q8L9I2; Match level="QueryCoverage=95%, HitCoverage=33%, E-value=1e-28, Identity=52%"; Hit description =Nodulin MtN21-like protein
MARRWSFYMDMLPVLVIIGNQLSLVALVTLFKEATLQGMNNHVFVAYTSAVAATLLFPITFFRRRSRVVPPLSFSIASKIMFIGMIGTSSQIMYYVGVSYSSPTLASSIANLGPAFTFILAIIFSFFPA

SEQ ID NO: 216740 - protein, 59 aa, Glycine max
  Coding DNA Sequence Number=SeqID_99962
MWGKATEEIEEDVGSLESPTTENVPIFQIHETINGYKGQNCGFTVFSYLLSLSRKAVKW

SEQ ID NO: 216741 - protein, 89 aa, Glycine max
  Coding DNA Sequence Number=SeqID_99963
MRQFRLPVNADLEKVTARLENGVLRITVGKFGEDKKRQPKVIDIAQRDSAAENVKPTKPQILQVVSCIFTLFGTWDFSDDVMLFVSNSF

SEQ ID NO: 216742 - protein, 45 aa, Glycine max
  Coding DNA Sequence Number=SeqID_99964
MVGPAFYPLASTSSFQIHTHLPNFLGRQQGCDVVGMRVPQPSIRD

SEQ ID NO: 216743 - protein, 59 aa, Glycine max
  Coding DNA Sequence Number=SeqID_99965
MAQSSKKMDLEELELLEQEGEERDSKVRESDVTPRALHKAIIRAGKPSLEESCCAMREI

SEQ ID NO: 216744 - protein, 70 aa, Glycine max
  Coding DNA Sequence Number=SeqID_99966
MAITRRKSEKLQKNDVLNMFHIQNINRNLDDKIKQEFIQVHLNKLSKCLHFGGVALAVGVSSREIKFFRV

SEQ ID NO: 216745 - protein, 83 aa, Glycine max
  Coding DNA Sequence Number=SeqID_99967
MGLDFGDLKRQALLQKHASGAQKGEKKVRAEPVFHTNLTNGNIVTLSDTYLSFEIDIICLKLPCCPQKVFSIVFHCRVPLKLN

SEQ ID NO: 216746 - protein, 179 aa, Glycine max
  Coding DNA Sequence Number=SeqID_99968
  Gene Ontology: Mol. function=nucleic acid binding; Cellular component= intracellular
  Homolog annotation: Hit_ID=Q1SUL6; Match level="QueryCoverage=73%, HitCoverage=74%, E-value=1e-16, Identity=41%"; Hit description=Zinc finger, C2H2-type
MANNFYNNAQFSKLYNNPDPKGCKLCNQVFTNTQALLTHVESHMAQEKDVVRRLNSSPPQHVNSQIQLGSHQFPPPPTMDDIRIFQSQSQLMGMPQPISRNPFFNSNQIGSSSSSSMPIRKMQVLPHAFPYVGNINGDGFKAFISNLEKPIKKIDFIDLVNVDDDNNSDVEVMDLDLKL

SEQ ID NO: 216747 - protein, 72 aa, Glycine max
  Coding DNA Sequence Number=SeqID_99969
MTTITTTTIITMKVVAIDDGVTTIIRIVVTRMIMMVAKITIQGSDNNYDSGCKDGHNGGRNNDDHGDESSDS

SEQ ID NO: 216748 - protein, 239 aa, Glycine max
  Coding DNA Sequence Number=SeqID_99970
  Homolog annotation: Hit_ID=Q2QMH0; Match level="QueryCoverage=33%, HitCoverage=24%, E-value=3e-29, Identity=71%"; Hit description =Tetratricopeptide repeat protein, putative, expressed
METAVKSWHETSSVDAKVYFLLDKEKTDTDKYAPVVNIDKAFESPHTHGNCFAFLRQYAEESFSKAACLVTPKNIIAYPQDKNALSLNLFDPLPLPLPPPYAPITPPLTSPPPPCVPSYSTLSPSPSAQSSRSLKGVGTVVRLMYDTVWWTFDRLTVVDASSSSLPAIRSGFGGSADWVACQWYGGGLVGDGGGGGVGVWAVVFCGAVVMEKGSRDPEVLDIGAHEVLPRLFKEKQPRS

SEQ ID NO: 216749 - protein, 191 aa, Glycine max
  Coding DNA Sequence Number=SeqID_99971
  Gene Ontology: Mol. function=binding; Cellular component=membrane; Biological process=photosynthesis
  Homolog annotation: Hit_ID=Q2QMH0; Match level="QueryCoverage=77%, HitCoverage=45%, E-value=4e-56, Identity=71%"; Hit description =Tetratricopeptide repeat protein, putative, expressed
  Pfam annotation: Domain name=TPR_1; Domain location=11-44; Score =26.7; E_value=8.1e-05; Accession=PF00515.18; Description =Tetratricopeptide repeat
  Pfam annotation: Domain name=TPR_1; Domain location=45-78; Score =19.9; E_value=0.0091; Accession=PF00515.18; Description =Tetratricopeptide repeat
  Pfam annotation: Domain name=TPR_1; Domain location=79-112; Score =32.4; E_value=1.5e-06; Accession=PF00515.18; Description =Tetratricopeptide repeat
  Pfam annotation: Domain name=TPR_2; Domain location=11-44; Score =25.5; E_value=0.00019; Accession=PF07719.7; Description =Tetratricopeptide repeat
  Pfam annotation: Domain name=TPR_2; Domain location=45-78; Score =18.6; E_value=0.022; Accession=PF07719.7; Description=Tetratricopepti de repeat
  Pfam annotation: Domain name=TPR_2; Domain location=79-112; Score =27.9; E_value=3.7e-05; Accession=PF07719.7; Description =Tetratricopeptide repeat
  Pfam module annotation: Pfam domain module=TPR_1::TPR_1::TPR_1::TPR _2::TPR_2::TPR_2; Domain location=11-44::45-78::79-112::11-44::45 -78::79-112
MAETKEGSGSEMSLKDQGNEFFKSGKYLKAAALYTQAIKLDPSNPTLYSNRAAALLQLDKLNKALDDAEMTIKLKPQWEKGYFRKGSILEAMKRYDDALASFQIALQYNPQSQEVSKKIKKINQLVKDSKRAQEVENMRSNVDMAKHLDTFKTEMERVREKEKGIWYSWRDTKRREKYSRKGGQVHKEGET

SEQ ID NO: 216750 - protein, 265 aa, Glycine max
  Coding DNA Sequence Number=SeqID_99972
  Gene Ontology: Mol. function=transporter activity; Cellular component= outer membrane-bounded periplasmic space; Biological process=transport
  Homolog annotation: Hit_ID=Q6D8W5; Match level="QueryCoverage=76%, HitCoverage=68%, E-value=9e-81, Identity=69%"; Hit description=ABC transporter, periplasmic binding protein
  Pfam annotation: Domain name=SBP_bac_3; Domain location=93-265; Score= 27.2; E_value=7.3e-10; Accession=PF00497.10; Description=Bacterial extracellular solute-binding proteins, family 3
MTILCAARLYATWAKGKIHRYLDAFSLPGNILNIRRKVPVKFAKGITLFALALSAHTAFAAEQSVPTDSSLHVQADAALKSLVPADVAKRGYIVAGTNPNTPPTTFYKEDNKTLAGREIDIMNAVGERLGIQVQWRDTGGFDNIIPGLKTGRYDVALSNINATPARAKIIDFVSYYDASRLGIISRKDANVAPFKTLDEVCGKEVGAGSGTTQVTRLEEASKACEAAGKKPIKVSVFPDRPAGVQAVVSGRVPMFLGPYEGLLWQ

SEQ ID NO: 216751 - protein, 197 aa, Glycine max
  Coding DNA Sequence Number=SeqID_99973
  Gene Ontology: Mol. function=oxidoreductase activity, acting on single donors with incorporation of molecular oxygen, incorporation of two atoms of oxygen; Biological process=response to salicylic acid stimulus
  Homolog annotation: Hit_ID=Q5GQ66; Match level="QueryCoverage=90%, HitCoverage=27%, E-value=1e-81, Identity=79%"; Hit description=Alpha- dioxygenase
MWSAVTDPIRAFFANFLRHFIHKDFHEAVARMTIIDAFLFVIVHSIDKLGIWPRLPVFLGLLYLAIRRRLHQEYNLFNVGTTPVGVRFNHSDFPYRTADGKYNDPFNEVAGSHGTFFGRNILPVDQKKKLLKPDPMVVATKLLARRTYKDTGKQFNVIAASWIQFMIHDWIDHLEDTNQNFSSLIYISPSQTRHTQV

SEQ ID NO: 216752 - protein, 118 aa, Glycine max
  Coding DNA Sequence Number=SeqID_99974
MAEKGKLDHIEERLGAVEGGGSYAFADIEELCLVSNFNKYKGTTCPKNHLKVYCRKMRAYTKDENLLMHFFQESLTGVVVTWYTNLEPSRVHSWKDLMVTFIRQYQYNSDMTLDRTQL

SEQ ID NO: 216753 - protein, 109 aa, Glycine max
  Coding DNA Sequence Number=SeqID_99975
MKTLSLVQAAAIAAERRLQYEICCGSQSGGDYEVAKNIVQHKGKNVRSSSLPVNSSSSTPNFVDLTMDTHKIGSKRRICRGSESTSHSQCKSSVSSSDNRTLHSEESGM

SEQ ID NO: 216754 - protein, 48 aa, Glycine max
  Coding DNA Sequence Number=SeqID_99976
MQNRLVRLVCVFLQSLIRNNIINVIQLVISGRCRNSILEQVQNLFKLL

SEQ ID NO: 216755 - protein, 135 aa, Glycine max
  Coding DNA Sequence Number=SeqID_99977
  Homolog annotation: Hit_ID=Q10RE9; Match level="QueryCoverage=66%, HitCoverage=41%, E-value=5e-16, Identity=43%"; Hit description =Expressed protein
MFGTKLAGTLDYSCSKAPAPVQEKSTKSNESIFDACHWIDCGGGSCNKTSKFSYSCECDVGYDNLLNVTTFPCFRECSLGLGCSELGISVKNSSTSAPPTLNDNSKNEGSSILQGNSLRLVMLIMFVAKLHLQIG

SEQ ID NO: 216756 - protein, 107 aa, Glycine max
  Coding DNA Sequence Number=SeqID_99978
  Gene Ontology: Mol. function=molecular_function; Cellular component =cellular_component; Biological process=cell proliferation
  Homolog annotation: Hit_ID=UPI0000660A02; Match level="QueryCoverage =88%, HitCoverage=21%, E-value=1e-34, Identity=70%"; Hit description =UPI0000660A02 related cluster
YDLDFLVIQQVLVEFANDPKLVYHCGLTPRKLPDLVENNPLIAVDVLTKLINSPEIAEYFTVLVNMDMSLHSMEVVNRLTTAVELPSQFIHMYITNCIASCVGIKIV

SEQ ID NO: 216757 - protein, 157 aa, Glycine max
  Coding DNA Sequence Number=SeqID_99979
  Gene Ontology: Mol. function=helicase activity
  Homolog annotation: Hit_ID=Q1SRJ5; Match level="QueryCoverage=99%, HitCoverage=18%, E-value=6e-48, Identity=56%"; Hit description =Probable helicase [imported]-Arabidopsis thaliana-related
MFQPHTILDVDGFPVYRRRNNGNAIEKNGVTVDNMYIVPYNPRLLRKYQAHINIEWCNQSTSIKYLFKYINKGYDRVTVILIDEDNDQTENGGTHNDEIKEYLDCRYICPCESTWRIFGFPIHGRKPAVERLHFHLPGQHSVLYEDHDDIEDVLSKP

SEQ ID NO: 216758 - protein, 225 aa, Glycine max
  Coding DNA Sequence Number=SeqID_99980
  Homolog annotation: Hit_ID=Q2QWE6; Match level="QueryCoverage=93%, HitCoverage=47%, E-value=2e-30, Identity=38%"; Hit description =Expressed protein
MPVEIRIISWLQASCNEGSEKVERAFILQLLGLNSSNSGKEWFVISEVFSFPGGLQFLKQSASDYVKGFDQSLHEFPPLDQLKQQFSDKVHLELYHCLFKDGSVKNVVPDPDVPPSCDADSVEFDLRPGTKPKHGAGDKDEALVGLLSNLSLEGLSPHWIRPLPPRLPIIDGELVWLNPDDNHELMWDYGMCVDTSRGAAVRDLIAKALKGALAPAQQEVIIVII

SEQ ID NO: 216759 - protein, 186 aa, Glycine max
  Coding DNA Sequence Number=SeqID_99981
CNEKTNGMDRSTEGDCHEKTNGMDRSTQEDCHEKPNGMNRSTQEDCHDKTNGMYRSTQEDCHEKSNGVDMSAQEGDDGARDKIDVCLKENCFDSARDDKDILLPEDANSKEMRAESKLSGPLKELLDNNATLNSLVPSNAATCEPPSGASERVQSESCMEETSQKSGSRDSIINENLIRKCVENDK

SEQ ID NO: 216760 - protein, 128 aa, Glycine max
  Coding DNA Sequence Number=SeqID_99982
MVNQPNKLWVEVVRNKYCKNNPFLHLEKKKASKGPIDLVEGGSYGLEASSFPNRHLEHLTINSRNSFFFDHKHTTIHLAEVIIVCFHFDMEQEPRQTLVDGNRPGQCGQAGFGDKDWISRFNGSLGDA

SEQ ID NO: 216761 - protein, 270 aa, Glycine max
  Coding DNA Sequence Number=SeqID_99983
  Gene Ontology: Mol. function=zinc ion binding; Cellular component =membrane; Biological process=defense response
  Homolog annotation: Hit_ID=Q1SIN6; Match level="QueryCoverage=96%, HitCoverage=35%, E-value=5e-81, Identity=57%"; Hit description =Regulator of chromosome condensation, RCC1
MADLASFGSHERDVEQAFITLKKGTQLVKYSRKGKPKLCTFRLSSDETKLIWISHGREKNLKLSSVSHIIPGQRTICKDQAEVEVWFSSLKALISRGERIRRGKSDLSNESVDLIPNDRPNAGTLEFASSIARGRFSFESVSHESTSSCSRSDTNMPVRTSCGDGSRVSVSSVSHSSSVGSGLDDIESLGDVYIWGEVWVDGNSSDGLGSLASCKTDVLTPKPLESDVVLDVHQIGPGDRHIALVTRQGEVFTWGEDSGGRLGHGFEKDF

SEQ ID NO: 216762 - protein, 98 aa, Glycine max
  Coding DNA Sequence Number=SeqID_99984
  Subcellular localization annotation: CTP_CleavageSite=32; ConfidenceScore=5.25e-01
MAAYTTTPRPQHLVNGTRHGSSPQRRRAPPPRDGNKSGLWVTKRMDMEYCFTRYVVDLVNERVVRIDLLSSAHNKFWKEIENRVQVFRKTIRYNAGQA

SEQ ID NO: 216763 - protein, 64 aa, Glycine max
  Coding DNA Sequence Number=SeqID_99985
MSRPGIERVVRRFQMFFHRLDKMQAPTASFKKYTLEKKLRAFDVTESQIGISLMANQKLRSLWG

SEQ ID NO: 216764 - protein, 207 aa, Glycine max
  Coding DNA Sequence Number=SeqID_99986
  Subcellular localization annotation: CTP_CleavageSite=34; ConfidenceScore=5.02e-01
MSRKRLGKKLQPAKKAWKSFSNTVQHKLHKLNIPKSMKTTLQRLLSAFHSLGHLIHSRLHRSLTTIRPRGATSNYYHAQYKHCAAIHIYDLFDHKANSVSMHATNKASARATQVQGETSKGKEKEEHGIYKGNNFVGECRNQQGHGGESSSSGLNTIEDAWKVVVAKSPQLHVDQKAEEFISKFREDMRLQKERSMLEFQEMLARST

SEQ ID NO: 216765 - protein, 729 aa, Glycine max
  Coding DNA Sequence Number=SeqID_99987
  Gene Ontology: Mol. function=zinc ion binding; Cellular component =membrane; Biological process=defense response
  Homolog annotation: Hit_ID=Q1SJ37; Match level="QueryCoverage=95%, HitCoverage=93%, E-value=1e-174, Identity=47%"; Hit description=Zinc finger, FYVE/PHD-type
  Pfam annotation: Domain name=DZC; Domain location=665-700; Score =66.5; E_value=8.3e-17; Accession=PF08381.1; Description=Disease resistancezinc fingerchromo
  Pfam annotation: Domain name=FYVE; Domain location=253-321; Score =47.9; E_value=3.5e-11; Accession=PF01363.12; Description=FYVE zinc finger
  Pfam annotation: Domain name=RCC1; Domain location=149-198; Score =24.0; E_value=0.00053; Accession=PF00415.9; Description=Regulator of chromosome condensation (RCC1)
  Pfam annotation: Domain name=RCC1; Domain location=203-250; Score =20.1; E_value=0.0047; Accession=PF00415.9; Description=Regulator of chromosome condensation (RCC1)
  Pfam annotation: Domain name=RCC1; Domain location=35-84; Score=9.3; E_value=0.069; Accession=PF00415.9; Description=Regulator of chromosome condensation (RCC1)
  Pfam annotation: Domain name=RCC1; Domain location=99-146; Score =20.1; E_value=0.0047; Accession=PF00415.9; Description=Regulator of chromosome condensation (RCC1)
  Pfam module annotation: Pfam domain module=DZC::FYVE::RCC1::RCC1::RCC1 ::RCC1; Domain location=665-700::253-321::149-198::203-250::35-84::99- 146
MVQDFLVMALIGPLEGLQVVSVACGTWHSALATSNGKLFTIGDGRFGVLGHGDRDSVAYPKEVQLLSGHKAIKVACGVWHSAAIIEVMGPSGSNTSAKRLFTWGDGDQYRLGHVNKETYLEPTCVAAVAEYNFHQVACGYTMTVALTTSGHVFTMGGTAYGQLGNPNSDGKVPILVRGKLVGEFVEEISCGANHVAVLTSRSELYTWGRGANGRLGHGDTDDQKSPTMVEALKDRHIKNISCGSTFTSCICLHKWVSGVDQSVCSDCRQPFGFTRKRRNCYHCGLVYCHPCSSKKASKAALAPTPSKPHRVCDACYAKLKGSDSASNFNRDISRPSSSIYGRESFHRGEVRSSRVLLPPTIEPVKYLEIRTNKPGSTHDSIVRAAQVPTSLQLKDVSFPISLSSVQNVYKPVIQPSQPPTPPTSATPIPMSPYARRPPSPPRSTSPGFSRSLIDNLRKKNDHLNQEVTKWQNKNQNLEQKSDMQDMKIQELQKNIEEAMSQFGEESSKLREAKEFIKSLADKLREVTEKLPPEIPDKETLRTMHAQAEEFLHEEKDFESSSSPQSLESEQQSAPDVPASDSDSSKLQQQRVEGNDDASGVVPSIDGENILEESSNSSVSSLVVIPPSSGNGSKLHDSGIPVKEGEKSVIEQFEHGVYGTLVVLPSGYKVFKRIRFSKRRFNEQQAEEWWNQNKDKVLSKYSPPATKNSKTGSSITPPHAEENSEALPSS

SEQ ID NO: 216766 - protein, 51 aa, Glycine max
  Coding DNA Sequence Number=SeqID_99988
MKKERNQYIAFKVGYLMEIAGPTLQGWYGGSVMAFAFGAVRIGSVPAHGYN

SEQ ID NO: 216767 - protein, 280 aa, Glycine max
  Coding DNA Sequence Number=SeqID_99989
  Gene Ontology: Mol. function=transcription factor activity; Biological process=regulation of transcription, DNA-dependent
  Homolog annotation: Hit_ID=Q397K1; Match level="QueryCoverage=96%, HitCoverage=96%, E-value=3e-60, Identity=45%"; Hit description =Transcriptional regulator, LysR family
  Pfam annotation: Domain name=HTH_1; Domain location=8-67; Score=70.9; E_value=4.1e-18; Accession=PF00126.17; Description=Bacterial regulatory helix-turn-helix protein, lysR family
  Pfam annotation: Domain name=LysR_substrate; Domain location=87-278; Score=50.4; E_value=6.2e-12; Accession=PF03466.10; Description=LysR substrate binding domain
  Pfam module annotation: Pfam domain module=HTH_1::LysR_substrate; Domain location=8-67::87-278
MSRRSLPLNAIDALLVTARHRNLTHAAAELSLTQGAVSRKIASLEAWFGFPLFERHARGLRLSPQGSALLPELQSTFEQLLTVADQARSQHTVIRLKAPTCAMRWLVPRLLEVEHAHPDLQIALTTTTDHNVNFKTESYDAAIVFGTHMSAGDLLFEEALTPVLSPVRAGTTLGSLTFLHPTRDKTDWSLWLAKQEGHGFVMHKNQHFDTMDLAITAAIQGLGVAIADETLVAEDVGAGRLMRPYETSVKTGASYRLVLRETPDEENGLAAFRACLLNRG

SEQ ID NO: 216768 - protein, 138 aa, Glycine max
  Coding DNA Sequence Number=SeqID_99990
  Gene Ontology: Mol. function=transferase activity, transferring nitrogenous groups; Biological process=biosynthetic process
  Homolog annotation: Hit_ID=Q39KW5; Match level="QueryCoverage=96%, HitCoverage=37%, E-value=2e-45, Identity=71%"; Hit description =Aminotransferase, class I and II
MTLRTPVQTRSKLPDVGTTIFTVIGQLSAQHNAINLSQGAPNFSCDPKLVAGVTRAMEAGHNQYAAMTGLQPLKERIADKIATLYGTQYDPGREVLVTASASEGLYSAISGLVHPGDELCANCSSAGGHPDRYQAHGA

SEQ ID NO: 216769 - protein, 162 aa, Glycine max
  Coding DNA Sequence Number=SeqID_99991
MPFPPAPVLPGCRSGCVALYALPTAQSAAGGGQTGGGAAGQADAARVGLRVYVVATVQGTLADVRACAVALIVAVTEPKNAEKSINLSMELASLPATLYCERISLDTIKPTNSIVPNIPKLASRDRGREDILALPIPTPKPKAKTRTENECAAQRRKQGKIA

SEQ ID NO: 216770 - protein, 205 aa, Glycine max
  Coding DNA Sequence Number=SeqID_99992
  Homolog annotation: Hit_ID=Q9AY32; Match level="QueryCoverage=28%, HitCoverage=89%, E-value=3e-24, Identity=94%"; Hit description=RRNA intron-encoded homing endonuclease
RTTAKAFAKDVFINQERKLGARRRSDTVLVSTINDADQGSADVAFRTPLAPYEKSKSLGSGGSMVARLKLKGIDGRAPPGIIAIVGLQRGIPSKRESSARVDYVPALCTHRPSLLPIEWSGEVFGLRRRERFAARDVVNLRKDHCRCLTIRLTRELVYSSTVGREGMTTAPRAPGLLVLATNTNPGASCAKELKSVKCDSRGPGD

SEQ ID NO: 216771 - protein, 148 aa, Glycine max
  Coding DNA Sequence Number=SeqID_99993
  Pfam annotation: Domain name=GRP; Domain location=1-125; Score=39.3; E_value=5.4e-09; Accession=PF07172.2; Description=Glycine rich protein family
MALKSKIALLITGLLAMLLFISSEVAAARNLKEGEVVRETNRVGDAKLVGGIHDVSKLSIPGIGGNFIGGVFPGNIGGGYIGGSIPIIGGGYIGGFPNIGGGGGFPNIGGGGGFPNIGGGFQGQAFCRFSCCVQDAMGRCLRCCSISR

SEQ ID NO: 216772 - protein, 103 aa, Glycine max
  Coding DNA Sequence Number=SeqID_99994
MSLPSAVHVSSIIKREASGDWEARYSVKKKEGVETRVVITKRQGERNQCPIFAFLLSPMRGGVQIATKPTWTLQKIPPEGCCFWRKQPCSLGRQEVKKKRTAS

SEQ ID NO: 216773 - protein, 128 aa, Glycine max
  Coding DNA Sequence Number=SeqID_99995
MRIFRSVGRKTSDISGKGADADITGKGADADISENGAGDDDSHCSLSRFEFYGLQMRLFRSLGWKTLHLRKGLGRKTLTSSGRVQVTTLVTACYRDAHISEKGASDDISVATYPSAGGRRETRGMRVP

SEQ ID NO: 216774 - protein, 58 aa, Glycine max
  Coding DNA Sequence Number=SeqID_99996
MLDKQGVVSPAKPADRPDPELHEELNAEFKTGCLPGSLPEWNALKGVDDTPQPKFKAA

SEQ ID NO: 216775 - protein, 38 aa, Glycine max
  Coding DNA Sequence Number=SeqID_99997
MVLRDGHKQRLGSRSIDRHFMPSTGQAGSAAGGQPSIL

SEQ ID NO: 216776 - protein, 96 aa, Glycine max
  Coding DNA Sequence Number=SeqID_99998
MSQKFICDIDNHGCLSGSVDLDLNLDYHGTLKGFLISHLDFTQQFSMGIWCLLQYTVERLWLSDDMDVDLPLPQTYLNFLSLHLDFTTSSHNSVWR

SEQ ID NO: 216777 - protein, 116 aa, Glycine max
  Coding DNA Sequence Number=SeqID_99999
RKEGGGCRPARPGKLGCFHQKIVQQCFLSTSGMLRNFMDCLTIGVKYLKAVKRRLHATKQWSPDEIRNIIIRPVNIPTSGTCHLERKKRYQKRHQNFSVLKAIKWDNHDTSPRHRT

SEQ ID NO: 216778 - protein, 493 aa, Glycine max
  Coding DNA Sequence Number=SeqID_100000
  Gene Ontology: Mol. function=endonuclease activity
  Homolog annotation: Hit_ID=Q1T6I5; Match level="QueryCoverage=92%, HitCoverage=98%, E-value=1e-157, Identity=61%"; Hit description =Calcium-binding EF-hand; Endonuclease/exonuclease/phosphatase
  Pfam annotation: Domain name=Exo_endo_phos; Domain location=55-322; Score=25.1; E_value=0.00026; Accession=PF03372.13; Description =EndonucleaseExonucleasephosphatase family
  Pfam annotation: Domain name=efhand; Domain location=392-420; Score =27.2; E_value=5.9e-05; Accession=PF00036.22; Description=EF hand
  Pfam module annotation: Pfam domain module=Exo_endo_phos::efhand; Domain location=55-322::392-420
MDMVVAGGAKFNLRRGNGSSHNVVNGYSSDGDLCRISKSGCFSSVAEVDRDPSCVSFTTFNILAPIYKRIDPQNQGLRESDFRAFWLARNERILDCLLSESSSIMCLQEFWVGNEELVNMYEERLGDAGYNLFKLARTNNRGDGLLIAIRKECLRVMDYKELLLNDCGDRVAQLLHVQSATPFVQNPKGSVPQEFLIVNTHLLFPHDSSLCVVRLNQVYQILQYVELYQRENRLKPMPIILCGDWNGSKRGHVYKFLRSQGFVSSYDIANRYSDSYADAHKWVSHRNHRGNICGVDFIWLCNPNQARKPLKTSWAEAVFSILKEFQASPSAIFTKLPISRNFQLRKASVSEDDAFTFLKGDNYADSVTYFSFSEALRQVKLVGVPYGLCFQQLQDLWNQADVDGNGVIDFEEFKQKIWNSTCPEHVLENVNGCMEDGNTEQEQEAIGFKVKNAMLYPREVEKGLWPEDYSLSDHARLTAVFSTARMRCSGVQN

SEQ ID NO: 216779 - protein, 282 aa, Glycine max
  Coding DNA Sequence Number=SeqID_100001
  Gene Ontology: Mol. function=catalytic activity; Biological process =metabolic process
  Homolog annotation: Hit_ID=Q6A5M5; Match level="QueryCoverage=29%, HitCoverage=13%, E-value=4e-39, Identity=96%"; Hit description =Putative long-chain-fatty-acid--CoA ligase/synthetase
VLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDLGDMQPLGQLFYLRQRRLNEQSQARTVIAQQHRVFEEGVLHERILDRLRRNILAVKGDNDVFEAIGNDEKTIFVDVPNIPSDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 216780 - protein, 75 aa, Glycine max
  Coding DNA Sequence Number=SeqID_100002
MVILSCIGTRQFDWRVPLGRLRRSSFAGVSPYSFAGVCQSIQMCRVQCSSVHEGTANTDGDLHFVGIASVAGELL

SEQ ID NO: 216781 - protein, 48 aa, Glycine max
  Coding DNA Sequence Number=SeqID_100003
  Homolog annotation: Hit_ID=UPI0000162EFD; Match level="QueryCoverage =97%, HitCoverage=2%, E-value=2e-10, Identity=64%"; Hit description =HB-1; transcription factor
MYRSLPLGLDRRRNRYWQFTTSAQNDPGCGRIFVELNDGRWKLIDSEE

SEQ ID NO: 216782 - protein, 381 aa, Glycine max
  Coding DNA Sequence Number=SeqID_100004
  Homolog annotation: Hit_ID=Q13K47; Match level="QueryCoverage=46%, HitCoverage=83%, E-value=2e-51, Identity=58%"; Hit description=Phage SPO1 DNA polymerase-related protein
MVCDQHRRLAAPQRLAQRGLQGQLAIGHQRAERGGAQRDDDPRPDVVELLFQPIAASGDLGLRRRFVHAALAAQLPLEVLDGVGDVDRIAAHAGLLQRLVQQRAGRAHEGMASQVLLVAGLFANQHDGGAALALAADRLRGVAPQAAAAAIGKLARVLVGVDLVVRVIGGPRVGIHAVSSIGLARNGAFKARPKVRNGCPPAARRAWPGPGPIRPRGPCPEVSGGRRHCGSGPPDGPTGFVRFQARACAARRPGSPGGSGVWCSCRRPRRRVLAATAGRRGGQACAASDVPRYGRFSRRITWLRFISTPLMGLRLSRTLQKMRTQLISASTGLCVMTASMVPSISSARVSGVRPWPMNTTRCCRPASLSARATPSEAPPML

SEQ ID NO: 216783 - protein, 211 aa, Glycine max
  Coding DNA Sequence Number=SeqID_100005
MNILTAHDQEWEKELSPYNQYEEERTLNLESVFEEFRAYHASSKANQNLMKNHEIHFGTSYSIENFQGRPELQPYYQNEVERGSNLDKLLMQFMETTKSTQQALQSVEIQVGELAEAVTQFMSRQEKSFVEVEANDLLHQWIPLLLGRGMAAEWRRKGERRRHFKEKMSLEEAHHHRRPWIRAWRKKEMNEGRGREEHGILCSKRALKSKV

SEQ ID NO: 216784 - protein, 172 aa, Glycine max
  Coding DNA Sequence Number=SeqID_100006
  Gene Ontology: Mol. function=ATPase activity, coupled to transmembrane movement of substances; Cellular component=integral to membrane; Biological process=transport
  Homolog annotation: Hit_ID=Q47522; Match level="QueryCoverage=23%, HitCoverage=50%, E-value=3e-17, Identity=100%"; Hit description=LacZ protein
MRKEKIPHQAPFAIQAAQLLGRAIGAGLFAITPAGERGMCCKAIKLGNARAKPEAGKLMIGTVALLIAATSSILVVCFFYYLPLPVPLSHTVTKISVSMYLQKFGGKIIDIVSREMQTPEEKDEALNAVKNTILEIFLGTELEFVIMVIAVSCVKLLSAHNSTQHTSRKHKV

SEQ ID NO: 216785 - protein, 89 aa, Glycine max
  Coding DNA Sequence Number=SeqID_100007
  Subcellular localization annotation: CTP_CleavageSite=65; ConfidenceScore=5.12e-01
MPVSPCGSISWSVLSRHRGSAHKTPSGPGGAQQGPRISSSGYRPLDHACKTLSGPGEVQQGPGVSSSDYGPLSVLWSACHSQQGHEAPY

SEQ ID NO: 216786 - protein, 82 aa, Glycine max
  Coding DNA Sequence Number=SeqID_100008
MAKFDPEIVMEFYANAWPTEERVQDMRSWDFAQTAVGRRVRIMHTSMTTLTQIWMTSLFSNILLSDHNSDLPLSKCQLVYAI

SEQ ID NO: 216787 - protein, 65 aa, Glycine max
  Coding DNA Sequence Number=SeqID_100009
  Subcellular localization annotation: CTP_CleavageSite=34; ConfidenceScore=5.22e-01
VFVDALSLPTPMRKRAAYRYGNADPNRGTRNRITTSSYQNFATSLAMPHRPCFDPLVSAVFGSGE

SEQ ID NO: 216788 - protein, 50 aa, Glycine max
  Coding DNA Sequence Number=SeqID_100010
  Homolog annotation: Hit_ID=Q6H6R9; Match level="QueryCoverage=90%, HitCoverage=5%, E-value=9e-12, Identity=78%"; Hit description =Putative cell division protein FtsH3
GIEEKTTKLKGSEKALVARHEVSHAVVGTAVANLLAGQPHVEALVIRLLV

SEQ ID NO: 216789 - protein, 46 aa, Glycine max
  Coding DNA Sequence Number=SeqID_100011
MGDSATCSKLNLENGHDALTNHGNSSALVMNAKKGLRVPRTNRKCP

SEQ ID NO: 216790 - protein, 86 aa, Glycine max
  Coding DNA Sequence Number=SeqID_100012
MKANKTRNELKASLRLFIGKGRGCRPACLGGLVFGNFTEALRKSGKPRKPFFNKTREVVAAQLTQASSALLGELGCFHLKQGNAEI

SEQ ID NO: 216791 - protein, 92 aa, Glycine max
  Coding DNA Sequence Number=SeqID_100013
MEEREKLDLIDERLRTIEGIGDYPFSNMVDLCLVPDVIIPPKFKVPDFDMYKGTTCPKNHLKMYCRKMGAYSRDEKLLMHFFQECLVGAAIT

SEQ ID NO: 216792 - protein, 171 aa, Glycine max
  Coding DNA Sequence Number=SeqID_100014
  Homolog annotation: Hit_ID=Q9LTY5; Match level="QueryCoverage=98%, HitCoverage=61%, E-value=4e-58, Identity=62%"; Hit description =Arabidopsis thaliana genomic DNA, chromosome 3, TAC clone:K1G2
  Pfam annotation: Domain name=DUF1325; Domain location=8-171; Score =27.9; E_value=2.6e-08; Accession=PF07039.2; Description=Protein of unknown function (DUF1325)
MSSPDIVSILDNSKELDRVRKEQEDILSEINKLHKKLQATPEVVEKPGDNSLARLKFLYTQAKELSESEASISNLLINQIDALLPTGPQGQTRRRIGKADSTCVTEGNEQKRKRVKTESDISRLTPSMRGQLEACANLKGEQVAARVTPRNADKDEWFVVKVIHFDKESKE

SEQ ID NO: 216793 - protein, 479 aa, Glycine max
  Coding DNA Sequence Number=SeqID_100015
MYGASDASEFQNSIPKVDTIIFHIEDEPTIHIEHFFDISSLESMELIRMFWQKTKFNIGHTMVSIVLGKTMTLNIETIAQAIGCMREGSKYNSKWEQVCGDNVPRALYKDNAQKAQGKKDSISDLHKFMLFHLMECIPFDLPYTIYLNILHITKKLGEVNRSIRLGDLNETEEEMVAPLQRKRKAKVTKERPTRNEPVLVPNVPKKLKKNATHANPTILGKSWTPPSQVNPFEEREKMVKKASRKAISINIPLATFSRSHMNSSLEVDPPKYSMLGDILAQMYASNQAVAYPPSLHISKATDILMVPNRCCPRLPLKDDGRKKDFKLYFNQEMASRQQKVELKLVKRPDVFDAKTFWNQIVWGDTRKALSSSFNGQDITDHKDNIQVLRSVSTYHFDDACVCFVKDKVDNDPIEQLHEVEKLAKEEYGKAFDVELEATRPTEEVLINLTLYEEVPPATFNVAKDDKGIPTVPIELVSKQ

SEQ ID NO: 216794 - protein, 175 aa, Glycine max
  Coding DNA Sequence Number=SeqID_100016
  Gene Ontology: Mol. function=nucleic acid binding; Biological process= DNA integration
  Homolog annotation: Hit_ID=Q1SG63; Match level="QueryCoverage=97%, HitCoverage=11%, E-value=1e-18, Identity=37%"; Hit description =Integrase, catalytic region; Zinc finger, CCHC-type
ESKGCASSGLENKCKAWKARSDSDNEILLEYSKTSNAFKVYNSRTLVVEEPIHAKFNDTKPDKKLSELDESFVDLRLDNGIIDKVSSSQNLGTVASTPPLDGTQEEIREPIRHVMRKNHSKSQIIVDPTESVQTRASLKLKGHTALISQIEPKHIDEAMQDDNWVKAMQEEPNQF

SEQ ID NO: 216795 - protein, 69 aa, Glycine max
  Coding DNA Sequence Number=SeqID_100017
  Subcellular localization annotation: CTP_CleavageSite=24; ConfidenceScore=5.24e-01
MKLSLAHQWPKCASIAKCSFSVVSATEESSRASILRPRAKREISALSATVVFCQDLRTTGAKLKSTYSR

SEQ ID NO: 216796 - protein, 67 aa, Glycine max
  Coding DNA Sequence Number=SeqID_100018
MSLRTVFLLPHQALIPEISGIRSNGRIGSKNAISRAHRNGLQTQVFENKETEAAAEPHRIGEGRREI

SEQ ID NO: 216797 - protein, 289 aa, Glycine max
  Coding DNA Sequence Number=SeqID_100019
  Gene Ontology: Mol. function=RNA-directed DNA polymerase activity; Biological process=RNA-dependent DNA replication
MVPKSSLTLCSLLQKGINRRPRKVARRILHKPTRIYNTRANRKRMDIVEQENQSLREEVATLREGMDRLTTMMSALLSAQNSQAAAATVEQPLVSTTPLSTVTSPPLFLPPGCTWGMPPPVCGGPQPAVSEVPPPFAQQSAPVPQPSTSFPQAAMTYSAPLIHTIQQEVEPIFQAENVVAFDKMEELQERFDGMQREVEALRGRDLFGKDACELCLVPNVTIPHKFKVPDFEKYKGNSCPRSHLVMYARKMSMYTDNHKLLIHFFQDSLTGAALKWYMNLDGASIRTFQ

SEQ ID NO: 216798 - protein, 112 aa, Glycine max
  Coding DNA Sequence Number=SeqID_100020
MRVHCNQASRRPSTTTNSPPLLMFPRTQIIRKEIKKKEQRRSHGKESTLIDWPNSLTRVPSGVANCRNLPFGGRATRDSRVHLPRKENARSCHQRLFEENVGKTGKGVVYEL

SEQ ID NO: 216799 - protein, 524 aa, Glycine max
  Coding DNA Sequence Number=SeqID_100021
  Gene Ontology: Mol. function=kinase activity; Biological process=D -ribose metabolic process
  Homolog annotation: Hit_ID=Q2NUE6; Match level="QueryCoverage=51%, HitCoverage=78%, E-value=1e-140, Identity=91%"; Hit description=1 -phosphofructokinase
VFAGFAHQQAVNQAADHRITGAHGADHLTGRRFGDPGTGGVNPQRAFRAEGDHHVGDALLAQRMRGLDHVRQRRQRAAGPDLQLAAVRLHQPRRGLQPSDQRFAAAVENDARTLGAQLGHPVGKGIGIDAGRQAAAHRHHVKLAQPAQRVADEAIPVLRRHFKTGEIEIGDFAVFFRQLDVDAGAARHYLEAVGDPQIAEQQLETVLIVFAQEAADGDVDAQILQHLGDVDALTGGVQAGGFYPVDFPAFDLRAKPHQIVRRVQGDRCYSSAHAAPSPSPSLIASPIAFSAASASSPLARHHLHQAAPVGRLAAAVQRRARPCVQAVLVADHELGAQYAALLGHFAGQQRQHPGGIRLQQAFSFVGQQQVAERHRLAVFHESLRRAADGGRAGQVAFNAVAQPDALPQVQRLAGNGIADELRVDRAGLLQPAGVQRLQRHQAVGRDVERNQRNVELEFGALLLAHQQAAQLFRGGGFRQPLRHAVIAQHVSKLAQQRQMLVGTGGDADRHIGGLAFAPGDALRN

SEQ ID NO: 216800 - protein, 76 aa, Glycine max
  Coding DNA Sequence Number=SeqID_100022
  Subcellular localization annotation: CTP_CleavageSite=27; ConfidenceScore=5.21e-01
MCKLFKTRAIGSLLRHFSALGPTRKLRAEVTSSLGRTRESRVALPPKGRLRQPTYMTNPHETKEIESQVRELLEKG

SEQ ID NO: 216801 - protein, 76 aa, Glycine max
  Coding DNA Sequence Number=SeqID_100023
MAAGNGGSWWPPVVVGGGGGGVRAWHTQRNSLSGGIVLSALLALSEWSKIVILQITMLHVELVGLGSSSSMESIAS

SEQ ID NO: 216802 - protein, 66 aa, Glycine max
  Coding DNA Sequence Number=SeqID_100024
  Gene Ontology: Mol. function=hydrolase activity
  Homolog annotation: Hit_ID=UPI00005F906D; Match level="QueryCoverage =69%, HitCoverage=32%, E-value=3e-12, Identity=67%"; Hit description =COG1051: ADP-ribose pyrophosphatase
  Subcellular localization annotation: CTP_CleavageSite=42; ConfidenceScore=5.13e-01
MGSSGRGSERRTRSRWLRPWANRAGRSAIAGWRCGWLRNAVPAGRRARTSATRRTFRVLSTRRCRR

SEQ ID NO: 216803 - protein, 93 aa, Glycine max
  Coding DNA Sequence Number=SeqID_100025
MSALRDGTMIGDIGIMAQNITATVHSKLKQLPVYFLLNQDVYQQVQMLKNNHKVMQFYPARALGRRLQVDWARDPREGPKVLMSLRVDFEPMG

SEQ ID NO: 216804 - protein, 126 aa, Glycine max
  Coding DNA Sequence Number=SeqID_100026
  Homolog annotation: Hit_ID=UPI000044A741; Match level="QueryCoverage =61%, HitCoverage=20%, E-value=9e-12, Identity=55%"; Hit description =PREDICTED: similar to Ac1147, partial
MGGGAWPFLVGGAICLVNSVNERDLSLLNSYVEIIAIVGLQRGIPSKRESSARVDYVPALCTHRPSLLPIEWSGEVFGLRRRERVRCPRRCEKSTEPYHFRGRRSRNKVSVGEPAEGIIVDASQSD

SEQ ID NO: 216805 - protein, 166 aa, Glycine max
  Coding DNA Sequence Number=SeqID_100027
MNILMAHNQEWEQELSPYNQYEEERTPNLESVFEEFMAYHTSSKANQNSMKNHEIHFGKSYSIENFHGGPKLQPYHQNEAERGSNLDKLLMQFMETTKSTQQALQSVEIQVGELAKAMTQFVVRQEKSFVEVEAQKKSPVKEHESREKDEEKDEEQAQQQWEKYST

SEQ ID NO: 216806 - protein, 60 aa, Glycine max
  Coding DNA Sequence Number=SeqID_100028
MVLPLDEVSVDSIGGSERGVKKRKIGLYGTDGGGTRESLGCVTTLDSWDVVIDYRLPVLV

SEQ ID NO: 216807 - protein, 77 aa, Glycine max
  Coding DNA Sequence Number=SeqID_100029
  Subcellular localization annotation: CTP_CleavageSite=35; ConfidenceScore=5.09e-01
MSKTLSNPTKTLSETIRTMNKILSKTTKITRTMISLSKKTSKEKPYRESESDSDTYTVSESETDSDDTVSDMAMVSP

SEQ ID NO: 216808 - protein, 104 aa, Glycine max
  Coding DNA Sequence Number=SeqID_100030
MNEESVWVMASIAPTWVSLGASEKVIQVSCSMLSHLHDNTFFVKALGQVLTGARPMIRSITTQCPAKDVKEALLGGNLVSLTLLFNFMFVFLNYHMNSPKLIHN

SEQ ID NO: 216809 - protein, 95 aa, Glycine max
  Coding DNA Sequence Number=SeqID_100031
  Subcellular localization annotation: CTP_CleavageSite=31; ConfidenceScore=5.18e-01
MVEPSKKQKGSSSRSQRHSEAQDTPIPSSISSSSLFSSEEQRTRYSNLFSSHSIIDPKFIDMDFFSDESFKCIQAFHNSNLIPFMSLKLPVYYEL

SEQ ID NO: 216810 - protein, 102 aa, Glycine max
  Coding DNA Sequence Number=SeqID_100032
MNHGHRRKAMKKEDPRRRILLGMTMTHPIVRRRRSTFYPRTMRAMRTSLKKIKRKAKSFLDIKYFEPLSNPFTLRIHSALNSAKMLSGNRLPQCIIDYNKAG

SEQ ID NO: 216811 - protein, 256 aa, Glycine max
  Coding DNA Sequence Number=SeqID_100033
  Gene Ontology: Mol. function=nucleoside-triphosphatase activity; Cellular component=chloroplast
  Homolog annotation: Hit_ID=Q2PMM5; Match level="QueryCoverage=99%, HitCoverage=11%, E-value=1e-150, Identity=100%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWI

SEQ ID NO: 216812 - protein, 105 aa, Glycine max
  Coding DNA Sequence Number=SeqID_100034
MRGYRMVIFTFRQPRANEPVDAQRPTSSSTPFVIQGQQVRWQAEIPYGFYSRRPETFKPDDARHSSLLGGGRSSSMAWGNVVVVPFYRFQDTEVLLTLLMHFLSF

SEQ ID NO: 216813 - protein, 189 aa, Glycine max
  Coding DNA Sequence Number=SeqID_100035
  Gene Ontology: Mol. function=binding; Cellular component =mitochondrial inner membrane; Biological process=transport
  Homolog annotation: Hit_ID=Q9FHX2; Match level="QueryCoverage=58%, HitCoverage=28%, E-value=2e-17, Identity=43%"; Hit description =Mitochondrial carrier protein-like
  Pfam annotation: Domain name=Mito_carr; Domain location=82-165; Score= 15.8; E_value=0.00013; Accession=PF00153.17; Description =Mitochondrial carrier protein
  Subcellular localization annotation: CTP_CleavageSite=60; ConfidenceScore=5.69e-01
MEGRPRQPVSPTTMAACPPRVSSSLSLPSPKPHPFSISNLTDFPSLLTHFSSHTPTLPIASTSKWARPSLMPLLKTLSVLDRALIGVAAGGLAGAFTYVCLLPLNIIKTKMKIKGATQIYKNNLDAIVKTFQSEGIISFYNGMSTVVVCSTTLPRATRSSKRTRIVAPRLGKLQVRVTCKRERERGSPP

SEQ ID NO: 216814 - protein, 492 aa, Glycine max
  Coding DNA Sequence Number=SeqID_100036
  Homolog annotation: Hit_ID=Q9LHA3; Match level="QueryCoverage=83%, HitCoverage=60%, E-value=1e-165, Identity=68%"; Hit description =Arabidopsis thaliana genomic DNA, chromosome 3, BAC clone: T19N8
LRDVLHSSHRFFWIDLRAGPVDYGPVDLRRRRHPRGEFHPLAALHGRPKSNKAFAADLASLVWSAYHVFLAPSLRIPVPFENSLVIQFVHVHSENEKDLAGLDWKSIEKSFRFEGKSNGLLLGDQSLSFRKYEIRYSECSICSFAISRSINSYTSRFLFDNYTLIVSEYLDSKRLHQILSDSGDELRKLAGVPEEDFGRVVPVYVFDLDYTSLLLLDRYHQSVAFKDMVIAVRTRNTQTVSDYSCNGRHVFMQTRQLERPIVGSILQSMWGVSPTHLNWSPQHNETLVDYTWSMGQTPFGPFSEMLSLSFVQKDAARRNVLLTSLNYSITSAIDVLQSVETHGGAKSLLKQKQHVEFVQRWNLFKYKLNKAVSALSHLDFDMALFYLRSSDHDLYAIHSIVYHASQEIEASLALISLPPQCNHIALLPLPPLQAEAFASPTTLFVKHISVKKTTLPKIESSKLWCSSQIPVVAMVLEEDEHGGLLADRSNSL

SEQ ID NO: 216815 - protein, 166 aa, Glycine max
  Coding DNA Sequence Number=SeqID_100037
  Gene Ontology: Mol. function=RNA-directed DNA polymerase activity; Biological process=RNA-dependent DNA replication
MQPHEKLLASIAKTKLCISKNVHQVSRQRIADMTGFELTGDVGKYLGVPLLHSRATKATYHYLLDNAHNKLSSWKENNLSFAGKATLAQTVLQALPSYTMQIVFLPKGSILKDMVVEDIPSNLIHKTMDQMVGNDGSWNLNEVLHLLPHSAPLEIAGSPTPSPLPV

SEQ ID NO: 216816 - protein, 355 aa, Glycine max
  Coding DNA Sequence Number=SeqID_100038
  Gene Ontology: Mol. function=carbonate dehydratase activity; Cellular component=membrane; Biological process=electron transport
  Homolog annotation: Hit_ID=A0E4X7; Match level="QueryCoverage=79%, HitCoverage=47%, E-value=2e-14, Identity=27%"; Hit description =Chromosome undetermined scaffold_79, whole genome shotgun sequence
  Pfam annotation: Domain name=WD40; Domain location=104-143; Score =33.1; E_value=9.5e-07; Accession=PF00400.22; Description=WD domain, G-beta repeat
  Pfam annotation: Domain name=WD40; Domain location=193-230; Score =8.4; E_value=3.8; Accession=PF00400.22; Description=WD domain, G -beta repeat
  Pfam annotation: Domain name=WD40; Domain location=240-277; Score =5.1; E_value=9.4; Accession=PF00400.22; Description=WD domain, G -beta repeat
  Pfam annotation: Domain name=WD40; Domain location=52-94; Score=32.6; E_value=1.4e-06; Accession=PF00400.22; Description=WD domain, G-beta repeat
  Pfam module annotation: Pfam domain module=WD40::WD40::WD40::WD40; Domain location=104-143::193-230::240-277::52-94
MTSVFRGDTQGEQNVLVTSSCDHSIRLWWKRSWMICVGSMVIPPYFGIKSEGSSLRCFRGHNGPVLSLSNKLLGEDGSKVLASGGEDGTVRLWSLGSSGKRGQRALKATFYGHEKPVNLMSVAGHKTSLLVTISRDSKVRVWDTGTATSSAVRTSCCVGMASVPGTPLNMKCHESLLYVAAGSSVAAFDLRTMQKVITAAVHQPKLCSFDAVPSKYLICTGGNGRAMLWDVRRNQESLKPEPIAELDGHCGQVTLLHMDPYKIVTGGPDNAYVNVWEVDTGVQTNSLLCSSTDDAGSGCDAMTVDGCRITTASYYEDLGVLRFRDFNHATNPVTKLENEPSSKFWISMSDDDRDD

SEQ ID NO: 216817 - protein, 410 aa, Glycine max
  Coding DNA Sequence Number=SeqID_100039
  Gene Ontology: Mol. function=RNA-directed DNA polymerase activity; Biological process=RNA-dependent DNA replication
  Pfam annotation: Domain name=Exo_endo_phos; Domain location=61-272; Score=-11.1; E_value=0.061; Accession=PF03372.13; Description =EndonucleaseExonucleasephosphatase family
MESKQIQSQRSDEWVWMTDSSGQFSTKSAYNAMREASLDGIEDTAFAELWKLKEDTGHMFFHCSKISPLWWESLSWVNSVGPIPINPKQHFLQHISGVAQGHRNKILFSNDTFDANKIMDDASFVMWTWLQSLEKDFEISYNHLSSNLRSGFPKDESEPWFLSAVYGAPWFLSQSKPWILCGDFNAYSSALEKKGGGLPDLLSIASFNGCIQEANLIDLGFFGYPYTWEARGVKERPDQCLCNTIWLLSFPQSFVTLLPTFKLDHKPILGDMDWLCRLHTFKNLASDWSHHCFGNIFHSKRRILAHLEGIDRRLINNANRAHMDWIKFGDRNIKIFHLSAVIRKNKNSIRGLLEDKGELGLFPVLEHQFILWIQATPSDEEIKEVVFGMGGMKAPGPDDIHAIFLSKELD

SEQ ID NO: 216818 - protein, 57 aa, Glycine max
  Coding DNA Sequence Number=SeqID_100040
MSRRLRAQCSSQREQTGYNVHRVHPVEVTEDRGDHSNMSSEEMEEVLGTTEAVGTDV

SEQ ID NO: 216819 - protein, 160 aa, Glycine max
  Coding DNA Sequence Number=SeqID_100041
  Pfam annotation: Domain name=F-box; Domain location=13-60; Score =29.6; E_value=1.1e-05; Accession=PF00646.23; Description=F-box domain
MAEQSRSPATPATTITDLNEDCIAHCAGHLSLGDVCNMAMTSSALKRLAYSDFIWQRFFREHWHLELPWHSSGNGGGGGARGVYMVRHAALRQFKFVDPFVLDFDAHAKPFDQLLLHKNHLFYSQGSRVEVIDLDGCLKRTTTDFFHSLCYHKARITCMR

SEQ ID NO: 216820 - protein, 467 aa, Glycine max
  Coding DNA Sequence Number=SeqID_100042
  Gene Ontology: Mol. function=hydrolase activity, acting on acid anhydrides, in phosphorus-containing anhydrides; Cellular component =membrane; Biological process=conjugation
  Homolog annotation: Hit_ID=Q8KNJ9; Match level="QueryCoverage=98%, HitCoverage=26%, E-value=1e-66, Identity=36%"; Hit description=TraI
MSREQGREVSVLTSSAERALSFAKSPALKDRLLHRSRMLDGTFSLAPQSTVIVESAEKLSLKEMLVLTGEAQLQNAQLLFLDSAGRQSNANALSVLTAAGVERQSLNAPSDGIEVRVTSIQDKRERYRALAERFAGMDPADGPVTAVVAGPREQAQLTGVIRNALKDAGRLGEAPVSIAARTPVYMTAKERRLPQTYRAGMVLEDRSERNETRHYVIDRVHDETRMLSLIDGDGVLSRVKLSALSGDWRLFTQSQLEVAVGERLFALAGDKNAGLKARDRLTVTSVENGALVVQREGQKKPLRIDPANPLYVTYGYVSAPGSRDNEHGTVLASLGAQDLSVNMINALAQSGHEAEIFTGEALSRAEDKLGRLRSTRSPLSLVRQASGKEDASEAIDTLSTQLLSDAQKAVTRGVAQMREVAFSRTKLLDEALTFCGDLKLIENEITRQVKEGDLIGVQTSAGPHFVA

SEQ ID NO: 216821 - protein, 138 aa, Glycine max
  Coding DNA Sequence Number=SeqID_100043
MNEGTFGILFKYVRKPLSGFMLNQILTYQDSRQIAQQLSPVLSRTLESDQFPLLNDPNKACIYVIKLLRPQGPTQLSLADMNGAKLNQIQFKPQEYPLSQQIMRSAPWPSIQTAMNSTWRHRVVLSQGKPSLSNQFVA

SEQ ID NO: 216822 - protein, 128 aa, Glycine max
  Coding DNA Sequence Number=SeqID_100044
LHVVPFVVRLMKQANVFLVKNTLKKFTIWEINRGKDILKEDFQASSRVLITNKDNGDHTLAISSSKTRRTTKLEETLTQFMQNPKEECKAVMTRSKRFVEAEDEDRVIMPKKKAAEKKGTDDKKDDVR

SEQ ID NO: 216823 - protein, 97 aa, Glycine max
  Coding DNA Sequence Number=SeqID_100045
MVRTKKIGQMTSKEAKEIAEKIASQGSFVTHGRQDVLTPRTSRTSSSMAPEDLEQLTQQIRDQLEESIIEKPEVGPSTARVSTKESCVNPSGNDPDT

SEQ ID NO: 216824 - protein, 91 aa, Glycine max
  Coding DNA Sequence Number=SeqID_100046
MEGYGSSSSTPNDGEGDDNNDSGHVTGVLLLEDGGKPGANGENKKEGGTHVIVTVVPAWPNFPPAQQYQYSANINPSHYPLPYQPRTPNHP

SEQ ID NO: 216825 - protein, 57 aa, Glycine max
  Coding DNA Sequence Number=SeqID_100047
MHDNWPTVSRSQIELDELESVSILSMTLAWDEFSFSTFQEAHYSLQDSLDQVPDMPF

SEQ ID NO: 216826 - protein, 137 aa, Glycine max
  Coding DNA Sequence Number=SeqID_100048
  Subcellular localization annotation: CTP_CleavageSite=57; ConfidenceScore=5.19e-01
MVTPPRSPPQSDGNTEPQPKKTRQSTRLRRLTLRSLDQPRPTIPIVHCNWKNVPETLKDMVWGDTLAKFDIPEAEKAKKKVMSTVATRWRQFKSSLTTKFVYADTQAGQEENPSVKYGIDKQTWDKLVASGKTPDWQ

SEQ ID NO: 216827 - protein, 211 aa, Glycine max
  Coding DNA Sequence Number=SeqID_100049
MLLPLGQICDGGSAIHNVTYADDVVRVSVDKVIEGDAEVPFPTSEIQYVSLYYMYDTPVELKWDGSKFGLSNVDASFFLTFSDVNEIVAGYKCLNISILQLWMLFLDEWSSTLGHASVYGFLEPQSIHHAKDRRAECEHYLQAWLKESQREGPLATGSTVSYDQYVDHAIIISSAMKSANTTAKGTNNPATPKWIEVKSHVQSGGYECGYY

SEQ ID NO: 216828 - protein, 57 aa, Glycine max
  Coding DNA Sequence Number=SeqID_100050
MTLSSWQNKLDKYFTCKTLVMKGGNSYKGGSKIQYPCEASALFIEVKSEDQCIYPIL

SEQ ID NO: 216829 - protein, 192 aa, Glycine max
  Coding DNA Sequence Number=SeqID_100051
MNLKGDGFSNITRAIGKDIDYPWKQDIIGDPTTNVITNWQVKDGELIQSELPPATQYQLPNIKDSNNKHVMAIPFKTKDVNEEVTSKDIKSLMEQANYTNKYLQALGETIKTKVVPKQKSIEEASPSIPIEKPLFKPFKVSEKAKRKIRELRKTKSLIEGVGDNHSELLNKIGSLLRSFQILPKPRKILPKW

SEQ ID NO: 216830 - protein, 169 aa, Glycine max
  Coding DNA Sequence Number=SeqID_100052
MKSADKREYHMVIRTFHQPGANEPVDAQRLTSSSAPSVILTHEVRFTLVVRRYSSPTTHEILLCWAVTIKFDSAWKRRGSVGWDIDRSNDGQLPYPNFIRGPLFGGMQPSLDHLEDSLESSEENFFCGKHPCRGASVTLSRLFRERFREDSSPFFIVLRRSSSFFGLQP

SEQ ID NO: 216831 - protein, 135 aa, Glycine max
  Coding DNA Sequence Number=SeqID_100053
  Homolog annotation: Hit_ID=Q7CJ08; Match level="QueryCoverage=28%, HitCoverage=3%, E-value=5e-07, Identity=68%"; Hit description =Transcription-repair coupling factor
MSRFPKGSIVKHKSGEIKGEVVNVFEQGNALTGYYVKWDDGNNSYHVERELSWANGAAEVRCAFMHPDINSERRDDPHGGMWNDDALETEERMSDLMSEQRRYTLPAKAGDHRQLGQLVGAAQAVECASITERHS

SEQ ID NO: 216832 - protein, 339 aa, Glycine max
  Coding DNA Sequence Number=SeqID_100054
  Gene Ontology: Mol. function=hydrolase activity; Cellular component =chromatin silencing complex; Biological process=regulation of transcription, DNA-dependent
  Homolog annotation: Hit_ID=P75960; Match level="QueryCoverage=61%, HitCoverage=81%, E-value=9e-87, Identity=78%"; Hit description=NAD -dependent deacetylase
  Pfam annotation: Domain name=SIR2; Domain location=50-216; Score =239.0; E_value=1e-68; Accession=PF02146.8; Description=Sir2 family
MRQPRRRLRLARYKKNRRKVHQRFRQRIFERDRQVELAAHPQPHVVVLTGAGISAESGIRTFRAEDGLWEEHRVEDVATPEGFRRDPALVQGFYNARRRQLQQPEIQPNAAHKALAELEQVLGDNFLLVTQNIDNLHERAGSQRVLHMHGELLKVRCEHSGQVLAWTEDVGPDDRCTCCQFPSRLRPHVVWFGEMPLGMEEIYQALEQADLFIAIGCAYRGAESGPQSGRALRVSPHPGLLPAGEGEKRAGLKLRLNPVGSFPQAKSGTHEPSPNAESSTNEPSPSGRGQGEGQAAPNPHLRTSPSRFQLLEQRFVLHAGGTDIVLPLAVFDHVSRRIE

SEQ ID NO: 216833 - protein, 602 aa, Glycine max
  Coding DNA Sequence Number=SeqID_100055
  Homolog annotation: Hit_ID=UPI00005F7E5C; Match level="QueryCoverage =44%, HitCoverage=87%, E-value=5e-71, Identity=51%"; Hit description =COG1879: ABC-type sugar transport system, periplasmic component
  Pfam annotation: Domain name=Peripla_BP_1; Domain location=58-334; Score=-15.3; E_value=1.1e-05; Accession=PF00532.11; Description =Periplasmic binding proteins and sugar b
DPPVDEGASCPEAMMVRNTAQISLFSNYRKPLTLESAMKTLKAILLLGLLTSSASALAEKIGVSMAYFDQNFLTIIRHAIDKEAKARGLDAQFEDARGDVGLQTDQVQSFISAGVDAIIVDPVDSASTPQLTRLAQQAKIPLVYVNRTPGDKTLPPGVVFVGSDERESGTLQMEALAKLANYKGNVAIMIGNLTDAGALQRTKDVEQVVAKYPGMKVVQKQPANYARNEGMDLMLNWIGNGEAIDIVAANNDEMAIGAAMALAKSNKKILVGGIDATPDGLKALAQDKMQVTVFQDAIGQGKTSVDVAQKLIKGEKVASHVWIPFELGRYLWRPGLPGAHECAPYRYSANTVGAPFMATWFLVRMNAHPTDILGAIYGDLVTGRPGSRPTQPSLAQYRHDDDVVVLALAQAGFALHAFLLKAQALIQTQRALVVVKHFQLNADHAQPVKGIVDTGADQPLTDATTAKRRIDANTKTDAVTRTQPLFGKQRQLAHHLPVDFRHKADIAFAVHTLEFFLPGGDAGKRQLRGPAIHLGMTDAPHRFPTRQRVAVLPLLSASGVAKFCRAADCRTGAGADRSGAFQLSQPYYRSGQSHHARHAVQR

SEQ ID NO: 216834 - protein, 140 aa, Glycine max
  Coding DNA Sequence Number=SeqID_100056
  Gene Ontology: Mol. function=isomerase activity; Cellular component =integral to membrane; Biological process=protein folding
  Homolog annotation: Hit_ID=Q1S1L9; Match level="QueryCoverage=100%, HitCoverage=16%, E-value=1e-44, Identity=65%"; Hit description =Peptidylprolyl isomerase, FKBP-type; Tetratricopeptide-like helical
  Pfam annotation: Domain name=FKBP_C; Domain location=1-134; Score =53.5; E_value=7.1e-13; Accession=PF00254.18; Description=FKBP-type peptidyl-prolyl cis-trans i
MDCPLHDSLLRVHYKGTVLNEEKRVFYDTRVDNDGQPLEFYSGEGLVPEGFEMSVRLMLPGEIALVTCPPDYAYDKFPRLLMKCGQLPIECDFYLMIHCHSVLFLFFIGILPPFITRPVNVPEGAHIQWEIELLGFETPK

SEQ ID NO: 216835 - protein, 209 aa, Glycine max
  Coding DNA Sequence Number=SeqID_100057
  Gene Ontology: Mol. function=protein-tyrosine kinase activity; Cellular component=integral to membrane; Biological process=protein amino acid phosphorylation
  Homolog annotation: Hit_ID=Q1SMM8; Match level="QueryCoverage=52%, HitCoverage=17%, E-value=9e-39, Identity=66%"; Hit description =Protein kinase
  Pfam annotation: Domain name=LRRNT_2; Domain location=30-71; Score =50.4; E_value=6e-12; Accession=PF08263.3; Description=Leucine rich repeat N-terminal domain
  Pfam annotation: Domain name=LRR_1; Domain location=122-145; Score =15.3; E_value=0.22; Accession=PF00560.23; Description=Leucine Rich Repeat
  Pfam annotation: Domain name=LRR_1; Domain location=74-96; Score=6.1; E_value=21; Accession=PF00560.23; Description=Leucine Rich Repeat
  Pfam annotation: Domain name=LRR_1; Domain location=98-120; Score =14.4; E_value=0.42; Accession=PF00560.23; Description=Leucine Rich Repeat
  Pfam module annotation: Pfam domain module=LRRNT_2::LRR_1::LRR_1::LRR_ 1; Domain location=30-71::122-145::74-96::98-120
MESIWGPFGLWLRIYVGLISLWGTQQCSSLNDEGLTLLEFRGRITSDPFAALANWNPNDCNPCKWLGVRCVDGQVQSLVLPDLSLEGTLAPELGKLSHLKSLVLYKNSFSGTIPKELGDLDKLELLDLRGNDLTGCIPAEIARVLLSKNLLVCDNKFEGSDSQELRKLRLPSNNNNRKFVHQWSFCILSSIGTNLHSEFLMALLIVLTP

SEQ ID NO: 216836 - protein, 532 aa, Glycine max
  Coding DNA Sequence Number=SeqID_100058
  Gene Ontology: Mol. function=protein-tyrosine kinase activity; Cellular component=integral to membrane; Biological process=protein amino acid phosphorylation
  Homolog annotation: Hit_ID=Q1SMM8; Match level="QueryCoverage=94%, HitCoverage=76%, E-value=0.0, Identity=67%"; Hit description=Protein kinase
  Pfam annotation: Domain name=Pkinase; Domain location=229-501; Score=- 23.5; E_value=3.7e-07; Accession=PF00069.15; Description=Protein kinase domain
  Pfam annotation: Domain name=Pkinase_Tyr; Domain location=241-501; Score=-76.4; E_value=8.7e-08; Accession=PF07714.7; Description =Protein tyrosine kinase
  Pfam module annotation: Pfam domain module=Pkinase::Pkinase_Tyr; Domain location=229-501::241-501
MEDSFVIPLKGALKNYLNAVIAVALPLFKLGKATPHAYEEKYCDNLTKFVQNVVDSARRKLLDQSSNLAAEHFSGGPAIEISSIPIAQSSGAFPAVPDTNKKQNQSPAPLPSPSVSPHVNQASQQNSPNGASGKLWKYIIIITGVAVLVILVVIMLCIWRKRAAKVIKPWKTGISGQLQKAFITAQSKIPAKCYQGIDLLSWIGILEEVIGSRYGVPKLNRGELETACEDFSNIINSFDECTVYKGTLSSGVEIAVDSTIVASANDWSKNMETAYRKKIAALSRVNHKNFTNLIGYCDEEEPFTRMMVFEYAPNGNLFEHLHGNNFQHSLKAQEVEPLDWSTRMRVIMGTAYCLQYMHHDLNPPVAHSNLNSIAILLTDDFAAKISEISFGKHAKTNTTGDESHKSSELPPQADPETDVYNFGVLLLEIISGKLPYSEEQGHLANWAAEHLNDKQSISYLIDPTLQSFKDEELDVICEVIKDCLQSDPRLRSTMKEITPRLREVLHVSPEQAVPRLSPLWWAELEILSVEAT

SEQ ID NO: 216837 - protein, 47 aa, Glycine max
  Coding DNA Sequence Number=SeqID_100059
MGEKGAGKEVPLCVETEGSTMFDDMMQCNAMQCTLVVTGVGGEGGER

SEQ ID NO: 216838 - protein, 67 aa, Glycine max
  Coding DNA Sequence Number=SeqID_100060
FSAAYVCGLLGHTCDTCDIMAANDGVRPWEPEIRADVRRAGGGGGGGGRSRWLRGEGESNSKWINND

SEQ ID NO: 216839 - protein, 123 aa, Glycine max
  Coding DNA Sequence Number=SeqID_100061
  Subcellular localization annotation: CTP_CleavageSite=38; ConfidenceScore=5.30e-01
MNCVFVHVFSTFEFGAMRSDCLVQFSILNLFRSPMNCVFVHVSSTFEFGVMRSDCLVQFSILNLFRSPMNCVFVHVSSTFEFGAMRSDCLVQFSILNPFFRSPMNCVFVHASSTQEFGAMLHD

SEQ ID NO: 216840 - protein, 131 aa, Glycine max
  Coding DNA Sequence Number=SeqID_100062
  Subcellular localization annotation: CTP_CleavageSite=48; ConfidenceScore=5.32e-01
MSFLFRKSFCLHFQKALLLVFHFFLRHCLWFVGVATLSAAVKVKFPASSFAVVGGGKRGTQMVFVRRGRTDDFRIKLIRKFQINLILISERADMDYENAQSCGANEPHVDCLDAFKTSQVFECQEDVLRWA

SEQ ID NO: 216841 - protein, 434 aa, Glycine max
  Coding DNA Sequence Number=SeqID_100063
  Homolog annotation: Hit_ID=Q1S1L9; Match level="QueryCoverage=28%, HitCoverage=20%, E-value=6e-50, Identity=81%"; Hit description =Peptidylprolyl isomerase, FKBP-type; Tetratricopeptide-like helical
  Pfam annotation: Domain name=TPR_1; Domain location=9-42; Score=23.7; E_value=0.00064; Accession=PF00515.18; Description=Tetratricopeptide repeat
  Pfam annotation: Domain name=TPR_2; Domain location=9-42; Score=23.7; E_value=0.00067; Accession=PF07719.7; Description=Tetratricopeptide repeat
  Pfam module annotation: Pfam domain module=TPR_1::TPR_2; Domain location=9-42::9-42
VLEANPAHVKGLYRRGMAYMAAGDFEEARADFKMMMKVDTSTESDATAALQKLKQKEQDVEKKARKQFKGLFDKKPGEIAEAKADVDGDLITSEIQKDDEVHGDSDGTNSEDSHEAPPEAQRTGIFVRIVIPPSPQKKKKKKSKSRKRANEIDVVEGAPRGQRLRLQTIHFSNVGVDTEELTIPKLCLQSTCCHELDASSSIDKELLANKEKFLGEVENLMKDRASSVKVLKGALMTNEELNNKIETLQSRVKLLKDKEIGWERKVKEAKDYATLAWIEVGKLKKSLLEKNHIIDIERSVEVKVEGFASLAKGEVVEQHTKWFEKAKRHVIFLGFTNVVDLDVIKDVYDCEIRPLAEVSHGFHDTPATHVTNVAKPEVEAFEVPSTPTKTCTTHSEEIGEMSKKRNMSLTVMRRLRMYGKFNYGKDEAYDGFSS

SEQ ID NO: 216842 - protein, 380 aa, Glycine max
  Coding DNA Sequence Number=SeqID_100064
  Gene Ontology: Mol. function=type I protein secretor activity; Cellular component=1-2nm peptidoglycan-based cell wall; Biological process=protein transport
  Homolog annotation: Hit_ID=Q7WBM8; Match level="QueryCoverage=64%, HitCoverage=51%, E-value=1e-121, Identity=89%"; Hit description=HlyD- family secretion protein
GLTSRELQVTRPLLKSGAVSEVDLLRLQRDVARYCGEQKGAEAQIDRIQASIKEAQSKLEESELNIRNQARNELSETNTKLATLREGKLALADRVKLAEVRAPVRGTVKTLFNNTVGGVVQPGKDIIEIVPKDDTLLLEVRILPRDIGFLHPDQKAEVKFTAYDFAIYGGLEGKVEQIGADTVTDEKGNSYYVVRVRTDRSTVGDKNLPIIPGMVAEVHVLTGKRTVLQYLLKPVLRAKANAFTEPLARPGSGALAGGPRARPGGPAALARAGPRPGGTGHRPAATAVLAGPRLECPARRAAGGGGQRQPQRRTGRPGAGRRRFGVLPQLRPGAGPGAGAGGGRLRRHLDGSFVGDAPAAAGHGARAGQPVLGQRHPDRA

SEQ ID NO: 216843 - protein, 163 aa, Glycine max
  Coding DNA Sequence Number=SeqID_100065
MALGVMAARPSELLLHPEVTLLAQASCTSYNILLRGPPLNSLGAIVPTPHFAMKFPLVEGRIATIHVVQKMTRECYAAKLKMTPLCTRMGTWLSKKCDKQITKVLQANANLFAWTTFDMLGTDPKFHFQRILIFPDARLTAQKEEKVGGRKKKGSDRGNCKLD

SEQ ID NO: 216844 - protein, 240 aa, Glycine max
  Coding DNA Sequence Number=SeqID_100066
  Gene Ontology: Mol. function=RNA-directed DNA polymerase activity; Cellular component=mitochondrion; Biological process=RNA-dependent DNA replication
MGAKRIICQTESKIATDHITGTSQVKKAHHLGYYHKVKNLVQEFDHEKVKHILKDQNSRANELAKLASTKKPGQHHIVIKHTLLDPSVGGKECMEVTMEPWHFLGKRKEKSQTSAWHNKQSRSLNKLGPEIKYYTKHKLKVQGARYTTIIGELYRRGFFALLLKCLTKTRSEYVLEEIHKGICGVHTRGQSMATHVQCVGYYWPTIGSDCIDYVKKCSDCQKHGNLIHQPANELHKIVSP

SEQ ID NO: 216845 - protein, 83 aa, Glycine max
  Coding DNA Sequence Number=SeqID_100067
MSTFTRDSPQISASPHQLDLAPYASGPYNAQWNAPGLLHDKHTLRSSRILGEMVVDEPWLGLWLPLNYQVVFVIGSAVDRLCG

SEQ ID NO: 216846 - protein, 44 aa, Glycine max
  Coding DNA Sequence Number=SeqID_100068
VFTLVIQRHSSSTSHEILLCWARTIKFDSVGKRHGYPTLSLSRR

SEQ ID NO: 216847 - protein, 72 aa, Glycine max
  Coding DNA Sequence Number=SeqID_100069
MVLGLGLNQEGEAVMDSSKSRPWGKYTRVWSVFSCTPKRPTRFFTYMEQMTKWVALKNLMLEDIGTQCSNRM

SEQ ID NO: 216848 - protein, 157 aa, Glycine max
  Coding DNA Sequence Number=SeqID_100070
MHKFVLFHLIECIPYDLPHIIYLYVLCITKFMGGLEDIYYTSLVNKILWEQGVYQVFNGLDEASRNKIMVKGSMIAKQQNLGPLNIKSIRLAMNIGQREVPQVNKEEIAKKRKKGLGSSSSMDSFAFWKMNGIGMEKEEREEMPLQGEDESRRSSPP

SEQ ID NO: 216849 - protein, 177 aa, Glycine max
  Coding DNA Sequence Number=SeqID_100071
  Homolog annotation: Hit_ID=Q00M75; Match level="QueryCoverage=18%, HitCoverage=5%, E-value=4e-10, Identity=96%"; Hit description=PPR -repeat containing protein
MRASPGAAVKLCLGDLLVMGSNPETASLHMQGIRPGEFELDQLAQASQILLGQVLQATNMSSSIKQPFSPSSLPLNPPPTSPTSSSTTDDRHEKPLLVVGPPHEEEQFNQCEIFRTQLKDLVDNKASNPSFVVSSRSMLPEDPGNVNPGHEFICMYVECDFFDVDDDVDVDNNTEMR

SEQ ID NO: 216850 - protein, 116 aa, Glycine max
  Coding DNA Sequence Number=SeqID_100072
  Gene Ontology: Mol. function=actin binding; Biological process =cytoskeleton organization and biogenesis
  Pfam annotation: Domain name=Transposase_21; Domain location=22-116; Score=-26.6; E_value=2.4e-12; Accession=PF02992.5; Description =Transposase family tnp2
MPKYPRCGVSRYKVKDDDERAKDLTWHGNGRNCDGMLRHPADSSQWKKIDRLCLDFEKEARNLRLGLATEEMNPYGSLSTQHSSWLVLLENDIDVYLSPLIEDLTKLGDEGVLVFD

SEQ ID NO: 216851 - protein, 378 aa, Glycine max
  Coding DNA Sequence Number=SeqID_100073
  Gene Ontology: Mol. function=acetate-CoA ligase activity
  Homolog annotation: Hit_ID=Q0Z6Q0; Match level="QueryCoverage=42%, HitCoverage=41%, E-value=4e-78, Identity=90%"; Hit description=Acyl -CoA dehydrogenase, type 1:Acyl-CoA dehydrogenase, central region:Acyl-CoA ...
  Homolog annotation: Hit description=dehydrogenase-like:Acyl-CoA dehydrogenase, C-terminal type2
MRRIGDEALVAVDHIVVPVPDGGGAQRGRVRARLGLGQRERGHDLARGQLGQPGRLLLGRAVDEDALRAYAHGRADHRAEGRRGLAQLEEHAHLFLHGQLQPAELLGDGHAEQAQVAHLLHDGLGNLVGLGHFVLGGHQALAHKAAHAVQQGFEGFLVADHCGQAAAVGVDGQPPAGRDAAPGHEGAALALGAKAQVLQEQQGVDGEGVVHLGHVHVLGRDARHGIGAAARYAGGGDGQVFHRRDLPVPDGGGVAQHVDRRARQVAGAVGAHQHVGAGAVGDQAAIAHAQGIGHHARGQDLLQRGRLAQLRLGIELGPLVGGQRDLRQVFAAGAVLVHVARRGQRIRRQRAQRVVRRLVGLRIELLAHAADLGAAQRR

SEQ ID NO: 216852 - protein, 87 aa, Glycine max
  Coding DNA Sequence Number=SeqID_100074
  Homolog annotation: Hit_ID=O64438; Match level="QueryCoverage=60%, HitCoverage=22%, E-value=3e-21, Identity=86%"; Hit description=ARG10
  Subcellular localization annotation: CTP_CleavageSite=55; ConfidenceScore=5.11e-01
MFCLFQHITSKIILVKGSCGKSLASFPRGCFYSTTVRGLRCYENPKNKITAIPVEEEEIWGAFFKVILELKKLELNIHYVTRIASCN

SEQ ID NO: 216853 - protein, 363 aa, Glycine max
  Coding DNA Sequence Number=SeqID_100075
LDEFKAELERRNFHKRLTNLADSSIDLALVKEFYANLYSPEGPSPKQVRIQGHLIRIDADSLNAFLETPVVLVEGESLPAYSRYYRMPTDIREIEVALCIPGRGFILNVEGHPGKIIRKDLTTLAQVWSVLSYSNLAPTSHTSDLTVDRARLIFGLVTQLDMNDGALISRQITSMAQSNSYRLGFPALITTLCRSRGVASDSLVFERLSPGARTPRARPVEAPSTIVAPHPASTSAAPPSAPWPGTQPPLHREDEDPATQVPHQPEDESSESSTPEPLIRKKRVVVTQEVATTSEKSLEATLELPTPVVDSTSPQQATDPSTPEDQNNPVLSPNTSPVATLVLHLSKEEEGQTQNTQDQLQDL

SEQ ID NO: 216854 - protein, 83 aa, Glycine max
  Coding DNA Sequence Number=SeqID_100076
  Subcellular localization annotation: CTP_CleavageSite=63; ConfidenceScore=5.68e-01
MVGMSPPPPKTSQSLKNSFKALQDASFASDNTLSACLQGRFSSRFVCLAECAGASLSGTYSLSAQTRLSATPDSALHKISFFT

SEQ ID NO: 216855 - protein, 82 aa, Glycine max
  Coding DNA Sequence Number=SeqID_100077
MTSGLSLSSPGRAATAPSDPFPINRRARGAERGFEHEVVKEIERIKREEEERRGNEVEALLNCDGDQSLRCSLFSVLRATVG

SEQ ID NO: 216856 - protein, 121 aa, Glycine max
  Coding DNA Sequence Number=SeqID_100078
  Gene Ontology: Mol. function=transition metal ion binding; Cellular component=cytoplasm; Biological process=cytoskeleton organization and biogenesis
MEYQKIHACPNDCILYRHEFQEMSKCPIFGTSRYHIHVENSNKDEEESNSDENSNKGPAAKVLWYLPIIPRFKCLFANEDDAKDLTWHANGRISDGMVRHPTDCLQWKKIDGLYPDFGKKT

SEQ ID NO: 216857 - protein, 363 aa, Glycine max
  Coding DNA Sequence Number=SeqID_100079
EDVPVSLASPSSRRVGCDSKLNLYVNLRRFDKPFRPGNNSEEYHQGDMNVEECNLDWFKGSLVARVHEVGNIQNIKELFVVEGSEEWLSEIFESIDNWSEETTMEFRLTWVRISNVSLKVWRQRCFEQIVYARVLIHTTTTETMDFTQRRKNNGKLHMIKMVEETILKKINTQGLCERCMGELWNEDSEDGSSVKGLDIVWGFKHARMFAKPKVMGRRRCGGGSHFSVKGWVSMGGFEFLSEGEKETSLHSLDMPHSEIEKDFEAKEVGGSCDCNEIGDNLSVGPSEEHLKKLILEEEEGDISQAKSVMGEHEGTKNNHGGGKRPYDIEIEFFNKGAKVHREVVHCLFGEHKIEDREGGWVRR

SEQ ID NO: 216858 - protein, 55 aa, Glycine max
  Coding DNA Sequence Number=SeqID_100080
MGIEHFEVVKRRSHANKQCLIEAEWIWKKDDWRRRFKEKMSQEQAHHHRKPWIRV

SEQ ID NO: 216859 - protein, 80 aa, Glycine max
  Coding DNA Sequence Number=SeqID_100081
FKIPINLWGICIYVFVQWGHMEERERDWTAMNSWEERKGWVSSTQRHYWKVASEFFNYKITSGNQPPRALVTVPLVGCPL

SEQ ID NO: 216860 - protein, 114 aa, Glycine max
  Coding DNA Sequence Number=SeqID_100082
MSMKQDQTTKRDSSGLAHEDKPEESSSTPARAYHVCSLLSEAVVSFALSARLALSQISLTRAKRTFEVRKPFLSLICTKKKEREHDDVKEVLIDYELCAENRGKAEQESKGPNF

SEQ ID NO: 216861 - protein, 61 aa, Glycine max
  Coding DNA Sequence Number=SeqID_100083
  Homolog annotation: Hit_ID=Q1T3B0; Match level="QueryCoverage=64%, HitCoverage=14%, E-value=2e-08, Identity=65%"; Hit description=RNA -directed DNA polymerase
MDTISLLVKDFGTYFMRTSQSRLGFYEVWIKWIKGCVELASVSILVNGSPTDEFGMQRGLR

SEQ ID NO: 216862 - protein, 171 aa, Glycine max
  Coding DNA Sequence Number=SeqID_100084
  Homolog annotation: Hit_ID=Q51613; Match level="QueryCoverage=32%, HitCoverage=64%, E-value=8e-16, Identity=90%"; Hit description=, complete genome
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTPLLASKLGREADSKEKVFVLLVRPIFEALGKQNKHVLSSSALCLARIIDNIHHPPLSLLGIL

SEQ ID NO: 216863 - protein, 237 aa, Glycine max
  Coding DNA Sequence Number=SeqID_100085
  Gene Ontology: Mol. function=DNA binding
  Homolog annotation: Hit_ID=Q1S0F5; Match level="QueryCoverage=83%, HitCoverage=40%, E-value=1e-21, Identity=34%"; Hit description=IMP dehydrogenase/GMP reductase
MGQLQLQAFYKTYGKIWDLAMIEVSVEAIASLVQYYNQPLRCFTFGDFQLVPTIEEFEEILGCPLGGRKRYLFSGLHPSMARMAKVVKVLAQELDRVKQNRNGVVRIPRKHLEEKAKALADQGEWALLIDVLVLLVFRAILFPNMDGLVDIVAIDAFLAYHHSKESPVVVALADAYDTFDWRCEKSGPRIVCYTPGLYVWLVSHLFRYESRPVCPLQGHCLCAEKGKANWEQLLAGM

SEQ ID NO: 216864 - protein, 288 aa, Glycine max
  Coding DNA Sequence Number=SeqID_100086
  Gene Ontology: Mol. function=pseudouridylate synthase activity; Biological process=RNA processing
  Homolog annotation: Hit_ID=Q00M75; Match level="QueryCoverage=11%, HitCoverage=5%, E-value=2e-07, Identity=82%"; Hit description=PPR -repeat containing protein
MTGRLRMILAHHSSVEPCQGAVTEHRVLGPKINGCSWVELCPLTGSIRKRERVNSISICQNIFGMSSTQIISRICCGITNRGWFWVELLLLQSQNFGLIPRQPHWKKNSKVYNSEVRASPDAAVKLCLGDLLVMDSNPETVSLHMQGKTAYNIPLLYLRIAKSLWAMRYELRVHCAEALGTPIVGDYKYGWFVHSRWKQMPRVDIEPTTGKPEGLDVQKGSVLSKVPLLHLHCRELVLPNIAKFLHVLNNSSEELRTSLREQPDVLRFVATMPSHMRISWNLMSSYLV

SEQ ID NO: 216865 - protein, 901 aa, Glycine max
  Coding DNA Sequence Number=SeqID_100087
  Gene Ontology: Mol. function=hydrolase activity, hydrolyzing O -glycosyl compounds; Biological process=carbohydrate metabolic process
  Homolog annotation: Hit_ID=Q5BMA5; Match level="QueryCoverage=99%, HitCoverage=97%, E-value=0.0, Identity=76%"; Hit description =Putative endo-1,4-beta-xylanase
  Pfam annotation: Domain name=CBM_4_9; Domain location=14-169; Score =79.8; E_value=8.3e-21; Accession=PF02018.8; Description=Carbohydrate binding domain
  Pfam annotation: Domain name=CBM_4_9; Domain location=186-339; Score =80.3; E_value=6e-21; Accession=PF02018.8; Description=Carbohydrate binding domain
  Pfam annotation: Domain name=CBM_4_9; Domain location=357-515; Score =105.3; E_value=1.8e-28; Accession=PF02018.8; Description =Carbohydrate binding domain
  Pfam annotation: Domain name=Glyco_hydro_10; Domain location=552-845; Score=238.0; E_value=2e-68; Accession=PF00331.11; Description =Glycosyl hydrolase family 10
  Pfam module annotation: Pfam domain module=CBM_4_9::CBM_4_9::CBM_4 _9::Glyco_hydro_10; Domain location=14-169::186-339::357-515::552-845
MAGIISGPSGSEGVNILLNHDFSSELNSWHLNNCTGYVISAESGNQGGISMESNVNYVVITDRKECWQGLEQDITNRISIGSTYTVSACVGVSGLSQRSSDVIATLKLEYHDSATRYLFIGRTSVNKDSWEKLEGTFSLSTMPHRVIFYLEGPAPGVDLLIRSVEINCSTPNNSTTSTGCVSAGDDNIIINPQFDDGLNNWSGRGCKIMLHDSMNDGKIVPKSGKFFASATERTQSWNGIQQEITGRVQRKLAYEVTALVRIFGNNVSTADVRATLWVQTPDLREQYIGIAKVQATDKDWVTMQGKFLLNGSPSKVVLYLEGPPPGTDILLNNLILKHAAKTPPSTPPDLKNIAFGVNIIENSNLADSTNGWFPLGNCTLSVKTGSPHIIPPMARDSLGSHEFLSGRYILVTNRTQTWMGPAQTITDKVKLFVTYQVSAWVRIGSGSSGPQNVNVALGVDNQWVNGGQTQVSDDMWHEIGGSFRIEKQPSKVMVYVQGPASGVDLMVAGLQIFPVDRHTRFRYLKIQTDKIRKRDVILKFSGLDSGSYANTSVKVIQTQNDFPIGTCISRMNIDNEDFVNFVVKHFNWAVFENELKWYWTEPQQGNFNYKDADNLLSLCQKHKIQTRGHCIFWEVDETVQQWIKSLNKNDLMTAVQNRLNGLLTRYKGKFSHYDVNNEMLHGSFYQDRLGKDIRANMFKTANQLDPSATLFVNDYHVEDGRDTRSSPDKYIHHILDLQEQGAPVGGIGIQGHIDSPIGPIVSSSLDKLGILGLPIWFTELDVSSVNEYVRADDLEVMLREAMAHPTVEGIMLWGFWELFMSRDNSHLVNAEGDINEAGKRFLSLKQEWLSHSRGHVDEQGQYNFRGFHGTYDVQVVTPSKKISKTFVLDKGDSPLVVSIDL

SEQ ID NO: 216866 - protein, 174 aa, Glycine max
  Coding DNA Sequence Number=SeqID_100088
  Homolog annotation: Hit_ID=Q51613; Match level="QueryCoverage=32%, HitCoverage=64%, E-value=4e-17, Identity=92%"; Hit description=, complete genome
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTTNIHKRVELGELAAAKLFKVEPHNFGNYMLLSNIYALAGRRKDVGKVRDKMRKQGVKKTIAMGIL

SEQ ID NO: 216867 - protein, 94 aa, Glycine max
  Coding DNA Sequence Number=SeqID_100089
  Subcellular localization annotation: CTP_CleavageSite=53; ConfidenceScore=5.44e-01
MNSDCKLFGHRGAKLGGNTSSKGPRNKGVRMMPFDVRVEPAALMRRKSSSKVVVEVGGGGAERVQWSRNRGGGGREGRDHGHIREKKKGKEKIG

SEQ ID NO: 216868 - protein, 459 aa, Glycine max
  Coding DNA Sequence Number=SeqID_100090
  Gene Ontology: Mol. function=sugar porter activity; Cellular component=membrane; Biological process=transport
  Homolog annotation: Hit_ID=Q665C4; Match level="QueryCoverage=70%, HitCoverage=98%, E-value=1e-117, Identity=69%"; Hit description=ABC sugar transporter, permease subunit
  Subcellular localization annotation: CTP_CleavageSite=34; ConfidenceScore=5.32e-01
MVPSEARIGETPIQATSAPLSAPIATATSRPATSASARNSGWSGWLTMIAAITSEQALAPAMIDRLMPPVSMVMPMPSASRPRIGSCEAIDWKLPRLKKRDPSSPANSSATAMMIAPCRRMIRSLGINRVNCVMSDLLEQLAFFVPGSGADADQNDRAAEYLVPIGRDAEQRQPVLQEGQQHHAEQGTGQRAAAAAHAGAAQHHRRQYRQLEAEQRVGGHRLGDLRLHHRRDAGQNAHVAVDAKMQPQQVQPQARRRVAVAAHGVDLAPQPGAVHQHAGDDDGRQQAQQRQRQAVVVAVGALEREPVDAVHEPVRKAVQPGTVGGVHQQAVEQVEGGDGDDDCRHFQPVHQETVHQPEQQANANRQGERQREAAAVLDHPAGHHVLSDGGDRRERNVDAAGDQHHEQPAGQDAENGVAGGDVGQVAERQKLVGAGAQADRQQQHQQAEIKLVPPGQAGQ

SEQ ID NO: 216869 - protein, 151 aa, Glycine max
  Coding DNA Sequence Number=SeqID_100091
  Gene Ontology: Mol. function=nucleoside-triphosphatase activity; Cellular component=membrane; Biological process=carbohydrate transport
  Homolog annotation: Hit_ID=Q665C3; Match level="QueryCoverage=99%, HitCoverage=30%, E-value=3e-69, Identity=86%"; Hit description=ABC sugar transporter, fused ATP binding domains
  Pfam annotation: Domain name=ABC_tran; Domain location=3-129; Score =13.4; E_value=1.1e-08; Accession=PF00005.17; Description=ABC transporter
MEQSIYDNTIVTVFDRLHTSLGLLDHAKATELVNRLIRDLNIKVSDSALPVKTLSGGNAQRIAIAKWVATQPKILILDSPTVGVDIANKEGIYQIARDLAQLGMAVLMICDEIPEAYYNSHRVMVMRKGELIAEFAPHQSTEQQIAEVVNG

SEQ ID NO: 216870 - protein, 71 aa, Glycine max
  Coding DNA Sequence Number=SeqID_100092
  Gene Ontology: Mol. function=transcription factor activity; Biological process=regulation of transcription, DNA-dependent
  Homolog annotation: Hit_ID=Q7W7H4; Match level="QueryCoverage=98%, HitCoverage=23%, E-value=1e-23, Identity=75%"; Hit description=LysR family regulatory protein
MGIDQGDRHGGGAVSGQDFHQFTGVEQVLHVVARDLHQPQPGAAAGDIALGVVDHHPAGQFEPLGMAVVGQ

SEQ ID NO: 216871 - protein, 89 aa, Glycine max
  Coding DNA Sequence Number=SeqID_100093
KQLLRECHILSNIEAKEIKGISVLAEHGEMPLQWLKGRQPLMLWATHWGKSGVTKSLDIHFTTLRKEEELEKEMERVAAFNIPVVAENE

SEQ ID NO: 216872 - protein, 242 aa, Glycine max
  Coding DNA Sequence Number=SeqID_100094
  Gene Ontology: Mol. function=metal ion transporter activity; Cellular component=integral to membrane; Biological process=response to nematode
  Homolog annotation: Hit_ID=O64738; Match level="QueryCoverage=83%, HitCoverage=62%, E-value=9e-71, Identity=64%"; Hit description=Zinc transporter 6, chloroplast precursor
  Pfam annotation: Domain name=Zip; Domain location=21-241; Score=88.3; E_value=2.4e-23; Accession=PF02535.12; Description=ZIP Zinc transporter
MAECVTDLAQAAACRNSAAATHLKVISICTIFVTSVMGVSTPVMLARYFQGKSLYDIAILLIKCFAAGVILATSLVHVLPDAFAALSDCQVASQHPWKDFPFAGLVTLIGVLMALLVDTVASSHMEHGHYTPVETLEKEGGSSAWSIELAGGGGEVQRVEELMRLKQRLVSQVLEIGIIFHSVIIGVTMGMSQNVCTIRPLVVALSFHQIFEGLGLGGCIAQPGGSTSSRAAATAVELQFAL

SEQ ID NO: 216873 - protein, 71 aa, Glycine max
  Coding DNA Sequence Number=SeqID_100095
MEFQAEALGQLTSDDLEKIKVSIVCSSHLHMCTPLNLNRNDFVLWLQLNNGAILPRKGQVTSAMSKRLQED

SEQ ID NO: 216874 - protein, 101 aa, Glycine max
  Coding DNA Sequence Number=SeqID_100096
MTSITNQIPQLTWAWEQLHRDWEWQSCSWERLNNVHKKFSEEEIRAKKMRFVPFTSGGNKTMMKERARGTFSTTRERFTILEGSRVKERLKEESFGRGHEK

SEQ ID NO: 216875 - protein, 70 aa, Glycine max
  Coding DNA Sequence Number=SeqID_100097
MDFNTLTTCTVVMAFTSLEDGLVVVFLNLPKMGDHINVVVHHKDKFKRDEHDTLEYVNGEYCIWEGVDKH

SEQ ID NO: 216876 - protein, 127 aa, Glycine max
  Coding DNA Sequence Number=SeqID_100098
MKVDYGVHIDERKIFKTLKEARLMVEDIVDLETRTTRGGFLIICVQVLETTNRMIGPSCQTFRRMRLSAHNLHLKMKKEKMFNQLTPAFRPPLVKPPTTIIIAFPSALSPRMIQPNFMDFIPTPRLS

SEQ ID NO: 216877 - protein, 68 aa, Glycine max
  Coding DNA Sequence Number=SeqID_100099
MPKILSDDELVDVVIDQVAEEVKEQNGIDSKIEEHEVVANGDLKKVTKIDDGIVSENVNAPVTENGDA

SEQ ID NO: 216878 - protein, 65 aa, Glycine max
  Coding DNA Sequence Number=SeqID_100100
MLHLLNVCWCFHGEVAPHLRNKVLQVQDIFEEAKIIAWKWLRTRSKGFVHSSGLLDDKLNSMSWR

SEQ ID NO: 216879 - protein, 73 aa, Glycine max
  Coding DNA Sequence Number=SeqID_100101
MVIRAHILLSYDPRVRWHVEKPYGYLHPIIRRPEARLARKDQCGHLHPSQRCQRLPVETANKSQFCDRDPRVR

SEQ ID NO: 216880 - protein, 238 aa, Glycine max
  Coding DNA Sequence Number=SeqID_100102
  Gene Ontology: Mol. function=RNA-directed DNA polymerase activity; Cellular component=chromatin; Biological process=chromatin assembly or disassembly
  Pfam annotation: Domain name=zf-CCHC; Domain location=170-187; Score =6.8; E_value=0.075; Accession=PF00098.13; Description=Zinc knuckle
MPPPASPSSFHRIKLEVPRFDGTNPLGWIFKINQFFEYHPTPETERLTIASFYMEGRALACTVNTYLLEFEDLANRIIGLPPPFLLSCFISGLAPEICHKVQTLHPLTLVQATRLARLSTLVSSTTLPPSSLPVVPLSPSLSLPPPMKSYPPLQLKRLSPEELALRQEGDLCFNCDEKFHRGHRCASKVFLLIVDEDKGFSLDNPDLGLSPDPPDPPTVPLAQISLHTLEGHLAPKTL

SEQ ID NO: 216881 - protein, 173 aa, Glycine max
  Coding DNA Sequence Number=SeqID_100103
  Gene Ontology: Mol. function=ubiquitin thiolesterase activity; Cellular component=intracellular; Biological process=ubiquitin -dependent protein catabolic process
  Homolog annotation: Hit_ID=Q6ZL19; Match level="QueryCoverage=73%, HitCoverage=30%, E-value=3e-26, Identity=41%"; Hit description =Putative carboxyl-terminal proteinase
  Pfam annotation: Domain name=DUF239; Domain location=31-172; Score =67.8; E_value=3.5e-17; Accession=PF03080.5; Description=Arabidopsis proteins of unknown function
MEGRSQASLTNMLVNGIRISSPLHNLKTTLAKGDIKVCNPSVDKDDEYSTSQVSLLTGPYKDFECVEAGWAVNPSVYGDRQTRLFVYWTADASNKTGCFDLTCPGFVQISNCPGCSNLSHINSWWASKYIIIIYIYKDPYTNNWWVQYGEKTNIGYWPPEKQYVTMRNVWSGG

SEQ ID NO: 216882 - protein, 593 aa, Glycine max
  Coding DNA Sequence Number=SeqID_100104
  Gene Ontology: Mol. function=RNA-directed DNA polymerase activity; Cellular component=chromatin; Biological process=chromatin assembly or disassembly
  Pfam annotation: Domain name=zf-CCHC; Domain location=51-68; Score =5.9; E_value=0.1; Accession=PF00098.13; Description=Zinc knuckle
  Pfam module annotation: Pfam domain module=RVT_1::zf-CCHC; Domain location=82-297::51-68
  Subcellular localization annotation: CTP_CleavageSite=38; ConfidenceScore=5.30e-01
MALSSTTLPPSSLPVVPLSPSLSLPPLMKSYPPLQLKRLSLEELALRREGDLCFNCDEKFHRDHRCASKVFLLIVDEDKGFSLDNPDLGLSPDPPDPPTHDGTWRFCVDYHVLNAIAIKDRFPIPTTDELLDELAGTTCFSKLDLLQDYHQILMHEADVCKTAFRTHHGHYEFRVMPFGLCNAPSSFQATMNSAFKSKTFCDHLNHLTKAFQVLLDGQFFLKLSKFSFAQFQVKYLGHVVLTKEVEPVPAKVHAIHGYESITAPLTNLLARDSFTWSTEAQTTFNDLKAAITTAPVLMLLDFMLPFTVETDAFGVGMSVVLSQKGHPIAFFSKPFSPKVLRASTYVWELFAIIVAVKKWRQYLLGNPFIILTDHHSLKELMMQVVQTPEQQTYLAQLLGYDYTTQFRSGKANVVANALLRIPELPPNTMLSLSVPCLTFLEELKQHLASNPAFNELRQTISATPIEHQDYSLANNLIMHHGGIWLPSASPFTQTLLKEYHSSPIGGHFGISKTLARGWLALSSPSTISAMGGSLPRFHNWVACLPRTHNYTYGGRPILEVVRDDSSNEPQAQHGPRHRPVRKVTTPSYLKDYV

SEQ ID NO: 216883 - protein, 424 aa, Glycine max
  Coding DNA Sequence Number=SeqID_100105
  Gene Ontology: Mol. function=glutamyl-tRNA reductase activity; Biological process=tetrapyrrole biosynthetic process
  Homolog annotation: Hit_ID=Q6AVG1; Match level="QueryCoverage=81%, HitCoverage=76%, E-value=1e-128, Identity=62%"; Hit description =Expressed protein
  Pfam annotation: Domain name=DUF266; Domain location=186-302; Score =188.1; E_value=2.1e-53; Accession=PF03267.4; Description=Arabidopsis protein of unknown function, DUF266
MQSRGLTLEEGKERINQSKPLRPVRLLVLFFALCVVFSLISIYTVKHFEIESVVTTVSSSFQPCYYEEPGGLDKWIRPPSSSIHNMSDKELLWRASFVPRIKGYPYPRVPKIAFMFLTKGPLPLAPLWERFLKGHEKFYSVYIHSLPSYQPQFPSSSVFYNRQIPSQSGGGNVDFLISVTWLVHQDKSVAGVKILSYWIVYTFRILQENGKVSEWGRMNMCDAERRLLANALLDISNEWFILLSESCIPLYKFSFVYHYIMKSKHSFVGAFDDPGPYGRGRYNEHMAPLVNVTKWRKGSQWFEVNRKLAITIVEDTTFHPIFEQYCRPACYVDEHYFPTMLTIQAANVLANRSITWVDWSRGGAHPATFGRNDITEEFFNRVRGGHICLYNNRNSSVCVLFARKFAPSALEPLLHMVDSKVLDY

SEQ ID NO: 216884 - protein, 121 aa, Glycine max
  Coding DNA Sequence Number=SeqID_100106
  Gene Ontology: Mol. function=protein kinase activity; Biological process=protein amino acid phosphorylation
  Homolog annotation: Hit_ID=Q2QZ78; Match level="QueryCoverage=90%, HitCoverage=19%, E-value=3e-33, Identity=62%"; Hit description=AT hook motif-containing protein, putative
MVASSGIVSLLLPGGRTAHSKFKIPVLVFEDSTCNIHQGTQLAELLNQTRLIIWDEAPMAHKFCFEALDHSLRHIIKHNSKDNTIFGGKVMVFGGDFRQIPPVIPRGSRNNSKLLSYLYTF

SEQ ID NO: 216885 - protein, 591 aa, Glycine max
  Coding DNA Sequence Number=SeqID_100107
  Gene Ontology: Mol. function=structural molecule activity; Cellular component=lateral plasma membrane; Biological process=signal transduction
  Homolog annotation: Hit_ID=Q6AT64; Match level="QueryCoverage=84%, HitCoverage=96%, E-value=1e-115, Identity=43%"; Hit description =Putative ankyrin
  Pfam annotation: Domain name=Ank; Domain location=170-202; Score =33.5; E_value=7.3e-07; Accession=PF00023.20; Description=Ankyrin repeat
  Pfam annotation: Domain name=Ank; Domain location=203-235; Score =15.8; E_value=0.16; Accession=PF00023.20; Description=Ankyrin repeat
  Pfam annotation: Domain name=Ank; Domain location=236-268; Score =23.2; E_value=0.0009; Accession=PF00023.20; Description=Ankyrin repeat
  Pfam annotation: Domain name=Ank; Domain location=269-301; Score =37.7; E_value=3.9e-08; Accession=PF00023.20; Description=Ankyrin repeat
  Pfam annotation: Domain name=Ank; Domain location=303-336; Score =37.2; E_value=5.8e-08; Accession=PF00023.20; Description=Ankyrin repeat
  Pfam annotation: Domain name=Ank; Domain location=337-390; Score=7.8; E_value=2.3; Accession=PF00023.20; Description=Ankyrin repeat
  Pfam annotation: Domain name=Ank; Domain location=391-423; Score =40.3; E_value=6.4e-09; Accession=PF00023.20; Description=Ankyrin repeat
  Pfam annotation: Domain name=Ank; Domain location=424-456; Score =46.0; E_value=1.3e-10; Accession=PF00023.20; Description=Ankyrin repeat
  Pfam annotation: Domain name=Ank; Domain location=457-489; Score=6.2; E_value=4; Accession=PF00023.20; Description=Ankyrin repeat
  Pfam annotation: Domain name=Motile_Sperm; Domain location=4-114; Score=16.0; E_value=0.00053; Accession=PF00635.16; Description=MSP (Major sperm protein) domain
  Pfam module annotation: Pfam domain module=Ank::Ank::Ank::Ank::Ank::An k::Ank::Ank::Ank::Motile_Sperm; Domain location=170-202::203-235::236- 268::269-301::303-336::337-390::391-423::424-456::457-489::4-114
MDRLIRLDPSNTVLIRVEPGQKCHGRITLHNVMYTMPVAFRLQPLIKTRYTVKPQSGIISPLATLTIDITYHLPQGSSLPHSFPHSNDSFLLHSVLVPGAAIKEPSSMFDAVPSDLFKKKQVFIDSAIRVMFVGPHILARLVTQGATDEIREVLEKSDPSWRNVNSTDPQGQTLLHLAISQGRADLVQLLLEFEADVEALNRSGSTPLEAASSCNEALIVELLLAHKANTERSELSMFGPIHHAARGGHVEVMRLLLLKGAKVDSLAKDGNTALHVAVEEHTKDCVRLLLANGARTDAKNTREGDTPLHVASAIGDESMVKLLLQKGGANKDVRNRQGRTAYDIAVENGHAHLYDALCLGDKLCVAARKGEVRSIHKLLENGAGINGRDQNGWTSLHRASFKGRIDTVKLLVEKGAEVDAKDEEGYTALHCAAESGHADVTEFLVKRGADVEARTRKGVSALQIAESLHYVGITRVLVNGGASRENCDVGKVAALGAIAFGTKMEARGVMNKKKRGGGGRARMLNGETLVLFTLAGTRACGCTCCIYFNDHDNNHSGGNNNSHVGGNDGGHDNDHDSGSYNDGVMVVTTIL

SEQ ID NO: 216886 - protein, 177 aa, Glycine max
  Coding DNA Sequence Number=SeqID_100108
  Gene Ontology: Mol. function=unspecific monooxygenase activity
  Homolog annotation: Hit_ID=O04892; Match level="QueryCoverage=52%, HitCoverage=23%, E-value=7e-27, Identity=57%"; Hit description =Cytochrome P450 like_TBP
TGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQNCALNVKVKKFNQARGKPAGVTMTLLSETHSPRERGLAESAGKEDPVELDSSPDFVK

SEQ ID NO: 216887 - protein, 66 aa, Glycine max
  Coding DNA Sequence Number=SeqID_100109
  Subcellular localization annotation: CTP_CleavageSite=53; ConfidenceScore=5.30e-01
MWGYRMVIRIFRQPGANKPVDTPRRTSSSAHFVIPGKTSLMTCGGCRMVIRIFCQSGPTNPLTRGD

SEQ ID NO: 216888 - protein, 112 aa, Glycine max
  Coding DNA Sequence Number=SeqID_100110
MAERGHGMYYTPQIFAQYPFEGHHIDTSASEHSFGGVAETHPNFSWPTITPSQQCHGPIPTPNTPLGTQWNVPGPIPNVEEILIAKHKDGIDHVALPHVIRDIIVNDFIVSV

SEQ ID NO: 216889 - protein, 91 aa, Glycine max
  Coding DNA Sequence Number=SeqID_100111
MYNYYEKGRDLDIESALADFTTYQASYKDIDKGRLELSVEDQKISFDLFEAMKHLDMDDACFEEGEVEQEIASSVSTMILQFPLEKELGHV

SEQ ID NO: 216890 - protein, 244 aa, Glycine max
  Coding DNA Sequence Number=SeqID_100112
  Gene Ontology: Mol. function=RNA-directed DNA polymerase activity; Biological process=RNA-dependent DNA replication
  Homolog annotation: Hit_ID=Q8H6Q8; Match level="QueryCoverage=94%, HitCoverage=46%, E-value=4e-37, Identity=43%"; Hit description=CTV.20
  Pfam annotation: Domain name=DUF755; Domain location=138-237; Score= -41.9; E_value=0.071; Accession=PF05501.2; Description=Domain of unknown function (DUF755)
MVATAYQTSHECSEETIIDILVAGFSGQLKGCAVKTDLNGKVITNDDDKEIPDAVNTLIFTIAQHFIGNPSLWKDRSAELLSNLKCRTLADFRWYRDPFLTRVYTREDSQQPFWKEKFLAGLPRSLGDKVRDKIRSQSANGDIPYENLSYGQLISYVQKVALKICQDDKIQRQLAKEKAQTKRDLGSFCEQFGLPACPKQKKKQTSRKEAHDHKPANNRRFSRRRYSQKPSTSREIENPKQKIK

SEQ ID NO: 216891 - protein, 164 aa, Glycine max
  Coding DNA Sequence Number=SeqID_100113
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=2e-15, Identity=35%"; Hit description= UPI00006A17C9 related cluster
MSSPERATLPSPWVLVPSPLRGLHVLAFRGLHVLANRGLHALTFRGRHVLALRGLHALTLEGYAPSPWVLVTLTVRGLHVLALRGLHVLTIRGLHALTSRGLHVLALRGLHALTLGTSYPHRQRTTRPRLERTTRPHHQRAARPYLQRTTCPRLERATRPHLGY

SEQ ID NO: 216892 - protein, 64 aa, Glycine max
  Coding DNA Sequence Number=SeqID_100114
MGCAITLYITVIFETDCKTLVENLKGGRNNITECGVVIDHIKQILNAHPGKDNYMSLWVKVIPT

SEQ ID NO: 216893 - protein, 52 aa, Glycine max
  Coding DNA Sequence Number=SeqID_100115
MQENSRLCGGSGGARKDEMKQGSARMGGTTPLVWIAFGPIKRVPVLTFIVFF

SEQ ID NO: 216894 - protein, 113 aa, Glycine max
  Coding DNA Sequence Number=SeqID_100116
MATRIMLLRGSLGECSSESRCKCTNGGGFTLAKQAKIFAKENICRKPHHRGIDGREVGSNMMKDRIEKKHFLIMGIKDLDFKILIRDVFVGSSWALWRYLVPMGFGYVKGESS

SEQ ID NO: 216895 - protein, 182 aa, Glycine max
  Coding DNA Sequence Number=SeqID_100117
  Gene Ontology: Mol. function=helicase activity; Biological process =viral genome replication
  Homolog annotation: Hit_ID=Q1SN45; Match level="QueryCoverage=99%, HitCoverage=10%, E-value=7e-41, Identity=45%"; Hit description=AAA ATPase
MFTTWMHSNKICSYGRDLTYHQYISRFVYVARKRCWQPRKQGNTIGRLIWVPPSAGELFYLRMMLSTAKGAQSYSDIRTVNGLVYPTFREACFAKGFLGSDQEFISALQEANNWGIAHYLRKLFVKLLFMNTMDRPEYVWQQTWQWMADDIIFNHRKQGIHLTKKETIHLCLTEIENMLQAN

SEQ ID NO: 216896 - protein, 98 aa, Glycine max
  Coding DNA Sequence Number=SeqID_100118
MENGENILDAIFQDENLEDDVEMIDVEEGELVELNDSQNGVVEADNKKPHSKKRRRRGNKRNKKKNSGTTGAIDIDRPRETENKNQELRYVHETTSVT

SEQ ID NO: 216897 - protein, 205 aa, Glycine max
  Coding DNA Sequence Number=SeqID_100119
  Homolog annotation: Hit_ID=Q9LTP9; Match level="QueryCoverage=93%, HitCoverage=52%, E-value=1e-25, Identity=37%"; Hit description =Arabidopsis thaliana genomic DNA, chromosome 3, P1 clone: MQC12
MVYTAVACLGVCALSDLINEVEAIQACGGQMTVDGRRFRTGGGVLWSIIKVREPNAYKEIIKKAKEFENLSKGQEIVIYDPMMKVDIGEGMGKIDSEVNLVMYKERDIQNCIKLYLVGGERRQPNVKQPPVQKKEDSFQGDDTSTFASGHQGTVSDKSFSALQMQDRQHKPSGSEEKRNSVHDRLRIHVSYDDDLLGLSADNDTA

SEQ ID NO: 216898 - protein, 164 aa, Glycine max
  Coding DNA Sequence Number=SeqID_100120
MVVVSTDTTTFHTDGEPTVHTKHFFDIDELEKVGLKFHKTMDTIAKANGCLHEGSTYYEGWEKAYNSQIHRALYAKKVGDQKAITYNLLSERAKIWANKLNKSVLHKVGSKTTLSDLHKFVLFHLMENLPFDLPNTIYINILCNSRNLGGMDNIYYATLMNKLL

SEQ ID NO: 216899 - protein, 239 aa, Glycine max
  Coding DNA Sequence Number=SeqID_100121
  Gene Ontology: Mol. function=protein phosphatase type 2C activity; Cellular component=nucleus
  Homolog annotation: Hit_ID=O82470; Match level="QueryCoverage=86%, HitCoverage=82%, E-value=2e-26, Identity=33%"; Hit description =Protein phosphatase-2C
  Pfam annotation: Domain name=PP2C; Domain location=30-233; Score= -58.3; E_value=0.015; Accession=PF00481.12; Description=Protein phosphatase 2C
MGICISVAEGVNDDNVTIFQARKVPNESQRLCSVYSQQGSKGLNQDAASVHEGYGMEDGTFFGVYDEHGGNGHKVSKIVSSRLSSLILDQKNVLEKIDAIENGIGCKKWKEAILSAFKVMDKEVKLQKNLDCSSSGTTAGEGLVIANLGDSRAVLGTICDEKTHGHSIDHRFEAGITSKVLKLLATEATVMSYMVWDVLSNNEVASIVWGVDSEEAVVEAATAAWNEKYPSYMADDCTV

SEQ ID NO: 216900 - protein, 64 aa, Glycine max
  Coding DNA Sequence Number=SeqID_100122
  Gene Ontology: Mol. function=nucleic acid binding; Biological process= DNA integration
MESTSIKPNTQEMKTPTHPTMYIGLDKEPKKVDNTQYRAMIGSILYLTTSRPDIMFSVCLCVRF

SEQ ID NO: 216901 - protein, 150 aa, Glycine max
  Coding DNA Sequence Number=SeqID_100123
  Subcellular localization annotation: CTP_CleavageSite=58; ConfidenceScore=5.80e-01
MGKIALALKKIISSSGRRFFWKSSGRRFFRKFSGRTFFRKNNLCSTGRTFFRKNLLPEAFRKKVLPKEQIVVLSEEGSSGKFPEEGSSGRTIYSSERRFFRMNNLFYRKNLLPNKLPEELLPVTSPEEGSSDRINCSTRRTFFRKKELFF

SEQ ID NO: 216902 - protein, 67 aa, Glycine max
  Coding DNA Sequence Number=SeqID_100124
MEHNVQNWKHEVSFGEGEGAGVHCCGGWFNVGGKLVDIDDQNEQECGVNEPQVYCSDAFNTSQVFDS

SEQ ID NO: 216903 - protein, 73 aa, Glycine max
  Coding DNA Sequence Number=SeqID_100125
MLLSSNVIHICVRVVMLVRMIRTRHFAAARVKSCPGMHSSWAIASLSGCACTVGRLPISGGGPGTDKRKLLAP

SEQ ID NO: 216904 - protein, 87 aa, Glycine max
  Coding DNA Sequence Number=SeqID_100126
  Homolog annotation: Hit_ID=Q2QQZ4; Match level="QueryCoverage=73%, HitCoverage=3%, E-value=3e-07, Identity=47%"; Hit description =Expressed protein
MDSSGDISILKYAAYFSEAISVGVLREDVDHVIALSELIKLGFLVKFNEEAVDFLMESKDLQIFLEDEELSRWGCSYSERKYNMMRF

SEQ ID NO: 216905 - protein, 272 aa, Glycine max
  Coding DNA Sequence Number=SeqID_100127
MGIGNSKSNAVEGEGLPAKIRPMLVSRYEEFRKRRNRETTLSKKNLLNEKDDNSQSSHRTETEDKVSSSKEIEPPKEETVERVITAEKMSRVVPIPNSECENVEETHPNKVKIEQVNKNMDPNQDILNHAVEMAEAELVEETKEEKEQEVGAKGDDHHEDSDDEDESEEVGRFLCPGSPSFRIYCNEAEKRNEEECNSPAIVVLHKSRSADSVQTAESTNSNEELEPTSKRKGHKKKFGAMRTLLKVKSLYHPMCTCTGDDRSLIVTTKATK

SEQ ID NO: 216906 - protein, 351 aa, Glycine max
  Coding DNA Sequence Number=SeqID_100128
  Gene Ontology: Mol. function=zinc ion binding; Cellular component =integral to membrane; Biological process=behavior
  Homolog annotation: Hit_ID=Q1S9E2; Match level="QueryCoverage=92%, HitCoverage=72%, E-value=4e-99, Identity=56%"; Hit description=Zinc finger, DHHC-type
  Pfam annotation: Domain name=zf-DHHC; Domain location=61-125; Score =115.9; E_value=1.2e-31; Accession=PF01529.11; Description=DHHC zinc finger domain
MAVLMALTLFVLITLVVTSARDPGIVPRNAQPPQPDDHHGTDNSNNRQISLSRFPRTKDVILNGITLKVKYCDTCMLYRPLRASHCSVCDNCVERFDHHCPWVGQCIGLRNYRFYYMFVFSATLLCLYVHAFCWVYIVKIKDSEAISIWKAMSKTIASIVLIVYTFLCSWFVGGLTIFHTYLISTNQSTYENFKNRYDPQTNPYNRGMVNNFKEVFCTRIPPSKNNFRSKVPREPLESYQRTGIRPLSPMMKRRTRTRSMELVGNAVYNEQDEEESNYRDGFDNEARSKDSGLTDKSLDLSRILHTEGVEGEESSIRHHQWEGTTEVQDSITEVGESNSATAPNCSTREVV

SEQ ID NO: 216907 - protein, 197 aa, Glycine max
  Coding DNA Sequence Number=SeqID_100129
  Gene Ontology: Mol. function=RNA binding; Cellular component=nucleus; Biological process=regulation of translation
  Homolog annotation: Hit_ID=Q9T0G5; Match level="QueryCoverage=82%, HitCoverage=22%, E-value=2e-40, Identity=52%"; Hit description =Putative DNA-directed RNA polymerase
  Pfam annotation: Domain name=KH_1; Domain location=112-178; Score =83.6; E_value=6.2e-22; Accession=PF00013.19; Description=KH domain
  Pfam annotation: Domain name=KH_1; Domain location=20-85; Score=73.3; E_value=7.9e-19; Accession=PF00013.19; Description=KH domain
  Pfam annotation: Domain name=KH_2; Domain location=112-164; Score =6.0; E_value=0.023; Accession=PF07650.7; Description=KH domain
  Pfam annotation: Domain name=KH_2; Domain location=20-66; Score=6.1; E_value=0.022; Accession=PF07650.7; Description=KH domain
  Pfam module annotation: Pfam domain module=KH_1::KH_1::KH_2::KH_2; Domain location=112-178::20-85::112-164::20-66
SVPSISPSAVSYSHQVGGASKKIDIPNGRVGVIIGKGGETIKYLQLQSGAKIQVTRDMDADPNSATRTVELMGSPDAIATAEKLINEVLAEAETGGSGIIARRVAGQAGSDEYVSKIPNNKVGLVIGKGGETIKNMQASTGARIQVIPLHLPPGDTSTERTLKIEGTPEQIESAKQMVNQVISGEVYDYCLKLPGPV

SEQ ID NO: 216908 - protein, 187 aa, Glycine max
  Coding DNA Sequence Number=SeqID_100130
TLTDGVEGRAVVVVLGAFGGVEGRGASEEASSDFLGALFGELEVGGGGGGGRDAVVGGGWRRHRVGAVGETGGAVVVVLPLEGGWGGDAVGVRRILRFVSHGDWVEEETLMGESNFFKATQGVFQQPKREYKKVPIIQSLSKRENHSKTPTSLPQQKGQQHDDPTTISDQASQNCCKNKRSRPHTTW

SEQ ID NO: 216909 - protein, 101 aa, Glycine max
  Coding DNA Sequence Number=SeqID_100131
  Gene Ontology: Mol. function=oxidoreductase activity, acting on NADH or NADPH; Cellular component=mitochondrion; Biological process =mitochondrial electron transport, NADH to ubiquinone
  Homolog annotation: Hit_ID=Q9SP38; Match level="QueryCoverage=71%, HitCoverage=34%, E-value=6e-38, Identity=95%"; Hit description=NADH ubiquinone oxidoreductase PSST subunit
  Pfam annotation: Domain name=Oxidored_q6; Domain location=1-58; Score= 47.5; E_value=4.5e-11; Accession=PF01058.12; Description=NADH ubiquinone oxidoreductase, 20 Kd
MPEPRWVISMGSCANGGGYYHYSYAVVRGCDRIVPVDIYVPGCPPTAEALLYGLLQLQKKINRRKDFLWWWTRCEAKLVWVLEKKNAVLEAKAALDVPFTF

SEQ ID NO: 216910 - protein, 78 aa, Glycine max
  Coding DNA Sequence Number=SeqID_100132
  Gene Ontology: Mol. function=oxidoreductase activity, acting on NADH or NADPH; Cellular component=mitochondrion; Biological process =mitochondrial electron transport, NADH to ubiquinone
  Homolog annotation: Hit_ID=Q42577; Match level="QueryCoverage=51%, HitCoverage=18%, E-value=2e-16, Identity=92%"; Hit description=NADH -ubiquinone oxidoreductase 20 kDa subunit, mitochondrial precursor
MALVTRIGLTWRLPQRLVSASLHSNSTGTTAPTSYSGGIRDLEGGLPLELGPHRVHLAHDVWAGLLRCGDDAHGRGPL

SEQ ID NO: 216911 - protein, 77 aa, Glycine max
  Coding DNA Sequence Number=SeqID_100133
MLFGGGGSLVMVDEGWRRWFWKEHGGGGAAMLFGGGGSLVMVDEGWRRWFWKEGGEDDLVEDDAARRCWCNSAICVR

SEQ ID NO: 216912 - protein, 187 aa, Glycine max
  Coding DNA Sequence Number=SeqID_100134
  Gene Ontology: Mol. function=adenosine kinase activity; Biological process=purine ribonucleoside salvage
  Homolog annotation: Hit_ID=Q1RYR5; Match level="QueryCoverage=50%, HitCoverage=30%, E-value=8e-35, Identity=72%"; Hit description =Adenosine kinase
MIMRQVLAEGPLIQFQNFVVMMGFSVYEDEKTQFIQQNIGINLKSDDDSLRVLYFCLGMEEVVEVWINFFGSPTIGRARYEGITIRETNKTGRLVYMDYIFGNETEARTFSKAQGWEISHLPKASQKHKRITVITQGADPVSVAEDEKIKLYPMILLPKDKLVDTNGAGDAFVGGLLSQLVKQKPIK

SEQ ID NO: 216913 - protein, 128 aa, Glycine max
  Coding DNA Sequence Number=SeqID_100135
  Gene Ontology: Mol. function=oxidoreductase activity, acting on NADH or NADPH; Cellular component=mitochondrion; Biological process =mitochondrial electron transport, NADH to ubiquinone
  Homolog annotation: Hit_ID=Q42577; Match level="QueryCoverage=75%, HitCoverage=44%, E-value=7e-31, Identity=68%"; Hit description=NADH -ubiquinone oxidoreductase 20 kDa subunit, mitochondrial precursor
  Subcellular localization annotation: CTP_CleavageSite=39; ConfidenceScore=5.35e-01
MALVTRTRPTWCLPRRLLFASLRSNSTGATAPPSYCAPPSMIANSSPVGHSKPVEFVISKVDSLLNWAHSRSIWPMMFGLAYCDMEMMHTGATYYDLDRFRIIFRPSPHQSNCMIVAGTLTNKMAHFY

SEQ ID NO: 216914 - protein, 175 aa, Glycine max
  Coding DNA Sequence Number=SeqID_100136
  Gene Ontology: Biological process=response to biotic stimulus
  Homolog annotation: Hit_ID=Q5Z8S0; Match level="QueryCoverage=92%, HitCoverage=91%, E-value=2e-51, Identity=56%"; Hit description=Bet v I allergen-like
  Pfam annotation: Domain name=Bet_v_I; Domain location=35-165; Score= -33.7; E_value=0.002; Accession=PF00407.9; Description=Pathogenesis -related protein Bet v I family
MASETHHHVQGLTPEELTKLEPIIKKYHLFEQSPNTCFSIITYRIEAPAKAVWPFVRSFDNPQKYKHFIKGCNMRGDGGVGSIREVTVVSGLPASTSTERLEILDDDKHVLSFRVVGGEHRLKNYRSVTSVNEFNKEDIPEGNTEEDTKMFVDTVVKLNLQKLGVVAMASSMHGQ

SEQ ID NO: 216915 - protein, 69 aa, Glycine max
  Coding DNA Sequence Number=SeqID_100137
MWWYRGHMRTQREEGGGNMMIVSNGGVYGRTKEMWWLKIVIIRKRKSSKFTILMASVTPRTNNTGMGGI

SEQ ID NO: 216916 - protein, 255 aa, Glycine max
  Coding DNA Sequence Number=SeqID_100138
MEAGHVLTSLSSIEVTQGSENEVLLKEVLYNSVMMIDYSFINPQAEFLLYANSLKDVAIIWLFVAELAVQSAREKGDHGKAMSYINAFCRSCIPIQLINWVTNQNCVGRKITRPNVSTPIALIKWLIVVEEQGIAVFAGETAKQINIMFKANFFTSRTECLLPVIKHFFNNLDKNLYLNSVNGEAGADKLDGDVEMLDTADTVSLPAADSVNRVIDGTRKRKEGIEDDTKTQLKYMRCQFHENSVRENSFIFRQQ

SEQ ID NO: 216917 - protein, 265 aa, Glycine max
  Coding DNA Sequence Number=SeqID_100139
  Gene Ontology: Mol. function=nucleic acid binding; Cellular component= mitochondrion; Biological process=DNA integration
  Homolog annotation: Hit_ID=Q1T1E6; Match level="QueryCoverage=96%, HitCoverage=44%, E-value=1e-88, Identity=62%"; Hit description=Zinc finger, CCHC-type; Peptidase aspartic, catalytic
MFLSQQYYIQDILQKGNIIDAKPVGTPMSTTCSLSSHDDTPSCDSSLFRSIIESLHYLSITRPDVAFTALKCILHYLKHTISHGLQLIATKNFDLTAFCDADWGGHTNDKKSTHAYIVYLGPNAISWSCKKQSTVARSSTEVEYCTIGLTFLELLWLQQLLLELGIKLTKQPIIFSDNIGATYLCANPVFHSRMKHLGIDYHFVHDIVVKGELKVSHVPSSHQLADLLTKPLSWPHHEFLIIKIGIVDSSSILQAHISDKCKYRI

SEQ ID NO: 216918 - protein, 320 aa, Glycine max
  Coding DNA Sequence Number=SeqID_100140
  Gene Ontology: Mol. function=molecular_function; Cellular component =cytosol; Biological process=cell differentiation
  Homolog annotation: Hit_ID=Q6Z8B1; Match level="QueryCoverage=93%, HitCoverage=94%, E-value=1e-122, Identity=66%"; Hit description =Putative pollen specific protein
  Pfam annotation: Domain name=Ndr; Domain location=23-278; Score =399.9; E_value=3.7e-117; Accession=PF03096.5; Description=Ndr family
MADSTSSDSLSLDIDSLSPSPQEHIIRTRHGSVSVAVYGDQDKPALITYPDLALNYVSCFQGLLFCPEAYYLLLHNFCIYHISPPGHELGAAEIDPDYPILSVDDLADQIAEVLNFFGLSAVMCMGVTAGAYILTLFAVVSNLLYFYGMCGVVKEILLKRYFSKEIRGGTQLPESDIVKSCRRLLDERQSLNVWRFLEAINGRPDISEGLRKLHCRSLIFVGDMSPFHSEAVHMTSKLDRRFSALVEVQACGSMVTEEQPHAMLIPMEYFLMGYGLYKPSKLSVSPRSPLSPSCISPELYSPESMGLKLKPIKTRISLEI

SEQ ID NO: 216919 - protein, 154 aa, Glycine max
  Coding DNA Sequence Number=SeqID_100141
  Gene Ontology: Cellular component=integral to membrane
  Homolog annotation: Hit_ID=Q1S9E8; Match level="QueryCoverage=56%, HitCoverage=41%, E-value=1e-26, Identity=63%"; Hit description=MtN3 and saliva related transmembrane protein
  Pfam annotation: Domain name=MtN3_slv; Domain location=1-77; Score =60.6; E_value=5.2e-15; Accession=PF03083.6; Description=MtN3saliva family
MRACMVDVVEFQKVVIRTKSVEFMPITLSLLLTVSAMMWMAYGILLRDIYVTLPNFVGITFGTIQIVLYLIYRKNKPVKDQKLPEHKDDVANDENVNTAVSGENRGANATGFVDIEIGEKKQVQEQADKKQDQQAVNARDQTEHNNNSNKTREG

SEQ ID NO: 216920 - protein, 112 aa, Glycine max
  Coding DNA Sequence Number=SeqID_100142
MPEEDLVDIKFRLYDGSDIGPFRKVEARKSGVVTGEAVKVDWDALPSRHETEAAVDRYYVWLVLNQTEVDNHWIKFIWERRTKQKEFQVFWNSATEIMMELVMKDDTDAIPC

SEQ ID NO: 216921 - protein, 84 aa, Glycine max
  Coding DNA Sequence Number=SeqID_100143
  Gene Ontology: Cellular component=membrane; Biological process =protein modification process
  Homolog annotation: Hit_ID=Q9SW27; Match level="QueryCoverage=65%, HitCoverage=47%, E-value=3e-19, Identity=83%"; Hit description =Membrane-anchored ubiquitin-fold protein 3 precursor
MGEEDQTKGVPGKTVVPKSANEVKLISSGKILENNKTVGQCKVPFGETPGGVIIMLVVVQPSLAKTKAGTFHGLLAIGNIYNFS

SEQ ID NO: 216922 - protein, 630 aa, Glycine max
  Coding DNA Sequence Number=SeqID_100144
  Gene Ontology: Mol. function=nucleotide binding
  Homolog annotation: Hit_ID=Q9FGW3; Match level="QueryCoverage=81%, HitCoverage=65%, E-value=2e-98, Identity=41%"; Hit description =Arabidopsis thaliana genomic DNA, chromosome 5, P1 clone:MFB16
MGWGRGYPILDGYGDGIINFNLSVIGYGYEDMFRSWGRGLGRQYPSLPRPIAMSSPEPRCWLAHLAPGLCRRTWAFSNKVRISRLNGQTMQAVGYVGAGFNERLYTEHRVAVLHIFEEYWEGRHCSTHVQWSPFSNEADLLLQFNLVKDHGTRVIIYNLWEDDQGQLELDFDEDPHDIQIRGVNRDEKNIQMSKEFPNSRHFLTYRHSLRSYTSILYLRLPSGFRIILRGKDILHHNIVNDMMMSQEVTYRPQAGVDGLLPKDSNMVAVVTIGFVKDAVHHVDVSAYPLSPFKNFCGPSAFEIMKNIFSVNLAILEDLESSWKWRAWGVLEANFVEPAHDKQGFERTLVLSRLESKLIQMQKKYWSTNCHKIGYASNRSKIQIRDYADKEASPDYFPESSQSKRKYSTMDDKATPLTSDKLRSHSDQKRIQKQTDKYIAYKNGQSSVSPRRRMQSLSEQSSSDDEVSEVLPKKKTQKISTAEKSFEKENGCSQDTTSRGKSSQYTRGSKLEGKSVNDGEQPPSDNDLLTLEQLKKENRELKERLQRKEEDILGQVLQDLQHEKDRCKSLETQLIDAEKKLEELNNEQETLIDVFAEERDRRDAEEKKLRNKLEVLLLPSAFQNEYKQHTL

SEQ ID NO: 216923 - protein, 299 aa, Glycine max
  Coding DNA Sequence Number=SeqID_100145
  Gene Ontology: Mol. function=nucleic acid binding; Cellular component= nucleus; Biological process=response to salicylic acid stimulus
  Homolog annotation: Hit_ID=Q1S025; Match level="QueryCoverage=93%, HitCoverage=77%, E-value=5e-35, Identity=39%"; Hit description=Zinc finger, CCHC-type; Homeodomain-related
  Pfam annotation: Domain name=Myb_DNA-binding; Domain location=156 -203; Score=54.2; E_value=4.2e-13; Accession=PF00249.21; Description =Myb-like DNA-binding domain
  Pfam annotation: Domain name=zf-CCHC; Domain location=5-22; Score =14.1; E_value=0.0046; Accession=PF00098.13; Description=Zinc knuckle
  Pfam module annotation: Pfam domain module=Myb_DNA-binding::zf-CCHC; Domain location=156-203::5-22
  Subcellular localization annotation: CTP_CleavageSite=51; ConfidenceScore=5.53e-01
MRMGRKCSYCGNFGHNSRTCNTHKRGLKLFGVQLDLCSSSSSSSLPLTSPCTSSSSSTPFDIMKRSLSMDYLVSSRIISPSYNFLLGGGADENSSDKTITDGYIASVGGGGLTSTTHHQERKKGSLQTLLAFVMMYGSNNKFCITSKQGEKYKKRGVPWSEEEHRKFLEGLEKLGKGDWRGISKKFVITRTPSQVASHAQKFFLRQTSFNQRKRRRSLFDMERDETTTLEQFNTCFKASGQFGSPSGTIITCPQWVSCNHSVLNWATTSTNYTHQSASPDLELKLAVPILTEPCGRTEL

SEQ ID NO: 216924 - protein, 69 aa, Glycine max
  Coding DNA Sequence Number=SeqID_100146
MAPPKEIAIVIYHNGHIATKFKDRCTHGLTRYISTQLLDNDDLRGAMETILQNSQLNSAKFYAITDLIP

SEQ ID NO: 216925 - protein, 1294 aa, Glycine max
  Coding DNA Sequence Number=SeqID_100147
  Gene Ontology: Mol. function=RNA-directed DNA polymerase activity; Cellular component=chromatin; Biological process=chromatin assembly or disassembly
  Pfam annotation: Domain name=Chromo; Domain location=1200-1250; Score= 28.5; E_value=2.4e-05; Accession=PF00385.14; Description='chromo' (CHRromatin Organisation MOdifier
  Pfam annotation: Domain name=rve; Domain location=944-1101; Score =83.4; E_value=7.2e-22; Accession=PF00665.16; Description=Integrase core domain
  Pfam annotation: Domain name=zf-H2C2; Domain location=885-926; Score =7.8; E_value=0.034; Accession=PF09337.1; Description=His(2)-Cys(2) zinc finger
  Pfam module annotation: Pfam domain module=Chromo::RVT_1::Retrotrans _gag::rve::zf-H2C2; Domain location=1200-1250::461-632::105-195::944 -1101::885-926
MADATHSKVSSDRLEDAIAKLTTSQLAMNSKIDDLLHRMLQLEVNQQPPQMPPSSSAGQTPSSYSPVHRMKLDVSRFDDFNPTGWTFKITQFFEYHSTPDQECLTIASFYMEGSALAWFQWMHCNAQLSLWSTFLHALHSHFASSTYEDPTGLLCKLQQRSSVSAYLSEFESLTNCIMGLPTPFVLSCFISGLSPAIRQEVQVLQPVSLAQAFAYARLQEEKLLDARRPPAHRFQPATRLTPEELAICREKGLCFHCDEKFSRGHKCSPSLFLLVMEDEELASELSLHALSGHSAPETLRMKGLIDELHVSILIDGGITVDNGDEIRCHQLCTAVTIQIQRHSFTVDFHILPLCGADIVLGVQWLKTLGPVLTDYTSLNMKFITGGKLVELHSDREKDMEPVSHSQLRHFLHTNPSSTFFHIRVEACPQSPSSTQTLLEITSLTTKYSSLFQSLTTLPPSRPTDHSITLLPNSTLDGAWQFCVDYRALNAITVRDRFPIPTVDELMDKLGGARWFFKLDLMQGYHHIWMREADISKTAFRTHHEHYEFRVMPFGLCNAPSSFQATMNQLFQPYLHKYIIVFFDDILIYSKTIADHLFHLESAFQILVAGQFSLKLSKCMFLQQQLEYLGHIVAGEGVRPVPEKVQTIQTWPTLHSPWALRGVLGLVWFYRRFIRGYAALATPLTKLLCHAQFHWSSEANVAFQNLKDAITTAPVLALPDFKVPFVVETDASGAGMGAVLTQGDHPIAFFSKQLCPKLINSSTYVCELAAITAAVKKWRQYLLGHHFIILTDHRSLRELMNQAMHTPKQHRYLAHLLGFNYTIQYRSDLHKELASLPAFVELRDQIQVDPTTYPKYTLTSKLILHKGLIWLPFNSSFIKLLLEEFHQSPIGGHMGVQKTLHRLQENFTWSSIREDTRAFIISCLTCQHTKYENRKLTGLLCPLPVSAQPWEDLSVDFIVGLPAYQGNTCILVVVDRFSKGLHLGMLPTHHTAHAVAILFMDMVGRLHDMLRNIVSDRDPLFISKFWRELFSLSGTKLRLSSAYHPQSDGQTEVANRIIEQYLRAFVHQKPSAWGRYLLQQEAVFELLRHKLSKAQTRMKTIADRHRRDQEFKVGDWVLVKLRPHRQTSAMGSAYSKLAKRYYGPFQITTRMGKVAYQLQLPDHSRIHPIFHYSLLKPYVATACPRGTADLPPMARDNHPVISPLAIVASKPIPSELGPKRMVLVQWKGLPPEETSWEEWSDFKTLHHLEDKVLFDGHGSVTSNTRAVLGGCVEVGNGGVGWLDGGVLLLFGFSLE

SEQ ID NO: 216926 - protein, 69 aa, Glycine max
  Coding DNA Sequence Number=SeqID_100148
  Homolog annotation: Hit_ID=Q5Z8T1; Match level="QueryCoverage=81%, HitCoverage=9%, E-value=7e-14, Identity=74%"; Hit description =Putative Potassium-efflux system protein
MNVHLSKKRKNEVTTPLLFKLIPAVVHLGVLLRWFSTDSSMEIGYKLDNLRSDSGKQRIILMDQESHDS

SEQ ID NO: 216927 - protein, 148 aa, Glycine max
  Coding DNA Sequence Number=SeqID_100149
  Gene Ontology: Mol. function=solute:hydrogen antiporter activity; Cellular component=integral to membrane; Biological process =regulation of pH
  Homolog annotation: Hit_ID=Q5Z8T1; Match level="QueryCoverage=81%, HitCoverage=19%, E-value=6e-42, Identity=72%"; Hit description =Putative Potassium-efflux system protein
MEMHDAKGKLDSCVSSETSVVIVFLTDCSDKLGLSLELGSFAAGVMIATTDLAQHTLEQIEPIRNLFAALFLASIGMLIHVHFLWNHVDILVASVILVIVIKTIIIASVVKGFGYNNKTSIHVGMSMAQIGEFAFVLLSRASNLHLVE

SEQ ID NO: 216928 - protein, 80 aa, Glycine max
  Coding DNA Sequence Number=SeqID_100150
  Homolog annotation: Hit_ID=UPI000034F37F; Match level="QueryCoverage =96%, HitCoverage=8%, E-value=3e-07, Identity=43%"; Hit description =KEA6; potassium:hydrogen antiporter
MEGKCETILTEQRGMQSMSPTWIQKGYHIFPSVLLENINLCSFWFERTLTSWSLITLLEKHPRCHPELEAMQRAIQQHSL

SEQ ID NO: 216929 - protein, 180 aa, Glycine max
  Coding DNA Sequence Number=SeqID_100151
  Gene Ontology: Mol. function=solute:hydrogen antiporter activity; Cellular component=integral to membrane; Biological process =regulation of pH
  Homolog annotation: Hit_ID=UPI000034F37F; Match level="QueryCoverage =62%, HitCoverage=19%, E-value=2e-45, Identity=82%"; Hit description =KEA6; potassium:hydrogen antiporter
MDQAVLETVARVTPNKNDTKDEKSFQLHHVFNRAEETPMLIDRKDNVFIISNFKSKYPVLQLDLRLISDLVVAIVSATCGGVAFAFAGQPVITGYLLAGSIVGPGGFNFISEMVQDPQIFWNITTLQPRRSTLCGLRLSNEEVQPLHASKLSCNLLLVQELPSSCRVRVTLLLFVAYRIT

SEQ ID NO: 216930 - protein, 117 aa, Glycine max
  Coding DNA Sequence Number=SeqID_100152
  Gene Ontology: Mol. function=solute:hydrogen antiporter activity; Cellular component=integral to membrane; Biological process =regulation of pH
  Homolog annotation: Hit_ID=Q9ZUN3; Match level="QueryCoverage=77%, HitCoverage=15%, E-value=8e-13, Identity=48%"; Hit description =Putative potassium/proton antiporter
  Subcellular localization annotation: CTP_CleavageSite=3; ConfidenceScore=5.30e-01
MSRARSRSRSPSPSPCCGDSHLVLLLPVMLAVFFNSLLLLPRSSLAIRPTESDRIELANATESSSNVSLSRPREGTFADMIDRALEHEFTENDQNEATADPGSFNNSVAEQQVGLVP

SEQ ID NO: 216931 - protein, 84 aa, Glycine max
  Coding DNA Sequence Number=SeqID_100153
  Gene Ontology: Mol. function=catalytic activity; Biological process =metabolic process
MNAKKKDDMVYVLPKRRILMQPGKLQGNRNTAVYTTTLDHDIQSTTQDMAQALRAGKHLRRVMDNDSCSPNWRVQFYMSPYVRI

SEQ ID NO: 216932 - protein, 278 aa, Glycine max
  Coding DNA Sequence Number=SeqID_100154
  Gene Ontology: Mol. function=transferase activity; Cellular component= nucleus; Biological process=flavonoid biosynthetic process
  Homolog annotation: Hit_ID=Q94CD1; Match level="QueryCoverage=99%, HitCoverage=61%, E-value=1e-102, Identity=65%"; Hit description =Putative N-hydroxycinnamoyl/benzoyltransferase
  Pfam annotation: Domain name=Transferase; Domain location=1-278; Score=29.0; E_value=2.3e-12; Accession=PF02458.6; Description =Transferase family
VTKFKCGGFVLGVNVNHCMSDGICAMQFVNAWGETARGLDLSISPVLDRTILRARNPPKIEFPHHEFDEIEDVSNATKLYEEEEILYKSFCFDPDKLELLKKVATEDGVVKKCSTFEALTAFVWRARSEALGTHSNQQTKLLFAVDGRSKFVPPIPKGYFGNAIVFSNALCKVEELVNNPLSFSVGLVGKAIDMVKDSYMRSAIDYFEVKRSRPSLTATLLITTWTRIPFRSADFGWGKPFFFGPVTLPGKEVILFLSHNEESKSINVLLGLPASAMK

SEQ ID NO: 216933 - protein, 59 aa, Glycine max
  Coding DNA Sequence Number=SeqID_100155
AEEANCVIKDLGDLAKQPDLQTLGKLVYDIPGATNLLQIPPLLTQIILFELEGEPWYSV

SEQ ID NO: 216934 - protein, 67 aa, Glycine max
  Coding DNA Sequence Number=SeqID_100156
MTNWKKFCTKNRLPKKKQKLIHTRDAKRINIAKINQVNKEKQQPKIHLLNLNRRLPKFANQTSHQDK

SEQ ID NO: 216935 - protein, 319 aa, Glycine max
  Coding DNA Sequence Number=SeqID_100157
  Gene Ontology: Mol. function=nucleic acid binding; Cellular component= nucleus; Biological process=regulation of transcription from RNA polymerase II promoter
  Homolog annotation: Hit_ID=Q5JKH1; Match level="QueryCoverage=99%, HitCoverage=67%, E-value=2e-45, Identity=33%"; Hit description =Putative BRI1-KD interacting protein 112
AFTLSKRKADDNLRALHSILFGKKAKAHHLKRNIGLFSGYVWTENEEKQRAKIREKIDKCVKEKLVDFCNVLNIPITKTSMKKEELSAKLLEFLESPHATTDVLLADKEKIGSMLQKGKKRARKQTPSKSPAKKQKQNSQVGKKQKQSSDIEDSDAAEPSDAKVDSREDDDSSQKSEGGNKESISEKEEDKEKVHKRSSKKILKEDQTTPVKKTTGVKTAKSNENTSKKSTSKRAVTDSTSKSKKQKSVKENLNSKRKDANKKQTDKSLKALLKDQGKDKSSEKAKAEPSKEELHRVAVDILKEVDFNKATLSDILRQL

SEQ ID NO: 216936 - protein, 194 aa, Glycine max
  Coding DNA Sequence Number=SeqID_100158
  Homolog annotation: Hit_ID=Q9FMU8; Match level="QueryCoverage=79%, HitCoverage=24%, E-value=6e-41, Identity=52%"; Hit description =Arabidopsis thaliana genomic DNA, chromosome 5, P1 clone:MLE2
  Pfam annotation: Domain name=DUF1767; Domain location=60-153; Score =98.0; E_value=2.8e-26; Accession=PF08585.2; Description=Domain of unknown function (DUF1767)
MPPIRIRRLRLDSDSDGEEQDPLQPQSEPQTHFPVEISDDEDFLDVLDSLPPPSPACPVTDFLRRLGLSPKSDWLTSCLREFQSSVPAFEHLDVAAKAKRCFEQFLYADMNFCGSGILPPNVDAMHLNVLPGPYVLQVDEIINMTCPLRGRYEKANPGIKRCLKLSMTDGIQRVFGMEYRPIEALEVCASSGLK

SEQ ID NO: 216937 - protein, 105 aa, Glycine max
  Coding DNA Sequence Number=SeqID_100159
MTLVSACYQAFRITDSKKVYTDNHSGISARQRDSKVSMTDLVSAEDDVNLRVSTGLSAAIDEGRRRRHSKKVYTDNHSGISACQRDSKVSMTDLVSAEDDVNLRV

SEQ ID NO: 216938 - protein, 163 aa, Glycine max
  Coding DNA Sequence Number=SeqID_100160
  Gene Ontology: Mol. function=receptor activity; Cellular component =integral to membrane
  Homolog annotation: Hit_ID=Q6A151; Match level="QueryCoverage=90%, HitCoverage=76%, E-value=9e-35, Identity=46%"; Hit description =Peripheral-type benzodiazepine receptor
  Pfam annotation: Domain name=TspO_MBR; Domain location=18-157; Score=- 27.5; E_value=0.00048; Accession=PF03073.6; Description=TspOMBR family
MASQILHDTKKSQARRALRSLAIGIAVPFTLTLAIIIIFGSGRKYNQIISKPFWFSPLWFIHLATLGSSFFMGLAMWLVWADGGFQGETDAMSLYIVHVSLSIVWHPLVLVMGVYWLALISCLVNFGTLFLCYLRFRKVNPFARDLAKPCLTWTAYLCLFCSY

SEQ ID NO: 216939 - protein, 200 aa, Glycine max
  Coding DNA Sequence Number=SeqID_100161
MTRTKKIGQMMSKASKEIAEKNDVLTVAIGRPEHPGLVRAARAGVTIKQYFRPTPRTSHTSSFIAPEELEQLTQKIRDQLEESITEKMQSQGLALPPEPEVGPSSARVSTKESYVDPSGNDPETGDSEKYGLLYEGSTIVHKIHLLHDQVKVGVEEVRDADFPIPVPTEEVKLVGQALNTFLAWPTHLIKRLSEHVFQCH

SEQ ID NO: 216940 - protein, 347 aa, Glycine max
  Coding DNA Sequence Number=SeqID_100162
  Gene Ontology: Mol. function=oxidoreductase activity; Cellular component=membrane; Biological process=metabolic process
  Homolog annotation: Hit_ID=Q9LUF1; Match level="QueryCoverage=90%, HitCoverage=91%, E-value=4e-84, Identity=49%"; Hit description=11 -beta-hydroxysteroid dehydrogenase-like
  Pfam annotation: Domain name=KR; Domain location=49-227; Score=-76.1; E_value=0.006; Accession=PF08659.1; Description=KR domain
  Pfam annotation: Domain name=adh_short; Domain location=48-216; Score= 89.5; E_value=1e-23; Accession=PF00106.15; Description=short chain dehydrogenase
  Pfam module annotation: Pfam domain module=KR::adh_short; Domain location=49-227::48-216
MVFIHEMLNILVPPLGLVLLLLMLPPYLLFKILRFIVRSIFSENVAGKVILITGASSGIGEHLAYEYGRRGARLALVARRENRLKEVASIAKLFGSPEVIIIPADVSSSQDCKRFVDSTINHFGQLDHLVNNAGVSAPGLFESTTDIRNFAPAMDINFWGSAYGTYFAIPHLRKSKGKIIAIASCTGWLPVPRMSIYNASKAAVISLYETLRIELGRDIGITIVTPGLIESEMSQGKVLFKEGKMVSDQLIRDVQASLIPIRSVTEAAKSIVNSACRGDSYLTEPAWFTTTFYWKIFFPDVLEFCNRRTLISGSSERDTVSKKLLDLSGLKKYLCPKSVRNPNLKPS

SEQ ID NO: 216941 - protein, 65 aa, Glycine max
  Coding DNA Sequence Number=SeqID_100163
MAPRILQSSENGKYKLEIALSGFRPIRMIIFCFMSLIFAWTALFGFSIYRDAHFCLSRPFGFSTY

SEQ ID NO: 216942 - protein, 60 aa, Glycine max
  Coding DNA Sequence Number=SeqID_100164
MEFMIERKNLKVQYGGKKRQRKKKVRWHHCMLSKGHVGILETQRNNIGDYFLQTILVAFQ

SEQ ID NO: 216943 - protein, 143 aa, Glycine max
  Coding DNA Sequence Number=SeqID_100165
MTTEALVLLPGFGLARSSQEVFTPHQLRRIGIIPIEDCRVFMMLRRVTSHLIRPILSHQATSFIHGCINHPESLFAKWQFLNEQLEHFLIQSFVVSSKFGNNPSSWHLPLFHVVSGKFGNNPSSWHLPLFPLVGGKFGNNPSS

SEQ ID NO: 216944 - protein, 463 aa, Glycine max
  Coding DNA Sequence Number=SeqID_100166
  Homolog annotation: Hit_ID=Q9FMU8; Match level="QueryCoverage=96%, HitCoverage=64%, E-value=2e-48, Identity=33%"; Hit description =Arabidopsis thaliana genomic DNA, chromosome 5, P1 clone:MLE2
MLVPETIEILGGLVEELDAARNRLVGELKKPPRPRGRRTRNGVFIPLATRATLAAWPPGGVDDLARSGSTLHSTDPVQENNQGSGPSMSGTGNSNSIPHMASNADAMNMDMSRDTNSVSRGSSMANQLSSVMSKAEEMHIDASNVTREYSVDHQSSNMVSNVSAAYNDTVHITRESSVATECPPVVESVETYRDRTPVATDSSHPRRTSSTVREYSVDNRFSNMVSNVSVVHNDTVHITRESSATTECPPVVENVETYRDRTPAATDSSHPRRASSSVLNTSDVEMGDASDHPLILSGDQEVPFTYMASLSAKWAKMKEEAPAIRGKIKCFLTGVKGFRYKKRTSYELQAYVDDGSLISEILIDHDVVQKGIGFSPEEVTAAISSPDTKTVQQMRDTMHKFQAFLANFEGIILVELNKKSSLPLALEMSQGCPQSDARLLLRRLKSLNPPQVQKPTDPIELSP

SEQ ID NO: 216945 - protein, 58 aa, Glycine max
  Coding DNA Sequence Number=SeqID_100167
MSELTIEEFEEWSEMAKMMQNVAVPPVTILNTVHAKDQIYGEVSKLYVVRWKDVLDSV

SEQ ID NO: 216946 - protein, 1157 aa, Glycine max
  Coding DNA Sequence Number=SeqID_100168
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=91%, HitCoverage=91%, E-value=1e-111, Identity=39%"; Hit description =Chromo
  Pfam annotation: Domain name=Chromo; Domain location=1059-1109; Score= 22.2; E_value=0.0019; Accession=PF00385.14; Description='chromo' (CHRromatin Organisation MOdifier
  Pfam annotation: Domain name=RVP_2; Domain location=209-337; Score= -37.0; E_value=0.00076; Accession=PF08284.2; Description=Retroviral aspartyl protease
  Pfam module annotation: Pfam domain module=Chromo::RVP_2::RVT_1; Domain location=1059-1109::209-337::460-660
MADGTHSKASSERLEEAIVKLTASHLSMSSKINDLLHRMSQLETSHNNPHTPSSSSFGPSASSPLKINHRVKLDVPRFDGSDPTGWIFKITQFFEYHATPDQERLTIALFYMEGQALAWFQWMHRNTQLSSWFAFLHALHSHFASSTYEDPMGLLYKLSQRSSGGSGPPTYIFSSGCGMCPPSGGKAPQCLTPFILSPFFIHFGNTDLRQTQDALSSHLAPETLRVKGLIDDHPVSIPIDGGSTHNFLHNQVVLTLGLSLTEIVPLRVTVGNGDELHCHQLCTAVKVHIQNHSFTIDFHILPLYGADVVLGVQWLKTLGPVLTDYTSLTMKFITDGQLIELQGDREKDVELISPSQLRCIIHTNPSSTLFHIRLDPPSSQHDPLSHSLPAITTLTMKYSSLFQPLTTLPPSRPIDHKITLIPNSAPMSVRPYRNPYYQKQEIEEQVASMLASGLIQPSFSPFSPPVLLVKKKDCSWRFCVDYRALNAITVRDCFSIPTIDELGGARWFSKLDLMQGYHQTLTNEININKTVFRTHHGHYEFRRWSPTSSGKSVGHPTMASPSFHTCPTGFPWPYRILPAIYQGALKDAIMKSPVLALPDFSVPFVVEANAFGSGMGAILSQGGHPIAFFSKQFCPKELMNQAIQTPKQHHYLARLLGFDYSIHYRKGKTNVVVDALSRSLKDQTAALYALSTPQFLFLEDLRKELLSLPEFTALRDDIQANPIAYPEHTLNPGFILHKGRIWLSSNSSFIKPLLKEFHQSPTGGHMGIQKTLHCLQDNFTWNIIRDDTRAFVASCLTCQLTKYDNQKPAGLLCPLPVLAQPWEDLSMDFIIGPPAYHGNACIFVVVDRFSKDGRQAAWNAKEYRIRPRPTVHQQVLEGAVFFEWHEAPPELGVPPAIRWPNGGLTPFEITFGRKPPTFPQYVTGTSKIDAVDDILSQREAVFALLHHKLLKAQSCMKAVADTHCRDQEYQVGDWVLVKLRQHRQSSATGTTYSKLTKCYYGPFQVTERMGKVAYKLQLPEHSRIHPVFHCSLLKPYVASNTPTDAADLPPMAVDNHHVITPLAIVASKLIPSEFSPKKMVLIQWKGMPLEETSWEEWSTFKTIHHLEDKVLLDGQGSDTNGNDGRLQKAKGVHEENNARPTRKKTAPTYLEDYVRSA

SEQ ID NO: 216947 - protein, 407 aa, Glycine max
  Coding DNA Sequence Number=SeqID_100169
MDEEVHLCDGEVYVEKWMIYMGKLTCLTLLLMTGFKTIAFGVKSLGLAYVVPDSPLQPTTFRVRRCRGSYAPCELGIVGRQKDCGHVGRHTLSHNAQEFKVTPVRFDARGLGIRAPTPGLTERVDAKKVVQCQRRLFDVGGNSLDKSVKLVKPPHPRQVLSGTCATHAQHFCIRVTRGMGMCWRHDAWPPSLCNFYLLSPEISLPSCLLLVSPFVLPSPSSILQGIPSLIMSSFLSDSATDMGDMILGNTRCGASDNEYFSLEKLKVMRLIGEGTSRLCGRARPSSVSPTKEPVSVTVILSPFAFGGARRSGRDIRASPRVQRSYSAWSLLSTPAIAGCEWVRDDVLKYKSSLTSTASVASNLEDSYKIAVQTCRSDDFPFYRATLGSPPFFFMYRCLVEILGLVPP

SEQ ID NO: 216948 - protein, 494 aa, Glycine max
  Coding DNA Sequence Number=SeqID_100170
MKLTDKIGWVSLNNVSNKLFEFDSNVFCRFKDRFFKVLAIDAMVDGLPLMFNRDKEYRFPFYWQSNPTKFKSFDENLLTLVERVDKAILEQLPSSLDMRVILSFPSTSDPLLALDGIMDDFAWRPLVKDARLAGGIVPPFTIALVAGERGQPTGEVGHVVGTVEVAPGRKKLGVHLSLRALRQAAGLTPGSSHPSSLQDVPPALVIVETFASTVVVTVTLARCSGATTSAHVMPPSAASAPSIPPFVVLAATCLPRLIVPMSLWITYTPPAMLIHCGNLIRLAGVQNAIDSAKVFLKRSLMILEENRQQHQEALRKVSSMETKVAKWRATACTVWRQERPKVGSVFPKLLRTRSDGDELSTHCKSLQEEKKDLGGKVRDIVTKRDELPKVVVELKARLKESKSWLEESELQVAKEKEASKEVEEELIMCKKDAMEQHEKGFQKVVRQTGLYAKDLDLSFFYPFKDVTDNFLLDEKDIVVEEEVGEEQGADDADV

SEQ ID NO: 216949 - protein, 148 aa, Glycine max
  Coding DNA Sequence Number=SeqID_100171
  Gene Ontology: Mol. function=RNA-directed DNA polymerase activity; Biological process=RNA-dependent DNA replication
MNVDGSFFPSNKRIGSRGVVRDLNYTRMVGLSSLDEVDDIDMSEILAWNHDLNLAWDRGFRKVLCEMDNLNLVHILNSKEGFETHLHVTLLLEAREKIQRDWKIEVNHVDKEANGVAHFLAGRGTDELEANSIPLRRSFTPMAKLQAK

SEQ ID NO: 216950 - protein, 598 aa, Glycine max
  Coding DNA Sequence Number=SeqID_100172
  Gene Ontology: Mol. function=sulfate porter activity; Cellular component=integral to membrane; Biological process=sulfate transport
  Homolog annotation: Hit_ID=Q6ZXB8; Match level="QueryCoverage=55%, HitCoverage=91%, E-value=1e-101, Identity=60%"; Hit description =Plasma membrane sulphate transporter
  Pfam annotation: Domain name=STAS; Domain location=438-572; Score =91.9; E_value=1.9e-24; Accession=PF01740.11; Description=STAS domain
  Pfam annotation: Domain name=Sulfate_transp; Domain location=182-393; Score=221.2; E_value=2.4e-63; Accession=PF00916.10; Description =Sulfate transporter family
  Pfam module annotation: Pfam domain module=STAS::Sulfate_transp; Domain location=438-572::182-393
MEPNNACTMHSHCIEMSMEVHQVVPPPHKSTLQKLQGRLKETFFPDDPLRQFKGQPLKRKLILGAQYVFPILQWGPKYNLKLFKSDLVSGLTIASLAIPQGISYAKLASLPPIVGLYSSFVPPLVYAVLGSSKDLAVGPVSIASLVMGSMLRQEVSPTADPILFLQLAFTSTLFAGLFQASLGILRLGFIIDFLSKAILIGFMAGAAIIVSLQQLKSLLGITHFTNQMGLIPVMTSVFHNIHEEGIAVGRTFAALKNYKVDGNKEMMAIGFMNVVGSFTSCYVTTGAFSRSAVNNNAGAKTAVSNVVMSVTVMVTLLFLMPLFQYTPNVVLGAIIVTAVIGLIDLPAACNIWKIDKFDFVVMLTAFLGVLFISVQGGLALAVLIPLTLVATHNHFAVLAQQDQVGLSTFKILLQITRPKTVMLGKIPGTDIYRNLDQYKEAVRIPGFLILSIEAPINFANITYLNERTLRWIEEEEEDNIKEQLSLRFLVLEMSAVSAVDTSGISLFKELKATLEKKGVEARILNSGILLLYTPLYLVLVNPLAEVIEKLKKADEANDFIRADNLFLTVGEAVASLSSAMKGQSSTITEGTHTIVSHN

SEQ ID NO: 216951 - protein, 49 aa, Glycine max
  Coding DNA Sequence Number=SeqID_100173
MGLVGFYEGSKIGSEVLLAPKLGLETFRGTIELPKKALNRELKLKWEVS

SEQ ID NO: 216952 - protein, 358 aa, Glycine max
  Coding DNA Sequence Number=SeqID_100174
  Homolog annotation: Hit_ID=Q66D11; Match level="QueryCoverage=49%, HitCoverage=56%, E-value=4e-60, Identity=68%"; Hit description=ABC type choline/glycine/betaine transporter, ATP-binding subunit
  Pfam annotation: Domain name=ABC_tran; Domain location=203-358; Score= 131.4; E_value=2.5e-36; Accession=PF00005.17; Description=ABC transporter
PASAAAGRHAAAHLTDWSAAGTRHRASRPLATCRLQRAESDPDRAVCGAVWPADCTAGRAGGAFSAAGAPRYQRDWRRAGADCAGAVCTAAAGAQRGRGAAAGAAGVLARRAAAGAAGVALRTARGGGANRRAGGGRRTDWGRRLRRHCVSGIAEQRAGSGAAGRDSGGGAGGDIRCAAAIAVSKAFAGKEAIRNLSLKIEKGSFTVLIGTSGSGKSTTLKMINRLVEHDSGEIRFAGEPIEQMDARALRRRIGYAIQSIGLFPHWNVAKNIATVPSLLGWPREKIAARVEELLALLNLDSQLASRYPHQLSGGQQQRVGVARALAADPELLLMDEPFGALDPVNRQALQQEMLRIQQ

SEQ ID NO: 216953 - protein, 87 aa, Glycine max
  Coding DNA Sequence Number=SeqID_100175
  Subcellular localization annotation: CTP_CleavageSite=51; ConfidenceScore=5.01e-01
MVQPKPSAGLKGKPHQHALTHHAFLYFNKQKLGPPRPKSCFGIYPNSRKLSASKKWHFIEHLVGALLGTNNKGMGAMWLAPSSQNTT

SEQ ID NO: 216954 - protein, 34 aa, Glycine max
  Coding DNA Sequence Number=SeqID_100176
MSEISALSAAVVFSQALCEGVDKLKSVYSRKAPG

SEQ ID NO: 216955 - protein, 137 aa, Glycine max
  Coding DNA Sequence Number=SeqID_100177
  Gene Ontology: Mol. function=adenylate cyclase activity; Biological process=cAMP biosynthetic process
  Homolog annotation: Hit_ID=Q00UW5; Match level="QueryCoverage=70%, HitCoverage=13%, E-value=2e-14, Identity=41%"; Hit description=[TZ] KOG4203 Armadillo/beta-Catenin/plakoglobin
MWFLRVSVNFDQIIFEGVYALHPDIRISLDLWIAVVGGVHSHLISRVQRDKSRVGCFISQNEIMMTVFPMFQQLIEPHLVHAHLKIRNDFDPVLSPESSLFVLKSNKKPIKEGNFIIQPKVDFDIGISTVAGLLNLG

SEQ ID NO: 216956 - protein, 504 aa, Glycine max
  Coding DNA Sequence Number=SeqID_100178
  Gene Ontology: Mol. function=sulfate porter activity; Cellular component=integral to membrane; Biological process=sulfate transport
  Homolog annotation: Hit_ID=Q6ZXB7; Match level="QueryCoverage=86%, HitCoverage=70%, E-value=1e-142, Identity=57%"; Hit description =Plasma membrane sulphate transporter
  Pfam annotation: Domain name=Sulfate_transp; Domain location=178-451; Score=384.5; E_value=1.6e-112; Accession=PF00916.10; Description =Sulfate transporter family
MDQVPNEVHQVVAPPYKSSLQKFITKVKETFFPDDPLRQFKGQPLKRKLILGAQYVFPVLQWAPSYSFKLFKSDLISGLTIASLAIPQGISYANLANLPAILGLCEYVDFASNSSFVPPLVYVVLGSSMDLAVGPVSIASLVLGSMLTEEVSPSEQPDLFLQLALTSTFFAGIFQAALGILRLGFIIDFLSKAILIGFMAGSAVIVALQQLKGLLGIKHFTKKMALSIRKPKLFWVSAGAPLVSVIISTVLSSVIKAQLHGISVIGKLPQGVNPPSVDKLLFQGSHLGLAIKTGLVTGLLSLTEGIAVARTFASIRNYKVDGNKEMMAIGFMNVVGSTTSCYVTTGSFSRSAINHNAGAKTAMSNLVMSVTVLVTLLFLMPLFQYTPNVILGTIIITAVIGLIDLPSAYLIWKLDKFDFVVMLTAFFGVIFISVQLGLAIALVLVNPLADVIEKLQKADEVDDFVREDYLFMTVGEAVTSLSSLMKGQSPTMEEEEAQKIVTEY

SEQ ID NO: 216957 - protein, 185 aa, Glycine max
  Coding DNA Sequence Number=SeqID_100179
  Gene Ontology: Mol. function=uridine kinase activity; Biological process=cAMP biosynthetic process
MGINGPWITKSYLEMILERKGVPRLSTPPLVSNTTVPGSQETVIAAPKPIRVTPNLVTGLDDLPQPWTRSPTKSKMEPVVAEWHFISSDSSLPDNSVLGIFLELEDVANFGDDFLHAYLRFPLCQDFSHEATTDPSSFRDSVRLAPMPDSFDLDRGLLLAVQAIQALLENKGVPVIVGIGNMDVS

SEQ ID NO: 216958 - protein, 347 aa, Glycine max
  Coding DNA Sequence Number=SeqID_100180
  Gene Ontology: Mol. function=uridine kinase activity; Biological process=biosynthetic process
  Homolog annotation: Hit_ID=Q6YV21; Match level="QueryCoverage=79%, HitCoverage=44%, E-value=2e-42, Identity=34%"; Hit description =Uridine kinase-like protein
  Pfam annotation: Domain name=PRK; Domain location=64-229; Score= -19.1; E_value=6.6e-06; Accession=PF00485.8; Description =Phosphoribulokinase  Uridine kinase family
MDDEVVQRVFHEGGRDYFQQQPSTSSSSSSILQSLPLHVSFDHGYYLLVKSIQELREKKDGLVTVGIGGPSGSGKTSLTEKVASVIGCTVISMENYRDGVDEGNDVDSIDFDTLIKNLEDLTKGNDTSIPEFDYQQKRRVGYKAIKSPSSVVVIVDGTYALHAKLRSLLDIRVAVVGGVHFSLLSKVRYDIGDSCSLDYLIDSIFPLFRKHIEPDLHHAQIRINNSFVSSFREAVYKVKCRSKSSDGHSGSAFQGNEAQTDNFIEMYLRPPSASEEARINDWIKVRQSGIRYYLSLGDQRIVDKNFIIRPKAEFEGVCKRRDWYCRIGIRTDLCQHVNVYILRMTSL

SEQ ID NO: 216959 - protein, 95 aa, Glycine max
  Coding DNA Sequence Number=SeqID_100181
MQYIPEFYGLSDRGCLTMMYKDKTTFLVGLKDRMRHEVTYPLGITNFPLRISETLSLATIDQIVNNDPSVRNLDEHFYHILIKILTATNVSSSIL

SEQ ID NO: 216960 - protein, 677 aa, Glycine max
  Coding DNA Sequence Number=SeqID_100182
  Homolog annotation: Hit_ID=Q2XNF9; Match level="QueryCoverage=9%, HitCoverage=34%, E-value=2e-07, Identity=45%"; Hit description =Histone H1F
  Pfam annotation: Domain name=AT_hook; Domain location=468-480; Score =13.5; E_value=0.11; Accession=PF02178.9; Description=AT hook motif
  Pfam annotation: Domain name=AT_hook; Domain location=522-534; Score =16.0; E_value=0.04; Accession=PF02178.9; Description=AT hook motif
  Pfam annotation: Domain name=AT_hook; Domain location=554-566; Score =15.1; E_value=0.057; Accession=PF02178.9; Description=AT hook motif
  Pfam annotation: Domain name=AT_hook; Domain location=589-601; Score =8.0; E_value=0.97; Accession=PF02178.9; Description=AT hook motif
  Pfam annotation: Domain name=Linker_histone; Domain location=69-139; Score=9.5; E_value=0.00078; Accession=PF00538.9; Description=linker histone H1 and H5 family
  Pfam module annotation: Pfam domain module=AT_hook::AT_hook::AT _hook::AT_hook::Linker_histone; Domain location=468-480::522-534::554- 566::589-601::69-139
MTTTTTTTQQNPNDDDQDSRNARAMTLLHDSVVSKLKTLNPSLSIEPHHSSLIQRRLQNLFPASFRTPTHPPYALMICNAIIGLDEATGSTEKAISEFIEREYDDLPLAHGRILSLQLEKLCEIGEIESVSGGRYVVMVDDSERKQCSKSSEKKKRGKRRSKRGEGKSVEEKSEEGRLQVFGKQSHQHAEAEAEAEAEAEAQCGLGESQIQDSRLHLKTTCSSQPTALKCIPAAANPLLPAPLQLQMPCNEPSESGVDAASKMSGSLSLNVEECKQDENPMTGHSDHPSRERTPHKCKQIADHQEETLLPSGDATAIQQEPNEKKIHGRGLELHRTARHINKKMHPHDQADDPECSSHLNKKETGSSSQPAAPNSTVNPTHDIGKQLVVPTSEGSPKCVVSTGLEFPSTQLQQQVSSDIDLGTVSKRKASSTLENDHDGQPQHYNQGSPKGDLDEDPMSGGSEQKPPKRPRGRPPKLETGANNPGKSLLPSDDDIHDEQRPNKMEKQQLLYGRGRGRGRGRGRGRGRPPKIKETPIQYEEQLQQQDQPQQHSQGRGRGRPRKLIQDTNICETQLLQEVQAKQQHVRVQGRGRGRPPKPKENTNQCEEQAQDQAQGLVNSPSSGWNYNQNLEQRGGRHHISESGEAKSPAGSRLEPESKYGSGEVSQSNVEANQSLGS

SEQ ID NO: 216961 - protein, 187 aa, Glycine max
  Coding DNA Sequence Number=SeqID_100183
  Homolog annotation: Hit_ID=Q53NY5; Match level="QueryCoverage=61%, HitCoverage=50%, E-value=3e-11, Identity=33%"; Hit description =Expressed protein
  Pfam annotation: Domain name=DUF1685; Domain location=15-116; Score =147.3; E_value=4.2e-41; Accession=PF07939.2; Description=Protein of unknown function (DUF1685)
MSRRPHAPPPPPPPRPLYKQQSWSPDTLRDEAWQRRKDNSHHISGDNHRCSHRLSKSLSEDDLDELKACFELGFGFDSPEIDPKLSNTIPALELYHAVNKQYNHHSLSRSSSSSSLVSDSDIASPTTIFNPGDDLAAKKTRLKQWAQVVACSVRESSSSSCSNPSDQMFTQVTNILVGCVKKQEKGR

SEQ ID NO: 216962 - protein, 670 aa, Glycine max
  Coding DNA Sequence Number=SeqID_100184
  Gene Ontology: Mol. function=calcium ion binding; Cellular component =mitochondrion; Biological process=translation
  Homolog annotation: Hit_ID=Q94HS0; Match level="QueryCoverage=88%, HitCoverage=75%, E-value=1e-142, Identity=33%"; Hit description =Putative salt-inducible protein
  Pfam annotation: Domain name=PPR; Domain location=102-136; Score =39.3; E_value=1.3e-08; Accession=PF01535.11; Description=PPR repeat
  Pfam annotation: Domain name=PPR; Domain location=137-171; Score =37.8; E_value=3.8e-08; Accession=PF01535.11; Description=PPR repeat
  Pfam annotation: Domain name=PPR; Domain location=172-206; Score =36.7; E_value=8e-08; Accession=PF01535.11; Description=PPR repeat
  Pfam annotation: Domain name=PPR; Domain location=207-241; Score =24.5; E_value=0.00038; Accession=PF01535.11; Description=PPR repeat
  Pfam annotation: Domain name=PPR; Domain location=242-276; Score =33.1; E_value=9.5e-07; Accession=PF01535.11; Description=PPR repeat
  Pfam annotation: Domain name=PPR; Domain location=277-311; Score =40.2; E_value=7.3e-09; Accession=PF01535.11; Description=PPR repeat
  Pfam annotation: Domain name=PPR; Domain location=312-346; Score =36.0; E_value=1.3e-07; Accession=PF01535.11; Description=PPR repeat
  Pfam annotation: Domain name=PPR; Domain location=347-381; Score =42.5; E_value=1.4e-09; Accession=PF01535.11; Description=PPR repeat
  Pfam annotation: Domain name=PPR; Domain location=382-416; Score =48.4; E_value=2.5e-11; Accession=PF01535.11; Description=PPR repeat
  Pfam annotation: Domain name=PPR; Domain location=417-451; Score =38.6; E_value=2.1e-08; Accession=PF01535.11; Description=PPR repeat
  Pfam annotation: Domain name=PPR; Domain location=452-486; Score =43.6; E_value=6.8e-10; Accession=PF01535.11; Description=PPR repeat
  Pfam annotation: Domain name=PPR; Domain location=487-521; Score =33.8; E_value=6e-07; Accession=PF01535.11; Description=PPR repeat
  Pfam annotation: Domain name=PPR; Domain location=522-556; Score =36.6; E_value=8.6e-08; Accession=PF01535.11; Description=PPR repeat
  Pfam annotation: Domain name=PPR; Domain location=557-590; Score =15.2; E_value=0.12; Accession=PF01535.11; Description=PPR repeat
  Pfam annotation: Domain name=PPR; Domain location=591-625; Score =14.0; E_value=0.16; Accession=PF01535.11; Description=PPR repeat
  Pfam annotation: Domain name=PPR; Domain location=67-101; Score=28.9; E_value=1.8e-05; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR; Domain location =102-136::137-171::172-206::207-241::242-276::277-311::312-346::347 -381::382-416::...
  Pfam module annotation: Domain location=417-451::452-486::487 -521::522-556::557-590::591-625::67-101
MKLFKTRDAAFAFFKLAFGDCSDSEEILRLSCVSAHVLAAQKLQLLAQDVVSWLIARVGTGPRPSNLTFNAMICGFCRQHRVVVGESLLHLMPKFMCSPDVVTFNILINACCIGGRTWVAIDWLHLMVRSGVEPSVATFTTILHALCREGNVVEARKLFDGIQDMGIAPNAAIYNTLMDGYFKAREVAQASLLYEEMRTTGVSPDCVTFNILVWGHYKYGRIEDSDRLLKDLIVSGLFLDSSLYDVMVSSLCWAGRLDEAMKLLQELLEKGLTLSVVAFNSLIGAYSRAGLEDKAFEAYRIMVRCGFTPSSSTCNSLLMGLCRKGWLQEARILLYRMLEKGFPINKVAYTVLLDGYFKMNNLEGAQFLWKEMKERGIYPDAVAFTALIDGLSKAGNVEEAYEVFLEMSAIGFVPNNFAYNSLIRGLCDCGRVTEALKLEKEMRQKGLLSDTFTFNIIIDGFCRRGQMKFAIETFLDMQRIGLLPDIFTFNILIGGYCKAFDMVGAGEIVNKMYSCGLDPDITTYNTYMHGYCRMRKMNQAVIILDQLISAGIVPDTVTYNTMLSGICSDILDRAMILTAKLLKMGFIPNVITTNMLLSHFCKQGMPEKALIWGQKLREISFGFDEISYRILDQAYCLMQDDVELAMEIEECFVPFKRKGSLGATVRGVAI

SEQ ID NO: 216963 - protein, 47 aa, Glycine max
  Coding DNA Sequence Number=SeqID_100185
MGGRFLYYPQACTFKNTWSIEYTVTVPAQCHPWHSLCQPSQLCCQQP

SEQ ID NO: 216964 - protein, 119 aa, Glycine max
  Coding DNA Sequence Number=SeqID_100186
MVSNVIYYLQGSRPQDSQWTRRSPTGPWGSSSNYGTLSVLQSDHHSDLPLPKCQQDRARKTPSGPEEVQQGPGVLALIMGLCRFYRVPAAPNKVIRPPINRAFIKKYCAPRQAQGEAPR

SEQ ID NO: 216965 - protein, 236 aa, Glycine max
  Coding DNA Sequence Number=SeqID_100187
  Pfam annotation: Domain name=Transposase_23; Domain location=33-103; Score=-13.4; E_value=0.033; Accession=PF03017.5; Description =TNP1ENSPM transposase
RLALPPEPDIGPSATRVSTKESCVDPLGNDLDTGDSDKCELYVEENPPRLVSLGRHCEGSTTIHNIPLLHDQVKVGVKEVRDADAPIPVPTEQVKLVGQTLNTFLAWPTHLVKRLLEHGAVGPAKPANRLDNDIDDPLYLMTLTIPQLFLKPLFLMMPKYNQTRLLQQTFKVKQIEIGSRLIQGQANKTKKKALVITRHYNRLPETRLQIGFSKGFWNLNFKSCNRLPVTKLQKTL

SEQ ID NO: 216966 - protein, 99 aa, Glycine max
  Coding DNA Sequence Number=SeqID_100188
  Gene Ontology: Mol. function=hydrolase activity
  Homolog annotation: Hit_ID=Q69MT1; Match level="QueryCoverage=76%, HitCoverage=21%, E-value=2e-13, Identity=52%"; Hit description=Acyl -CoA thioester hydrolase-like
MDLERNGTSKSVEILDELAHPDKMQVLLREGVLRTEGPLERTGFSKTEDLASQRAYMAGEWNIPGHRLMGLRLEEPASMETEVVVLVVVGYVVEESVEK

SEQ ID NO: 216967 - protein, 366 aa, Glycine max
  Coding DNA Sequence Number=SeqID_100189
  Gene Ontology: Mol. function=ATPase activity, coupled to transmembrane movement of substances; Cellular component=integral to membrane; Biological process=transport
  Homolog annotation: Hit_ID=Q3PIT3; Match level="QueryCoverage=60%, HitCoverage=70%, E-value=6e-53, Identity=50%"; Hit description=ABC transporter, transmembrane region
RGAGLRPPVEALVAAWRHARGGAVAGRGHWRPGAARHGLGLAHRRGRGGGAVLHAVHAGRHGAVHAHHGSVVAAQSRHRLHAANERESLLRDAADLGRHHAGRPHRLRRRGRRGGRAGGMRPIGRRALGSPGGNMNKSWEIMRPPVEPGLPGAGHARVAAVPGHLSLARVPGRAGVHPAGLLPAAAGLQPVALRRLPPGSDPAQRPGAAPGAAFLRRIAGAGQRPAGQGGAERRAGAARFRGRQHAAVRPRLRHAAVQRGAAVRAGLAHGTGRRGRAGGRRGGPVAGDARPRSHDAALPPGARTGHARGAHLRYRPEHLRTIPPRPGALPGDADRLVSRRQFQFPLRDCRARAAADPCGAAVAGHL

SEQ ID NO: 216968 - protein, 87 aa, Glycine max
  Coding DNA Sequence Number=SeqID_100190
NLDLKHVKNHVLDVGFQKPRLVRNQTYQLCKRASEVASFEDMQEHEDADHDHAEELVEHRGPEEQEDHADDGVERHNLDIRAGRQRQ

SEQ ID NO: 216969 - protein, 83 aa, Glycine max
  Coding DNA Sequence Number=SeqID_100191
MGAFVEGNYPLRGNQPKEEYAHNTDNRGGGKGWRICNFGCQIYTFFGHCDCVRAREPHKRMKEQGKISVNGEGFQRQFFQNHP

SEQ ID NO: 216970 - protein, 148 aa, Glycine max
  Coding DNA Sequence Number=SeqID_100192
  Subcellular localization annotation: CTP_CleavageSite=94; ConfidenceScore=5.11e-01
MPISPCGSISWSVPSRHRGRAHKTPGGPGEVQQGPGVSSFGYGPLSVLQGARSPQQGITPVRHSVDPKKSNRVLGFPTLITGLCQFHNSACRPQQGAGQDTTVAWGWPAADNRRTAATSKAPQFIHKKVSALPTTHGRPAGDQSPKPK

SEQ ID NO: 216971 - protein, 160 aa, Glycine max
  Coding DNA Sequence Number=SeqID_100193
  Subcellular localization annotation: CTP_CleavageSite=43; ConfidenceScore=5.27e-01
MSLSSWQNKLNRCFMLKILVMKGGQWHMATLPSSPPLPPESASSSSLPKKTRKVTRLRSLATKPGGMERPMVHVNPAIGKDDGPHKKKLRMYFGIVARDKDVRKKALTIQQLNTAPHVLSRGGYDLLEEKLMKEKQKKRLEQVSQFESTKTIVDPPSPIR

SEQ ID NO: 216972 - protein, 123 aa, Glycine max
  Coding DNA Sequence Number=SeqID_100194
MDVDPFTFINLWSSGLMPSKASKLIKNKPFTHFDEVVAYFRKLAFDQHLKDTLSNPNYKGQLQQTINEVFKFDDLVADEFHEEIESFLNVCNNDFKANQLYDQHVADIIEIESSIELDQSKLI

SEQ ID NO: 216973 - protein, 475 aa, Glycine max
  Coding DNA Sequence Number=SeqID_100195
  Gene Ontology: Mol. function=intramolecular transferase activity, phosphotransferases; Biological process=carbohydrate metabolic process
  Homolog annotation: Hit_ID=Q7XHZ2; Match level="QueryCoverage=94%, HitCoverage=75%, E-value=1e-155, Identity=65%"; Hit description =Putative phosphoglucomutase, chloroplast
  Pfam annotation: Domain name=PGM_PMM_II; Domain location=99-232; Score=22.6; E_value=1.4e-05; Accession=PF02879.6; Description =Phosphoglucomutasephosphomannomutase, alphabetaalpha domain II
  Pfam annotation: Domain name=PGM_PMM_III; Domain location=234-358; Score=1.9; E_value=0.028; Accession=PF02880.6; Description =Phosphoglucomutasephosphomannomutase, alphabetaalpha domain III
  Pfam annotation: Domain name=PGM_PMM_IV; Domain location=388-459; Score=2.2; E_value=0.014; Accession=PF00408.10; Description =Phosphoglucomutasephosphomannomutase, C-
  Pfam module annotation: Pfam domain module=PGM_PMM_II::PGM_PMM _III::PGM_PMM_IV; Domain location=99-232::234-358::388-459
MIQISYYGDSKLNLSSSHTNLKASHLPFNRNGFKFFTNAGGLGKADIKDILERAADIYNRFTEESLTNSERKASLSIKKVDYMIVYTSDLVKAVRKAAGNIGMTLLKYFYNKKPLGGFHIVVDAGNGAGGFFAAKVLEPLGAITSGSQFLEPDGNYYAWRNDFNWVWQMDFNSLSNKWLFYSGLFPNHIPNPEDKTAMKAITQAVLDNKVDLGIIFDTDVDRSAAVDFTGREFNRNRLIALMAAIVLEEHPGTTIVTDSVTSDGLTTFIEKKLGGRHHRFKRGYKNVIDEAIRLNSIGEESHLAIETSGHGALKENHWLDDGAYLMVKILNKLASARASGKGGGSKVLTDLIDGLQEPDFAVELRLKINQNHPDLKGGAFRSFREYGEAVLKHLENSIGSDPSLHKAPVNYEGVRVSGYGGWFLLRLSLHDPVLPLNIEAPSNDDAVKLGLAVLAAVKDFAGLDTSALNKFVGAS

SEQ ID NO: 216974 - protein, 141 aa, Glycine max
  Coding DNA Sequence Number=SeqID_100196
  Homolog annotation: Hit_ID=Q9LFQ7; Match level="QueryCoverage=19%, HitCoverage=8%, E-value=8e-07, Identity=71%"; Hit description =Lysophospholipase-like protein
MIFLHPEWVAAVVHGVLALGVSHLQNITTLLEGFRAAHAPIGVDQGMGSSHGFQMSAVAPGVGFSCGFQIIADGWESKKVPLVVAHGGDDVVCVEELHAHALSKDISRDVAPDGWGIRRQRGVGVRGHVGVCSDKIFIVSS

SEQ ID NO: 216975 - protein, 157 aa, Glycine max
  Coding DNA Sequence Number=SeqID_100197
  Gene Ontology: Mol. function=transcription factor activity; Cellular component=intracellular; Biological process=regulation of transcription, DNA-dependent
  Homolog annotation: Hit_ID=Q46YB4; Match level="QueryCoverage=94%, HitCoverage=94%, E-value=4e-46, Identity=62%"; Hit description =Regulatory protein, MarR
  Pfam annotation: Domain name=MarR; Domain location=47-116; Score =37.8; E_value=3.8e-08; Accession=PF01047.13; Description=MarR family
MTPPEYPSAVSGQPENYHFTEQVGHLLRKVYQRHLAIFQQNVGDSQLTAVQFITLCAVRDMGPSSLTELVQVTAVDQATIRGIVERLKPRDLITVTPDPVDRRKVVVGLTDAGAVLLTETVPQAAKITELTFGTLNPAERIAMIFLLNKMLEDPPTG

SEQ ID NO: 216976 - protein, 288 aa, Glycine max
  Coding DNA Sequence Number=SeqID_100198
  Gene Ontology: Mol. function=2 iron, 2 sulfur cluster binding; Biological process=electron transport
  Homolog annotation: Hit_ID=Q2XF97; Match level="QueryCoverage=41%, HitCoverage=10%, E-value=2e-43, Identity=76%"; Hit description =Aldehyde dehydrogenase family protein, putative/cytochrome c family protein, putative
  Pfam annotation: Domain name=Fer2; Domain location=24-84; Score=29.8; E_value=9.7e-06; Accession=PF00111.17; Description=2Fe-2S iron-sulfur cluster binding domain
  Pfam annotation: Domain name=Fer2_2; Domain location=92-156; Score =79.4; E_value=1.1e-20; Accession=PF01799.10; Description=[2Fe-2S] binding domain
  Pfam module annotation: Pfam domain module=Fer2::Fer2_2; Domain location=24-84::92-156
MAISEVQSPREGAKTTLTEHPLMLSVNGEQLHAQVMADTPLLLVLRNDLALNGPKYGCGLGECGACTVLIDGVAARSCVIPALGVSGRAIVTLEGLGDRQRLHPVQRAFIEEQAAQCGYCLNGMIMTTKALLDRNPAPSEAEIRQALAPSFSAAMRAPTLMTDSRPSSPSQAELLQRDGVLLIVDSVQPPSGPVPKGQTPVLKPREQGLFIALCDSGEIYAFNGHVDLGTGVRTALGQIVAEELYLRMDQVRMVLGDTERAPNQGATIASATLQISAVPLRNAAAEAR

SEQ ID NO: 216977 - protein, 148 aa, Glycine max
  Coding DNA Sequence Number=SeqID_100199
MIFLPHLQLLLQHPLQQLLQSQSLQVVGPPGSIPTVEKFLASVAWPGAQPSLHREDEEEEAGERQVRQEAAATPERSLEGTSEPPAPVVDLSLPQHAVDPSTPILEILEDPTTPILTLNTSPPATPVLYLTDEEDVQTRDTQDQSREF

SEQ ID NO: 216978 - protein, 255 aa, Glycine max
  Coding DNA Sequence Number=SeqID_100200
  Gene Ontology: Mol. function=RNA-directed DNA polymerase activity; Biological process=RNA-dependent DNA replication
  Homolog annotation: Hit_ID=Q1T0R3; Match level="QueryCoverage=52%, HitCoverage=57%, E-value=5e-15, Identity=35%"; Hit description =Hypothetical mitochondrial protein atmg00310
MLVCNFYEQEIRAFNKELLGKWRWDMLQQSNKLWSKILHSKYGGWRSLVEGSRRNNESGWWKDLMEVTHDQQMNSILQDGTTWRVGCGDKIKFWEDSWAGHGKAQKMKYPRLYRISLQQHKLIQQVGSFNDSSWEWNLSWRRIQQEDAAHLFFNCTKSLALWWESLAWTGIVGAFPIIPRYHFLQHQNGMNGGKRNNRWKDVDEEKDKEEQNKKKIKEVSHECSLVNKHKAIWMTKPEEITKEEYSAFYKSLTND

SEQ ID NO: 216979 - protein, 141 aa, Glycine max
  Coding DNA Sequence Number=SeqID_100201
MMKVYGKTFLQAECESNALFNVIMATDPTSPPQSDGQSEATSKRSRTTTRLRTLTLRTVDQPRPAVYVDPATGRASGPMREKFHSYLGVVAREKVPIIHNNWKDVPETLKDIVWNDILWSKHPLLAVEHVEISLGRKNSTF

SEQ ID NO: 216980 - protein, 669 aa, Glycine max
  Coding DNA Sequence Number=SeqID_100202
  Gene Ontology: Mol. function=DNA binding; Biological process=DNA integration
  Pfam annotation: Domain name=Transposase_23; Domain location=360-424; Score=-8.1; E_value=0.0088; Accession=PF03017.5; Description =TNP1ENSPM transposase
MVYDLNDIFVSLPNKRTCFKKHDLQMGKLDMNAKFDIGEATKVKTKVMSTVATRWRQFKSTLTSKFVFAKSEGQQTQDVVTKYGLDPEAWKQFEETRLTPNWEGIRKRAQSIQKHNDCPHVLSRGGYDLLEKKLLDQKRKRIQEEALLSENAASLDEPPSPIKRHVKWKVARTRAVGNMTSESAQEIADKIDSLEEQVTQGSFVPHGRQDILNTAIGRPEHGGRVRAAGLGVTITQYYGRASRTCSSSSTSISQQQLDEVVARLREDMTGQIREELRTQIKEELRTQLEEENKRSLEIMTNALKEAIKKELSNKGSPELLQIQPDIQQVAARVSTQGSNVVTNVQASQEHHADAIPLMGLYVQLKDGTTRLVAMGKIMEGDSVIHTVAYADDVVRVSVETVIDPEAEVPYATSEIQYVKQAVDTFVAWPTHLVKAVLDEVPQSIPHNEDAHVPKPTNVDADDPLRGLIKYSFDIYDNPLEINFDGSFLGIVDASASIFITYSDVSEIIAGDKSLNISIIQLWLMYIHEWSQIFSQGFMYAFLEPQSLVCSKERRSECEQYLLRWLKESDREVYIGPYFHHVMTKLKTTLSPETKAVAPKWIEVKSHVQTGCYECGYYVMHWIWNIIASDIKSDWSMWFANDTPLDIDMITTIRKKWATFFLKMAISKNG

SEQ ID NO: 216981 - protein, 90 aa, Glycine max
  Coding DNA Sequence Number=SeqID_100203
SVMMKLKMTLSPETKAVAPKWIEVKSHVQTGCYECGYYVMHWIWNIIASDIKSDWSMQQLSAAIVPPSLALQQLTEQMKCPQSLDGCLVE

SEQ ID NO: 216982 - protein, 210 aa, Glycine max
  Coding DNA Sequence Number=SeqID_100204
  Gene Ontology: Mol. function=translation initiation factor activity; Cellular component=intracellular; Biological process=translational initiation
  Homolog annotation: Hit_ID=Q5GXU9; Match level="QueryCoverage=99%, HitCoverage=25%, E-value=4e-13, Identity=53%"; Hit description =Translation initiation factor IF-2
MTPDEERADILRKLEESRARNLAEQQALAEKDRLRDEAIVRAREEEIAAKERAEAEKKAAEEAAAAAKAAEALAATKPKRAPIDETAPRPPRAPAAAPAAPRSAPPPPRSDDRNNRSAPRNERGPGDRFAGQMHLSAADRARRGNSNNSNTRGRPGGRNQVGGRRDMSRVINNVGPHAFERPTAPVVREVAIGDTITVADLAQKLALKGG

SEQ ID NO: 216983 - protein, 274 aa, Glycine max
  Coding DNA Sequence Number=SeqID_100205
  Gene Ontology: Mol. function=translation initiation factor activity; Cellular component=intracellular; Biological process=translational initiation
  Homolog annotation: Hit_ID=Q5GXU9; Match level="QueryCoverage=65%, HitCoverage=19%, E-value=2e-86, Identity=90%"; Hit description =Translation initiation factor IF-2
MGHVAGDFHVGHAHRGQPMLAHGVVHQGAEFTAQLGGDTVGSMESLGHEELLVQLSPDQRSGATFDSIVARPTVGRYRYMVGPDRWSGHLAALQGARHFDTLEALDLVTRLDVVVGLHRDTAFGTVADFLDVFLEAAQRFQFAFEDHHAVAQHADRLVALDHALDDHRAGNGAQLGAAEHVADLGDTDDLFADLHAQQTGGHLLHLIDHVIDDREVTQVDAVGFDDATGRSIRTHVEADDGGLRSSRRVGVRFGDAGHAGVDHVDADVVVGQRD

SEQ ID NO: 216984 - protein, 167 aa, Glycine max
  Coding DNA Sequence Number=SeqID_100206
MLQRVRKSWNAVQRKDKELRGSNYGIIGGYHQWLKARTQGITWLPKLKSSSGEEAEVPEESEEVQALKAELERMPVVKENFKMTTIRVKKECDKPRDVNVATAEALERETKRAQKKEWGRNKFRGAATTNSSFKGLLSAVLAPSPNPLTRAKSNSGAKRDGAISEPI

SEQ ID NO: 216985 - protein, 313 aa, Glycine max
  Coding DNA Sequence Number=SeqID_100207
  Gene Ontology: Mol. function=chitin binding; Cellular component =extracellular region; Biological process=chitin metabolic process
  Homolog annotation: Hit_ID=UPI00006A17C9; Match level="QueryCoverage =60%, HitCoverage=100%, E-value=7e-19, Identity=33%"; Hit description= UPI00006A17C9 related cluster
RATRPHLQRTTHPRLEDYMSSPSEGYMPLPLEGYTSSPLRDYMSTPSEGYMSFRGLHVLALRGLHPLAFRGLHALAFRGLLVLTFRGLPVLTFRGLHAFSFRGLHVLAFKGLHVLAFKGLHVFAFKRLHALAFKGGLDALAFRGLNTLAFRGLHVLAFTGLHVLTFRGLHICAFRGLKHHQREAIVQPPCILGQDFTHATTKRRVQIMRTNMTTLTQIWMTLLLSNILPSHHNADLPLRKYQLGSRPQDTQWTRRSPTGPWGFQLWLQAFVSPTGDRVRETPSGPGEVQQGLGVSSSDYGPLLVLRSARRPQQ

SEQ ID NO: 216986 - protein, 117 aa, Glycine max
  Coding DNA Sequence Number=SeqID_100208
MEGTSVTRAVISGITWKEYLHDTLRHHDSLRMRYLHYPVAQTVAARFIAHFISRTVAECAINCAATTRSVISGITWKEYQSPVRLSAASYERNICAIRCATMIHCGWDICIIPSHKP

SEQ ID NO: 216987 - protein, 269 aa, Glycine max
  Coding DNA Sequence Number=SeqID_100209
  Gene Ontology: Mol. function=two-component response regulator activity; Cellular component=intracellular; Biological process=two -component signal transduction system (phosphorelay)
  Homolog annotation: Hit_ID=Q5PN70; Match level="QueryCoverage=98%, HitCoverage=79%, E-value=1e-121, Identity=82%"; Hit description =Putative receptor/regulator protein
  Pfam annotation: Domain name=CheW; Domain location=1-114; Score=41.0; E_value=4.1e-09; Accession=PF01584.9; Description=CheW-like domain
  Pfam annotation: Domain name=Response_reg; Domain location=135-262; Score=35.3; E_value=2e-07; Accession=PF00072.14; Description =Response regulator receiver domain
  Pfam module annotation: Pfam domain module=CheW::Response_reg; Domain location=1-114::135-262
MPEFTKPAGMKSPLMGMVNIRDQVIPVIDLAAVAGCKPTTGLNILLITEYARSVQAFAVESVENIMRLDWKQVHAAETAVSGRYITSIACLDEKTDTNELAMVLDVEQILYDITPANHDLHATNLKTTKFHIKPGAVAIVAEDSKVARSMLEKGLQAMEIPAQLHITGKDAWEKIGVLAAQAQAEGVPITDKIALVLTDLEMPEMDGFTLTRNIKRDDALRQIPVVIHSSLSGSANEDHVRKVGADGYVAKFEINELSSVIYRVLEKKR

SEQ ID NO: 216988 - protein, 124 aa, Glycine max
  Coding DNA Sequence Number=SeqID_100210
  Homolog annotation: Hit_ID=Q9FGZ2; Match level="QueryCoverage=35%, HitCoverage=27%, E-value=5e-09, Identity=70%"; Hit description =Arabidopsis thaliana genomic DNA, chromosome 5, TAC clone:K6M13
  Pfam annotation: Domain name=PPR; Domain location=11-45; Score=35.3; E_value=2.2e-07; Accession=PF01535.11; Description=PPR repeat
MKEQGLHLDTRAYNIVIHVFCKFGKVNKAYQLMEEMKTKGINKINWGEDHLPHGPSFFIFMTETSVDDCVLYQFLLYKPNIFIYNWWSCCWYFGICRLERICVLLTSHVIYFTWAHGQSKVLQA

SEQ ID NO: 216989 - protein, 37 aa, Glycine max
  Coding DNA Sequence Number=SeqID_100211
MEFKHSKRQLIGDGDQFQKALDILIQMRKHSIKKWNL

SEQ ID NO: 216990 - protein, 69 aa, Glycine max
  Coding DNA Sequence Number=SeqID_100212
MSVSSRQRARLPPWLTKGADSKRMFAGYRRVSLHATGLLGHGNKRWGGRQKQGFCSYLSSICDEELRHT

SEQ ID NO: 216991 - protein, 178 aa, Glycine max
  Coding DNA Sequence Number=SeqID_100213
  Gene Ontology: Cellular component=nucleus; Biological process=mitotic cell cycle
  Homolog annotation: Hit_ID=Q2HT10; Match level="QueryCoverage=91%, HitCoverage=25%, E-value=3e-60, Identity=68%"; Hit description=Barren
MRDRNCADPVFVFSVAFAVDPLYRQMSAQFDEGGAKGLLMNNLGIYGKCRLLFDSLEVPGKCITSQNESDISDTIDLSFARDCVEQMILDIHTKGEISPTLRVIVNQFDENNKRPSDFQSSTEKSGEEFDAAIDSELATEKEYENFPSWSNDHDSEAFPAEWGSDDADPTFPSYHQVC

SEQ ID NO: 216992 - protein, 178 aa, Glycine max
  Coding DNA Sequence Number=SeqID_100214
  Homolog annotation: Hit_ID=Q1SP02; Match level="QueryCoverage=65%, HitCoverage=26%, E-value=4e-14, Identity=36%"; Hit description=IMP dehydrogenase/GMP reductase
MTGIKGAPYRRRLDTLTVTDVCWMPYAEHRGVKGFDLISSYTGQLKWGQIVVYVRPERVLRQFGYLQTVPPPPVYDSLTGDDIDDRWLHFSEHLVPSGELCVVPGQVASDYMEWFFRISHPFVTRTEETAEPRHPPPPHDEEFVEPPIPEVDCQGCPGMAEDLGAIAEDLERVINLRM

SEQ ID NO: 216993 - protein, 67 aa, Glycine max
  Coding DNA Sequence Number=SeqID_100215
MTPTHDALLYYNGRWNVSRQNEFFGYSFTGKNPKKFDIPSACTMDELKDLIKQVASHEILPYGVSAF

SEQ ID NO: 216994 - protein, 96 aa, Glycine max
  Coding DNA Sequence Number=SeqID_100216
MGLDVEGASSNRLPVLCNRLHRGTGHCCEIRVWPLIVMAAQFIHDRVPRGSLGDPRRQCEVLIPGHDSIHGYFIGASRGTRAIASVHCGVDITHAY

SEQ ID NO: 216995 - protein, 739 aa, Glycine max
  Coding DNA Sequence Number=SeqID_100217
  Gene Ontology: Mol. function=microtubule motor activity; Cellular component=microtubule associated complex; Biological process =microtubule-based movement
  Homolog annotation: Hit_ID=Q1RV39; Match level="QueryCoverage=100%, HitCoverage=80%, E-value=0.0, Identity=75%"; Hit description =Calponin-like actin-binding; Kinesin, motor region
  Pfam annotation: Domain name=Kinesin; Domain location=336-606; Score =408.8; E_value=7.9e-120; Accession=PF00225.13; Description=Kinesin motor domain
MVGIVAAKDLPAEPSEEEFRLVQPGAVPRVVESPIDSALVPDGAPLSAFQYFENVRNFLLTVQEIGVPTFEASDLGGKSARIVNSVLALKSYSEWKQTGGNGVWKIGGTIKPTVSSKSFVRKNSEPFTNSLSRNSSINEKSMTALTSDVESNKMSGSHSLSMLVRAVLLDKKPEEVPLLVESVLNKVVEEFEHRIASQGEQTKISRGAVLLGNGSVSKFVMADKKMDNKIPMVTKKERLLHKNFVDDEESKRQLLKKQMLFDQQQRDIQELKHTIHTTKAGMQFLQMKFHEEFSNLGRHVHGLAHAASGYNRVLEENRKLYNQVQDLKGSIRVYCRVRPFLSAQANYSSTVNNIEDGTITINIPSKNGKGHRSFNFNKVFGPSASQAEVFSDMQPLIRSVLDGFNVCIFAYGQTGSGKTHTMTGPKEITEKSREIRSNSQRGLSVPDACLVPVSSTKDVIELMNLGQRNRAVGATALNDRSSRSHSCLTVHVQGRDLTSGTILRGCMHLVDLAGSERVDKSEATGDRLKEAQHINKSLSALGDVIASLAQKNQHVPYRNSKLTQLLQDSLGGQAKTLMFVHISPEVDAVGETISTLKFAERVATVELGAARVNKDGADVKELKEQIACLKAALARKEGESEHSLSGSSEKYRTMASELSPYHANQQGADIVSPGCRQPMLDVGNIELHSSTTLRQKTQSYDFDEMSTNSPPWPPVNNPRQLYGDDDRETGSGEWVDKVM

SEQ ID NO: 216996 - protein, 98 aa, Glycine max
  Coding DNA Sequence Number=SeqID_100218
  Homolog annotation: Hit_ID=Q1RV39; Match level="QueryCoverage=74%, HitCoverage=7%, E-value=1e-21, Identity=69%"; Hit description =Calponin-like actin-binding; Kinesin, motor region
  Subcellular localization annotation: CTP_CleavageSite=93; ConfidenceScore=5.29e-01
MDDLDDTTTDSSEPDLRWQFNHSKLTSIANGNGSKARRPVSKPTNSPVLSKNNVHSSLGPSPSRKQSNSVSHRTARHPAPVDMKHNGAIMPVACTMGP

SEQ ID NO: 216997 - protein, 149 aa, Glycine max
  Coding DNA Sequence Number=SeqID_100219
  Homolog annotation: Hit_ID=Q1SWM9; Match level="QueryCoverage=20%, HitCoverage=5%, E-value=9e-09, Identity=90%"; Hit description=Mlo -related protein
LVTGLCVPAVVFVVYVIVGIRVSIIVGGAAYGFLPPILATFEDVHQGKVTNLSTGESLVAISTLSIPQNDIQPFEGISEVEQDLGINENIMHQSSSSSSSFSSYFSQESNSGAFNQYGEGLEQLHRFLFVLGMTHVLYSCVVVGLAMSK

SEQ ID NO: 216998 - protein, 75 aa, Glycine max
  Coding DNA Sequence Number=SeqID_100220
MKTKVDPGDLFRHYVAGAIGVVAINLLWVDATITSAKEEITNTECELIHVNDLLSRVMKETDDAQAKCNKLMLLN

SEQ ID NO: 216999 - protein, 635 aa, Glycine max
  Coding DNA Sequence Number=SeqID_100221
  Gene Ontology: Mol. function=transition metal ion binding; Cellular component=nucleus; Biological process=electron transport
  Homolog annotation: Hit_ID=Q852J6; Match level="QueryCoverage=72%, HitCoverage=78%, E-value=7e-87, Identity=38%"; Hit description =Putative TNP-like transposable element
  Pfam annotation: Domain name=Transposase_21; Domain location=166-294; Score=-11.8; E_value=1.3e-13; Accession=PF02992.5; Description =Transposase family tnp2
MDRSWMKASRITEDYENGVEDFLQFSQSNAPSLWGKYLWPCVNCANGRGQIVNDIRSHLICDGIVLNYTKWIWHGELSDMATVSQAKPARFGWSDKSFTKLLVLLKNILPQDNRLMKNHYEAKKISCPMGMDVDAIANNRHPAKVCWHLPIIPRFKQLFPNGDDAKKLTRHAHNRKSDGFLRHPAHSPQWKAIDCLYPDFGDEPRNLRLGPRQPWNDIDVYLSPLTKNLRKLWEDGVDVWDGNLHKTFRLHAMENESAPSPLAGKEVYDQKRLVFFDLPYWSDLDVRHCIDVMNVKKNVCDSLIGTLLNIKGKTKDGLKCHQDLVDMVPQGYSSNIKSLVSLNDLKLVVLKSHNCHVLMQQLLPVAIRGSLPDKVKVAITRLCFPLNVICRKVIDPQKLDELEIEAAVVLCQMETYFPPSFFDIMVHSVVHLVREILVCGLVFLRWMYPVEWYMKVLKGYTKNQHRPKVSIFESASDNNLIRVSMTYFGIIEKIWEVDYSELRVSIFKCKWVNRNNAMHEDPLGFTLVDLNKEDQVVSVTIMMIQPLIFVRRLIFTMNEAHDIDDVMGTSPRSPPYSDGQSEATSKRSRQSTRLRSLTLRIVNQPRPTVNIDPGTVSWYYERIKPSQGKFPQLSG

SEQ ID NO: 217000 - protein, 210 aa, Glycine max
  Coding DNA Sequence Number=SeqID_100222
  Gene Ontology: Biological process=regulation of transcription
  Homolog annotation: Hit_ID=Q7X9T5; Match level="QueryCoverage=68%, HitCoverage=28%, E-value=1e-09, Identity=27%"; Hit description =SCARECROW-like protein
MEDNIEQMPFYDSLNLQVTEKSFYNTLTGNIPLFPNQHPVVLSPQAETTPTTSNNNNHNFLDENSLTVNHGLSNLDSSTAKLLAQNIFNDVDSLSKFRRGLEEATRFLPPGPKLVAGLDSKGKEPINTLGKNSYGLKGRKNHDLQSETVKAVEPGGVKGHPKNQAINKETINLRNLLMMCSQSVYANDKRAANKLLKQIRQHFSPSGDAL

SEQ ID NO: 217001 - protein, 55 aa, Glycine max
  Coding DNA Sequence Number=SeqID_100223
  Homolog annotation: Hit_ID=Q8L9X1; Match level="QueryCoverage=75%, HitCoverage=16%, E-value=6e-11, Identity=78%"; Hit description =Putative lysophospholipase
MVALKLTVFIKLGIGGFNMGAAATTLYSATCHVLGHYGNGNIYPINLSAIVIVNM

SEQ ID NO: 217002 - protein, 288 aa, Glycine max
  Coding DNA Sequence Number=SeqID_100224
  Gene Ontology: Mol. function=DNA binding; Biological process =regulation of transcription, DNA-dependent
  Homolog annotation: Hit_ID=Q1PFR7; Match level="QueryCoverage=64%, HitCoverage=54%, E-value=3e-30, Identity=39%"; Hit description =Transcriptional factor B3 family protein/leafy cotyledon 2
  Pfam annotation: Domain name=B3; Domain location=80-173; Score=23.1; E_value=0.00017; Accession=PF02362.12; Description=B3 DNA binding domain
  Subcellular localization annotation: CTP_CleavageSite=34; ConfidenceScore=5.37e-01
MPNSELQGSRACMTKATRERWRQVRQRSKNSTPVASNSVQEGTTREQFVPNGGSNVRITVKQHNATKFFNTPNGKKLEEILTKKLNKSDVGVLGRIVLPKREAKDKLPTLWKQEGINIVLKDVYSEIEWSIKYKYWTNNKSRMYILDNTGDFITLYKDELKNLYVSARKDQENLEESKSSSNTGMPHEPDAYLAYLTKELGHKGKAEAANNLLNNVEEEAPNQANQLHQFMPMNNIVGEGASNQAIEEAAPAAPINVDQENKVVDNDDDVIYGGLDNIFEIGNTYQIW

SEQ ID NO: 217003 - protein, 377 aa, Glycine max
  Coding DNA Sequence Number=SeqID_100225
  Gene Ontology: Mol. function=DNA binding; Biological process =regulation of transcription, DNA-dependent
  Homolog annotation: Hit_ID=Q1PFR7; Match level="QueryCoverage=52%, HitCoverage=54%, E-value=1e-35, Identity=41%"; Hit description =Transcriptional factor B3 family protein/leafy cotyledon 2
  Pfam annotation: Domain name=B3; Domain location=158-262; Score=61.8; E_value=2.3e-15; Accession=PF02362.12; Description=B3 DNA binding domain
  Subcellular localization annotation: CTP_CleavageSite=35; ConfidenceScore=5.57e-01
MENFFVPFLKKNPNPSITTTGGNGSSSSNQTSLVQPSTYPQNFPYNTSVKLNFPEQPYFIPLYPFPTGQVSFSNQPYGMPNSELQGSRACMTKATRERWRQVRQRSKNSTLVAPNSVLERTTREQFVPNGGSNVRITVKQHNATKFFNTPNGKKLEEILTKKLNNSDVGVLGRIVLPKREAEDKLPTLWKKEGINIVLKDVYSEIEWSIKYKYWTNNKSRMYILDNTGDFVNHYKLQTGDFITLYKDELKNLYVSARKDQENLEESKSSSNTGMSHEPDAYLAYLTKELSHKGKAEAANNLLNNVEEEAPNQANQLHQFMPMNNIVGEGASNQAIQEAAPAAPVNVNQENKVVDDDDDDIYGGLDNIFEIGNTYQIW

SEQ ID NO: 217004 - protein, 377 aa, Glycine max
  Coding DNA Sequence Number=SeqID_100226
  Gene Ontology: Mol. function=DNA binding; Biological process =regulation of transcription, DNA-dependent
  Homolog annotation: Hit_ID=Q1PFR7; Match level="QueryCoverage=52%, HitCoverage=54%, E-value=1e-34, Identity=41%"; Hit description =Transcriptional factor B3 family protein/leafy cotyledon 2
  Pfam annotation: Domain name=B3; Domain location=158-262; Score=56.1; E_value=1.2e-13; Accession=PF02362.12; Description=B3 DNA binding domain
  Subcellular localization annotation: CTP_CleavageSite=35; ConfidenceScore=5.57e-01
MENFFVPFFKKNPNPSITTTGGSGSSSSNQTSLVQPSTYPQNFPYNTSEKLNFPEQPYFIPLYPFPTGQVSFSNQPYGMPNSELQGSRACMTKATRERWRQVRQRSKNSTPVAPNSILEGTTREQFVPNGGSNVRITVKQHNATKFFNTPNGKKLEEILTKKLNKSDVGVLGRIVLPKREAEDKLPTLWKKEGINIVLKDVYSEIEWSIKYKYWTNNKSRMYILDNIGDFVNHYKLQAGDFITLYKDELKNLYVSARKDHENLEESKSSSNTGMSHEPDAYLAYLTKELGHKGKAEAANNLLNNVEEEAPYQANQLHQFMPMNNIVGEGASNQAIQEAAPAAPVNVDQENKVVDDDDDDIYGGLDNIFEIGNTYQIW

SEQ ID NO: 217005 - protein, 98 aa, Glycine max
  Coding DNA Sequence Number=SeqID_100227
MVGSRGKFANICEEINLSQLMVGTVFEGHWYEDGHGTKPVLELWTFYIGSKGTNDVENGYSTSVLQNQCRMSIFYIVHSFRTDVEYPHSTSFIPPKPM

SEQ ID NO: 217006 - protein, 101 aa, Glycine max
  Coding DNA Sequence Number=SeqID_100228
  Homolog annotation: Hit_ID=Q84VJ1; Match level="QueryCoverage=65%, HitCoverage=19%, E-value=1e-10, Identity=52%"; Hit description =Biostress-resistance-related protein
MSGLELSVNVMMSTELGALWSTKAWKKTSSCMIKLICPTAPTRPVALFGVFLALLACLQGFDAGDISEEAPSDLEGLDASAAHVANLLSIEPPNSRLSMIT

SEQ ID NO: 217007 - protein, 138 aa, Glycine max
  Coding DNA Sequence Number=SeqID_100229
  Homolog annotation: Hit_ID=Q1SXY0; Match level="QueryCoverage=45%, HitCoverage=35%, E-value=1e-11, Identity=53%"; Hit description =Transcription factor jumonji, jmjC
  Subcellular localization annotation: CTP_CleavageSite=37; ConfidenceScore=5.04e-01
MFAHSIKGCRPLRRACGVLIPSPSRLFRFFRHFPQINVGGDSARIPFVEHASRESRVALPPKGRLRQSCIKVALDFVSPENVGECFRLTEEFCTLPISHASSEDKVELQCYMHSLIDLKEEIRSWCIVIGVLKKETPC

SEQ ID NO: 217008 - protein, 150 aa, Glycine max
  Coding DNA Sequence Number=SeqID_100230
  Homolog annotation: Hit_ID=Q84VJ1; Match level="QueryCoverage=26%, HitCoverage=12%, E-value=8e-10, Identity=85%"; Hit description =Biostress-resistance-related protein
MILILQCGAFKALKTTDDCKLPQSTPQWIEVKSHVERGGYECGYYVMHWMWNIIGAELKTDWSLWFGDATPLETKMMTTLRQKWAEYFFKLRNSQSGPNSWKLFLFRILNGFSPTAPTRPVALFGVFPCTAWYDLLQERILSLLDQVASE

SEQ ID NO: 217009 - protein, 453 aa, Glycine max
  Coding DNA Sequence Number=SeqID_100231
  Gene Ontology: Mol. function=polygalacturonase activity; Cellular component=cellulose and pectin-containing cell wall; Biological process=carbohydrate metabolic process
  Homolog annotation: Hit_ID=Q2XTD7; Match level="QueryCoverage=95%, HitCoverage=90%, E-value=1e-132, Identity=51%"; Hit description =Polygalacturonase-like protein-like
  Pfam annotation: Domain name=Glyco_hydro_28; Domain location=70-426; Score=-7.9; E_value=9e-09; Accession=PF00295.8; Description=Glycosyl hydrolases family 28
MSVTVLLLIILSTALEGNGEDDHEPCKEKVLDPRPHSVSILEFGAVGDGKTLNTVAFQNAVFYAKSFADKGGAKLYVPSGKWLTGSFNLTSHLTLFLERGATIIASQDYAHWTAMDPLPSYGRGDNGIIDGQGSVWWDLISTHSLNYSRPHIIELVGSDNIIISNLTFLNSPAWSIHPVYCSNIQIQKITVQAPTKFPYTSGIVPVRVLNMIEERVLFPVLIFGVFPFTDSSEHVCIDNCNISTGHDAIVLKSGWDEYGVAYGKPTSNVHIRGVYLQSSSGAGLAFGSEMSGGISDIIAEQLHITNSTFGIELKTTRGRGGYMKNIFISDAKLENIYLGISMTGSSGSHPDDKYDPNAVPDVGNVTFENVIGANIAIAGNFSGIVDSPFTPICLSNVTFSTSSESSPSWFCSNVMGISKEVFPEPCPDLQNTYSNFSSCFSSLHPSSSFVSSA

SEQ ID NO: 217010 - protein, 86 aa, Glycine max
  Coding DNA Sequence Number=SeqID_100232
MGAKYLEVVKRGSHPNNGWSPDEIRTQNGHNLSLRFVGHDRAWAARHRLTIICLCVPPDTIASGWRKGARNDHNLSPPTSRLIVPE

SEQ ID NO: 217011 - protein, 481 aa, Glycine max
  Coding DNA Sequence Number=SeqID_100233
  Gene Ontology: Mol. function=transporter activity; Cellular component= integral to membrane; Biological process=transport
  Homolog annotation: Hit_ID=P44658; Match level="QueryCoverage=47%, HitCoverage=72%, E-value=8e-53, Identity=45%"; Hit description =Putative thiamine biosynthesis protein HI0357
  Pfam annotation: Domain name=NMT1; Domain location=267-479; Score =231.7; E_value=1.6e-66; Accession=PF09084.1; Description=NMT1THI5 like
  Pfam annotation: Domain name=SBP_bac_3; Domain location=258-474; Score=-91.4; E_value=0.05; Accession=PF00497.10; Description =Bacterial extracellular solute-binding proteins, family 3
  Pfam module annotation: Pfam domain module=NMT1::SBP_bac_3; Domain location=267-479::258-474
  Subcellular localization annotation: CTP_CleavageSite=48; ConfidenceScore=5.30e-01
MTFCCCTASRCSGAGRVAAGAPQRRTGISAAGTAGGAGGSVAKAAAARASRNVYAGGNCAGAAAGCRRWRGAGGADGLQPATASGAVSAGDSQPDHPGICAGPAAGAVAGFWHRVKSRGGGADFVFPAVPVAVRRFMPYACRLAGAGANAVSLALANFLARTLAGCAAAVFRRPADGGGAGTDWGGDRRVGRCQRRVRLPDDAIQRAAGNGHQFCRTAAVNEPGAAALSGSGAVNRLLRAIASLLLLATINAQAAEKVRLLLDWFINPNHAAIFAAQYSGAFKQQGLDVEMIAPADSASVPLLLAAGKADLAISYQPQLYTLVDKQVPVIRVGTLINQPLNTLTAVSGDIHSIKDFAGKSIGYAIPGAEDVAIRNMLKSQGVDVNSVKLVNLNMDAVSALLTHKIDGALTIFRNYELLDLQGKGAKPVSFKPEDYGVPAYDELIILANSNTAANDPRIPAFLRGLDAGIAWLRAHPQQAWQ

SEQ ID NO: 217012 - protein, 132 aa, Glycine max
  Coding DNA Sequence Number=SeqID_100234
MAKKGKLDHIKERIKAIEGDGDYAFTDMAELCLVSGIVIPLKFKVPNFDKYKGTTCPKNHLKEYCRKMGAYAKDEKLLMHFFQESLTGAAVTWQYQYNSDMASDRMQLQNMCKKSMNPSKDTPKGGGIWQLK

SEQ ID NO: 217013 - protein, 214 aa, Glycine max
  Coding DNA Sequence Number=SeqID_100235
  Gene Ontology: Mol. function=nucleic acid binding; Biological process= DNA integration
  Pfam annotation: Domain name=zf-CCHC; Domain location=111-126; Score =6.6; E_value=0.081; Accession=PF00098.13; Description=Zinc knuckle
  Pfam module annotation: Pfam domain module=RVT_2::zf-CCHC; Domain location=119-213::111-126
MTTKSNSNCRIRDFTSMSLATLFGKLQEHEMELMRLHQHEENDKKNKGIALRTSSSSIQEESDKEDLNEIEEDDDFRFFIKRFSKFFRNKGNQRRSNINPKKEGENSSLAPKCYECNQPGHLRFNEVLSAILYKARLVAKGYTQQAGIDFSYTFSLVVKLTTVRVLLCVATARNWCLLLLDVNNAFLNGDLFEEVYMELPNFLGMQIEQIIVWT

SEQ ID NO: 217014 - protein, 433 aa, Glycine max
  Coding DNA Sequence Number=SeqID_100236
  Gene Ontology: Mol. function=N-acylneuraminate-9-phosphate synthase activity; Biological process=carbohydrate biosynthetic process
  Homolog annotation: Hit_ID=Q1NTS1; Match level="QueryCoverage=99%, HitCoverage=57%, E-value=1e-172, Identity=66%"; Hit description=N -acylneuraminate-9-phosphate synthase
  Pfam annotation: Domain name=AP_endonuc_2; Domain location=179-389; Score=84.0; E_value=4.6e-22; Accession=PF01261.14; Description=AP endonuclease family 2
  Pfam annotation: Domain name=NeuB; Domain location=1-73; Score= -142.5; E_value=0.09; Accession=PF03102.5; Description=NeuB family
  Pfam annotation: Domain name=SAF; Domain location=88-146; Score=42.6; E_value=1.3e-09; Accession=PF08666.2; Description=SAF domain
  Pfam module annotation: Pfam domain module=AP_endonuc_2::NeuB::SAF; Domain location=179-389::1-73::88-146
QVTGCLVGYSGHERGISVPIAVTALGARVIEKHFTIDKSMEGNDHKVSLLPPEFKEMVVRIREVEESMGNAGERTITQGEMINRETLAKSLIINRDLKKGEIITREMVEVKSPGQGLQPLYLEQLVGKKANRDHEKGGYFYESDLNDVAIEAKDYDFNRPFGIPVRYHDYGKLKNKSNLDFVEFHLSYQDMELDLTEFFSGAENIGFAVHSPELFANDHILDLATDDPVYLAHSIKQLQRVCDVTRALKQYFPKTERPVIVVNAGGFNTTGFLPKESRQAMYERIGAALGEINQEGVEIIIQTMPPFPWHFGGQSYHNLFVDPDEIKAFCEKYGYRICYDTSHSMMACNYYQWDLHEFTQKVGPYTAHMHIVDALGVDGEGVQIGKGDVNFDELADDLRRHAPGAQFIPEVWQGHKNQGEGFWHALNFLEKYL

SEQ ID NO: 217015 - protein, 104 aa, Glycine max
  Coding DNA Sequence Number=SeqID_100237
MGVEKREELEPERRHANRGRILASKKVQFFLLVAEYEVTSREKAPKSLLISTPNCKEKPFSESWSTHLHCGTSNFKYGWTYSHMKFVGVGFLGAMMGSSTRLMP

SEQ ID NO: 217016 - protein, 122 aa, Glycine max
  Coding DNA Sequence Number=SeqID_100238
MPISPCGSISWSMSFPHSPIGCPFPPARSRHHDIGIAPARHPVDPKKSNRVLGFPALVTSLYQFYGVPITPNKVIKTPINQAFIKKYCAPEAGAGRDTTAAWGWTAVGNKRTAATSKAPQLI

SEQ ID NO: 217017 - protein, 71 aa, Glycine max
  Coding DNA Sequence Number=SeqID_100239
MWVRISSIFKFMAWMVSPKRARTLVSWGGGLAVEAMRAPNDRDERVLVYDPHFQPESNATSDMILDLMSLI

SEQ ID NO: 217018 - protein, 247 aa, Glycine max
  Coding DNA Sequence Number=SeqID_100240
MEGLQLGAMEYKMDFHSLCRLSARAKLKENPISYLVVHVASFSVSLGFHGSLGLEEFISDGLEGVIPVNQHFIHNINYAKVDSLGKAINNNQNGGVTLVWKELDNEATKYDPSAAPSSEREKTGDVCGGYREWIAGVQYTQVELPIVDRVPQGKSTMGLTESRTEMLLSPAYMVREDNEVATKKILSPFLHRAGYGTQFPDISRSSEKLWAKRIAPMPTLDASVSTMKGISKLGKTRTGAEDMACLS

SEQ ID NO: 217019 - protein, 280 aa, Glycine max
  Coding DNA Sequence Number=SeqID_100241
  Gene Ontology: Mol. function=DNA binding; Cellular component =chromatin; Biological process=DNA integration
MEVARITSSNLRWSPPWVCLAGRPRHPFGSWWGMANTWNDNTFILDLYILPISGANVVFGVQWLKTLGPVLTNDTLVLPALSPSTRDLLLPYYADSRDINVSQPRYHFLGDSWLAFQVRTSLPTATDSAKHEIELQDDSMLQQGLIQSNTSPFSLPVLLVRKPDGSWHFCVDYRALNPVTVRDRFPILTIDELLDELGDAQYFSKLDLLQGHMVSGRGMEPVASKVAAIQQWPTPRSIKAVRSFLGLAGFYRRFICGYATIAAPMVKVTTGDQFQWTTQA

SEQ ID NO: 217020 - protein, 96 aa, Glycine max
  Coding DNA Sequence Number=SeqID_100242
MAIKLAELVLCEGPQISVMFSVKHYQTVLIEELHGQSTIVDTRTFQVLAIPHHDPKGCRGRPARQTQGGDHLRLDEVMRATSINKDGNTVVGDKAR

SEQ ID NO: 217021 - protein, 77 aa, Glycine max
  Coding DNA Sequence Number=SeqID_100243
MGEVDEVQGRMKVDIEAMMSMKKLMEVNAAVVVTTNAVSEVDPTPPSDLNQIIGKYGRPPFCASSEQACLPIIWLTS

SEQ ID NO: 217022 - protein, 70 aa, Glycine max
  Coding DNA Sequence Number=SeqID_100244
MEKKPTRMRRWLICLTSWEGVETRDWEIPRFMVNAVKFPGRPKWTRMNAQIDKGTYFGNIGLIKNRGNES

SEQ ID NO: 217023 - protein, 131 aa, Glycine max
  Coding DNA Sequence Number=SeqID_100245
  Gene Ontology: Mol. function=catalytic activity; Cellular component =mitochondrion; Biological process=embryonic development ending in seed dormancy
  Homolog annotation: Hit_ID=Q6Z7E0; Match level="QueryCoverage=96%, HitCoverage=65%, E-value=8e-26, Identity=31%"; Hit description =Putative pentatricopeptide (PPR) repeat-containing protein
  Pfam annotation: Domain name=PPR; Domain location=17-51; Score=37.9; E_value=3.4e-08; Accession=PF01535.11; Description=PPR repeat
  Pfam annotation: Domain name=PPR; Domain location=97-131; Score=25.9; E_value=0.00015; Accession=PF01535.11; Description=PPR repeat
  Pfam module annotation: Pfam domain module=PPR::PPR; Domain location =17-51::97-131
MEVLDRQLQIKCYPDVVTYTELIDAACKDSRVGQAMKLLIEMVSKECKPNVVTYNALIKGICNEGVGWMNLSSGGRWTDAMKLLASMLCKGCSLNVVTFNTLINFLCQKGLLGKAFNVLEMIQSMSVLLIP

SEQ ID NO: 217024 - protein, 519 aa, Glycine max
  Coding DNA Sequence Number=SeqID_100246
  Gene Ontology: Mol. function=hydrolase activity; Cellular component =integral to membrane; Biological process=proteolysis
  Homolog annotation: Hit_ID=Q1H3D4; Match level="QueryCoverage=99%, HitCoverage=88%, E-value=6e-92, Identity=42%"; Hit description =Peptidase M16-like protein
  Pfam annotation: Domain name=Peptidase_M16; Domain location=255-398; Score=-22.4; E_value=0.015; Accession=PF00675.10; Description =Insulinase (Peptidase family M16)
  Pfam annotation: Domain name=Peptidase_M16_C; Domain location=2-188; Score=133.6; E_value=5.5e-37; Accession=PF05193.11; Description =Peptidase M16 inactive domain
  Pfam annotation: Domain name=Peptidase_M16_C; Domain location=408 -519; Score=8.5; E_value=0.007; Accession=PF05193.11; Description =Peptidase M16 inactive domain
  Pfam module annotation: Pfam domain module=Peptidase_M16::Peptidase _M16_C::Peptidase_M16_C; Domain location=255-398::2-188::408-519
MTADDAREWYRTWYAPNNATVVVVGDVKAQEVFALAEKTFGQLKAKPLPIRKPQVEPAQIGERRAIVKAPAKLPYFVMGFHTPALKNGVAYSEQDWEPYALEVLSSILSGNDASRLNQKLVREQAIALEIDTGYDSTNRGQTSTFEVAASPSEGVSQEDLIKAIWAQIEEVKNHGVTAAELHRIKAAVIAADVYKRDSMFYQAMQIGQLETMHYPLSLLQNNAARVQAVTSEQAYAMNVFAALNIQHWTTSEGSEVYFVENHSLPMMDVSINFRAGSAYDTLETSGAAAVTHHLMSLGAGGLDEETLTNQFADIGAVLGGSFDADRASFKVRTLTSEQQAALDTFMLVLHKPDFPQNVLVREQARIVAALQEAETEPDSIAQKAFMQSVYGMHPYSMDQNGEISTVQSLTVAQLREFYQTYYTAKSAVIAMMGDLTTDQAKQIAERLSAGLPQGPAVAAIPPVKELNVPSIKKFPHPAVQAHILIGQPGNMRGDPDFFPLYVGNYILGGGGFVSRLTEE

SEQ ID NO: 217025 - protein, 79 aa, Glycine max
  Coding DNA Sequence Number=SeqID_100247
MKQNMMALLIGLIGAALTLFAYSQTFVSPGQCITLGLIVLMLGLLVGEGMYIENYIIWPFVNSAEAGQTPLIAIRIQKR

SEQ ID NO: 217026 - protein, 585 aa, Glycine max
  Coding DNA Sequence Number=SeqID_100248
  Gene Ontology: Mol. function=RNA binding; Cellular component =ribonucleoprotein complex; Biological process=gynoecium development
  Homolog annotation: Hit_ID=Q1S2B2; Match level="QueryCoverage=87%, HitCoverage=93%, E-value=0.0, Identity=72%"; Hit description=KH, type 1
  Pfam annotation: Domain name=KH_1; Domain location=140-207; Score =82.0; E_value=1.9e-21; Accession=PF00013.19; Description=KH domain
  Pfam annotation: Domain name=KH_1; Domain location=284-345; Score =31.5; E_value=2.8e-06; Accession=PF00013.19; Description=KH domain
  Pfam annotation: Domain name=KH_1; Domain location=370-437; Score =67.9; E_value=3.2e-17; Accession=PF00013.19; Description=KH domain
  Pfam annotation: Domain name=KH_1; Domain location=43-105; Score =54.8; E_value=2.9e-13; Accession=PF00013.19; Description=KH domain
  Pfam module annotation: Pfam domain module=KH_1::KH_1::KH_1::KH_1; Domain location=140-207::284-345::370-437::43-105
MGGQRSGYGKRPHSQSDHDNGPNKRRNHGDDREQFVIDSEDTVYRYVCPGRKIGSVIGRGGEIVKQLRVETKAKIRIGETVPGCEERVVTIYGPSDETNAVEGGGNYVSPAQDALFKVHDRVVAEDFHGDQDDDGGQQVTAKLLVPSDQIGCVIGKGGSIVQNIRGETGAQIRILKDDHLPMCALSSDELVQITGDAAVVKKALYQIASRLHDNPSRSQHLLTSAVSGVYPAGGSLIGPGAGAPIVGIAPLVGSYGGYKGDTGDWPPRSMYSAPRDEASSKEFSVRLVCPTGNIGGVIGKGGMIINQIRQDSGATIKVDSSTIEGDECLIAISTKEFFEETFSPTIEAAVRLQPRCSEKVERDSGIISFTTRLLVPTTRIGCLIGKGGSIITDMRRLTKANIRIISKENLPKIANEDDEMVQISGDLDVAKDALVHVLTRLRANLFDREGALSAFLPVLPYLPVSADGSDGLNYDGRDGKRHGRGHSYSSGYGGSSDLAAGDVYGSYGGSQLGSNSAYGAYGSYSLGRSSTAGKYIFLSSENGVRVLSNESQSGVTIGIPTFHFCMGCGLTPFKSCPNFLTKWAV

SEQ ID NO: 217027 - protein, 181 aa, Glycine max
  Coding DNA Sequence Number=SeqID_100249
  Gene Ontology: Mol. function=sequence-specific DNA binding; Cellular component=intracellular; Biological process=regulation of transcription, DNA-dependent
  Homolog annotation: Hit_ID=Q1LFC0; Match level="QueryCoverage=99%, HitCoverage=53%, E-value=7e-73, Identity=76%"; Hit description =Transcriptional regulator, AraC family
MFPLRIVETLSADSFNPPLFAALCSANLVQAMQRLAKYKQLVAPMSLEVNTGDAGELVVTPRWLLMQTDVPYSLQVAEIAFFVRLARLATREPIKAHRVILPPLPSAHYPRRYESFFGVPVQNGECPGIAFAAVDALRPFLTVNESMFRAFEPDLRRRLSELDATASTADRVRAVLLELLP

SEQ ID NO: 217028 - protein, 191 aa, Glycine max
  Coding DNA Sequence Number=SeqID_100250
MASQPISIGNVLFLHPQNSVIIAHSTDAQSRTRSICPELSNLNNGDIPMNATNAIDQLAPQKWTETSPAERLRLLEEIRANMKKYGDDLALADSKMKNGILGAPLFSHPLSKVATVVPMASTVSAAILLYESILDGKMPQPLSVEKVSEDLYDIYVFPQERKDKLMYADQKSRIRVKGEPKQINPMEKPCP

SEQ ID NO: 217029 - protein, 247 aa, Glycine max
  Coding DNA Sequence Number=SeqID_100251
  Gene Ontology: Cellular component=membrane
  Homolog annotation: Hit_ID=Q4KDQ4; Match level="QueryCoverage=64%, HitCoverage=50%, E-value=1e-42, Identity=57%"; Hit description =Membrane protein, putative
  Pfam annotation: Domain name=DUF6; Domain location=75-194; Score =33.0; E_value=1.1e-06; Accession=PF00892.11; Description=Integral membrane protein DUF6
MAAESHVCHSQAYDYAEVSKLRLSDDTLFTCRDVGRLTIPELARKGWKVIHLAQQTEYTDSVDSDGEVIKLYQEIVVAIKAAEPDVSAVLQIAIRSGLAALAVYLLARGCGERFTWDRATLCAGLSVGALFALEFFFVSAGLRYTSASHMAVFLYTAPLFSALGLHFLLPQERLSPVQWLGMLIAFGGVVLAISGMAEGSGGAERLKGDLYGLLAGIAWGASTLVIRTTRLAECPGQTDAVVSVDGR

SEQ ID NO: 217030 - protein, 169 aa, Glycine max
  Coding DNA Sequence Number=SeqID_100252
APFEGTIVDDWKFDYSSHDARRMAHLVRYRMHKALLANAPLPYPQLVTPFLCHFQIPLDDEPFVQVKRSFAIGVGAVTSFGYRKDRDGQWLKKDVLPPQDEYTPSHPSQRDDSSTLMNEVLSELRDLHTYVGERFDSLDGRFEGMDTRITQLEEDVTYLCRCFDLPPPS

SEQ ID NO: 217031 - protein, 766 aa, Glycine max
  Coding DNA Sequence Number=SeqID_100253
  Gene Ontology: Mol. function=protein binding; Cellular component =nucleus; Biological process=regulation of transcription, DNA -dependent
  Homolog annotation: Hit_ID=Q9LHH0; Match level="QueryCoverage=95%, HitCoverage=99%, E-value=0.0, Identity=63%"; Hit description=Actin -like protein
  Pfam annotation: Domain name=Actin; Domain location=72-762; Score =56.4; E_value=3.3e-17; Accession=PF00022.9; Description=Actin
  Subcellular localization annotation: CTP_CleavageSite=71; ConfidenceScore=5.75e-01
MSVTYVVQHAEVVVSPKHTTKATSSSVSPTQCLSSPKFSAKPITPSLVPPLPSSSTMAPPISALGETVTIVGDHDPALLKYFDCTRSGPRSAFDSNVVYQFEIMEYSIDLVISSRSYRMIISWDYLTDSAIVWCLAPSNAKILDFGFDRLGATGSEIDHPVLITECVSNPVQSRSKMGELLFETYGVPSIAFGVDAAFSYKYNQQQGVCDKDGLAMCPGFNTTHVIPFVDGEPIYKGCCRTNIGGFHVTDYLKQLLSLKYPHHMTRFTWEKVEDLKMEHCYIAPDYASEARLFLKGAREAEEKTRCWQLPWVPPPTEEPPSEEEIARKAAIKERQGQRLREMAEAKRSSKINELENELHGLEFLLKQLEQVQDSNVPSFLAETGYVSRQEIESARTKVTQSLRKAKGEPKNEQAETDKASPNANEKYSLINIPDDMLTPDQLIEKKKQLSLKSMSEGRQRLKQKRYEEELERQRKQLLEEETRLENPELYLEQLRARYKDLSVKVDQRKRLKTNGGHSNGNNLAGAIGRGERLNAVQRERMRLLTTAAFDRGKGEDTFGAKDEDWQLYKLMSKDIDDGDEGPDEDDAELARISSRLQDLDPTFVPNKSEAGSSQPAAEAQRARPLTKEDFQIVFGVERFRCPEILFNPNWIAVDQAGLHEMAGVSIRRLSCKDEGLEERLTSSILVTGGSSLFPGITERLEAGIRMIRPCGAPIKVVRALDPVMDAWRGAAAFASAPQFHTQTFSRMDYFEKGEDWLRNYQIKYSS

SEQ ID NO: 217032 - protein, 74 aa, Glycine max
  Coding DNA Sequence Number=SeqID_100254
MVLTTQPDQPVKEYMLPAIAGHLPPPKTSLDPFLTLNSTQPLLLVFPGATCKPHSSLTGLENMRDLAFPKKDLE

SEQ ID NO: 217033 - protein, 188 aa, Glycine max
  Coding DNA Sequence Number=SeqID_100255
MLLLKGLDDLGHELFETLIISKDHKVVTQEDPAHHDAKSICFQRERDREVRGAQLVDELINGWHGKYVFDGNDVKTVAYADKSGIEHGECDGLSGMSEGDKVWLVTGIGVIWKKVDMAWVCNRRLSWWAEVKGGLKEIFTNSWMGWPKWVKVIESEVGCMHYMTSPFPTITCKGSMDLDGRLRNFATQ

SEQ ID NO: 217034 - protein, 90 aa, Glycine max
  Coding DNA Sequence Number=SeqID_100256
MACPTIVYFEVKALKIGKVTTLECVMCLNEFRNDENEGDRVRQTSTRTQEGLGEEIAQLENWGFRDSSEFERTGGCLDQVNKLKAAMCPM

SEQ ID NO: 217035 - protein, 55 aa, Glycine max
  Coding DNA Sequence Number=SeqID_100257
  Gene Ontology: Mol. function=chromatin binding; Cellular component =chromatin; Biological process=chromatin assembly or disassembly
  Homolog annotation: Hit_ID=Q1SAV4; Match level="QueryCoverage=89%, HitCoverage=12%, E-value=1e-08, Identity=54%"; Hit description =Integrase, catalytic region
MAVVGGACKAWQVVMIEYATSTEEEPCRYCGIKGGGLPYVISKGNNSVLECMNVL

SEQ ID NO: 217036 - protein, 71 aa, Glycine max
  Coding DNA Sequence Number=SeqID_100258
MSLPSAVHVFSLIKCEASGDWEARYSVVFQIGSFAKRKKRRSRDESRHCEKGRTDEISPIFAFLLSPMRGK

SEQ ID NO: 217037 - protein, 87 aa, Glycine max
  Coding DNA Sequence Number=SeqID_100259
MTWMQPNLTNVVGFSSEGNMANDKGLKDTSLKFNKVKKYKNLTKDPTTFTTNVFKGKGKERFELEFAIMSKVLKQMSYIEVDEEGGG

SEQ ID NO: 217038 - protein, 86 aa, Glycine max
  Coding DNA Sequence Number=SeqID_100260
MQEQCPSKADSRPPWSHRSQWRDCAWGVSQEPMAAWAYVEAFSPVGVARQRPRQLSRQAEWRHPLSSLATANGGTPFLPVLLAGSS

SEQ ID NO: 217039 - protein, 73 aa, Glycine max
  Coding DNA Sequence Number=SeqID_100261
MEDWGNFLHRILQEDSEDSALIKVFLLVWGFGGKQRRLTAATGGGEGGIKISLSELVSLSWSPLFALSATIQA

SEQ ID NO: 217040 - protein, 102 aa, Glycine max
  Coding DNA Sequence Number=SeqID_100262
  Gene Ontology: Mol. function=phosphatidylinositol phosphate kinase activity; Biological process=phosphatidylinositol metabolic process
  Homolog annotation: Hit_ID=Q9LLS0; Match level="QueryCoverage=81%, HitCoverage=11%, E-value=9e-33, Identity=78%"; Hit description =Putative phosphatidylinositol 4-phosphate 5-kinase
  Pfam annotation: Domain name=PIP5K; Domain location=2-81; Score= -142.0; E_value=0.022; Accession=PF01504.9; Description =Phosphatidylinositol-4-phosphate 5-Kinase
MPARAERMARRSDFDQYTPCCSGETYDVVIYCGIIDILQDYDISKKLEHAYKSLQVDPSSISIVDPKLYSKRFRDFVGRIFIEDWGQGLWSQIGYEYDVKND

SEQ ID NO: 217041 - protein, 154 aa, Glycine max
  Coding DNA Sequence Number=SeqID_100263
MGRGKLPKITPVAKHGGASLFMIGMLACGASMEAGSLSFNEELHHQECALDKKLEEDALMEEKKERRGEHEIEGIKEGEKWNFEHEVHENPKVFFSNSSPIFLESSIKYPWGVGLHHPLHLGKDLTSNPESRVRSENPFHGHLPIREHGSSPTQ

SEQ ID NO: 217042 - protein, 42 aa, Glycine max
  Coding DNA Sequence Number=SeqID_100264
MLREKDEKFANQNTLAREVICSSAQVLKLSLSLNNPLNPINK

SEQ ID NO: 217043 - protein, 226 aa, Glycine max
  Coding DNA Sequence Number=SeqID_100265
  Gene Ontology: Mol. function=protein kinase activity; Cellular component=intracellular; Biological process=protein amino acid phosphorylation
  Homolog annotation: Hit_ID=Q1SLN3; Match level="QueryCoverage=94%, HitCoverage=50%, E-value=4e-64, Identity=40%"; Hit description =Tetratricopeptide-like helical
  Pfam annotation: Domain name=PPR; Domain location=161-195; Score =20.6; E_value=0.0058; Accession=PF01535.11; Description=PPR repeat
  Pfam annotation: Domain name=PPR; Domain location=62-96; Score=14.1; E_value=0.16; Accession=PF01535.11; Description=PPR repeat
  Pfam module annotation: Pfam domain module=PPR::PPR; Domain location =161-195::62-96
MLVLKLPRVTPAFSMYLPHPCSLKEVVNLLKFSATAKSLRFGKTIHAQLVVRNQTSKDSDITQINSLINLYSKCGQSKCARKLFDRMLQRNVVSWSALMMGYLHKDSGRVKEGKQCHGYLLKSGLLLHQYVKNALIHMYSRCFHVDSAMQILDTVPGDDVFSYNSILSALVESGCRGEAAQVLKRMVDECVIWDSVTYVSVLGLCAQIRDLQLGLQIHAQLLKTGL

SEQ ID NO: 217044 - protein, 97 aa, Glycine max
  Coding DNA Sequence Number=SeqID_100266
MAFGVGEGFGGRESGVAVQGVAGAQGQLSKDVSFTIVPLVASVNESVEPEMWPFDLSNTTSLKVANGVMPYEAPTPTPTPTPTPDTTRTRTRGHLKC

SEQ ID NO: 217045 - protein, 372 aa, Glycine max
  Coding DNA Sequence Number=SeqID_100267
  Gene Ontology: Mol. function=binding; Cellular component =intracellular; Biological process=metabolic process
  Homolog annotation: Hit_ID=Q1SLN3; Match level="QueryCoverage=99%, HitCoverage=92%, E-value=1e-161, Identity=44%"; Hit description =Tetratricopeptide-like helical
  Pfam annotation: Domain name=PPR; Domain location=137-171; Score=0.9; E_value=5.8; Accession=PF01535.11; Description=PPR repeat
  Pfam annotation: Domain name=PPR; Domain location=204-238; Score =16.4; E_value=0.084; Accession=PF01535.11; Description=PPR repeat
  Pfam annotation: Domain name=PPR; Domain location=66-100; Score=38.0; E_value=3.4e-08; Accession=PF01535.11; Description=PPR repeat
  Pfam module annotation: Pfam domain module=PPR::PPR::PPR; Domain location=137-171::204-238::66-100
MELEDTRPNEFTFAVLLNACASLVALAYGFKNHLIVGNALINMYSKSGNIDSSYNVFSNMMNRDVITWNAMICGYSHHGLGKQALLVFQDMMSAGECPNYVTFIGVLSACVHLALVQEGFYYFDQIMKKFDVEPGLEHYTCMVALLGRAGLLDEAENFMKTTTQVKWDVVAWRTLLNACHIHRNYNLGKQITETVIQMDPHDVGTYTLLSNMHAKARKWDGVVKIRKLMKERNIKKEPGASWLDIRNNTHVFVSEGSNHPESTQIFEKVQQLLAMIKPLGYAPDVGVVLHDVEDEQKEGYLSHHSEKLALAYGLMKIPPPGPIRIIKNLRMCDDCHIAVKLISKATNRLIIVRDANRFHHFREGLCTCNDHW

SEQ ID NO: 217046 - protein, 135 aa, Glycine max
  Coding DNA Sequence Number=SeqID_100268
MAHIDPGIDVAPCGACRPWIFFINGFLCFLRSYYSGMEKEKDEWRRHFKKLDALVNLVTQLAINQKSAVAPVTVARVCGLCSSVDHYTDLCPSLQQSGVNKQPAAYAANIYNRPPQQQNQQQQNNYDLSSNRYNP

SEQ ID NO: 217047 - protein, 220 aa, Glycine max
  Coding DNA Sequence Number=SeqID_100269
  Gene Ontology: Mol. function=zinc ion binding; Cellular component =nucleus; Biological process=regulation of transcription
  Homolog annotation: Hit_ID=Q0GLC4; Match level="QueryCoverage=72%, HitCoverage=48%, E-value=7e-80, Identity=91%"; Hit description=Dof27
  Pfam annotation: Domain name=zf-Dof; Domain location=121-183; Score =139.3; E_value=1.1e-38; Accession=PF02701.6; Description=Dof domain, zinc finger
MLEAKDSTMMKLFGNTIPAPEIPAGAPAFSSGDVFGDSVGQNRGSSSVNGDGEEHEIQQDIMGEETTESKKEDEVTNLDTVSRSGEGSINPSTEKEDLTLKTSKKTEQEQGENSQNKTLRKPDKILPCPRCNSMDTKFCYYNNYNVNQPRHFCKNCQRYWTAGGVMRNVPVGAGRRKNKNFASQYRHITVPEAALSSSQPDLSNGVSNPSLNCNATLLAY

SEQ ID NO: 217048 - protein, 97 aa, Glycine max
  Coding DNA Sequence Number=SeqID_100270
MSDAQRRGLSNQKLLEGDINTIKGFEDLIGGLFLSKGIKVAFVSPLRLSQVNHFHHRIGIEDACAVGSMHHSVKPEVGAEQNEWGQAFETEDFHSNI

SEQ ID NO: 217049 - protein, 88 aa, Glycine max
  Coding DNA Sequence Number=SeqID_100271
NVYTDNHSGISARQRDSNVSMTDLVSAEDDTAKRNVYTDNHSGISARQRDSNVSMTDLVSAEDDAFRLTDSKKGFERADNHLGISACH

SEQ ID NO: 217050 - protein, 41 aa, Glycine max
  Coding DNA Sequence Number=SeqID_100272
MTTIDEGDDSDERLMKDLSMVSTLTTLAGLRLAKVVGLVPK

SEQ ID NO: 217051 - protein, 133 aa, Glycine max
  Coding DNA Sequence Number=SeqID_100273
  Gene Ontology: Mol. function=binding; Biological process=mRNA editing
  Homolog annotation: Hit_ID=Q6Z236; Match level="QueryCoverage=76%, HitCoverage=24%, E-value=2e-15, Identity=40%"; Hit description =Pentatricopeptide (PPR) repeat-containing protein-like
  Pfam annotation: Domain name=PPR; Domain location=46-80; Score=18.0; E_value=0.035; Accession=PF01535.11; Description=PPR repeat
MVTFRLSPLSPMRPFFANSIIVAYVQNGDLHDTFHHFAIVPGKNIASYNVMISGLARCKHMEDVQRLFEAMPCPNIVSYTVMVDGYARVEGGIGRKRMLFKGMPRRNAINNTEKLCNNGDWNLKPYQVFDPGS

SEQ ID NO: 217052 - protein, 202 aa, Glycine max
  Coding DNA Sequence Number=SeqID_100274
  Gene Ontology: Mol. function=structural constituent of ribosome; Cellular component=intracellular; Biological process=translation
  Homolog annotation: Hit_ID=Q5N757; Match level="QueryCoverage=53%, HitCoverage=46%, E-value=2e-14, Identity=39%"; Hit description =Pentatricopeptide (PPR) repeat-containing protein-like
  Subcellular localization annotation: CTP_CleavageSite=45; ConfidenceScore=5.69e-01
MANSICSADFGSKSRQINHLQKNRRTPSSSSSSNSLQIPPCDRSRSAMVDVVMFIAVVCACGFLFFPYVEFLVTKCYEVIKVVVFLIKEEVSVAPWIYVSIGLSVVFAALATWGVVACTTRKCGNPNCKGLRKAAEFDIQLETEDCVKNSASSSGSGTKEASSKDQQEVAAIVTETSRTRDRRGHPFDLLDGIKERDDNWIK

SEQ ID NO: 217053 - protein, 165 aa, Glycine max
  Coding DNA Sequence Number=SeqID_100275
MTLLLSNILPNDRNANLPRQKVSVGLCRPDMGIAPARHPVDPKKSNRVLELSSSNYGSLSVLRSTCHLQQGHQAPYQSSFHQEVLRLQAGVGRNTTAAWQWPAAGNRRTATSRVHLSSSAKRLERCLRHMADQQATKSKAKGKQNTRSVTYKPSCVQLKTLKKRC

SEQ ID NO: 217054 - protein, 152 aa, Glycine max
  Coding DNA Sequence Number=SeqID_100276
  Subcellular localization annotation: CTP_CleavageSite=51; ConfidenceScore=5.41e-01
MYHYPTHQYNYSANIGSPPCPTPLRPRMPNQPQRPPQHHPQNPFPTLPRPSANPNPNTNTNPKRNFPERKPVEFTPIPMSYANLLPSLLYNQMAIVSLGKKMEWIRREKVASLWRAEWKGFGSKFECVWMENDDDNDGVQVGLKGWFKFGNF

SEQ ID NO: 217055 - protein, 46 aa, Glycine max
  Coding DNA Sequence Number=SeqID_100277
MMRAPDSTLRCNVGTVLSLSRPPGCACNSPPPIGDQPGSPKVFPTK

SEQ ID NO: 217056 - protein, 66 aa, Glycine max
  Coding DNA Sequence Number=SeqID_100278
  Subcellular localization annotation: CTP_CleavageSite=41; ConfidenceScore=5.55e-01
MVHDSTKAANHTQPITLTPASPLVGSNLRQLLTREVFDIMSQSKVTSSLSVNNNEESNFKGKTLLS

SEQ ID NO: 217057 - protein, 134 aa, Glycine max
  Coding DNA Sequence Number=SeqID_100279
  Gene Ontology: Mol. function=triacylglycerol lipase activity; Biological process=lipid metabolic process
  Homolog annotation: Hit_ID=Q1SH82; Match level="QueryCoverage=65%, HitCoverage=18%, E-value=7e-33, Identity=71%"; Hit description =Lipase, class 3
MKQELKNFDMLTFTQARSRHHSKGHEIGYVVVVRTMARVFVLGGRKGNVTVLEEQWNKNYFSLWCVIPMAYNAILEIIRSFIIARQNGAYYREGWFLFAFRTIGLIIPGVPAHGPQDYFNSTLLGKIEKHFKVE

SEQ ID NO: 217058 - protein, 107 aa, Glycine max
  Coding DNA Sequence Number=SeqID_100280
  Homolog annotation: Hit_ID=Q1S7C5; Match level="QueryCoverage=82%, HitCoverage=7%, E-value=4e-10, Identity=38%"; Hit description =Integrase, catalytic region
  Subcellular localization annotation: CTP_CleavageSite=19; ConfidenceScore=5.34e-01
MASTNSGATSANNGGLTPVNNSGATPLNAFLMNQDVPSLFPMTNFLIQITKKLDDKNFLLWQQQIKPAITALGLNRFVASPQIPPRYLSDEDHDPDRINPLFSIWQK

SEQ ID NO: 217059 - protein, 202 aa, Glycine max
  Coding DNA Sequence Number=SeqID_100281
  Gene Ontology: Mol. function=RNA-directed DNA polymerase activity; Cellular component=chromatin; Biological process=chromatin assembly or disassembly
MKDRPNKMWKLDTSLGSNGREHAQSSFLREMKECLNSKMESRFVKLTTSMQQTIHGMFQQRQQDSPTSSNQPRGERSSPYSCGTRLARLDFPRFNGEGIKQWLIQCETFFSVDNTPDEFKVRLAVVHFEGKAFQWHNAYIKSVGLENLPSWNEYHILLLDHFGDVCEDPMADLMKLRQTGSIIEYHKEFDSIISRVDLFYEH

SEQ ID NO: 217060 - protein, 88 aa, Glycine max
  Coding DNA Sequence Number=SeqID_100282
  Gene Ontology: Mol. function=binding
  Homolog annotation: Hit_ID=Q9LUZ0; Match level="QueryCoverage=92%, HitCoverage=8%, E-value=1e-09, Identity=47%"; Hit description =Phosphoinositide-specific phospholipase C-line
MRSYGVVKALEKETTTVKENAMCVLVHLLQNREEEKAMIGRGRVIMHLVKLLDGRELRGKKNVATVQYVLCSTTKENKVKAVSAGVIL

SEQ ID NO: 217061 - protein, 640 aa, Glycine max
  Coding DNA Sequence Number=SeqID_100283
  Gene Ontology: Mol. function=nucleotide binding; Cellular component =chromosome; Biological process=chromosome organization and biogenesis
  Homolog annotation: Hit_ID=Q9FJL0; Match level="QueryCoverage=99%, HitCoverage=50%, E-value=0.0, Identity=71%"; Hit description =Chromosome condensation protein
  Pfam annotation: Domain name=ABC_tran; Domain location=414-619; Score= -48.6; E_value=0.0035; Accession=PF00005.17; Description=ABC transporter
  Pfam annotation: Domain name=SMC_N; Domain location=59-625; Score =97.5; E_value=4.1e-26; Accession=PF02463.9; Description=RecFRecNSMC N terminal domain
  Pfam module annotation: Pfam domain module=ABC_tran::SMC_N; Domain location=414-619::59-625
EKQVDLLPKLKKNVSTPEGVPRLFDLVKVQDERMKLAFFAALRNTVVAKDLDQATRIAYGGNTEFRRVVTLDGALFENSGTMSGGGGKPRGGKMGTSIRATSVSVESVANAEKELSRLTDKLNDIRQRIMAAVQRYQASEKAVAALEMELAKSQKEVDSLNSQYNYIEKQLDSLEAASTPQEDELDRLKELKKIVSAEEREINRLNNGSKQLKEKALELQRNLENVGGEKLKSQKSKVQKIQSDIDRNSSETNRHKVQIETGQKMVKKLTKGIEDSKKEKDRLTEQKEKLTQAFKEIEQKAFVVQENYKKTQKVIDEHMIVLEKAKSEYNKMKKVMDELRASEVDAEFKLKDMKKAYKELEMKGKGYKKRLDDLQTALHRHIEQIQADLVDQEKLQATLADEHLNAACDLKKACEMVALLEAQLKEMNPNLDSISDNTDSKLMIIRYRKKVSSYNERVEELNAVTQERDDIKKQYDEWRKKRLDEFMEGFNAISLKLKEMYQMITLGGDAELELVDSLDPFSEGVVFSVRPPKKSWKNIANLSGGEKTLSSLALVFALHHYKPTPLYVMDEIDAALDFKNVSIVGHYVKDRTKDAQFIIISLRNNMFELADRLVGIYKTDNCTKSITINPGSFVVCEKAV

SEQ ID NO: 217062 - protein, 145 aa, Glycine max
  Coding DNA Sequence Number=SeqID_100284
GRLRHGGYEGVGGADGGLGVEYGVLGEHGGGSGRGDGGTASMMSFNGDFQPWRCSRRQRRRGERRRHPLGNKPWKKELHHQDEPWIRSLEGCFNEGKERGRERERGEHEIEGIKEGEKWNFEVCLTRLSFIKVTTSVTHASIYRL

SEQ ID NO: 217063 - protein, 599 aa, Glycine max
  Coding DNA Sequence Number=SeqID_100285
  Gene Ontology: Mol. function=nucleotide binding; Cellular component =chromosome; Biological process=chromosome organization and biogenesis
  Homolog annotation: Hit_ID=Q9FJL0; Match level="QueryCoverage=92%, HitCoverage=44%, E-value=0.0, Identity=67%"; Hit description =Chromosome condensation protein
  Pfam annotation: Domain name=SMC_N; Domain location=24-562; Score =109.8; E_value=7.9e-30; Accession=PF02463.9; Description=RecFRecNSMC N terminal domain
MAPHAESAPDSATRRRSSARPRLFIKEMVMRNFKSYAGEQRVGPFHKSFSAVVGPNGSGKSNVIDAMLFVFGKRAKQMRLNKVSELIHNSTNHQNLDSAGVSVHFQEIVDSDDGTYEAVAGSDFVITRVAFRDNSSKYYINDRTSNFTEVTKKLKGKGVDLDNNRFLILQGEVEQISLMKPKAQGPHDEGFLEYLEDIIGTNKYVEKIDESHKLLESLNEKRSGVVQMVKLSEKERDSLEACKFGIVCSHLMFIQHLMKATKLALDDTGGKMDELQGNVATLEESLKAERDKIQDSKQTLKELETTHNNYMKRQEELDNDMRKCKEEFKEFERQDVKYREDFKHVNQKIKKLEDKVEKVEGSHSLWQLKVKDSSKIEALIKEGEESTVLIPKLEDNIPKLQKLLLDEEKVLEEITESSKVETEKYRSELAKVRAELEPWEKDLIEHNGKLEVACTEAKLLNDKHEGASQAFEDAQKQMKSISETIKSKTASISQINSDIEKRKHEASEAHQIEEECIKEQDELIPLEQSARQKVAELKSVLDSEKSQGSVLKAILKAKETKQIEGIYGRMGDLGAIDGEVFQLQFFWLHEVLFLPSYTT

SEQ ID NO: 217064 - protein, 106 aa, Glycine max
  Coding DNA Sequence Number=SeqID_100286
MTQNPVACGDTLRLSATRHTETPSSIDKQRPIWSSAPFPEMSACFGAKASLLSTTPPFAIMTQNPVACGDTLRLSIPRHTETPSPIDKQRPMWSSAPFSGDDNIFW

SEQ ID NO: 217065 - protein, 132 aa, Glycine max
  Coding DNA Sequence Number=SeqID_100287
  Homolog annotation: Hit_ID=Q8GW20; Match level="QueryCoverage=45%, HitCoverage=11%, E-value=4e-13, Identity=60%"; Hit description =Protein At5g03900 precursor
MHLPELHQIQTLILCKNRNPLDKIYAGSFFAIPLVRWFFIRKKNADIEKRNKARQQCAQVLELPDTSLRQKIAGIIIKERKHSKVNKGKYPQTSSDGDETSGLGVAGRDDPHFGSPTRAQAGCAFVRCKSFQ

SEQ ID NO: 217066 - protein, 88 aa, Glycine max
  Coding DNA Sequence Number=SeqID_100288
  Homolog annotation: Hit_ID=Q8GW20; Match level="QueryCoverage=44%, HitCoverage=7%, E-value=4e-10, Identity=67%"; Hit description =Protein At5g03900 precursor
MAQKTVIGQDQIVYSTDKDLLEQEYEAREWDKKFRELERALSSHFAIIDNFSTASRLPSVKALGSPGLLQAFTGPCINLNSFLLGPAI

SEQ ID NO: 217067 - protein, 82 aa, Glycine max
  Coding DNA Sequence Number=SeqID_100289
MEGEQRANGTSDNGRQQLENLLGNMSENMPERDSPLDPSHSDVYSIHSFIPPAGSLLGATPCPCHISCALAITPRARQRPGC

SEQ ID NO: 217068 - protein, 240 aa, Glycine max
  Coding DNA Sequence Number=SeqID_100290
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=5e-35, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPSEGYRPSPFEDYTSSPSKGCTPSPPKGYMPSPLEDYTSSPSKDYRSSPSEDCTSSPTEGYMPSPLEDYTPSPSEGYMPSPSEDYKSSPSKDYRSSPLEDCRGLHVLTFRGLHALTFRGLYVLAIGGLDAVAFRGLRVLPFRGLHVFTFRGLHALAFKGLQVLAFRGLHVLAFRGIYALAFRGLHALGFRGLQVLAFRGLHALALRGLHVFAFRGLHVLAFRGLHICAFRGLKVLYP

SEQ ID NO: 217069 - protein, 91 aa, Glycine max
  Coding DNA Sequence Number=SeqID_100291
  Homolog annotation: Hit_ID=Q1SS89; Match level="QueryCoverage=77%, HitCoverage=9%, E-value=9e-08, Identity=47%"; Hit description =Integrase, catalytic region
MCLLRSCRKNTKLMSPPWTAPIYLKTSMKQSKWQAAVKEQIKALEMNETWKLSKLTEGNKPDECTWPPWWLRGSPNLMGWTVKKRLHSWQN

SEQ ID NO: 217070 - protein, 36 aa, Glycine max
  Coding DNA Sequence Number=SeqID_100292
MKGSYQLILEVSTVSLNCKRVMQVVTSTFQCSPWSS

SEQ ID NO: 217071 - protein, 112 aa, Glycine max
  Coding DNA Sequence Number=SeqID_100293
  Gene Ontology: Mol. function=phosphoribosylaminoimidazole carboxylase activity; Cellular component=integral to membrane; Biological process= 'de novo' IMP biosynthetic process
  Homolog annotation: Hit_ID=Q8GW20; Match level="QueryCoverage=73%, HitCoverage=16%, E-value=9e-23, Identity=63%"; Hit description =Protein At5g03900 precursor
MWYGRDINRPYNTVEYYTPSDWREYRPNIFLSLCGLMWKCRGTGRRRLQADDDKMNFIESVFSFVFGDGDPNQGIEEERWKLIGQYIASNGGVVAAEELAPYLDIDSTEGIK

SEQ ID NO: 217072 - protein, 58 aa, Glycine max
  Coding DNA Sequence Number=SeqID_100294
MGTWGNGSSPRRAGSFRLKSSEGPGEPKDPFAPPFWYLSLTGVEQCSSASENQNISER

SEQ ID NO: 217073 - protein, 116 aa, Glycine max
  Coding DNA Sequence Number=SeqID_100295
  Subcellular localization annotation: CTP_CleavageSite=70; ConfidenceScore=5.06e-01
MLHITSLSSILLKATLTMLFPIMLTLDSSGRASHCDSSSDSSGMILMGGPLDLPSVRIRPSKSTRMWEILATMRISRHLRSLSTGVFTMKRYSRERWFCLMRNEIPQDMRVNLLKI

SEQ ID NO: 217074 - protein, 354 aa, Glycine max
  Coding DNA Sequence Number=SeqID_100296
  Gene Ontology: Mol. function=tRNA-pseudouridine synthase activity; Cellular component=cytosol; Biological process=tRNA pseudouridine synthesis
  Homolog annotation: Hit_ID=P07649; Match level="QueryCoverage=62%, HitCoverage=81%, E-value=1e-109, Identity=84%"; Hit description=tRNA pseudouridine synthase A
  Pfam annotation: Domain name=PseudoU_synth_1; Domain location=136 -234; Score=135.3; E_value=1.7e-37; Accession=PF01416.10; Description= tRNA pseudouridine synthase
  Pfam annotation: Domain name=PseudoU_synth_1; Domain location=273 -354; Score=48.2; E_value=2.8e-11; Accession=PF01416.10; Description =tRNA pseudouridine synthase
  Pfam annotation: Domain name=Semialdhyde_dhC; Domain location=1-120; Score=-3.8; E_value=3.2e-05; Accession=PF02774.9; Description =Semialdehyde dehydrogenase, dimerisation domain
  Pfam module annotation: Pfam domain module=PseudoU_synth_1::PseudoU _synth_1::Semialdhyde_dhC; Domain location=136-234::273-354::1-120
MSTILAAAGVQPAAAAGGQCRQRGERAPAGLPIAVSSVQAPVFYGNAQIVYIENLRPLSAEEARDELARADDISLSDDGDYPTPVSDASGNEALSIGSVRNDYGIPELLQFWSVADNIRFGGALMAVKTAEKLLALGIEYDGSRYYGWQRQNEVRSVQEKLEKALAKVANHPVNVFCAGRTDAGVHGTGQVVHFETTSSRADSAWTLGVNANLPDDIAVRWVKAVPESFHARFSATARRYRYVIYNQRLRPAILGKGITHFYHPLDAEKMHRAAQALLGENDFTSFRAVQCQSRTPWRNVMHLNVTRLGPYVIVDIKANAFVHHMVRNIVGSLLEIGCGNQPETWMATLLGGKR

SEQ ID NO: 217075 - protein, 138 aa, Glycine max
  Coding DNA Sequence Number=SeqID_100297
MGKLDHLEERLRAIKGGEDYAFANLEELFLVPNIITPPEFKVLDFDKYKGTTCPENHLKMYCRKMGAYAKDEKLLIHSFQESLTGGSCYLPSFPPTQQCHYSANNKPSPYPPPSHPQRPSLKSTTKPTYRTSNDKHHL

SEQ ID NO: 217076 - protein, 1005 aa, Glycine max
  Coding DNA Sequence Number=SeqID_100298
  Gene Ontology: Mol. function=transferase activity, transferring glycosyl groups; Biological process=purine base biosynthetic process
  Homolog annotation: Hit_ID=P0AG16; Match level="QueryCoverage=49%, HitCoverage=99%, E-value=0.0, Identity=89%"; Hit description =Amidophosphoribosyltransferase
  Pfam annotation: Domain name=Colicin_V; Domain location=1-104; Score =35.3; E_value=2.2e-07; Accession=PF02674.6; Description=Colicin V production protein
  Pfam annotation: Domain name=GATase_2; Domain location=93-302; Score =216.4; E_value=6.2e-62; Accession=PF00310.11; Description=Glutamine amidotransferases class-II
  Pfam annotation: Domain name=Pribosyltran; Domain location=355-508; Score=43.0; E_value=1.1e-09; Accession=PF00156.17; Description =Phosphoribosyl transferase domain
  Pfam annotation: Domain name=SBP_bac_3; Domain location=773-1000; Score=327.6; E_value=2.2e-95; Accession=PF00497.10; Description =Bacterial extracellular solute-binding proteins, family 3
  Pfam module annotation: Pfam domain module=Colicin_V::GATase _2::Pribosyltran::SBP_bac_3; Domain location=1-104::93-302::355 -508::773-1000
FDDELVRNGIAIAVLFVATLIVGAIVNYVIGSLVEKTGLSGTDRVLGVCFGALRGVLIVSAILFFLDTFTGFSKSPDWQQSQLIPQFRNDNMCGIVGITGFMPVNQSIYDALTVLQHRGQDAAGICTIDALNCFRLRKANGLVSDVFEARHMQRLQGNMGIGHVRYPTAGSSSASEAQPFYVNSPYGITLAHNGNLTNAHELRKQLFEVGRRHVNTTSDSEILLNIFAQELDRFQHYPLEADNIFAAVAAVHQQVRGAYAVVAMIIGHGMVAFRDPNGIRPLVLGKRELADGRTEYMVASESVALDTLGFEFIRDVAPGEAVYITEQGQLSTRQCAENPKSNPCLFEYVYFARPDSFLDKISVYSARVRMGTKLGEKIAREWEDLDIDVVIPIPETSTDTALEIARILDKPYRQGFVKNRYVGRTFIMPGQQLRRSAVRRKLNANRAEFRDKNVLLVDDSIVRGTTSEQIIEMAREAGAKRVYLASAAPEIRFPNVYGIDMPSATELIAHGREVEEIRQLIKADALIFQDLQDLIDAVREENPDIAQFECSVFNGIYVTKDVDLQYLEYLQSLRNDDAKAIARQNEVENLELHNEARLNYETTHHWYFRRQRRDLRRAYAAGAATVSRSGNPSGTGRCGARCARYRRQHLVRLVQNAGYGNSAMFHEDPVGHCAQLQRQSADARRRRGAERAAPAGAVRAGNPAASRSSAHDDHRRRAWGADYAARRSTACWISLISSCRKICLPAGRRVLALSLMLAMSGAASVFAAVPQSLRIGTDPTYPPFESKNAQGQLVGFDIDLANEICKRIKTKCTYVESDFDALIPSLKAKKIDAIISSLSITEKRQEEIAFSEKLYAANARLVAPKGSKLQPTIESLKGKNIGLLQGTTQETYANEYWRPKGVTVTPYANQDLVYQDLNAGRIDAAFQDEVQASEGFLKQPVGKNYAFAGPAVKDDKIFGVGTGMGLRKDDADLKAAIDKAFNDMRKDGTYDKIAKKYFDFNVYGD

SEQ ID NO: 217077 - protein, 91 aa, Glycine max
  Coding DNA Sequence Number=SeqID_100299
MLVRTIRTCLFAAARVKSCPGMHSSCVIASLSGCIRIVGALQYQGMWSPLKARTRTPLKARACSPPKAMMCSPLKGRTYSPLKIRVCSPLK

SEQ ID NO: 217078 - protein, 158 aa, Glycine max
  Coding DNA Sequence Number=SeqID_100300
  Subcellular localization annotation: CTP_CleavageSite=60; ConfidenceScore=5.10e-01
MPISPCGSINWSVLSRHRGRAHKTPSGPGEVQQGPGVSSSGYGPLSVLQGARTPRQGIAPAGHPVDLKKSNRVLGFPALIMGLCQFYGVPVTPSKVIRPPTNRAFIKKYCAPRQAKGETPQQPGDGQQQATNAPPPPPEPLSSSTKGLEYCLRHMADQ

SEQ ID NO: 217079 - protein, 287 aa, Glycine max
  Coding DNA Sequence Number=SeqID_100301
  Gene Ontology: Mol. function=DNA binding; Biological process=DNA integration
  Homolog annotation: Hit_ID=Q1SDN3; Match level="QueryCoverage=86%, HitCoverage=18%, E-value=3e-29, Identity=33%"; Hit description =Polynucleotidyl transferase, Ribonuclease H fold
MASIKQGDKSITDYFTRFCVIWDEFESYGLDPICVCDPKCSCDALSSVLERKKQDHVMQFLRGLNDQFSIVKSNVLMMDPLPVISKVFLYAMQQQRQISNNDVLGSTSMINAANTNSSSSPFSCTYCGNLGGLGNKICTHCGFTNYIVDECYRKHEYPSDVKLTAQQYNALMTLLQQQGSSTHNNSQVNQIGTMASFGHAPIGNMPSITCSVSKVMSLLISKQGPLVYPGIPFIAQDSSGLITVLPIPTSSFHDDIEFPVYASSVSPSVPPDSSLIASTPTEAPQSS

SEQ ID NO: 217080 - protein, 507 aa, Glycine max
  Coding DNA Sequence Number=SeqID_100302
  Gene Ontology: Mol. function=5-formyltetrahydrofolate transporter activity; Cellular component=chloroplast envelope
  Homolog annotation: Hit_ID=Q9SKZ5; Match level="QueryCoverage=95%, HitCoverage=87%, E-value=1e-173, Identity=67%"; Hit description =Expressed protein
  Pfam annotation: Domain name=BT1; Domain location=86-500; Score =630.6; E_value=1.3e-186; Accession=PF03092.7; Description=BT1 family
  Pfam annotation: Domain name=MFS_1; Domain location=82-454; Score =57.5; E_value=4.5e-14; Accession=PF07690.6; Description=Major Facilitator Superfamily
  Pfam annotation: Domain name=PUCC; Domain location=112-487; Score= -227.2; E_value=0.05; Accession=PF03209.6; Description=PUCC protein
  Pfam module annotation: Pfam domain module=BT1::MFS_1::PUCC; Domain location=86-500::82-454::112-487
MEISGTVPSSGSSFRLSSDDGDPLLGSRIGAGTDDGDALTTETDPEVSSSSRIAARKNKYRTSSIKLFGVELSPDNVAVAMVYFVQGVLGLARLAVNFYLKDDLHLDPAEAAVLSGFSALPWLVKPLYGFISDSVPLFGYRRRSYLVLSGLLGALSWSLMATFVDNKYSAGFCILLGSLSVAFSDVVVDSMVVERARGESQSTSGSLQSLCWGSSAFGGIVSSYFSGSLLDAYGVRFVFGVTSLLPLITSVVAVLVKEQPMIGTARGLNLLFSGPEFLESSKQRIIQLWGSVRQRSVFLPTLFIFLWQATPQSDSAMFYFTTNSLGFTPEFLGRVKLVTSIASLLGVGLYNGFLKNVPLRKVFFATTLLGSTLGMTQVFLVTGLNRKFGISDEWFAIGDSLILTVLSQASFMPVLVLAARLCPEGMEATLFATLMSVSNGGSVVGGLLGAGLTQLFGITKDRFDNLAALIILCNLSSLLPLPLLGLLPGDNPDMNEEDNSDIEMKCN

SEQ ID NO: 217081 - protein, 211 aa, Glycine max
  Coding DNA Sequence Number=SeqID_100303
MRTVFLQSKTKSSTSSSDEDNNSCYFPGCKKDANCNCEMCLASINATLDLMPNSVHKGTLTKLSASKPNVACTPISFDASILSTPRSSEFQLSSSTPLSKSRARSDLSKKMEKHKKGQQASGFSFLRLMLFFGFFLSADLVFPLVVSGVFQPSLSPDVVKRVGEKCSLVRDLNGKLRLLQKELASVVVGEVSNCSFTDTLWEISQVGQNWF

SEQ ID NO: 217082 - protein, 146 aa, Glycine max
  Coding DNA Sequence Number=SeqID_100304
DGLLLNSRCTLYKSAIEEVTIWGWPLQTAGLLTNGFSSRTFTLLSGRVTQWNGGQIGYSIRTANASWVQPKWDASAVQLDPNTWVLEYQMSYIFDGTRLHSAALEFLKYRISRIVARLKKDFWLFIAFEDKQYNGFTAKNGPQIPT

SEQ ID NO: 217083 - protein, 156 aa, Glycine max
  Coding DNA Sequence Number=SeqID_100305
  Homolog annotation: Hit_ID=Q9SEK8; Match level="QueryCoverage=29%, HitCoverage=19%, E-value=1e-12, Identity=78%"; Hit description=Seed maturation protein PM26
  Pfam annotation: Domain name=SMP; Domain location=55-96; Score=19.0; E_value=0.0035; Accession=PF04927.3; Description=Seed maturation protein
MDKEETCRESWCNAWPRILTSHLLNWNTKPILNTIRQQDTKMSQEQPRCPKDQDPIKYGDVFHVSGNLAKKPVAPEDAAMMQRVLAQVTHCHRRFRLIIFFHSSLPHHHNIWVTRRWIRVTQAAEMRAMGRVGWLLWLKSEQDKVKLADVLTAARC

SEQ ID NO: 217084 - protein, 156 aa, Glycine max
  Coding DNA Sequence Number=SeqID_100306
MVVVVELVVAVSGGDGGGDNDKGGISGGSDNNDNDGNNVDGGGSNGNGVVVVVVIAMSIMMMMSMTVMVAVTMVVVVMVAMIKVVVIIMMMLVAIALMVVVVAISMVVVVVVTILMMVMVVLAIGYDNDKCGIGSGSSGDGDGSDNDVGDEVKTKR

SEQ ID NO: 217085 - protein, 304 aa, Glycine max
  Coding DNA Sequence Number=SeqID_100307
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=Q26F34; Match level="QueryCoverage=99%, HitCoverage=96%, E-value=1e-110, Identity=68%"; Hit description=Cell division protein, signal recognition particle (Docking protein) FtsY
  Pfam annotation: Domain name=CbiA; Domain location=117-296; Score= -26.7; E_value=0.013; Accession=PF01656.13; Description=Cobyrinic acid a,c-diamide synthase
  Pfam annotation: Domain name=MMR_HSR1; Domain location=115-270; Score= -18.9; E_value=0.054; Accession=PF01926.13; Description=GTPase of unknown function
  Pfam annotation: Domain name=MobB; Domain location=115-242; Score= -30.4; E_value=0.01; Accession=PF03205.4; Description=Molybdopterin guanine dinucleotide synthesis protein B
  Pfam annotation: Domain name=SRP54; Domain location=113-304; Score =361.9; E_value=1e-105; Accession=PF00448.13; Description=SRP54-type protein, GTPase domain
  Pfam annotation: Domain name=SRP54_N; Domain location=16-98; Score =47.1; E_value=6.1e-11; Accession=PF02881.9; Description=SRP54-type protein, helical bundle domain
  Pfam module annotation: Pfam domain module=CbiA::MMR_HSR1::MobB::SRP54 ::SRP54_N; Domain location=117-296::115-270::115-242::113-304::16-98
MSWFKNIFKKEEKETLDKGLEKSSQGFFEKITKAVVGKSTVDDEVLDDLEEILIASDVGASTTIKIIQRIEERVARDKYVNVGELDKILREEISNLLLENPHAGTGNIDTSKKPYVIMVVGVNGVGKTTTIGKLAHQFKSEGKKVVLGAGDTFRAAAVDQLTIWSERVGVPIVKQEMGSDPASVAFDTVQSAVAQGADVVIIDTAGRLHNKVNLMNELSKIKRVMQKVIPDAPHEILLVLDGSTGQNAFEQAKQFTAATEVNALAVTKLDGTAKGGVVIGISDQFQIPVKYIGVGEKMQDLQLF

SEQ ID NO: 217086 - protein, 413 aa, Glycine max
  Coding DNA Sequence Number=SeqID_100308
  Gene Ontology: Mol. function=DNA binding; Cellular component =membrane; Biological process=DNA integration
  Homolog annotation: Hit_ID=Q1SDN3; Match level="QueryCoverage=57%, HitCoverage=33%, E-value=2e-40, Identity=58%"; Hit description =Polynucleotidyl transferase, Ribonuclease H fold
DMQNLQRIGTVDMVEGLYRLKMLPSKPPKEYNSSSITAFVSASVSALSCCFPFTAQDKPDPITVLHVPTSSFDGTIDQFDDFPSEPPIDHTIVEPNDTDLNPSISQKATQAPRQSMRQIHRPSKYKDSHITYPSSTIANLSTIEPQSYNGASKDPSYTQIEGQDYLDTFSLVAKLTIVRLLLALAAINQWHLKKLDVNNALLHGHLNEEVHMAFPQGFEVARTTTSINLCQRKYALNILSDTGMLCSKPVFTPSNYTTRSITGFAIYFGNSLISWKSKKRATVSKSSSEVEYRALANATCELQWLIFLLKKFKIDFQHHVALYCDNRSALHIAITLVFHERTKHIEIDCRIVREKMLNGLVKLLLVSSTNQLADIYIKALMHGAFPFLHSKLGMSTFIPSLRGALSIDIVLIM

SEQ ID NO: 217087 - protein, 154 aa, Glycine max
  Coding DNA Sequence Number=SeqID_100309
  Gene Ontology: Mol. function=protein serine/threonine kinase activity; Biological process=protein amino acid phosphorylation
  Homolog annotation: Hit_ID=Q7XJ40; Match level="QueryCoverage=36%, HitCoverage=7%, E-value=1e-12, Identity=57%"; Hit description =Receptor-like protein kinase ARK1
MCWKSFYLEVDDMDLPVFDLSTIVTATSNFSVKNKIGEGDFGLVYREIAVKRLSSSSTQGLTKFKNEAKQLCLGITSTLILEYRPVRVVAKAGNKREIGDVPTASMKEAMPGGHNLGQRRGRLRRMGTSITTTTTKVKTLVMRGSDTNDERLGL

SEQ ID NO: 217088 - protein, 252 aa, Glycine max
  Coding DNA Sequence Number=SeqID_100310
  Homolog annotation: Hit_ID=Q1S365; Match level="QueryCoverage=49%, HitCoverage=10%, E-value=6e-39, Identity=70%"; Hit description =Lissencephaly type-1-like homology motif; CTLH, C-terminal to LisH motif; WD40-like; ...
  Homolog annotation: Hit description=Quinonprotein alcohol dehydrogenase-like
MRVHINSFRKPKWRWLFLRLCKLNLMLTTLPLLRQPILLYSGRTFVGTNLSPMWERFLFPLEDDSVLCQHTSSPLGNGAVPQEIGITSHQYDKELTESINVKVSQEIFYSIVHEVVEEIGVPASSLSWDEVEKYLIVHNGNWDEVEKYLSGFTKVDDNRYSMKIFFEIRKQKYLEALDKHDWSKAVEILVKDLKVFVTFNEELFNEITQLLTLENFRKLPTVLQMRAAVCEVVNCFPTAVVSGRSKDKIVRF

SEQ ID NO: 217089 - protein, 49 aa, Glycine max
  Coding DNA Sequence Number=SeqID_100311
MSVWRLSVWENPEWMTQSQFETFACTPTSSLGGSCCLRRHRHFSVRIHG

SEQ ID NO: 217090 - protein, 87 aa, Glycine max
  Coding DNA Sequence Number=SeqID_100312
MIDLDSLKCGRVILLTSFEMFILESSSFDSLKHQLLFLLVLRNANNVPWITWLPYVKERISMMLLAKELRLAVWLAMLSMNDEEVVE

SEQ ID NO: 217091 - protein, 225 aa, Glycine max
  Coding DNA Sequence Number=SeqID_100313
  Homolog annotation: Hit_ID=Q8H6Q8; Match level="QueryCoverage=98%, HitCoverage=9%, E-value=2e-26, Identity=29%"; Hit description=CTV.20
MEPEFWDKNPFKATAKAFPSGFYFKPTAINKTRTFYELILVDSNSVSIKHFKDSKDQSLNTHSTIQIFKVLQPRHFGPDLNKGKKNSVPFDPVGYTYWDYVDAWTKVFWHQNNRYKHLWLIYFMTNVVYNFPNWFFQWRDFFGPIPEIFPEQRHTFVKWWTQFDSSKADPKQVKLWFQSHPKLLKAADPETSVFLNQKSQLATFLTGSRSKESLAKNLKEVLQML

SEQ ID NO: 217092 - protein, 137 aa, Glycine max
  Coding DNA Sequence Number=SeqID_100314
  Homolog annotation: Hit_ID=Q1EP77; Match level="QueryCoverage=46%, HitCoverage=13%, E-value=9e-15, Identity=67%"; Hit description =Serine carboxypeptidase (Carboxypeptidase D), putative
ALGVAKPSVASYLSQEILAEQEVDRAHGLPAQPPVKFNNMVVISLSMKLKEEHCSIGFSRPLTNQNKNPFSFGSMEVPFFTNPALHVYDYLVDTAAFVQTRESINEFLTSVKQHDLAKAKVLSILNIGPAADFELYP

SEQ ID NO: 217093 - protein, 123 aa, Glycine max
  Coding DNA Sequence Number=SeqID_100315
MDVNLDRILIPVILCIVGISVHNSKSSTSLLVFFAINTIIFSILVGSRKSSLAEIGMASPLLPSFFEVGGNIEDESVDKVDEITTQEQEESDDNLKSRIESFITKVYKGWIEESYWDKYGIDM

SEQ ID NO: 217094 - protein, 378 aa, Glycine max
  Coding DNA Sequence Number=SeqID_100316
  Gene Ontology: Mol. function=DNA binding; Cellular component =mitochondrion
  Homolog annotation: Hit_ID=Q1RVC8; Match level="QueryCoverage=97%, HitCoverage=100%, E-value=1e-114, Identity=61%"; Hit description=HMG- I and HMG-Y, DNA-binding
  Pfam annotation: Domain name=AT_hook; Domain location=78-90; Score =19.1; E_value=0.012; Accession=PF02178.9; Description=AT hook motif
  Pfam annotation: Domain name=DUF296; Domain location=193-313; Score =231.3; E_value=2.1e-66; Accession=PF03479.5; Description=Domain of unknown function (DUF296)
  Pfam module annotation: Pfam domain module=AT_hook::DUF296; Domain location=78-90::193-313
VLLHKCLNMEASGGVSSGVTVVGSDAPSDYHVAPRTDNPAPASGSTTQIPATAGSALSPSHPPHTAAMEAYPATMPAKKKRGRPRKYAPDGSVTMALSPKPISSSAPLPPVIDFSSEKRGKIKPASSVSKAKFELENLVLVFVFVVSVGKWKIGMRKWLIGKWNEKRGIRSFKLDPNHIFLGEWVACSVGANFTPHIITVNSGEDVTMKVISFSQQGPRAICILSANGVISSVTLRQPDSSGGTLTYEGRFEILSLSGSFMPNESGGTRSRSGGMSVSLASPDGRVVGGGVAGLLVAASPVQVVVGSFLAGNQHEQKPRKQKHEVISSVTPAAVVPISTLDPVSILSAASSIRNDNWSAMPAEAKDKPADINVSLPAG

SEQ ID NO: 217095 - protein, 257 aa, Glycine max
  Coding DNA Sequence Number=SeqID_100317
  Gene Ontology: Mol. function=endopeptidase Clp activity; Cellular component=chloroplast; Biological process=proteolysis
  Homolog annotation: Hit_ID=Q1RVC7; Match level="QueryCoverage=89%, HitCoverage=81%, E-value=1e-103, Identity=77%"; Hit description =Peptidase S14, ClpP
  Pfam annotation: Domain name=CLP_protease; Domain location=58-241; Score=302.9; E_value=5.8e-88; Accession=PF00574.13; Description=Clp protease
MAALVAGFEKLRPAPCNIPKLTERKSKGLCFRYANHNTSMARIRMMPIGTPKVPYRTPGEGTWQWVDVWNALYRERVIFIGQEIDEEFSNQILATMLYLDSIENSKKLYMYINGPGGDLTPSMAIYDTMQSLQSPVATHCVGYAYSLAAFLLAAGEKGNRSAMPLSRVALTSPAGAARGQADDIQNEANELLRIRDYLFNELAQKTGQPVEKITKDLSRMKRFNAQEALEYGLIDRIVRPPRIKADAPRKEAGTGLG

SEQ ID NO: 217096 - protein, 333 aa, Glycine max
  Coding DNA Sequence Number=SeqID_100318
  Gene Ontology: Mol. function=DNA binding; Cellular component=nucleus; Biological process=regulation of transcription
  Homolog annotation: Hit_ID=Q0PJD8; Match level="QueryCoverage=96%, HitCoverage=100%, E-value=1e-119, Identity=70%"; Hit description=MYB transcription factor MYB187
  Pfam annotation: Domain name=Myb_DNA-binding; Domain location=14-61; Score=47.2; E_value=5.4e-11; Accession=PF00249.21; Description=Myb -like DNA-binding domain
  Pfam annotation: Domain name=Myb_DNA-binding; Domain location=67-112; Score=47.1; E_value=6.1e-11; Accession=PF00249.21; Description=Myb -like DNA-binding domain
  Pfam module annotation: Pfam domain module=Myb_DNA-binding::Myb_DNA -binding; Domain location=14-61::67-112
MGRPPCCDKEGVKKGPWTPEEDIILVSYIQEHGPSNWKAVPANTGLSRCSKSCRLRWTNYLRPGIKRGNFTDQEEKMIIHLQALLGNRWAAIAAYLPQRTDNDIKNYWNTYLKKKLNKLEAGSDQGHNIGVSVSQPMSRGQWERRLQTDIRMAKRALIEALSSNKASSSSTLLLAESNSNLSSENSIFYNSNTNKPTTQSMCYASSADNIARLLKGWMKNTPKLASCAASAVTQNSFNNLAGADTAFSEGITTTKGSTSTSTVELSETFDSLFGYESLDYSSNSEFSPSLSPEATPFQDESKPDITADGIDMPFSLLEKWLLDDAACQEKLGF

SEQ ID NO: 217097 - protein, 171 aa, Glycine max
  Coding DNA Sequence Number=SeqID_100319
  Subcellular localization annotation: CTP_CleavageSite=41; ConfidenceScore=5.34e-01
MALKLQLPRKPSPLPTVTSKPQTYGSFGYGFGALSLSPLPRVNLAGVRCYDVLVVWCVGDMGFGDGVWGFGRDGVGQVDLRDEPTTVRAKTMTSTMASKGPKCVGVTAKLFFSGVFVWESAVATMTMHVSLTRGERRGFRVWSTNAFKISIFGHGQIVGEPKQICSFSYNF

SEQ ID NO: 217098 - protein, 47 aa, Glycine max; identical to SEQ ID NO: 161998
  Coding DNA Sequence Number=SeqID_100320

SEQ ID NO: 217099 - protein, 48 aa, Glycine max
  Coding DNA Sequence Number=SeqID_100321
MRLPGKERKHHLEETPGSTKIEENHSECINLAQCGAKKSPTQRILVGN

SEQ ID NO: 217100 - protein, 89 aa, Glycine max
  Coding DNA Sequence Number=SeqID_100322
  Subcellular localization annotation: CTP_CleavageSite=21; ConfidenceScore=5.76e-01
GSSGSSGRRFSGKFPQVAVVRVFPNSSGRTTSSGRLPENVFRELSGRSGSSGRIPEDSHFRKKFQTSGRPFRKNPSSGVFPEEPLLPEV

SEQ ID NO: 217101 - protein, 98 aa, Glycine max
  Coding DNA Sequence Number=SeqID_100323
MEYSNVGQFHPCIQDSIENIIDAKVDSNCGYRAIVALLGMGEESWSLVRNHLHVELTSWSEKYINLLGRIEKFEDVATYPSAGGRRETRGMRVPRKEY

SEQ ID NO: 217102 - protein, 178 aa, Glycine max
  Coding DNA Sequence Number=SeqID_100324
  Gene Ontology: Mol. function=oxidoreductase activity; Biological process=gibberellin biosynthetic process
  Homolog annotation: Hit_ID=Q4JH25; Match level="QueryCoverage=99%, HitCoverage=46%, E-value=6e-66, Identity=70%"; Hit description=GA 20- oxidase
MDSGFCLVSSPNHQEVVQSRFFDPSWLQMQPHVPMSFVWPKECLVNANEEFHAPMVDLGGFLRGDDDDATNRAVRLVRKACSSHGFFQVINHGVDPLLIGEAYDQMDAFFKLPIRRKVSVKKTLGSVWGYSGAHADRFSSKLPWKETLSFPFHDNNELEPPVVTSFFNDTLGGDFEQA

SEQ ID NO: 217103 - protein, 114 aa, Glycine max
  Coding DNA Sequence Number=SeqID_100325
PRLTMGAEDEDDSNVCMTDLVSAEDDTAKKNVYTDNHSGISARQRDSNVSMTDLVSAEDDIAKKNVYTDNHSGISARQRDSNVSMTDLVSVEDDVNLRVSTGLSAAIDEGRRRR

SEQ ID NO: 217104 - protein, 219 aa, Glycine max
  Coding DNA Sequence Number=SeqID_100326
  Homolog annotation: Hit_ID=Q47522; Match level="QueryCoverage=28%, HitCoverage=83%, E-value=6e-22, Identity=75%"; Hit description=LacZ protein
VLQWLLFLSAVPPVQLLTGWCVTAKAPPDISAGKCSGHAARRVPFAIQAAQLLGRAIGAGLFAITPAGERGMCCKAIKLGNARVFPVTTLNSMKAGAMLLGLAPSGTPLRDCQRSPRETQWLSEGHTAMPLGRLMDENYMQLFLNNISTSSAPPSSIGTESSCSRSWLRREAGTPAAPWSVGHQAYRYRRPRGGARYQLLFPLVRVNFELGVIMVIAVS

SEQ ID NO: 217105 - protein, 216 aa, Glycine max
  Coding DNA Sequence Number=SeqID_100327
MEKLDHLEERLRAIEEGEDYAFANLEELFIVPNIITPPKFKVLDFDKYKGTTCPKNHLKMYCRRMGAYAKDKELLIFDSIGNRAVMRCSCVLHHRVWSPTNSLPSIVHVSSHIESGTPRIDCLALFANSPFSNFIRRPMNSLPSAVHMSSTIESRASRIDCLALFTNSPFSNLIRRPMNSLPSAVHVSSTIESGAPRIHCLALFANSPFSILFGDP

SEQ ID NO: 217106 - protein, 102 aa, Glycine max
  Coding DNA Sequence Number=SeqID_100328
MKEGICSIQHFFNTWKAIPFQARTNVRRSVLVRIGEKERQPCKSPLPLAIQPWVQHVAFRHCHWRNSQWFRHWSWRHSHAVVFATLTSELRAGVRRCRRQQD

SEQ ID NO: 217107 - protein, 250 aa, Glycine max
  Coding DNA Sequence Number=SeqID_100329
  Gene Ontology: Mol. function=protein serine/threonine kinase activity; Cellular component=membrane; Biological process=protein amino acid phosphorylation
  Homolog annotation: Hit_ID=Q9LXT2; Match level="QueryCoverage=79%, HitCoverage=41%, E-value=1e-54, Identity=72%"; Hit description =Serine/threonine-specific protein kinase-like protein
  Pfam annotation: Domain name=Pkinase_Tyr; Domain location=146-250; Score=-140.8; E_value=0.00078; Accession=PF07714.7; Description =Protein tyrosine kinase
  Subcellular localization annotation: CTP_CleavageSite=25; ConfidenceScore=5.10e-01
MVSMQIATNWGTKMQREVLLSALVRVFASRKIRNGRRFWVQKEGQDSTRRNHGTRLRRRVCAARCLRLLLPHPQQGLESSQKPQKRFGSLSENVVKFKVRFILLDFIIVEDANLNEKSDFANLQVVAEKGLQVFTFKQLHSATGGFSKSNVIGHGGFGLVYRGVLNDGRKVAIKFMDQAGKQGEEEFKVEVELLSRLHSPYLLALLGYCSDSNHKLLVYEFMANGGLQEHLYPVSIQPACAQFDWLHWHF

SEQ ID NO: 217108 - protein, 1473 aa, Glycine max
  Coding DNA Sequence Number=SeqID_100330
  Gene Ontology: Mol. function=RNA-directed DNA polymerase activity; Cellular component=chromatin; Biological process=chromatin assembly or disassembly
  Pfam annotation: Domain name=Chromo; Domain location=1422-1473; Score= 22.0; E_value=0.0021; Accession=PF00385.14; Description='chromo' (CHRromatin Organisation MOdifier
  Pfam annotation: Domain name=RVP_2; Domain location=341-474; Score= -15.7; E_value=1.7e-05; Accession=PF08284.2; Description=Retroviral aspartyl protease
  Pfam annotation: Domain name=rve; Domain location=1119-1275; Score =125.5; E_value=1.5e-34; Accession=PF00665.16; Description=Integrase core domain
  Pfam annotation: Domain name=zf-H2C2; Domain location=1060-1101; Score=17.2; E_value=0.0019; Accession=PF09337.1; Description=His(2) -Cys(2) zinc finger
  Pfam module annotation: Pfam domain module=Chromo::RVP_2::RVT _1::Retrotrans_gag::rve::zf-H2C2; Domain location=1422-1473::341 -474::598-767::102-192::1119-1275::1060-1101
MSSSPKMDRIEEAIAKLASSHLILTEKLDELINRVTNLENITNPSPSPSSSSAMPIPQIQLANPHRLKLDVPRFDGSDPSGWVFKITQFFEYHATPEAERLTVASFYMDGPALAWFQWMARNHQLTTWSGFLQAIEARFAQSPYEDPTGLLFKLTQKGTVREYLAQFEALANRITGLSPASLLSCFISGLEPDVRREVQALQPSTLVHAAGLARLQEEKILEHRRAFRQRPHPSPPQHSPTPLSIVTPTPSPPLLPSPPKPPPLPIRRLTPEEIASRRERGLCFHCDEKFTRGHRCPSRFLLLLADEDPPDNPNIDNPDPLMDPNRPETPIINPMTQDPTEPTQAQISLHALSGYGTPETLRVTGRINLHHVTILVDGGSTHNFVQERLVKTLGLNPQPTPTLRVLVGNGNTVECSQVCSEVTVHIQGVSFSVNLHVLPLYGADVVFGVPWLKALGPVLTDYNNLVMKFMHDDRIIELKGSSETPLTAISPPQLRRLVQTQGASEFFHIRVCPSPEHTPNNSPNTQSAILDVINQFPSLFQPPTKLPPSRATNHHIHLLPNSTPVNVRPYRYPHFQKEEIESQVNTMLQNGIIRPSNSPYSSPVLLVKKRDDTWRFCVDYRALNALTVKDRFSIPTIDELLDELGGAYWYSKLDLLQGYHQILMAPEDVNKTVFRTHHGHYEFLVMPFGLCSAPSSFQATMNAIFGPCLRKFLIVFFDDILVYSKTFHDHLEHLRNTFQIISDNGFVLKKSKCSFAIQQVEYLGHVVSARGVEPVPEKVLAVQQWPPPRSVRHLRGFLGLSGFYRRFIKGYTTLAAPLTALLAKDQFGWTPEAEDAFNRLKEALCKAPVLALPDFAAPFIIETDASGAGMGAILSQHHHPLAFFSKPFCSKLLRASAYVRKLAAITAAVKKWRQYLLGHHFSIITDHRSLKELMAQAVQTPEQQVYLARLMGYDYTIHYRAGKHNSAADALSRLPEPPPNPLDTTQSQIFMLTIPNCVFLQELKRELFTNEEFQAKKKQIQEEKETPSEFIIKDEFILHQGRIWLPRNLPLLPTIIAEFHATPTGVHMGIMKTMARVRENFTWASMKEDIQRHITNCITCQQIKTDHRHPPGLLCPLPVPARPWEDLSLDFISGLPPYRGNSVILVIVDRFSKGIHLGSLPSHHTAFSVAQLFMELSGKLHGMPRSLVSDRDPLFLSRFWQELFKMSGTKLRMSSAYHPQSDGQTEAMNKIVEQYLRAFVHQNPASWGRFLVWAEWSYNTSVHSVTGKTPYEVTYGKPPPSLPQYITGSSNVQAVDELLTNRETLNACLIKKLTKAQQRMKEIADKQRRDVSYEEGDFVLVKLRPRRQTSATGETYSKLAKRYYGPFQITKKIGSAAYQLNLSTSSRIHPVFHCSLLKPFNSSTTEGSLELPAIAEDNEPLIHPLVIIDTRWDITPIGRHLLVLVQWAGLPPEDASWEKWEVLKKDYNLENNQ

SEQ ID NO: 217109 - protein, 65 aa, Glycine max
  Coding DNA Sequence Number=SeqID_100331
  Gene Ontology: Mol. function=transferase activity
MAKNNKSGSQSKHINIKYLATKERVKDKKVFIERINIELMMVDPLTKGMPPFKFKDHVRVETLIL

SEQ ID NO: 217110 - protein, 377 aa, Glycine max
  Coding DNA Sequence Number=SeqID_100332
  Gene Ontology: Mol. function=DNA binding; Cellular component=nucleus; Biological process=regulation of transcription
  Homolog annotation: Hit_ID=Q6ZGU0; Match level="QueryCoverage=99%, HitCoverage=100%, E-value=2e-81, Identity=45%"; Hit description =Putative NAC domain protein NAM
  Pfam annotation: Domain name=NAM; Domain location=12-136; Score =271.4; E_value=1.8e-78; Accession=PF02365.6; Description=No apical meristem (NAM) protein
MERNEMERIDDVMPGFRFHPTDEELVDFYLKRKIQQKSLPIELIKQVDIYKYDPWDLPSTGEKEWYFYCPRDRKYRNSARPNRVTRAGFWKATGTDRPIYSSEGKCIGLKKSLVFYRGRAAKGMKTDWMMHEFRLPCISDSSPPKKLSDRSLPPNDSWAICRIFKKTNSLSLAQKALSLPLISQLPGGIVSDMFTQGLKCHNIGSPAIQFCGDKQDELHQVSNNAINNNFSASDIPTYKLINNSTVSKPSPQSPVSDGDLADNFIFYSSWPTKCCTLDPTSMLSPNPDYIEFEDPNQQHYSGFSINLPQDMKQNMSTETGTKEQDHQWETTIGMRTTGYPFSLSPPYDAWKASSVAWESRPCPSDMSTTYSTNKCYT

SEQ ID NO: 217111 - protein, 82 aa, Glycine max
  Coding DNA Sequence Number=SeqID_100333
MASMPLGPQQQLPPPPPQQPPPAENDAMKVDSRGGSDAGTEKLIRQRGLGMSVAYGDLLISGIVFACSEVAGIMLRLRSEWF

SEQ ID NO: 217112 - protein, 731 aa, Glycine max
  Coding DNA Sequence Number=SeqID_100334
  Gene Ontology: Mol. function=protein binding; Cellular component =nucleus; Biological process=cell cycle
  Homolog annotation: Hit_ID=Q6YWY5; Match level="QueryCoverage=99%, HitCoverage=99%, E-value=0.0, Identity=78%"; Hit description =Putative cullin 3
  Pfam annotation: Domain name=Cullin; Domain location=27-630; Score =907.2; E_value=7.3e-270; Accession=PF00888.12; Description=Cullin family
TQKKRPYHIEAFKHRAVGDPKYAEKTWKVLEHAIHEIYNHNASGLSFEELYRNAYNMVLQKFGEKLYTGLVTTMTSHLKEISQSIESAQGEIFLEEINRKWVDHNKALQMIRDILMYMDRTFIPSNHKTPVHELGLNLWRDVVIHSSKTQARLLDTLLELVLRERNGEVINRGLMRNIIKMLMDLGLPVYQQDFEKHFLDVSANFYCRESQKFIESCDCGDYLKKAERRLNEEMERVSHYLDPRSESKITNVVEKEMIESHMHTLVHMENSGLVSMLVDDKYEDLQRMHNLFRRVPDGLTIVKDVMTSFVRDTGKQLVMDPERLRDPVDFVQRLLDLKDKYDRVITMSFNNDKTFQNALNSSFEYFINLNARSPEFISLFVDDKLRRGLKGVGEEDVEILLDKVMMLFRYLQEKDVFEKYYKQHLAKRLLSGKTISDDAERSLIVKLKTECGYQFTSKLEGMFTDMKTSHDTMQGFYAILGTEMGDSPSLSVQVLTTGSWPTQPSPPCNLPAEILGVCDKFRTYYLGTHNGRRLSWQTNMGTADLKATFGKGQKHELNVSTYQMCVLMLFNSAERLTCKEIEQATAIPMSDLRRCLQSLACVKGKNVLRKEPMSKDIAEDDAFFFNDKFTSKFFKVKIGTVVAQRESEPENLETRQRVEEDRKPQIEAAIVRIMKSRRTLDHNNIVAEVTKQLQSRFLPNPVVIKKRIESLIEREFLERDKVDRKLYRYLA

SEQ ID NO: 217113 - protein, 221 aa, Glycine max
  Coding DNA Sequence Number=SeqID_100335
  Gene Ontology: Mol. function=RNA-directed DNA polymerase activity; Cellular component=chromatin; Biological process=RNA-dependent DNA replication
MAESTRSKANSDLLEDAITKLTISLNDTLHSLTHKIDELINHLQKPEPNSHSPLSSSAIPSSATPPSSHRMKLDVPRFDGADLLGWIFKINQFLEYHATPEHERLTIVSFYMDGRALSLFQWMTSNGQFTSWPAFLQALQFQFAPSQYEDPTRALFKLTQKGTVNSYLFEFEDLANRIVGMPSPFLLSCFVSGLSSEIRREVQALQPLTMEVIGDLKLTKL

SEQ ID NO: 217114 - protein, 837 aa, Glycine max
  Coding DNA Sequence Number=SeqID_100336
  Gene Ontology: Mol. function=nucleic acid binding; Cellular component= mitochondrion; Biological process=RNA catabolic process
  Homolog annotation: Hit_ID=Q9FLF1; Match level="QueryCoverage=78%, HitCoverage=83%, E-value=0.0, Identity=72%"; Hit description =Mitochondrial RNA helicase-like protein
  Pfam annotation: Domain name=DEAD; Domain location=292-416; Score= -25.2; E_value=0.00075; Accession=PF00270.19; Description=DEADDEAH box helicase
  Pfam annotation: Domain name=Helicase_C; Domain location=474-560; Score=61.3; E_value=3.1e-15; Accession=PF00271.21; Description =Helicase conserved C-terminal domain
  Pfam module annotation: Pfam domain module=DEAD::Helicase_C; Domain location=292-416::474-560
  Subcellular localization annotation: CTP_CleavageSite=70; ConfidenceScore=5.41e-01
MARGLFHLCTRKRILSKLQALLFINHSQFHTFQNPVSPISTRFSNPLLRPRFSQSSKLPGERFRPTRPFSAAGNEGGATETPEGEFKTDFELGDEVINSVHGFSEHGVVANDESNDCNLEIVDSAECSSSSNNGGGGGGGGSDTNNELGKKSEEFMHVASRDPVELYREMCSVERGPRLDSTEVEVLLEVCHWFAKSGWASNQALAIYIGLSFFPTAAHKFRNFLKKCPADVAKYLVYLGPSDEAVRFLFPIFVEFCLENFPDEIKRFRGMVEAADLTKPHTWFPFARVMKRKIIYHCGPTNSGKTYNALQRFMEAKTGIYCSPLRLLAMEVFDKVNAKGIYCSLLTGQEKKRVPFSNHVACTVEMASTQELYEVAVIDEIQMMADSNRGYAWTRALLGLTADEIHLCGDPSVLDIVRKICQDMGDELCEQHYERFKPLVVEAKTLLGNLENIRSGDCVVAFSRREIFEVKLAIEKQTKHRCCVIYGALPPETRRQQASLFNDQSNEYDVLVASDAVGMGLNLNIRRVIFNSLTKYNGDKMVPVPASQVKQIAGRAGRRGCLYPDGLATTLHLDDLDYLIECLKQPFDDVKKVGLFPSYEQVELFSGQLPDLTFTQILEKFGENCRLDGSYFLCQHNHIKKIANMLEKVQGLSLEDRFNFCFAPVNVRDPKAMYHLLRYATSFGQKLPVNVAMGMPRSSARNDAELLDLETRHQVLSMYLWLSNHFDEETFPYVKKVEAMASCIADLLGQSLVKANWKPESRIKGRPKTEKSEGQLETRSAVELQTEKTEMGYSRTRSLLKLYEKIFGWGACLVEGVNIVEGEMLASSNTLYHQFIL

SEQ ID NO: 217115 - protein, 398 aa, Glycine max
  Coding DNA Sequence Number=SeqID_100337
  Gene Ontology: Mol. function=serine-type endopeptidase activity; Cellular component=chloroplast; Biological process=proteolysis
  Homolog annotation: Hit_ID=Q9LU10; Match level="QueryCoverage=83%, HitCoverage=77%, E-value=1e-133, Identity=72%"; Hit description =Protease Do-like 8, chloroplast precursor
  Pfam annotation: Domain name=Trypsin; Domain location=128-306; Score=- 11.1; E_value=4.1e-05; Accession=PF00089.16; Description=Trypsin
MNISNSNQTTISCVESHPSLTPYPYLSHKFNFQCQPTVTEEEEAVSSAAVRSALMECPLSAQTTPFRPSPFQALALGDPSVKLEEVTPPVFSSGPLFPIEDRIVQLFERNTYSVVNIFDVTLRPQLNVTGVVEIPEGNGSGVVWDEEGHIVTNYHVIGNALSRNPNSGEVVARVNILASEGLQKNFEGRLIGADRLKDLAVEAPKDILRPIKVGQSSSLKVGQQCLAIGNPFGFDHTLTVGVISGLNRDISSQTGVTIGGGVQTDAAINPGNSLLCKNVALFMIGVKWTSAGVGFAIPSSTVLRIVPQLIQFGKVVRAGLNVDIAPDLIANQLNVRNGALVLLVPANSLAAKAGLNPTTRGFAGNIVLGDIIVAVDNKPVKSKADLLKALDDYNVGDK

SEQ ID NO: 217116 - protein, 77 aa, Glycine max
  Coding DNA Sequence Number=SeqID_100338
MGHLSDQRVPTDPKRIKVIPKWPTPPSVKERNPEYQEPLNLRSNPFQGGKDDAIGGYWIEDSKRIGLEWLKKALGFS

SEQ ID NO: 217117 - protein, 121 aa, Glycine max
  Coding DNA Sequence Number=SeqID_100339
MEKVPRQRRQNYLFDHNTCLLPLLNWYYLFLYGSSLTSKHTGSANMKKSLHQLVNKNLQLRVLAFHGKEAPFTLKKRNQEKLHAYKGMGMSLPPLGISQSLKNSLISLKDETWPLALFYAL

SEQ ID NO: 217118 - protein, 80 aa, Glycine max
  Coding DNA Sequence Number=SeqID_100340
MVGVEEVRDAYALIHVPTEEVKLVGQTLNTFLAWPTHLVKSLLEHGVVGPMKPADRPDHDVDDPLYLMTLTIPQHFLKPL

SEQ ID NO: 217119 - protein, 61 aa, Glycine max
  Coding DNA Sequence Number=SeqID_100341
MAHKFCFEALDHSLRDIIKHISRHNKIFGGLEADKKHALTKQHASNRPRRNCKFCTMDYRY

SEQ ID NO: 217120 - protein, 267 aa, Glycine max
  Coding DNA Sequence Number=SeqID_100342
  Gene Ontology: Mol. function=transferase activity; Cellular component= intracellular; Biological process=translation
  Homolog annotation: Hit_ID=Q1SP37; Match level="QueryCoverage=82%, HitCoverage=82%, E-value=4e-67, Identity=50%"; Hit description =Bacterial adhesion
MKKSLGSYLRANNNYMATPLAVAKEEEWYIVIVKKIQFRRRFCMLRHVLIRIVNALSNHDEYFQMRVDALRQKGLSPLQKCTTVIRILAYGSPADSVDEYVRIGETTTVECLERFVLGICTIFGNEYLRRPNNEDIKRLLQMGAARGFPVLSGHAPAMQFMVNRTQYNMGYYLADDIYPDFVTFVKTISMPQGEKRKLFAQRQESVRKDVERAFGVLQSRFAIIRGPSRFWDAGKMKNIIYACIILHNMIVEDERDTYQNNIDYDTA

SEQ ID NO: 217121 - protein, 112 aa, Glycine max
  Coding DNA Sequence Number=SeqID_100343
MTKARQKGVRKENRGEACHPACPGIVLQCLLLTSGMSRNFTNCLMMGAKYLEVVKQGSHPNNGWSPDEIRRMHASGVLSRMSAHLARASNSSFFQIPPRAQPYEWCAQRMAC

SEQ ID NO: 217122 - protein, 81 aa, Glycine max
  Coding DNA Sequence Number=SeqID_100344
MGAALAPTYPQAKGHFGAVAAHPGELSLSAEAISSPKRAGFFTMKLFGSPREPEAGLGELGSKNTKEKTLLSPLFWYFLHS

SEQ ID NO: 217123 - protein, 86 aa, Glycine max
  Coding DNA Sequence Number=SeqID_100345
MAPRKLASKRSRKDKSAEGTSSAPEYDSHRFRSAVHQQLFEAIKGWVNAVKFSRTLKWTWMNAQMDKRTYFGNVGLTKIEEMNPEP

SEQ ID NO: 217124 - protein, 361 aa, Glycine max
  Coding DNA Sequence Number=SeqID_100346
  Gene Ontology: Mol. function=phosphoribosylaminoimidazolesuccinocarbox amide synthase activity; Cellular component=cytoplasm; Biological process=purine nucleotide biosynthetic process
  Homolog annotation: Hit_ID=Q8PQ58; Match level="QueryCoverage=56%, HitCoverage=65%, E-value=1e-100, Identity=87%"; Hit description =Phosphoribosylaminoimidazole-succinocarboxamide synthase
  Pfam annotation: Domain name=SAICAR_synt; Domain location=168-361; Score=71.0; E_value=3.8e-18; Accession=PF01259.9; Description=SAICAR synthetase
AGEVGGENGRGDEAVGHGRGLRNGERILPPAGGTVGSALAQGLDAVVGGVDPPRLLLGLLLQLGGGTAQLVGVVLRDQLAIGALYLGIGGLGGQPQLPVRVLLVQAEPVRVEGMADQQADHRAKQRIGPEQQGAGDESEQFSVPAHGAPGRIDNAPGVPVPTTLLQSDLPGLPLRHRGKVRDVFDIPRERLPAGTPPGDYLLMVATDRLSAFDVVLPDPIPGKGEMLCQVSNFWLTKSAHLMPNHLTGIDVASVLPEGVDPALYAKRAVVTRKLKPVPVEAIARGYLIGSGWKDYQRTGKVSGIDLPDGLRQTEQLPEPIFTPSTKAAVGIHDENIDFDAMVKQVGADLTENMRDATLRIY

SEQ ID NO: 217125 - protein, 488 aa, Glycine max
  Coding DNA Sequence Number=SeqID_100347
  Homolog annotation: Hit_ID=P05481; Match level="QueryCoverage=43%, HitCoverage=62%, E-value=2e-84, Identity=70%"; Hit description=Major head protein
  Pfam annotation: Domain name=HDPD; Domain location=183-276; Score =153.9; E_value=4.1e-43; Accession=PF02924.5; Description =Bacteriophage lambda head decoration protein D
  Pfam annotation: Domain name=Phage_cap_E; Domain location=277-488; Score=302.2; E_value=9.9e-88; Accession=PF03864.6; Description=Phage major capsid protein E
  Pfam module annotation: Pfam domain module=HDPD::Phage_cap_E; Domain location=183-276::277-488
AVLDTEAAVYTGQESIDAGLSDELVINTDALAVMREAISNSKVTRSIGGQMSVNQTQTVADTPTGSEVATAQMAADPTAAQPAGSVTAAVNDAIQAENARIMGILDCDEAKGRGASARALAATPGMTVENAQRILASMPESAQVRTETGLDRLMVDSPEALGQGAAAKAEENDLMNTPPLGGSDAAHTAIGISGLAAATPALTPLMLKEDTNTLVAWDGAKAGTAVAILALAIDGPQPKITYYKSGTFRVEDVRWPEAAATDELKFNAFAGKLMSQSMYSTSKLIAVTETKFKFDPLFLRVFYRESYEFDTETVDLAKIPGEVAMAVYISPTVEGKVLRSRGGLTTQFKPGYVKPKHEVNPQMVLRRLPDEDPEQLKDPAYRRNRIILQNLKDEELAIAQVEEKQAVDAVISGKYIMTGEAFEEVEVDLQRDPANNITQAGAGRWSTQDKETYDPTGDLEEYALNASGIVNLVVMDPKAWSLFQSFKA

SEQ ID NO: 217126 - protein, 118 aa, Glycine max
  Coding DNA Sequence Number=SeqID_100348
  Subcellular localization annotation: CTP_CleavageSite=43; ConfidenceScore=5.06e-01
MWLKWVKTPVVLFGNHDERTKWHQKRKAPSTPSQVRFDRSRFTSQEAWERFALLRPDPQELAAKLCIPRSGFKLNADGQPLKILRKNMTTLAQTWSVLSFSNLIPTSHTSDVTLAEPS

SEQ ID NO: 217127 - protein, 93 aa, Glycine max
  Coding DNA Sequence Number=SeqID_100349
  Subcellular localization annotation: CTP_CleavageSite=39; ConfidenceScore=5.22e-01
MVKKPTCLGKLIASTLSFRSPGQAAFALSAHFPINRRAREAVERQKGSRGEGNWRREKEEEERRGNEVEALQIVTAIIPYVIFLFYVLCATIG

SEQ ID NO: 217128 - protein, 86 aa, Glycine max
  Coding DNA Sequence Number=SeqID_100350
MTDLVSAEDDVNLRVSTGLPAAIDEGCRMTIICLCVPSDTTVSEWKMVCGMTIICLRMSSGPPPLDDKRVQNDHNLSLRAIGHDCV

SEQ ID NO: 217129 - protein, 58 aa, Glycine max
  Coding DNA Sequence Number=SeqID_100351
MFLAGEKGIAQRQYKWRLQSLLILSNVWEPYQSNQRKKLRNPRNLLEMSLSLSEDTVL

SEQ ID NO: 217130 - protein, 245 aa, Glycine max
  Coding DNA Sequence Number=SeqID_100352
  Gene Ontology: Mol. function=RNA-directed DNA polymerase activity; Cellular component=mitochondrion; Biological process=RNA-dependent DNA replication
MPYLRKQRKLESEDQTMYVLDGVHKGICGMHIVGRSMATRIIRVGHYWPTLREDCTRYVKKCKECQEFNNFHHTPPKELYNITSPWILPYEEWIINLRPFPTAKSQIKFFLAIGYEEFLKKLKIRHLAFSVNHPQTNGQVEAINKVILVELHMTLSKVPKGLWVDELPSVLCGMFNTSKNLGSLAVELDLVEEVRSEARVHEKAYKRTMTRKYNSKLKKQSFKANNMVWRMVLIGLKTWGKKGHL

SEQ ID NO: 217131 - protein, 78 aa, Glycine max
  Coding DNA Sequence Number=SeqID_100353
MSPFGLGNFIVICSIETIAPRAFIHVLLNRTLWEVSASMRTYWTSSVLDKSLIPKVVSCSTTPWAWTYPLVKLIKGYG

SEQ ID NO: 217132 - protein, 128 aa, Glycine max
  Coding DNA Sequence Number=SeqID_100354
MEAQECYAKTLPAKPYIFTSEKHTKAIDINNVGGVTPISLVEFDPRKDKEDERPTPIEELLLEESHRAARSTLTRGKIKKMEGQHRSKSYVYSNSKKSSPTHRIGQKLDKHLLKEIEEVLKQNTDFFA

SEQ ID NO: 217133 - protein, 101 aa, Glycine max
  Coding DNA Sequence Number=SeqID_100355
MVEKSNEKGRMCIDYTVLNKACPKDAYLLPNIDRLVDGAMWNPQNLKEVQKLTCRLCNKLDSLTRRRSKANANLLHHLITSMSRKDILNNRKAHPNTDKLR

SEQ ID NO: 217134 - protein, 277 aa, Glycine max
  Coding DNA Sequence Number=SeqID_100356
MEDGSPIRGRSLMGREKTEDFLVGSSDEVEIFKEKGKKGKRVLEGNYGEVKRQKRDNATAYGKKVRKSREKKFTPITIPGQSWKNFKSNFFQVHPNLASRDLKKLFFKKDERTPKFPFYWQCFPFKFKSHSHQTLSAQEIKDIDIIREWSCEMSCKFIMVIPNSCFPNCVLSKVMKGYDYKNLKCLVANDQMDLRKTKKRKRVKDSSKSDLGKSSIDFVEEKVEGNNANVEVLHVGGTKETMSKTGEKTKAMAAQLKVMKVEVNKSKQLNWLRVGKQ

SEQ ID NO: 217135 - protein, 119 aa, Glycine max
  Coding DNA Sequence Number=SeqID_100357
MEKTKKLKFGEWDKYQHHREEILQHSTKEGTFTQDSPNTATFVNDNEIYLNVVGGPNYKGNIYRLGTLSKRFSCSKSGSSTFVAPVEGQIEEMRETINKLNAELLAKANKEKTLEEKML

SEQ ID NO: 217136 - protein, 103 aa, Glycine max
  Coding DNA Sequence Number=SeqID_100358
MERAVLVILVSTMASESSFSTEGRVLDLYHCFLTPQMVEALVLVCHILMQSYPPRALDRRLQEDWAKDAREGPRVLMSLRDSHSLFLDHSGMTFILLGSMGSP

SEQ ID NO: 217137 - protein, 206 aa, Glycine max
  Coding DNA Sequence Number=SeqID_100359
  Gene Ontology: Mol. function=RNA-directed DNA polymerase activity; Biological process=RNA-dependent DNA replication
MALIASTTLSLKWNIGVPEGFCLTKGLRQGIPLSPYLFLLYMEKLATMIQEIVANKKWLLVKIAKASGLKANIQKSKFLASRNISKTKKKKFISIIGFNQSQNLGRARRTTLAKLVLNAIMVYPMKNLRVPNGVCEEIGKIMRTFIWHSHHNHWVNWSIVMCPPSRVGLDVRTMREINVALLGKHVWLLQHDPHMLWVQLLSNKYL

SEQ ID NO: 217138 - protein, 204 aa, Glycine max
  Coding DNA Sequence Number=SeqID_100360
  Gene Ontology: Mol. function=chitin binding; Cellular component =extracellular region; Biological process=chitin metabolic process
  Homolog annotation: Hit_ID=UPI000044A8F0; Match level="QueryCoverage =85%, HitCoverage=99%, E-value=5e-23, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MDTSEPYTGAMKGTMHKPQANLGGGPLGTSTLIFKGLHVLAYRGLHVLEFRGLHVLAFRGLHVLAFRGLHALAFRGLHVLAFRGLHVLAFKGLHALAFRGLHVLTFRGLHVLAIRRLHALTFRGLHALALRGLHVLAFRGLQALSFRGLHALAFRGLHTLASEDYTPSSSEDYTSSPLEDYTSSPSEDYTSSPLECYTPSRPRL

SEQ ID NO: 217139 - protein, 82 aa, Glycine max
  Coding DNA Sequence Number=SeqID_100361
MPCKYVMAPRKLPAKRSRKDTAREGSNKAPQTDVDFDSHRFRSVEHQQRFEAIKGWSFHRERRVQLREDEYPDFQGEIARRH

SEQ ID NO: 217140 - protein, 190 aa, Glycine max
  Coding DNA Sequence Number=SeqID_100362
MKADMEAMKEQMTIMMEAMMSMRKMIEVNTATVVAASIATKGAEALGSTGGPHFMQVQNKHSFPPYGLPPNYTSPNVAHAPDENVNNSTPILIESQQPQSGHAQGQAFGSIPLPMMEREMIIMIVDMLPVFYYERMVGYMPPSFADLVFPGERIEVGLRRGKFDYPPLMNRKPEANGENKKEGGTHAMTV

SEQ ID NO: 217141 - protein, 70 aa, Glycine max
  Coding DNA Sequence Number=SeqID_100363
MGGSGALFGEGHCFDNEIDTAGVFLNEVQDMAIHQHGPDVWEWTADPTGTVRMMQFSFFGPGLGTLRKAS

SEQ ID NO: 217142 - protein, 288 aa, Glycine max
  Coding DNA Sequence Number=SeqID_100364
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=2e-40, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
ALTFRGLHVLTFIGLHALAFKGLHVLPFRGLCVFTFRELHVLAMRGLHILAIRGLHALTFRRLHVLTFRRLHAFAFIGLHALTFRGLHVPAIRGLHALTIRGLHVLTIRGLHALTFRGLHVLTFKGRHVLTFRGLHALAFRGLHALACRGLHVLAFIGLHALTFRGLHVLAFIGLHALTFRGLHVLTFIGLHALAFRGLHVLPFRGLRVLTFSRLHVLAIRGLHAFTFRGLHVFTFRGLHVLTFRGLHVLTFRGLDFLAFRGLHILTFRGLLVLTFRGLHVPAFRGLH

SEQ ID NO: 217143 - protein, 225 aa, Glycine max
  Coding DNA Sequence Number=SeqID_100365
MLVKNLIGCPGVHNRTDHTLGDQLGSLCVCENAPTIWDQHRLQGTFKPSVFITKAYTSKSTLGPLPLDLGISSQIPTVGMCEDAFCTWCSNLTMIQQNAKVDVSLSELNALSECHPLSEASTHLADRRNLEGNLSRRHALSALSASSTSRLSPSRLSMSLALRENSLTRVKRENGAEHDVEVRETFLKPRIVEEKEGGMREALNSRKSLMSEIHRGKEQSKEAKF

SEQ ID NO: 217144 - protein, 77 aa, Glycine max
  Coding DNA Sequence Number=SeqID_100366
DLKEISKPTLLPLQTQAMIQFQTTCLRTLLAIAASKKWSLYQLDVQNAFLHGENIALERKAQHGNRRQVKFSKKLDR

SEQ ID NO: 217145 - protein, 216 aa, Glycine max
  Coding DNA Sequence Number=SeqID_100367
  Homolog annotation: Hit_ID=Q9C770; Match level="QueryCoverage=46%, HitCoverage=29%, E-value=5e-33, Identity=70%"; Hit description =Integral membrane protein, putative; 85705-84183
MFETWRILGCVSETPYAPWIFFLLRACYPAGNDDTGDDGDEGEIGEPGLTLEGHDISEDDGEEGGGGADGLVERHRKVAEGDIVENDENAEDEAEGGDLEELEAGANGLHGDHLEPGDDNIAKKGAACYPAGNEDTEDFDDHEGAGGVEAGGWFVKEEHDRVVDDVGVNGDAATFVAGDVVVALVANDQRREKLGGERGVIGDQRREKLGGERKKI

SEQ ID NO: 217146 - protein, 244 aa, Glycine max
  Coding DNA Sequence Number=SeqID_100368
  Homolog annotation: Hit_ID=Q1SKD7; Match level="QueryCoverage=75%, HitCoverage=45%, E-value=6e-16, Identity=28%"; Hit description =Ankyrin
MAPRKLASKRSRKDKAAEGTSSAPEYDNHRFRSAEHQQRFEAIKGWSFLRKRRFEAIKGWSFLRERRVQLRDDEYTDFQEEIVRRRWASLVTPMAKFDPDIVLEFYANAWPTEEGVRDMRSWVRGQWIPFDADALSQFLGYPLVLEEGQECEYGQKRNRADGFDEEAIAQLLCIPGQDFARTAAGRRVRIMRTKMTTLTIIWMSIHVAQLIADVIYLFAETGPGGCSAGRRRTATSSGWPSWII

SEQ ID NO: 217147 - protein, 297 aa, Glycine max
  Coding DNA Sequence Number=SeqID_100369
  Gene Ontology: Mol. function=protein binding; Cellular component =integral to membrane; Biological process=defense response to fungus
  Homolog annotation: Hit_ID=Q1SWI7; Match level="QueryCoverage=98%, HitCoverage=85%, E-value=5e-57, Identity=37%"; Hit description =Leucine-rich repeat
  Pfam annotation: Domain name=LRR_1; Domain location=104-126; Score =9.3; E_value=5.2; Accession=PF00560.23; Description=Leucine Rich Repeat
  Pfam annotation: Domain name=LRR_1; Domain location=128-150; Score =11.7; E_value=1.8; Accession=PF00560.23; Description=Leucine Rich Repeat
  Pfam annotation: Domain name=LRR_1; Domain location=152-174; Score =18.3; E_value=0.027; Accession=PF00560.23; Description=Leucine Rich Repeat
  Pfam annotation: Domain name=LRR_1; Domain location=176-198; Score =18.5; E_value=0.024; Accession=PF00560.23; Description=Leucine Rich Repeat
  Pfam annotation: Domain name=LRR_1; Domain location=205-227; Score =9.6; E_value=4.6; Accession=PF00560.23; Description=Leucine Rich Repeat
  Pfam annotation: Domain name=LRR_1; Domain location=229-252; Score =10.5; E_value=3; Accession=PF00560.23; Description=Leucine Rich Repeat
  Pfam annotation: Domain name=LRR_1; Domain location=254-277; Score =8.7; E_value=6.7; Accession=PF00560.23; Description=Leucine Rich Repeat
  Pfam annotation: Domain name=LRR_1; Domain location=29-51; Score=3.6; E_value=61; Accession=PF00560.23; Description=Leucine Rich Repeat
  Pfam annotation: Domain name=LRR_1; Domain location=3-24; Score=11.7; E_value=1.8; Accession=PF00560.23; Description=Leucine Rich Repeat
  Pfam annotation: Domain name=LRR_1; Domain location=53-78; Score=3.4; E_value=67; Accession=PF00560.23; Description=Leucine Rich Repeat
  Pfam annotation: Domain name=LRR_1; Domain location=80-102; Score =14.8; E_value=0.32; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =104-126::128-150::152-174::176-198::205-227::229-252::254-277::29 -51::3-24::53-78::80-102
MWKLEYLYLSNANLSKAFHWLHTLQSLPSLTHLYFSECTLPHYNEPSLLNFSSLQTLHLYNTSYSPAISFVPKWIFKLKKLVSLQLQGNEIQGPIPGGIRNLSLLQNLDLSENSFSSSIPNCLYGLHRLKFLDLRLNNLHGTISDALGNLTSLVELHLSSNQLEGTIPTSLGNLTSLVELDLSRNQLEGTIPTFLGNLRNLREIDLKYLYLSINKFSGNPFESLGSLSKLSTLLIDGNNFQGVVNEDDLANLTSLKEFDASGNNFTLKVGPNWIPNFQLIYLDVTSWQIGPNFPSWI

SEQ ID NO: 217148 - protein, 70 aa, Glycine max
  Coding DNA Sequence Number=SeqID_100370
KSQLAAFLASSKSKESLAQNLKEVLQLLQQEVEEEPSKKEAESSETNDDQEDDPFYQNEEYCFGISLDDD

SEQ ID NO: 217149 - protein, 118 aa, Glycine max
  Coding DNA Sequence Number=SeqID_100371
MSSECLLVDPNGHNVGLCTIDSQVFCLCSVLLGCDSLCCLNVILLGCCGSLGGLMGTRGWWVYARIVDVENLLCTIARPPPKWYLEICRGGQETLGTSGGVLLSKTKLDQSRPNPGIV

SEQ ID NO: 217150 - protein, 556 aa, Glycine max
  Coding DNA Sequence Number=SeqID_100372
  Gene Ontology: Mol. function=inorganic phosphate transporter activity; Cellular component=integral to membrane; Biological process=phosphate transport
  Homolog annotation: Hit_ID=Q8GSG4; Match level="QueryCoverage=98%, HitCoverage=99%, E-value=0.0, Identity=60%"; Hit description =Phosphate transporter PT4
  Pfam annotation: Domain name=MFS_1; Domain location=27-475; Score =75.7; E_value=1.4e-19; Accession=PF07690.6; Description=Major Facilitator Superfamily
  Pfam annotation: Domain name=Sugar_tr; Domain location=22-520; Score =68.8; E_value=1.7e-17; Accession=PF00083.14; Description=Sugar (and other) transporter
  Pfam module annotation: Pfam domain module=MFS_1::Sugar_tr; Domain location=27-475::22-520
MATNQGVLSTLDNAKTQSYHFKAIVIAGMGFFTDAYDLFCITAVIKLIGRLYYYDPNSHSPGKLPKNVNNAITGVALCGTLAGQLFFGWLGDKLGRKRVYGITLVTMVGCALASGLSFGSTAKSVVASLCFFRFWLGFGIGGDYPLSAVIMSEYANQKTRGAFVAAVFAMQGVGILVAGGVAMLVSKLFLFAYPARIFAEDAVQSTQPEADFVWRIVLMFGAFPAALTYYWRMKMPETARYTALVEGDHKKAVEDMAKVLDNDIPLEESNARVAATPGPSYGFFSSKFLEKHGLHLLGTTSTWFLLDIAFYSLQLTQKDFYPASGLVPKDSRMNAIEEVFLLSKAMFTVALFATVPGYWCTVYFIDKIGRYKIQLVGFFVMSVCMWILGRKYGEYRGVDCSSDDRLEYCDGNLPMFIILFGLTLFFANFGPNSTTFIVPAELFPARFRSTCHGISAAAGKAGAIIGAFVVQSYTDNAEDKIKGMKKALMTLSVVNFLGFFCTFLVPETRGRSLEEISGEDKELPGNITQDNANETTTDKQKGTKNSNVEKLPETLM

SEQ ID NO: 217151 - protein, 438 aa, Glycine max
  Coding DNA Sequence Number=SeqID_100373
  Gene Ontology: Mol. function=endonuclease activity; Cellular component=nucleus; Biological process=cell redox homeostasis
  Homolog annotation: Hit_ID=Q9LS39; Match level="QueryCoverage=80%, HitCoverage=76%, E-value=2e-88, Identity=46%"; Hit description =Genomic DNA, chromosome 3, P1 clone: MYF24
  Pfam annotation: Domain name=Exo_endo_phos; Domain location=89-429; Score=83.5; E_value=6.4e-22; Accession=PF03372.13; Description =EndonucleaseExonucleasephosphatase family
  Subcellular localization annotation: CTP_CleavageSite=72; ConfidenceScore=5.05e-01
MVRHKRGRPSPENSPSKRRRRRSPLECRRRWVVSSKDSSNCTAAVIYPGQQHGRPRLWKSSTGKFKYLLPVKAENTSAGSPCFRLWNKVLVVSYNILGVENASNHPDLYSNIPHSFLEWDRRKRLILEEINNYNASILCFQEVDHFNDLDDLFQNSGFKGVYKARTGEAQDGCAVFWKDKLFKLLHQEDIEFQRFGMRNNVAQLCVFEANHDKKESDACNLTTMTPSTGKRRFVVGNIHVLFNPNRGDIKLGQVRLLLDKAYKLSQEWGNIPVIIAGDLNSVPQLDIQLHDRRNMSGQLEIQTNRVFRSQIGDDASISMSVSRQLYRWSVEELRLASGAEGVTRLQHQLKLCSAYSGVPGNHRTRDDIGEPLATSYHSKFMGTVDYIWHSEDLIPVRVLETLPIDTLRRSRGLPSEKWGSDHLAVVCEFAFANNANVS

SEQ ID NO: 217152 - protein, 210 aa, Glycine max
  Coding DNA Sequence Number=SeqID_100374
  Homolog annotation: Hit_ID=Q7XYW2; Match level="QueryCoverage=79%, HitCoverage=64%, E-value=1e-20, Identity=36%"; Hit description=Seed specific protein Bn15D17A
  Pfam annotation: Domain name=DUF260; Domain location=2-73; Score= -36.8; E_value=0.045; Accession=PF03195.5; Description=Protein of unknown function DUF260
MDMCVNRRLGRETRKQEGKRGCWVRDATVFKSLLYEACGRMVNPVFGSTRLLSTGNWHLCEAAVKAVLNGTPFQQAPLGGAASLQLEACDIRHVAKSDKSCDSNTLHKVKSRTTKFKRQAVKSRVESVVAELAESELGGHGSVSCDTGSGVTRMSENKFVEGEADNGSVQSVEPALDNGGEIELQLTLGWGPVKRQTALMTPRVGLDLSG

SEQ ID NO: 217153 - protein, 488 aa, Glycine max
  Coding DNA Sequence Number=SeqID_100375
  Gene Ontology: Mol. function=metal ion binding; Cellular component =intracellular; Biological process=regulation of transcription
  Homolog annotation: Hit_ID=Q8RWD0; Match level="QueryCoverage=66%, HitCoverage=75%, E-value=5e-47, Identity=37%"; Hit description=Zinc finger protein CONSTANS-LIKE 16
  Pfam annotation: Domain name=zf-B_box; Domain location=10-57; Score =38.3; E_value=2.7e-08; Accession=PF00643.14; Description=B-box zinc finger
MKEASALGARTARACESCLKVRARWYCAADDAFLCHGCDNMVHSANQLASRHERVKLQTASSKVNYSVTPKVAWHSGFTRKARTPRSNNKHSSLQQQQQKPLHEEQGEEEEVFFNNTIISVQPLVPELGSEEPLLNDETEEQLLCRVPVFDAELCSIYNEVKDEVNVAGGEVAFDLENFSSEFLPTDMDLAEFSADVESLLGNGVDEDSPVKKGSELVLLDCKEEGDDEMDACVNGIGANKDAMVKVKDEEELDADDDTACHLDSILDMNSEAFNWNIAESESPAQAQEDEVSKVGTNKKDIFLRLNYEEVITAWASQGSPWTTGTPPKFFNSDDCWLDLFSYSIIADLIYIWLKEEGCVASSVTDVKFVDIPEIIRRAEMCYAFGFEWWGCSMLLWGSEKLKSACRWGKRSKSVKVPREEKNAFICKEDKCLIYRVLISTSFTSALHIGIEEEGKQQLDAMCFWRFVGSPKFVGSEIGWFFQFRELD

SEQ ID NO: 217154 - protein, 852 aa, Glycine max
  Coding DNA Sequence Number=SeqID_100376
  Gene Ontology: Mol. function=microtubule motor activity; Cellular component=microtubule associated complex; Biological process =microtubule-based movement
  Homolog annotation: Hit_ID=Q0WN69; Match level="QueryCoverage=93%, HitCoverage=79%, E-value=1e-167, Identity=49%"; Hit description =Kinesin-related protein
  Pfam annotation: Domain name=Kinesin; Domain location=535-792; Score =187.8; E_value=2.7e-53; Accession=PF00225.13; Description=Kinesin motor domain
MNPPSNNHTIEPRDLGNSSANFNGINSLQSKVSSEAKFQHILHSPVMTEPSTTLISQVGHKFPEVFRLRQGSYGDLPSAKISELMKSTSLDNAPTQSLLSVVNGILEESVERRNGEIPHRVACLLRKVVQEIERRISTQAAHLKTQNNLFKAREEKYHSRIKILEALTFGTKEESEVGRTKKEDKKVEELKHFDKINIEKEMVNDLKPIEGTKKMENDKDVIRYTKDIEDKNMEISTLKQELETMRKTYEVQLSQLEAKAEAEKKVDDKEIIKYVKELEDKNMEVLTLKKNLETMKKTYEIQCSQLEAKTEKEKMADDKGVIKYIKELEDKNVEILAFKQELETLKKTYEVKCSQLEAKVNEKENVDDKEIIKYIKELEDKNVEISTFKQELETTKKTYEVKCSQLEAKVEDAKEELKHKSQEYEHLLEKLRNEVKENEVISESKYQKWIMKENEIRKAVNFQFSSIQKLKLSWESIKQDAMKEQKIYSEECNLLGINLKSLVDAAESYQIVLAENRKLFNEVQELKGNIRVYCRLRPFLPGQKEKQSIVEHIGETDLVVANPAKQGKEALRTFKFNKVFGPTSTQAEVYADIQAFIRSVLDGFNVCIFAYGQTGSGKTYTMSGPNGATTESLGVNYRALNDLFSISTSRKGSIEYDIGVQIIEIYNEQHDMFMTYDFLDLHTLGILSHSQPNGLAVPDATMQPVKSTSDVIKLMDIGLKNRAKGSTAMNERSSRSHSVVSIHVHGKDKKSGSSLQGGQAKTLMLVQINSDLKSFSESLSTLKFAERVSGVELGAAKSTKDGRDVRELMEQVSSLKDTILVKDKEIEKLQLLKDLKNVYPSVNSENPETTSE

SEQ ID NO: 217155 - protein, 235 aa, Glycine max
  Coding DNA Sequence Number=SeqID_100377
  Gene Ontology: Mol. function=protein dimerization activity
  Homolog annotation: Hit_ID=Q1T3H7; Match level="QueryCoverage=86%, HitCoverage=58%, E-value=2e-16, Identity=38%"; Hit description=Zinc finger, BED-type predicted; HAT dimerisation
  Subcellular localization annotation: CTP_CleavageSite=52; ConfidenceScore=5.34e-01
MSSNFSILNTEVSTSPAVTSSTVVRTPHHNGRRNRSKAWNHFNQLEPKSDKRAQSKYYDVMINYENGTSSMLGHVFRYLNNPNKEAIKRKKTIASSTNDRIISSSSYDKFDKDLCEVEMVKLFVETELPFQLVEHPVFRSGLKDIDNFVLRICVAVEYIRSSPSRLMSFKECVERKNIEYKGHICLDVETRKTFREFEFHDRKYANELGKGIGLPSYEDWEYVEAILSILLEHFL

SEQ ID NO: 217156 - protein, 144 aa, Glycine max
  Coding DNA Sequence Number=SeqID_100378
  Gene Ontology: Cellular component=integral to membrane; Biological process=protein transport
  Homolog annotation: Hit_ID=P59277; Match level="QueryCoverage=95%, HitCoverage=44%, E-value=6e-50, Identity=69%"; Hit description =Syntaxin-81
MGKARDRTEDFKDAVRHTARSLGYDEAKLASVMASFIIHKPPQRSPFSKAALKTLESIGELDQFLLKHRKDYTDLHRTTEKERDSIEHEVSTFIKTCQEQIDILKNSINQEEETSKHWLGIATTKSNADTIAHKHGVVRTYGAC

SEQ ID NO: 217157 - protein, 458 aa, Glycine max
  Coding DNA Sequence Number=SeqID_100379
  Gene Ontology: Mol. function=translation initiation factor activity; Cellular component=cytosol; Biological process=cellular metabolic process
  Homolog annotation: Hit_ID=Q9SPU4; Match level="QueryCoverage=89%, HitCoverage=99%, E-value=1e-171, Identity=75%"; Hit description =Putative translation initiation factor 2B beta subunit
  Pfam annotation: Domain name=IF-2B; Domain location=62-432; Score =265.9; E_value=8.4e-77; Accession=PF01008.8; Description=Initiation factor 2 subunit family
HELEPLDQDQRMKFRMHILSLDYEAKNDSSIFIQRLRLAKMPDVQTLVNDFLNQLKKRDASKIEGSQATAKLTAELLRSVISQQRVPHTNQATALINAVRAVGEQLIAANPVELAVGNIVRRVLHIIREEDLSLATAAMDGLGVSAASDDEDDAERDENPVLSAAAVAAAARSTLRPPSLQTLLEDTSDSAAPPHTSSSGGESDGRSRSVEKGSRGRKLKHDVIEAVNELIQDISTCYEQIAEQAVEHIHHNEVILTLGSSKTVLEFLYAAKEKQRSFKVFVAEGAPRYQGHLLAKELAARGLQTTVITDSAVFAMISRVNMVIVGAHAVMANGGVIAPVGLNMVALAAQRHAVPFVVLAGSHKLCPLYPHNPEVLLNELRSPSELLDFGEFSDCMDSASGAGSLHVVNPTFDYVPPKLVSLFITDTGGHNPSYMYRLIADYYSADDLVVKRRPTTGS

SEQ ID NO: 217158 - protein, 171 aa, Glycine max
  Coding DNA Sequence Number=SeqID_100380
  Gene Ontology: Mol. function=hydrolase activity; Cellular component =integral to membrane; Biological process=methylglyoxal catabolic process to D-lactate
  Homolog annotation: Hit_ID=Q307X6; Match level="QueryCoverage=86%, HitCoverage=57%, E-value=6e-64, Identity=77%"; Hit description =Hydroxyacylglutathione hydrolase cytoplasmic-like
RFYLAYMFPSLVSINISYFCDLLSHTQGHISYYVTGKEDEQPAVFTGDTLFIASCGKFFEGTAEQMYQSLNVTLASLPKSTRVYCGHEYSVNNLQFALTLEPDNLRIQQKLTWARNQRQAGQATIPSTIEDELETNPFMRVDLPEIQERVGCKSPVEALGEIRKQKDNWRG

SEQ ID NO: 217159 - protein, 158 aa, Glycine max
  Coding DNA Sequence Number=SeqID_100381
MHMDVSSHWHDSRAGAILEGPNDVAMAQLLRFSFKATYNQIAIELINNVFQIRDLQLPNYYHTFENLKREFEEVQVTHISRELEESPLGWKKDILDYLRHEILPANKSKARKIKMLTVSSENCIRVLAVYITEKEPWPQEFCGSATICQPSGRTARTL

SEQ ID NO: 217160 - protein, 100 aa, Glycine max
  Coding DNA Sequence Number=SeqID_100382
MSPITFTIDDFKMEIPESEILPHDDPLLSFVGEQVEGLELDPRTNYDKRVTLVEEMTTFQLGNQNGQRKRTIGEERCRAVHQEMAKLTAIDFIREIDYST

SEQ ID NO: 217161 - protein, 276 aa, Glycine max
  Coding DNA Sequence Number=SeqID_100383
MSLSHLDYQLYNTPPNHALVLLIRYVAEGYVRFGCAMSLLGPTKYFIRYLIIVSVEGSSSRESVEGKSKIQRYNDIVLELPSTTVENIGESIAAPVVAATAEAGISQRDTSRPKKCLVLKKRCPPPPITLREYTWVDEEDYFYDSTGTLCSPSTGNSILDGPADEGQGLLELGASRQYEALGRSWDTELARLQSTLADAKKETKEANAKKERVQQKAFDDDPSVFDINKDVHEGELVLIDDISEDDVATLPRGQVTPIKEPHAEEITDRENVKPMD

SEQ ID NO: 217162 - protein, 170 aa, Glycine max
  Coding DNA Sequence Number=SeqID_100384
MGDGGGIVLLDYGNNSTIHLTTGTGFGQPYPQQKAQASFHGPQKQAQTNVPHSHPVPFPADYATNPYVGGPSYAPAGPSYQPPRTTTPSPSNVNYAPNFFPSSGGMAPSYFNMPSSSSSGAGPRPRGPPGFAIGAGAGALAAGAVIFGDNIMSGFDVGDPTLTIATDPLF

SEQ ID NO: 217163 - protein, 169 aa, Glycine max
  Coding DNA Sequence Number=SeqID_100385
  Homolog annotation: Hit_ID=Q9FNF3; Match level="QueryCoverage=65%, HitCoverage=21%, E-value=9e-18, Identity=35%"; Hit description =Arabidopsis thaliana genomic DNA, chromosome 5, P1 clone:MOP9
MPPKTTQLMELFGMHHLIDLKKDNSGGDQTQTNVQDRYQESLGRRENFLLHVVVAVLSFLIFGAFPLVIYGLLINKNYYTEVKLATVAATSIVCIILLAIGKVYTSKAPKSYIKTVLYYVTLAISASGVSYIAGNLIKDFLEKLNQPESGFAITMPISDTSVGSAWMSY

SEQ ID NO: 217164 - protein, 528 aa, Glycine max
  Coding DNA Sequence Number=SeqID_100386
MEQEGHQWIVHPHDEEEGEEIMEDGALIRKQTVSHNKGNLIMEEVTFTSSSSSSSSSSNGSEHSNGICSVAPPDGSPVQKEEEVAERGDVGENCNHVNGDIVDYAAAGLAQVAEFAGAETNGEAITGVVVSQNKNSVYFDEQQGMWKCHHCTWTKRFDSPWTVPNWNLKGYPDLMTVKTMIQHGPFFVCDTKDDEVNGVQNGDAFWSVHPTNLGGRDFDVQADQSVVQNSLCSEITNQCMKTVDDKLPSVTEISHLHNSSDIQATAVTNFPEETSTKEAPNLIEEIDPQLEEFDVEAVLAKQETHDLFCPNCSSCITKRVILTKRKRNTKKSGSKPKRDKPENTHNLDNEAKCDELQTRGSSELPDSSAQPEAKQGVHANIMPEPGILSPEPSADNNQPHEEPEVFRCLACLSFFIPSGDAPLEYSGTGSAEQPNSTLTSNDEPSSTEIGHSKGPLADTSDIKNVKPTSNINHGHGGMNSLMSSTNDLSSIQSGTKGAGDLMNGVQSVVQDSIDYASVDIIRTGMLEN

SEQ ID NO: 217165 - protein, 59 aa, Glycine max
  Coding DNA Sequence Number=SeqID_100387
MVVMVVGVIVNGGGKSIRILNPYKPVLNAKEEEGLTTETMAKSVSTARALTGSTMRTEA

SEQ ID NO: 217166 - protein, 66 aa, Glycine max
  Coding DNA Sequence Number=SeqID_100388
MVVVVIGVVVNGGSKKKRGEDERLTAETMAKSVSTARAFTGGTMQTEARKVTRRRNKEEEEEEEEQ

SEQ ID NO: 217167 - protein, 106 aa, Glycine max
  Coding DNA Sequence Number=SeqID_100389
  Gene Ontology: Mol. function=protein kinase activity; Cellular component=integral to membrane; Biological process=protein amino acid phosphorylation
  Homolog annotation: Hit_ID=Q6H4R9; Match level="QueryCoverage=90%, HitCoverage=15%, E-value=1e-18, Identity=44%"; Hit description =Putative receptor kinase
MLDNGVLLAVKRIKDWGISKQDFERRMNLIAQVKHPRVLPPVAYYCSQQEKLLAYKYLQNGSLFMLLYGSQSGHSFDWGSRLNVAAKIAEALAYVHEEFLENGIAH

SEQ ID NO: 217168 - protein, 146 aa, Glycine max
  Coding DNA Sequence Number=SeqID_100390
  Gene Ontology: Biological process=multicellular organismal development
  Homolog annotation: Hit_ID=Q9M610; Match level="QueryCoverage=65%, HitCoverage=35%, E-value=9e-18, Identity=58%"; Hit description=Ttg1 -like protein
MEHSELYFLHPQKTKGNKNTLTRHPFLHKKPYIGYRGSVGVDVPNDDASGVNVGGGNALGVNVIPVKGDQRDAGLVGFVVEEEYGLNRVVMDLPGKNDNGLGVVEGKEGVAVRERVSGWKERMSTRLLYSLMKVSRVRYWGGATIF

SEQ ID NO: 217169 - protein, 765 aa, Glycine max
  Coding DNA Sequence Number=SeqID_100391
  Gene Ontology: Mol. function=protein binding; Cellular component =nucleus; Biological process=cell cycle
  Homolog annotation: Hit_ID=Q6YWY5; Match level="QueryCoverage=95%, HitCoverage=99%, E-value=0.0, Identity=78%"; Hit description =Putative cullin 3
  Pfam annotation: Domain name=Cullin; Domain location=61-664; Score =903.0; E_value=1.3e-268; Accession=PF00888.12; Description=Cullin family
MVKKMSVIGFKTKSSLVNHSKYEGSSSDSRGKMSTQKKRALQIEAFRHRIVVDPKYAEKTWKVLEHAIHEIYNHNASGLSFEELYRNAYNMVLYKFGEKLYTGLVTTMTSHLKEISQSIESAQGEIFLEELNRKWVDHNKALQMIRDILMYMDRTFIPSNHKTPVHELGLNLWRDVVIHSSKTKARLLDTLLELVLRERNGEVINRGLMRNIIKMLMDLGLPVYQQDFEKHFLDVSANFYCRESQKFIESCDCGDYLKKAERRLNEEMERVSHYLDPRSESKITNVVEKEMIESHMHTLVHMENSGLVSMLVDDKYEDLQRMYNLFRRVSDGLTIVKDVMTSFVRDTGKQLIMDPERLRDPVDFVQRLLDLKDKYDRVITMSFNNDKTFQNALNSSFEYFINLNARSPEFISLFVDDKLRRGLKGVGEEDVEIVLDKVMMLFRYLQEKDVFEKYYKQHLAKRLLSGKTISDDAERSLIVKLKTECGYQFTSKLEGMFTDMKTSHDTMQGFYANLGTELGDGPMLSVQVLTTGSWPTQPSPPCNLPVEILGVCDKFRTYYLGTHNGRRLSWQTNMGTADLKATFGKGQKHELNVSTYQMCVLMLFNSAERLTCKEIEQATAIPMSDLRRCLQSLACVKGKNVLRKEPMSKDIAEDDAFFFNDKFTSKFFKVKIGTVVAQRESEPENLETRQRVEEDRKPQIEAAIVRIMKSRRTLDHNNIVAEVTKQLQSRFLPNPVVIKKRIESLIEREFLERDKVDRKLYRYLA

SEQ ID NO: 217170 - protein, 799 aa, Glycine max
  Coding DNA Sequence Number=SeqID_100392
  Gene Ontology: Mol. function=nucleic acid binding; Cellular component= mitochondrion; Biological process=RNA catabolic process
  Homolog annotation: Hit_ID=Q9FLF1; Match level="QueryCoverage=73%, HitCoverage=76%, E-value=0.0, Identity=75%"; Hit description =Mitochondrial RNA helicase-like protein
  Pfam annotation: Domain name=DEAD; Domain location=298-422; Score= -23.9; E_value=0.00059; Accession=PF00270.19; Description=DEADDEAH box helicase
  Pfam annotation: Domain name=Helicase_C; Domain location=480-566; Score=61.8; E_value=2.2e-15; Accession=PF00271.21; Description =Helicase conserved C-terminal domain
  Pfam module annotation: Pfam domain module=DEAD::Helicase_C; Domain location=298-422::480-566
  Subcellular localization annotation: CTP_CleavageSite=88; ConfidenceScore=5.55e-01
MARGLFHLYTRKRTLSKLQALLFNNHHSQFHTFQNPVSPISTRFSNPLLRPRFSQSSRLSGERFRPTRPFSAAGDDGGTTEAPEGEFVADSGKGIDFELGKEVVNSVHGFPEHGVVANDDSNECNLEIDDSVECSTSSSGGEGGGGSDNNNELGKKNEEFMHVASRGPVELYREMCRVEWGPRLDRTEVEVLLEVCHWFAKSGWASNQALAIYIGMSFFPTAAHKFHKFLKKKCPTDVAKYLVYLGPSDEAMRFLFPIFVEFCLENFPDEIKRFRSMVESADLTKPHTWFPFARAMKRKIIYHCGPTNSGKTYNALQRFMEAKSGIYCSPLRLLAMEVFDKVNAKGIYCSLLTGQEKKRVPFSNHVACTVEMASAQELYEVAVIDEIQMMADSNRGYAWTRALLGLKADEIHLCGDPSVLDIVRKICQDTGDELCEQHYERFKPLVVEAKTLLGNFENIRSGDCVVAFSRREIFEVKLAIEKQTKHRCCVIYGALPPETRRQQASLFNDQSNEYDVLVASDAVGMGLNLNIRRVIFNSLAKYNGDKMVPIPASQVKQIAGRAGRRGCLYPDGLATTMHLDDLDYLIECLKQPFDDVKKVGLFPFYEQVELFSGQLPDLTFPQILEKFGENCRLDGSYFLCQHNHIKKIANMLGKVQGLSLKDHFNFCFAPVNVRDPKAMYHLLRYATSFGQKLPVNVAMGMPRSSARNDAELLDLETRHQVLSMYLWLSNHFDEETFPYVKKVEAMASCIADLLGQSLSMASLSKSLAGYGVVSVYLLAHLCGIRFVVVENIRGVKFYC

SEQ ID NO: 217171 - protein, 84 aa, Glycine max
  Coding DNA Sequence Number=SeqID_100393
MDSPCTVFLAFLCFFVTSLCHTCTEHVCTTGSSGHVLSVECALARDNCLPLWLLALSGLLRGRAKRDTSVHESSFGPLLQLYKI

SEQ ID NO: 217172 - protein, 79 aa, Glycine max
  Coding DNA Sequence Number=SeqID_100394
MWIIWRQRNDKVSKAKDCRDVGVLSRANSFFQDWLRAKNLFVSNEKAPNENFMESWRAPYGGRVLSVSIGWMNLWLEVM

SEQ ID NO: 217173 - protein, 240 aa, Glycine max
  Coding DNA Sequence Number=SeqID_100395
  Gene Ontology: Mol. function=nucleic acid binding; Cellular component= chromatin; Biological process=DNA integration
MKDEMNSMQSNGFWNLVELPNGAKAIGCKWVFKTKRDSLDNIERYKARLIAKGFTQKEGIDYTETFSPVSKKDSLHIILALVAHFDLELQQMDVKTVFLNGDLEKEEVPSAPQPALTPPISTPSSFQTFALEDLKLQSIHQGQQPIMSIEEFQPTVVVEATAEAEITAATAEVEFVIDIATETVVGPTTIDPLVDVVEHGENLDYIVDVSTTQTPARESIIYIGLGHLIVHFSLFIVFFL

SEQ ID NO: 217174 - protein, 200 aa, Glycine max
  Coding DNA Sequence Number=SeqID_100396
  Gene Ontology: Mol. function=DNA binding; Cellular component=oxygen evolving complex; Biological process=DNA integration
  Homolog annotation: Hit_ID=Q1SS89; Match level="QueryCoverage=72%, HitCoverage=20%, E-value=5e-52, Identity=56%"; Hit description =Integrase, catalytic region
MSEEHNWEDWPGFEASNDVWMEVGAEIEESAETENEQPFHDLAVPQSNQSPENISKPPNRYSPDHGTTMKNPKWIQALEEEMKALQENNTWPLVPLPKGKKTVGCKWVFTIKHKADGSVERYKVKLVAKGFTQTYEINYQETSSPVAKLNTIRVLISLVANLDWSLHQFDVKNIFLHGDFEEKVYMDIPPGFIPSTQRSV

SEQ ID NO: 217175 - protein, 39 aa, Glycine max
  Coding DNA Sequence Number=SeqID_100397
MGNYYRGTGSQRVQHEVKENVMKGTTCQREEVDSVRGLN

SEQ ID NO: 217176 - protein, 85 aa, Glycine max
  Coding DNA Sequence Number=SeqID_100398
  Homolog annotation: Hit_ID=Q9FIR7; Match level="QueryCoverage=77%, HitCoverage=16%, E-value=3e-19, Identity=59%"; Hit description =Arabidopsis thaliana genomic DNA, chromosome 5, P1 clone:MXC17
MGSGKWMKRSLACLRIPFEEVGWGCVWRNIQILSSHLLAQRAEPREAMYGGSGFVPDIPSLQRWLEIAWERGFDAPGADQFNHAI

SEQ ID NO: 217177 - protein, 123 aa, Glycine max
  Coding DNA Sequence Number=SeqID_100399
MSAYCSFFETKFSSPIHAPCSNALPPSTTQKKHSDSGGVKEVENEHANPNIVELSNAHDAKVDGEVNDVDEGGEEEHWGVVFGVGEVGYDAAADCGAEKTKDVIKWQHARVWRVGVGGGGNRE

SEQ ID NO: 217178 - protein, 865 aa, Glycine max
  Coding DNA Sequence Number=SeqID_100400
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=P22180; Match level="QueryCoverage=99%, HitCoverage=90%, E-value=0.0, Identity=81%"; Hit description=Plasma membrane ATPase 1
  Pfam annotation: Domain name=E1-E2_ATPase; Domain location=11-232; Score=305.5; E_value=9.4e-89; Accession=PF00122.10; Description=E1 -E2 ATPase
  Pfam annotation: Domain name=Hydrolase; Domain location=236-522; Score=72.2; E_value=1.6e-18; Accession=PF00702.16; Description =haloacid dehalogenase-like hydrolase
  Pfam module annotation: Pfam domain module=E1-E2_ATPase::Hydrolase; Domain location=11-232::236-522
GKPPDWQDFVGIITLLIINSTISFIEENNAGNAAAALMARLAPKAKFLRDGKWIEEDASILVPGDIISVKLGDIIPADARLLEGDPLKIDQSALTGESLPVTKGPGDSVYSGSTCKQGEINAVVIATGVHTFFGKAAHLVDSTNQVGHFQKVLTAIGNFCICSIAVGMIVEIIVMYPIQHREYRPGIDNLLVLLIGGIPIAMPTVLSVTMAIGSHRLAQQGAITKRMTAIEEMAGMDVLCSDKTGTLTLNKLTVDKNLIEIFAKGVDVDTVVLMAARAARLENQDAIDAAIVGMLGDPKEARAGIQEVHFLPFNPTDKRTAITYIDGESKMHRVSKGAPEQILNLARNKSEIERRVHSVIDKFAERGLRSLAVAYQEVPDGKKESQGGPWQFIGLLPLFDPPRHDSAETIRRALNLGVNVKMITGDQLAIGKETGRRLGMGTNMYPSSALLGQNKDEAIATLPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWHFDFPPFMVLIIAILNDGTIMTISKDRVKPSPYPDSWKLAEIFTTGIILGGYLAMMTVIFFWAAYKTDFFPQTFGVSSLQKKDRDDFRKLASAIYLQVSTISQALIFITRARSWSYVERPGLLLVAAFVIAQLIATLIAVYANWSFAAIEGIGWGWAGVVWLYNLIFYIPLDFIKFIIRYALSGRAWDLVIEQRIAFTRKKDFGKEERELKWAHAQRTLHGLHPPETKMFNERTSYTELNQMAEEARRRAEIARLRELHTLKGRVESVVRLKGLNIDTIQQAYTV

SEQ ID NO: 217179 - protein, 88 aa, Glycine max
  Coding DNA Sequence Number=SeqID_100401
MSKGHKLLNLELITQMTWKKFVLPFDEIESNDEWITEEGYNDEDEQPQSEAESNDDAQSEEDLDDDGDGNESDDIHGDDPIREFDMIL

SEQ ID NO: 217180 - protein, 152 aa, Glycine max
  Coding DNA Sequence Number=SeqID_100402
  Gene Ontology: Mol. function=RNA-directed DNA polymerase activity; Cellular component=extracellular region; Biological process=RNA -dependent DNA replication
SIMDNVLMAFEIIHYLRCKRSGNRGLKQGDPLSPYLFLICVEGLSALIKSAQQEGKAMELKKMLVMYELASGQAINLSKSEVFFSRNFDEARCAMISNILGVHTRTGIGEQPSALSKASYGRKSTLLVNYGGVTAHDELILVGEQMGKKRSE

SEQ ID NO: 217181 - protein, 39 aa, Glycine max
  Coding DNA Sequence Number=SeqID_100403
MEAVGSNGGNGLAVTCRLKQNEGHDGACDKLRRSPPSQE

SEQ ID NO: 217182 - protein, 97 aa, Glycine max
  Coding DNA Sequence Number=SeqID_100404
  Gene Ontology: Mol. function=pyruvate dehydrogenase (acetyl -transferring) activity; Cellular component=mitochondrion; Biological process=glycolysis
  Homolog annotation: Hit_ID=P52904; Match level="QueryCoverage=100%, HitCoverage=22%, E-value=7e-30, Identity=72%"; Hit description =Pyruvate dehydrogenase E1 component subunit beta, mitochondrial precursor
MLGVIRHKSIRPAFSAIRHFSSAAKELLSNIKLSAVVSMQITVRDALNSALDEEMSADPKVFLMGEEVGEYQGAYKISKGLLDKYGPERVLDTPITE

SEQ ID NO: 217183 - protein, 160 aa, Glycine max
  Coding DNA Sequence Number=SeqID_100405
  Gene Ontology: Mol. function=transferase activity; Biological process= paclitaxel biosynthetic process
  Homolog annotation: Hit_ID=Q1RZ42; Match level="QueryCoverage=91%, HitCoverage=39%, E-value=7e-51, Identity=59%"; Hit description =Transferase
MANPKTPIVLNMKDLVIVKPSKPAPPELLALSTIDKALSKAFVYYYPLAGKIVTFDDGKLGINCNVDGIPFLEATANYELSSLHYLEGIDVPTSQKLVFDDDNPNNSHDHPLVFKVTKFLCGGFTLGMGLSHSVCDGFGAYKFFRALAKLASTVEKVSHQ

SEQ ID NO: 217184 - protein, 107 aa, Glycine max
  Coding DNA Sequence Number=SeqID_100406
MMMKKHDEGKHSENEEGIGNDPSLTSIIDSAKIEYISEGVIYHIIHVSNPKVLGMNKCIGNNPNLTLVRDSAKIKYISGRQPSSYELPFGVELDTNSHSKKGVDLSE

SEQ ID NO: 217185 - protein, 87 aa, Glycine max
  Coding DNA Sequence Number=SeqID_100407
MVTTTPQPRINLEFLFDSNGNNNHGFRFRFSQLQVHAGADNEGGVEMQYPLQGRGLPEERELRGRTASNTNLTMLNNFNGRNLSGIK

SEQ ID NO: 217186 - protein, 1171 aa, Glycine max
  Coding DNA Sequence Number=SeqID_100408
  Homolog annotation: Hit_ID=Q10LU7; Match level="QueryCoverage=16%, HitCoverage=27%, E-value=5e-15, Identity=32%"; Hit description =Expressed protein
MSGESAPKPKPRLVLCPKCWQLLPESPDYDVYKCGGCGTTLQAKKRRNGAVNSESNTHETDAAPRNALNKESSTRETDASAGNALNSESRMRETGAAPTNALDPKTDDKKYSNGELLVSDQGNGVRKKSTSSSSEECSLDGQDKRDQIENGECNGEQLAASQDKGFKERATSSSSGECSLNGSGGSDQIEDGECNGEQLVTSQENGFEEKSTSSSSREGSLNGNYGREQIEDGECNGEQPLISYENGLKAKTASSSPEECSLNGNGGRDQIEDGEFTGELACFSQENGLREKATTSSSGECSLSGNGGRDQIENGECIGEQLATSLRAKETSSSSREYSLDGNGGRDQIENGECNGEQIGQLNLPEEELENEIDSLKLSDMRRHTVSYNRCSDEVTHFEIEASAELMADSSVENAKNTNLQLEGEELSNGNVPLEEAVEHLICAFDKEDGNDEKLAPVQEKSEVDIAGNDIDVVEELNNGNSLLERAEKDLFSGLDREEVNNDNSALVGANPKVDINGSNEAGSEKFNNRNLLLEVTEEELNECALDGEDRKHDQSGLVGAKSEMDNTRNASIAQRLSTEEGRISHAYPRELEKGTSGYHASFKAIHHRFDRVRSVDTFVNAEVINPGFETSGTLGGLSKSSTIQSYHAYDGSISSNDGVDEQFPNQYVDSLENTYTVANGVSEGGSRKGKGLVNSMLCGDLETQHQSYFRERRPRVPRDSRRNLNEVPETTRHGRAHWMRTKKDEFPARVPNHRSGSLSGYESGSTSNQMHDELYCSSSYRSPDSFDDPDQEKMKLLRMVYKLQEQLNRTCYLNGETNGRLSMGSHVSAYQSHDLHERRLYHGLDYPRCDEICSHGTDWCQKHNFPHVPCLTEPTSSIHHVDHSFFPCCPQQCQCSTELPPCDLYQHEELCRPSPGHNCCSPHHSYPSGPQWLKNLPAHGHETKSCDQKLRPEVKKYFWEKPSLTRQHYRPVAGGAPFVTCHKCLKLLQLPSDFLLFKRVYHQLKCGACQEVLKFSLQNRSHIVSYAPNGLKPPSSSSLDDQNEVIDGSNPHSESHADHISYSDDYGHSVGKSYSSEGDPVSAAPLHPLHGSAYDKQTVSSGTLEPITEKDKTASRSLSTSKAPVETDEQAVNSSNNVPSELEAHSQPKSSPLHQLMGYTSPSQVIRGIP

SEQ ID NO: 217187 - protein, 132 aa, Glycine max
  Coding DNA Sequence Number=SeqID_100409
MSYLVPSKPSSPFLAFACVEKVDGDADFAAGVGGEAGHGKPDDGRGSVDVALAADVGLGYFPSCTPMIETADVRLGYFPSVIDGESWTFDNHTLVLRDAYHVRHFRDFELELEFKRQQSECIKKFSNYCSRI

SEQ ID NO: 217188 - protein, 101 aa, Glycine max
  Coding DNA Sequence Number=SeqID_100410
  Gene Ontology: Mol. function=voltage-gated ion-selective channel activity; Cellular component=mitochondrial outer membrane; Biological process=anion transport
  Homolog annotation: Hit_ID=Q4PKP6; Match level="QueryCoverage=74%, HitCoverage=27%, E-value=4e-34, Identity=89%"; Hit description =Mitochrondrial voltage-dependent anion-selective channel
MSKGPGLYSDIGKKARDLLFKDYHSDQKFTITTYSPTGVAITSSGTKKGDLFVADVNTQLKNKNITTDIKLDTNSNSVRALLKGQCGRCEVELLFNLLTSD

SEQ ID NO: 217189 - protein, 107 aa, Glycine max
  Coding DNA Sequence Number=SeqID_100411
MGPVLPDSQRPFLGGCAQKGTGHPEVEHCPHVLSHGGYDYLEQKLLAEKMKKKLEEAAQSRSVDGVIDPPSSVRRHVKWKMARTKKTGEMTIEAAKEIAEKIDSFEE

SEQ ID NO: 217190 - protein, 99 aa, Glycine max
  Coding DNA Sequence Number=SeqID_100412
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=92%, HitCoverage=32%, E-value=8e-26, Identity=49%"; Hit description =Photosystem II 44 kDa reaction center protein precursor
QRLGANVGSAQGPTGLEPLRGPNGLDLSRLKKDIQAWQERRSAEYMTHAPLGSLNSVGGGIYGTREELAQLPQDLQHGIDRDFEPVLSMTPLNCDHEIL

SEQ ID NO: 217191 - protein, 163 aa, Glycine max
  Coding DNA Sequence Number=SeqID_100413
MLTQGFHKFYGSITESMEAPKTIFQKRGGACHPVASSLSNPTSKMFRKGLDLNCYLHPYLDKFTPPFLYFWLFSFRNLTKLYGFRNDIHFLSGLLRNFTDYATMLLLTSGILRNFTDCATMFLFYFQNVAELYGLPNDGVKYLEVVKRRLHAIKQWSPDEIRV

SEQ ID NO: 217192 - protein, 68 aa, Glycine max
  Coding DNA Sequence Number=SeqID_100414
  Subcellular localization annotation: CTP_CleavageSite=31; ConfidenceScore=5.10e-01
MCNNNHGSGSDDCSINHGSNNDNSQDGKVMVVMVVVAGVTMIKATTTTMTIMVMDVIVAAMIIVVVMS

SEQ ID NO: 217193 - protein, 183 aa, Glycine max
  Coding DNA Sequence Number=SeqID_100415
MVEPSKKRKGSSSRSQQYSEAQDIPIPSSISSSSLFSSEEQRIRYTNLFSSHSIIDPRFIDMDFFSDESFECIQAFQNSNPIPFMSLKLHVYFELVKVFYSNLEIQESTLISEVYGIKMVIDQSLFYDLTQLSSDGVPFEGTLDDDWKFDFSVHDAHRFSNLAQVSEKDLIVMWAFHTGRQID

SEQ ID NO: 217194 - protein, 65 aa, Glycine max
  Coding DNA Sequence Number=SeqID_100416
MRLLEKETRWRLNSEWVLFLGEIPLLFLPRERMDILILGQGLWLFEVLAQKVCRMAGHDVCQGVS

SEQ ID NO: 217195 - protein, 141 aa, Glycine max
  Coding DNA Sequence Number=SeqID_100417
  Gene Ontology: Mol. function=trans-cinnamate 4-monooxygenase activity; Cellular component=membrane; Biological process=electron transport
  Homolog annotation: Hit_ID=Q42797; Match level="QueryCoverage=87%, HitCoverage=24%, E-value=1e-52, Identity=80%"; Hit description=Trans- cinnamate 4-monooxygenase
MLPCESIRNHSKKSFNRDPAEGGYEIPTESKILVNAWWLANNPAHWKKPEKFRPERFLEEELHVEANGNDFRYLPFGVGRRSCPGIILALPILAITLGRLVQNFELLPPPGQSQIDTSEKGGQFSLHILKHSTIVAKPRSF

SEQ ID NO: 217196 - protein, 148 aa, Glycine max
  Coding DNA Sequence Number=SeqID_100418
  Homolog annotation: Hit_ID=Q9FLD2; Match level="QueryCoverage=45%, HitCoverage=54%, E-value=9e-12, Identity=55%"; Hit description =Arabidopsis thaliana genomic DNA, chromosome 5, TAC clone:K18I23
  Subcellular localization annotation: CTP_CleavageSite=65; ConfidenceScore=5.73e-01
MKGSLYVADFHMLSTSLSMSKSNNPSSPCQTRVSPSSVRGLSFKRQKKKNNNGFVVVGCAKWDLEADMKPQEDEEKGRSGMATFRHKCGERKGVVELLECLEREAIMGEDVGKEPSDYNRRAQIFDRSSQVFQALKQLNNDVFPESSQ

SEQ ID NO: 217197 - protein, 709 aa, Glycine max
  Coding DNA Sequence Number=SeqID_100419
  Gene Ontology: Mol. function=nucleic acid binding; Cellular component= nucleosome; Biological process=nucleosome assembly
  Homolog annotation: Hit_ID=Q7XJP0; Match level="QueryCoverage=94%, HitCoverage=40%, E-value=1e-174, Identity=51%"; Hit description =SNF2/SWI2 family global transcription factor
  Pfam annotation: Domain name=Helicase_C; Domain location=526-613; Score=12.3; E_value=0.0011; Accession=PF00271.21; Description =Helicase conserved C-terminal domain
  Pfam annotation: Domain name=zf-C3HC4; Domain location=416-463; Score= 22.5; E_value=0.00074; Accession=PF00097.15; Description=Zinc finger, C3HC4 type (RING finger)
  Pfam module annotation: Pfam domain module=Helicase_C::zf-C3HC4; Domain location=526-613::416-463
MAPTLSISGFPLLCSFASPSDIVMLVCNAYHDSRTDQNTFWWLEALHHAEQNKDFSTELIRKIEEAISGTSNNSKSSRVASRISIKKVAEQCNPVRTDINNIPYLVMSNVLVYSFRSISSLKYQIQTGLDQLEASRKTLLDQLLEIDQTMEKPNEENIECVGKCRNCQPNCDGPCALCELDILFQDYEARLFVLKNERGRIISSAEEAVDFQKKNLALNHFLSKLSQSSHSSTVSDISHEESKKRNVGQRVVVSKSASELELILGVLNYCKSRLGRDSVSAATKHLHVFEGMRKQFGHTRSLALAQAQYLRAHDEIKMAVSRLHPRENEDDKSLDDLGENELAAASSNFSHDKFMSLTMLSQIKGKLRYLKGLVQSKQKLQFESPNSSLFTRETTAMSNSTEEKGALLSKTDDETCPICQEKLGKQKMVFQCGHVTCCKCLFAMTEKRLQNNKLHNWVMCPTCRQHTDFGNIVLMHGTNLPILQCCIELTIEAVTRRILWVKANDHRAKVLVFSSWNDVLDVLEHAFAANNITFFRMKGGRKAHVAISQFRGKQNGTKGCEGSTPKSIQVLLLLIQHGANGLNLLEAQHAVLVEPLLNPAAEALAISRVHRIGQKNKTLIHRFIVKDTVEESIYKLNRSRSNHSFISGNTKNQDQPVLTLKDVEALLSRAPLTMPESDENHNTNTNLRHLPPSVATAIAAERRLNEQRT

SEQ ID NO: 217198 - protein, 334 aa, Glycine max
  Coding DNA Sequence Number=SeqID_100420
  Homolog annotation: Hit_ID=Q1S5Y9; Match level="QueryCoverage=40%, HitCoverage=24%, E-value=2e-61, Identity=81%"; Hit description =Tetratricopeptide-like helical
MQEEGLKPNQVTFIGVLNACGSSGHIEEGCRLFRIMTGVFGIEPLPDHYICIVDLLGKAGQLERAYDLIKQNATSSIATTWGSLLAACRLYGNVELGEIAAKHLFEIDPEDSGNYVLLANTYASNDKWERAQEVKKMKLWDRGCNIVSVCNLCEQNFETSDHLFFWCPFSVKIWNWKQQLLNKSFDCSSIQGILSSAVLGWSPQMKDTVLAAVIFSVWMIWHCRNRKRFHSRAITYQSAMALIVAKDKVTGNMTSAYMSNSISEFSINRALGVVGYPRKSVHIIQVYHLEGGILKYLEIPDSRDREPLGRRVLCFRQKSLWGAWFGARKFQVSG

SEQ ID NO: 217199 - protein, 473 aa, Glycine max
  Coding DNA Sequence Number=SeqID_100421
  Gene Ontology: Mol. function=chitin binding; Cellular component =extracellular region; Biological process=chitin metabolic process
  Homolog annotation: Hit_ID=UPI000044A8F0; Match level="QueryCoverage =65%, HitCoverage=99%, E-value=1e-41, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=52; ConfidenceScore=5.18e-01
MDTSEPYTGAMKGAMHKPQANLGENQKFSPNRFPATRVEPWVVVPITFRGLRALVFRGLHTLAFRGLHSLVFRGLHSIAYRGLHVLAFRGQHILAFIGLHDLAFRGLHALAYKGMHAFAYKGLHTLAFRGLQSFAYRGQHTLAFRVLHVLASRGLHILVFRGLRILVFRGLHALAFRGLHALVFRGLHVLAFRRLHTFAFRGLHALAFRGLRVLVFRGLHSLAFRGLHALTFRGLHALAFRGLHALAFRGLHPLTFRGLHVLAFRWLHALAFRGLHALTFRGLHALAFRGLHALAFRGLDAFTIRGLHALAFRGLHLLAFKGLNALTFRGLHVLDFRGLHTLAFRGLHTLAFRGIHIRAFRELKVSGFDDEETIAQLLCILGQDFAQPRQGDEDRAHQTPSGLGEVQQGPGVLALITGLFNSTECPSPPTRRTATTSRVHLNSFTKAGVLPTTHGRPVGDQVQSNGDVSSIGA

SEQ ID NO: 217200 - protein, 222 aa, Glycine max
  Coding DNA Sequence Number=SeqID_100422
  Gene Ontology: Mol. function=RNA-directed DNA polymerase activity; Biological process=RNA-dependent DNA replication
MYCQMMGAHSRDERLLMCFFQESLAGVAVTWYTHLEPSQIHSWKDLRVAFIKQYRYNLGAAPDRTQLRDMCKKEHKSFKGYAQRWKDMAAHVAPLIMEKELIAMIINTLPMSYHAEMASYMPSSFTDLVFAGERIEVALGIGKFDHLALTRRRGRNPCSNRFLHGQISHLLNHAITQPISALLITHLPISHKVCLLHNQCRTPPLAQTKTPIEEGILQKRNL

SEQ ID NO: 217201 - protein, 79 aa, Glycine max
  Coding DNA Sequence Number=SeqID_100423
MAACSGHWWLWVVWKKLGTLEMVLGKRKRKERLFFQGYTKNKACNTQVFLLSRKEASRTHQYSYQQCSGHGQLSYDPPN

SEQ ID NO: 217202 - protein, 144 aa, Glycine max
  Coding DNA Sequence Number=SeqID_100424
  Homolog annotation: Hit_ID=Q8LBX4; Match level="QueryCoverage=23%, HitCoverage=11%, E-value=3e-09, Identity=82%"; Hit description =Putative serine/threonine protein kinase
MDTLMTRQYVASLARALIYCYGKHVIHRDIKPKNLLIGTKSKKWRNNEENKKSTTKSNSDASLNVKFALSGFGDTGAKRTAGAKWAKQTQALSMRSPLSARSTHSKRAYKGPKPTSTAINREPDQGGKHTPTTPKTQSFLMNTS

SEQ ID NO: 217203 - protein, 128 aa, Glycine max
  Coding DNA Sequence Number=SeqID_100425
MNNIVCFASEISVSTQKKRVIIEELLKGQEAATQLKVLLLEKPFWSEAFLSFQEVMDNVLRSFSEALSILNSSSSSEPAGSAAEVAHRSLLNSGQNGSPVAASGEKRFQKDGRGRYNRSFSRQSDLGC

SEQ ID NO: 217204 - protein, 87 aa, Glycine max
  Coding DNA Sequence Number=SeqID_100426
LSLEYLPCDLMIKFPQFQSSHPQWTIWAQCASDAKRRFSALRVTKESGRAQESRPCAKREISSLSAMVVLSQAQRMTGAKLKFTNSH

SEQ ID NO: 217205 - protein, 85 aa, Glycine max
  Coding DNA Sequence Number=SeqID_100427
MADSFGGSGKAFSEGNCEGQIKVATDDLSSANKIGEAGFGPVYCRQRIKLKVLMMPKDYMNHMLLKDLLKTKQLELIKMDDQDSL

SEQ ID NO: 217206 - protein, 258 aa, Glycine max
  Coding DNA Sequence Number=SeqID_100428
  Gene Ontology: Mol. function=transporter activity; Cellular component= integral to membrane; Biological process=transport
  Homolog annotation: Hit_ID=Q93MT4; Match level="QueryCoverage=92%, HitCoverage=28%, E-value=1e-68, Identity=53%"; Hit description=MrfC
  Pfam annotation: Domain name=Usher; Domain location=2-247; Score= -476.3; E_value=0.00052; Accession=PF00577.10; Description=Fimbrial Usher protein
  Subcellular localization annotation: CTP_CleavageSite=66; ConfidenceScore=5.55e-01
MPIGGDSSLSYSQQTSGKQTTHSASFYDRLDSNNSYSLSAGLNSDRRQSFSGFYSHQGSLTSMTASASAQQGQYRSASLSLQGGLTLTPQGAALHRLGMPGSTRLMVDTDGVSGVPVNGGGSNTYTNFFGKAVISDVNSYYRNTASIDVTGLADNVEASRPVTQITLTEGAIGYRRFGVIKGIKAMAAIRLEDGSWPPFGASVQSNGREVGILDDDGLVWLSGIEAGASMDVRWNGETQCQLALPDPLPQQLLDEGQN

SEQ ID NO: 217207 - protein, 97 aa, Glycine max
  Coding DNA Sequence Number=SeqID_100429
  Gene Ontology: Mol. function=catalytic activity; Biological process =carbohydrate metabolic process
  Homolog annotation: Hit_ID=UPI00006B677C; Match level="QueryCoverage =92%, HitCoverage=19%, E-value=1e-27, Identity=57%"; Hit description =alpha-amylase, putative
MDLPKDWKHSANIYEVNVRQYTQEGTFRAFEKEMPRLKFMGIKVLWFMPVTPIAQQNKKGSLGSPYAAADYTSVNPEFGTLDDFKHMVNEAHRLGFK

SEQ ID NO: 217208 - protein, 198 aa, Glycine max
  Coding DNA Sequence Number=SeqID_100430
MVYKIRVILDAKEDIFRDIEVKGKQTLWNLHLGIKSAFSLQGDELSTFNLLEEDGTIVKSVPLEDMSDDGDGEIMSDVYIDEAFASVGNKAQFQYGLLDLWEFFCELIEVIEETKGVNYPITVYRFGNVPLKAPSKSGNGGGSKKKSAMPLIDDEFNFDDDFESGGNFSDEDDSFDDEEEEDYNDDVFDEDDDNDDER

SEQ ID NO: 217209 - protein, 135 aa, Glycine max
  Coding DNA Sequence Number=SeqID_100431
  Gene Ontology: Mol. function=oxidoreductase activity
  Homolog annotation: Hit_ID=UPI00005F9079; Match level="QueryCoverage =84%, HitCoverage=32%, E-value=7e-38, Identity=63%"; Hit description =COG3491: Isopenicillin N synthase and related dioxygenases
MADTLPVLDLALLELPDAEQAAYLAQLRETARDVGFFYLVNHGINPQLLHNVQSITRAFFALPQAEKQRVAMIHSPHFRGYNHAGVEYTRDQRDQREQFDIGAERAALTLQPGDPAWKRLQGPNLWPEALPQLRP

SEQ ID NO: 217210 - protein, 76 aa, Glycine max
  Coding DNA Sequence Number=SeqID_100432
MVARGGHQWSWVVEKKVLVFGWAFGEKESEKIMFFMLKNQATYDVIQSYAHAMPSLDPIIECLLVKARFSDVAKLR

SEQ ID NO: 217211 - protein, 405 aa, Glycine max
  Coding DNA Sequence Number=SeqID_100433
MNEEDAKRACALSVISAKHALCAKPEVHSTEVELSVPYCAKLKKILPERNVVIYYTEFDDFKEEIERRKWDEELTSFIEGSIDVAIVREFYANLYDPKDKSPKFALLRPDPQELAAKLCIPRRGFELNVDGLPLKILRKNLTTVAHTWSVLSFSNLMPTFHTSDITLDMAKLGFPTLITTLCKAKGVTSDSRTLESLSPAINIAYMKKNCWNLDDPTVTFRGPRKAKGKRFEAPPSSEVPPTTSVPSSVPASSAPALPAPLPAQLPASIGPLSFTSETLHAMMQSLHRGQVIMMQSLGIPSIMSMEEFHTQVAWPGVQPSLFGGGGAFAAQEPGPIEEHTPVAEDEHTPPEPFSFASNLIVAQEEVPSPKLMLEPSSTPIFEDIQPSASALEAEQHISQDLSAAP

SEQ ID NO: 217212 - protein, 68 aa, Glycine max
  Coding DNA Sequence Number=SeqID_100434
  Gene Ontology: Mol. function=sequence-specific DNA binding; Cellular component=nucleus; Biological process=regulation of transcription
  Homolog annotation: Hit_ID=Q9M6E0; Match level="QueryCoverage=91%, HitCoverage=28%, E-value=2e-13, Identity=57%"; Hit description=DNA -binding protein 4
  Pfam annotation: Domain name=WRKY; Domain location=3-44; Score=19.3; E_value=3.1e-06; Accession=PF03106.6; Description=WRKY DNA -binding domain
MNKSYFRCGYKYDQGCKANKQVQRDQENPNMYRITYIGIHTCNATPKATHSATDSNTWESFLLNSDGE

SEQ ID NO: 217213 - protein, 122 aa, Glycine max
  Coding DNA Sequence Number=SeqID_100435
MNNSLCPESEISISAKKNRMIMKELVKGQESATQLKVLLEKPFGSEGSLSCQELTANVLRSFTQAISIINSSSADEVAHRSLLNSGQNGSPVAVSGENRSQKGGRGRYNRSFRDLGYYKRLC

SEQ ID NO: 217214 - protein, 198 aa, Glycine max
  Coding DNA Sequence Number=SeqID_100436
  Gene Ontology: Mol. function=sequence-specific DNA binding; Cellular component=nucleus; Biological process=regulation of transcription, DNA-dependent
  Homolog annotation: Hit_ID=Q4VPF0; Match level="QueryCoverage=70%, HitCoverage=62%, E-value=2e-49, Identity=67%"; Hit description =Homeobox knotted-1-like protein KNOX3
  Pfam annotation: Domain name=ELK; Domain location=95-116; Score=29.8; E_value=9.3e-06; Accession=PF03789.4; Description=ELK domain
  Pfam annotation: Domain name=Homeobox; Domain location=118-177; Score= 5.7; E_value=0.0012; Accession=PF00046.19; Description=Homeobox domain
  Pfam module annotation: Pfam domain module=ELK::Homeobox; Domain location=95-116::118-177
MMLYGLLWSDLVWLYSVLSCDGQILVGLSGCQKQFVGGCSWASSPVLNHYSIAFEIICSEEIMSDKNDGGVSSDEDLSTGDGDAQDGQLKGEDRELKDRLLRKFGSHIGTLKLEFSKKKKKGKLPKEARQALLQWWNVHYKWPYPTEADKIELAKSTGLDQKQINNWFINQRKRHWKPSENMQFSMMENFNGRILADE

SEQ ID NO: 217215 - protein, 223 aa, Glycine max
  Coding DNA Sequence Number=SeqID_100437
  Gene Ontology: Mol. function=methyltransferase activity; Cellular component=mitochondrion; Biological process=menaquinone biosynthetic process
  Homolog annotation: Hit_ID=Q8YLP4; Match level="QueryCoverage=80%, HitCoverage=71%, E-value=2e-42, Identity=51%"; Hit description =Menaquinone biosynthesis methyltransferase ubiE
  Pfam annotation: Domain name=Methyltransf_11; Domain location=69-186; Score=66.8; E_value=6.9e-17; Accession=PF08241.2; Description =Methyltransferase domain
  Pfam annotation: Domain name=Methyltransf_12; Domain location=69-184; Score=15.3; E_value=0.02; Accession=PF08242.2; Description =Methyltransferase domain
  Pfam annotation: Domain name=Ubie_methyltran; Domain location=20-223; Score=63.4; E_value=3.7e-16; Accession=PF01209.9; Description =ubiECOQ5 methyltransferase family
  Pfam module annotation: Pfam domain module=Methyltransf _11::Methyltransf_12::Ubie_methyltran; Domain location=69-186::69 -184::20-223
  Subcellular localization annotation: CTP_CleavageSite=19; ConfidenceScore=5.04e-01
MAMTFVPSTSSSFRPTLIRCANSNERRALFSRIAPVYDNLNDLLSLGQHRIWKRMAVSWTGAKMGDRVLDVCCGSGDLSFLLSDQVGSHGKVIGLDFSKDQLLFASSRQESLSKNCFTNIDTIGDMGRFNGLLQDRWVEGDALDLPFSDGWFDAITMGYGLRNVVDKQKAMQEIFRVLKTGSTVSILDFNKSNELLTSAFTQCSILNKCSHSSDLLSKSEGLA

SEQ ID NO: 217216 - protein, 298 aa, Glycine max
  Coding DNA Sequence Number=SeqID_100438
  Gene Ontology: Mol. function=sequence-specific DNA binding; Cellular component=nucleus; Biological process=regulation of transcription
  Homolog annotation: Hit_ID=Q9M6E1; Match level="QueryCoverage=98%, HitCoverage=93%, E-value=5e-29, Identity=30%"; Hit description=DNA -binding protein 3
  Pfam annotation: Domain name=WRKY; Domain location=103-161; Score =79.8; E_value=8.4e-21; Accession=PF03106.6; Description=WRKY DNA -binding domain
MKELVKGQESATQLKVLLEKPFGSEGSLSCQELTANVLRSFTQAISIINSSSADEVAHRSLLNSGQNGSPVAVSGENRSQKGRRGRYNRRKNALTWTILSCTTDDNHAWRKYGQKRILNSEFPRCSHKYDQGCRAIKQVQVDQENPNMLQTTYIGIHTCNGTPMATHSAIGSSSTEWESSYLLNFDHHDSKVPNVQDHHISSPNLTIKQEFPKEDTHSDVADHKYSDPNLWSDLKDFQPFKPTIMPFRMESDNNNNNNTNADNVHSSCTDYQRLNMNFEMASVHFDTDFHFDESHFDE

SEQ ID NO: 217217 - protein, 648 aa, Glycine max
  Coding DNA Sequence Number=SeqID_100439
  Gene Ontology: Mol. function=protein serine/threonine kinase activity; Cellular component=membrane; Biological process=protein amino acid phosphorylation
  Homolog annotation: Hit_ID=Q9FNE1; Match level="QueryCoverage=93%, HitCoverage=91%, E-value=1e-134, Identity=44%"; Hit description =Receptor-like serine/threonine kinase
  Pfam annotation: Domain name=DUF26; Domain location=191-244; Score =55.8; E_value=1.4e-13; Accession=PF01657.8; Description=Domain of unknown function DUF26
  Pfam annotation: Domain name=DUF26; Domain location=78-135; Score =47.5; E_value=4.4e-11; Accession=PF01657.8; Description=Domain of unknown function DUF26
  Pfam annotation: Domain name=Pkinase; Domain location=324-591; Score =153.4; E_value=5.9e-43; Accession=PF00069.15; Description=Protein kinase domain
  Pfam annotation: Domain name=Pkinase_Tyr; Domain location=324-591; Score=129.7; E_value=8e-36; Accession=PF07714.7; Description=Protein tyrosine kinase
  Pfam module annotation: Pfam domain module=DUF26::DUF26::Pkinase::Pkin ase_Tyr; Domain location=191-244::78-135::324-591::324-591
MSFASFFLIFLCYHALPALADPRATEVAVLCTNTTAPMPQRQAFLTNFYDALEALTALVTRQKYAFVVKGTTQNNATVYAFGECRKDLTKPDCDVCFAQCKTRVLRCSPFQRGIDGGMFFFDGCFLRYDGYNFFNESLSPQDFTVCGTEDFSGNWSVYKANTVELVRNLSIEAPKNEGFFVGYVSQRNVTVYGLAQCWKFMNGSACQNCLVEAVTRIDSCASKAEGKALNAGCYLRYSTHNFYNSSNNNVPHENQGHKNLAIIVAVASASLALLLIVATVVFFVRTNLLKRRRERRQFGALLNTVNKSKLNMPYEILEKATDYFSHSNKLGEGGSGSVYKGVLPDGNTMAIKRLSFNTSQWADHFFNEVNLISGIHHKNLVKLLGCSITGPESLLVYEFVPNHSLYDHLSGRKNSQQLTWEVRHKIILGTAEGLAYLHEESQRIIHRDIKLANILVDDNFTPKIADFGLARLFPEDKSHLSTAICGTLGYMAPEYVVLGKLTEKADVYSFGVLIMEIISGKKSKSFVENSYSILQTVWSLYGSNRLCDIVDPILDGNYPEMEACKLLKIGLLCAQASAELRPPMSVVVEMINNNHGITQPTQPPFLSCSSAEFSKFILQGESFHPISYTQPSEDSVTEILIQHKRVTI

SEQ ID NO: 217218 - protein, 652 aa, Glycine max
  Coding DNA Sequence Number=SeqID_100440
  Gene Ontology: Mol. function=protein serine/threonine kinase activity; Cellular component=integral to membrane; Biological process=protein amino acid phosphorylation
  Homolog annotation: Hit_ID=Q9FNE1; Match level="QueryCoverage=87%, HitCoverage=85%, E-value=1e-126, Identity=42%"; Hit description =Receptor-like serine/threonine kinase
  Pfam annotation: Domain name=DUF26; Domain location=193-246; Score =49.0; E_value=1.5e-11; Accession=PF01657.8; Description=Domain of unknown function DUF26
  Pfam annotation: Domain name=DUF26; Domain location=83-136; Score =52.6; E_value=1.3e-12; Accession=PF01657.8; Description=Domain of unknown function DUF26
  Pfam annotation: Domain name=Pkinase; Domain location=324-601; Score =151.3; E_value=2.6e-42; Accession=PF00069.15; Description=Protein kinase domain
  Pfam annotation: Domain name=Pkinase_Tyr; Domain location=324-601; Score=114.3; E_value=3.5e-31; Accession=PF07714.7; Description =Protein tyrosine kinase
  Pfam module annotation: Pfam domain module=DUF26::DUF26::Pkinase::Pkin ase_Tyr; Domain location=193-246::83-136::324-601::324-601
MMKQVSLVSYQCKFFLLIKLLLLSKTVIAEPRAKTVLTTCGHELEHNTTIFVPNFVATMEKISDEMRKTGFGTAIVGTGPDTNYGLAQCYGDLSLLDCVLCYAEARTVLPQCFPYNSGRIFLDGCFMRAENYSFFNEYLGPGDRAVCGNTTRKNSSFQAAARQAVLRAVQDAPNNKGYAKGNVAVAGTTNQSAYVLADCWRTLDKRSCKACLENASSSILGCLPWSEGRALNTGCFMRYSDTDFLNKEQENGSSSGNVVVIVIAVVSSVIVSVVGVTIGVYIWKQRNIQKKRRGSNDAEKLAKTLQNNNLNFKYSTLDKATESFHENNKLGQGGFGTVYKGVLADGREIAVKRLFFNNRHRAADFYNEVNIISSVEHKNLVRLLGCSCSGPESLLVYEFLPNRSLDRYIFDKNKGKELNWEKRYEIIIGTAEGLVYLHENSKTRIIHRDIKASNILLDAKLRAKIADFGLARSFQEDKSHISTAIAGTLGYMAPEYLAHGQLTEKADVYSFGVLLLEIVTARQNNRSKASEYSDSLVTVAWKHFQAGTAEQLFDPNLDLQEDHNSNVNVKDEILRVVHIGLLCTQEVSSLRPSMSKALQMLTKKEEDLVAPSNPPFLDESTMELHDTSGDPFYPLTAPDSIATMSHSSFYPR

SEQ ID NO: 217219 - protein, 105 aa, Glycine max
  Coding DNA Sequence Number=SeqID_100441
  Gene Ontology: Biological process=protein transport
DKAAEVVKHLSESHWNSSCIVTMKKFQDMCGGPDEASVMLRYLSGCRTAQYLSVNKKDFLEGVKVSLSAGALSSITNLDYDVLHLIWTTEKLQLQLDVTDRRYEL

SEQ ID NO: 217220 - protein, 211 aa, Glycine max
  Coding DNA Sequence Number=SeqID_100442
  Gene Ontology: Biological process=protein transport
  Pfam annotation: Domain name=Snf7; Domain location=5-177; Score=7.3; E_value=7.9e-05; Accession=PF03357.11; Description=Snf7
MLHQCWDFSQKCLVASQIDFIRLRKSALASLQSGNKKLALNYARELKLVTQSREKCSSLLNRVEEVLSVIADAESTKKVTEAMQIGARAIKENKISVEDVDLCLRDIQESIDSHKEVENALERMPSYVDIEDEDIEEEFKKLELAVGQDAQVPALEKAFNEEGRMASEAADFISDTFSNLKLSDRPAEKPGITQAVSEGDKITKKLEMEAV

SEQ ID NO: 217221 - protein, 154 aa, Glycine max
  Coding DNA Sequence Number=SeqID_100443
  Gene Ontology: Mol. function=RNA-directed DNA polymerase activity; Cellular component=intracellular; Biological process=RNA-dependent DNA replication
MPGLSSDIVQHRLPFNPECSPIKQKLRRMRPETSLKIKEVKKQFDVGFLAVARYPEWVANIVPVPKKDGKIKMAPEDMENTTFDTLWGMFCYKVMSFGLKNVGATYQWAKVALFHDMMHREIEVYVDYMIAKSKTEEDTLSICGSCSKGLGSID

SEQ ID NO: 217222 - protein, 462 aa, Glycine max
  Coding DNA Sequence Number=SeqID_100444
  Gene Ontology: Mol. function=hydrolase activity, acting on glycosyl bonds; Cellular component=amyloplast; Biological process =carbohydrate metabolic process
  Homolog annotation: Hit_ID=Q38958; Match level="QueryCoverage=96%, HitCoverage=96%, E-value=1e-153, Identity=59%"; Hit description =Polygalacturonase-like protein
  Pfam annotation: Domain name=Glyco_hydro_28; Domain location=92-439; Score=307.0; E_value=3.4e-89; Accession=PF00295.8; Description =Glycosyl hydrolases family 28
MKRSRSFSLLFYLYLLVIVFATFSIVSMEARKTNIKKKLHKRHKGGHTRGSHSPCPVPAPQGSTFDVLAFGAKGNGVSDDSEALLAAWNGACKVAAATVKIPAQFKFLMKPVTLQGPCMPDLTLQIDGTLLAPSEASSWPQSSLFQWINFKWVQNFTIIGSGTVDGQGYNWWSSSEFYDMQKTYSKHIPSIKPTAIRFYSSNFVTVRDIRIINSPLCHLKFDNSKGIKVNNITISSPENSPNTDGIHLQNTQDVEIQRSIISTGDDCVSIQTGCSNVHVHHINCGPGHGISLGGLGKDKTSAACVSDITVEDISMKNTLFGARIKTWQGGIGMVKNVTFSRIQVYDVMYPIMIDQYYCDKEICKNHTSTVVISGVKFDQIHGTYGMQPVHLACSNSIPCTDVDLSDIQLSPSPKYRGLQQAVCWNSYGKSQGPLIPSSIDYCLRSGGGLIKRIARSHDRVCY

SEQ ID NO: 217223 - protein, 399 aa, Glycine max
  Coding DNA Sequence Number=SeqID_100445
  Gene Ontology: Mol. function=ubiquitin thiolesterase activity; Cellular component=intracellular; Biological process=ubiquitin -dependent protein catabolic process
  Homolog annotation: Hit_ID=Q93X76; Match level="QueryCoverage=98%, HitCoverage=87%, E-value=1e-172, Identity=72%"; Hit description =Putative carboxyl-terminal proteinase
  Pfam annotation: Domain name=DUF239; Domain location=181-357; Score =288.1; E_value=1.6e-83; Accession=PF03080.5; Description=Arabidopsis proteins of unknown function
MDFSLCLSSPIISTLVHFLLVASLFCPVCSSDIGNTLVANQTFKPQEEAHKLNIIRTRLQQINKPAVKSIQSPDGDVIDCVVSHQQPAFDHPMLKGHKPLDPPERPKGHNQMDMSENFQLWTMSGESCPEGTIPIRRTTEQDMLRASSVSRFGRKIRRRVRRDTNSNGHEHAVGYVSGEQYYGAKASINVWAPRVENQDEFSLSQMWVISGSFGDDLNTIEAGQPRDLRGQIPEILYVLDGFVQTNNRIAIGAAISPTSSYAGGQFDISLLIWKDPKHGNWWLEFGSGILVGYWPSFLFTHLRDHASMVQFGGEIVNSRQSGSHTSTQMGSGHFASEGFGKASYFRNMQVVDWDNNLVPLSNLRVLADHPNCYDIQGGINNVWGNYFYYGGPGRNVRCP

SEQ ID NO: 217224 - protein, 87 aa, Glycine max
  Coding DNA Sequence Number=SeqID_100446
MESLGKVRREGESEVAGGEGSEIGIQVWLLSLAGKKERRGWWTLSLVALIHSRLKDYAPFSASCISTRTIPSGCLETDLYFTSDIYF

SEQ ID NO: 217225 - protein, 155 aa, Glycine max
  Coding DNA Sequence Number=SeqID_100447
  Homolog annotation: Hit_ID=Q6H6B9; Match level="QueryCoverage=28%, HitCoverage=12%, E-value=4e-14, Identity=79%"; Hit description =Putative inositol-1-monophosphatase
MASWNFEKTSPNSGGVARCETRSARTKPQTEQHNSLQRCDQQQSPGHERRRRRCTRHPHTTFSSATTAAGQQHDARERPEQDAREREDADDRATSTVFWTDKMSEAAILEVVKKNFEDHLILGEEGGVIGDAASDYLWCIDPLGLGFHLTLPSKP

SEQ ID NO: 217226 - protein, 116 aa, Glycine max
  Coding DNA Sequence Number=SeqID_100448
MVWVNWQYMHAKFVGEVLSLIPQNILLGMDEKSFKVTKLQTKSLTIQVQNIIERRTKTENHLDLTKQGSHPHLMVETSNQSPSSELSQLPAHFPSCDSLEEYLCIPLRVCVCLHVS

SEQ ID NO: 217227 - protein, 180 aa, Glycine max
  Coding DNA Sequence Number=SeqID_100449
MTFSSTGNKYQLGSNNKNSNLGGMDCGAGVISVELARDMLMVHWSTYVVVINLARQKPMKTCSDDRDQIDACWRCATHCVRELHVLRPSIGSLKSDEARCWAARLWVSQTTTNRAKQQPNQEVAGKVTCRSLGSVVAHAVALGLLERDTSDQRVTPARWQHSGGGNIAAKMGKIAEKRDS

SEQ ID NO: 217228 - protein, 114 aa, Glycine max
  Coding DNA Sequence Number=SeqID_100450
MGSKIYPEIHENPRAFFSSPNPILLESLAHGSSDWSLTREDCIRMSCPPPCKSTEDESMVENVVGVAMLLAAENVARKWKKGDNRGQAKKYTRDSRSSVQNDFSLSLNQALIPT

SEQ ID NO: 217229 - protein, 69 aa, Glycine max
  Coding DNA Sequence Number=SeqID_100451
MFQKLYLPESYLEAGDQAMLSMTDGRTQRKAEIPPYKHAITAYGSTIADLPSQIAYGSWQKNRHSTSCV

SEQ ID NO: 217230 - protein, 97 aa, Glycine max
  Coding DNA Sequence Number=SeqID_100452
MSLTHTHVCAQLPLRVNCTRAHCWDCLRSFKNATLQPTQHTDAATPCRALFWREKFTRMTRDSSPTSVTLQPPPSASGHALFTGEHPLQLRVFVGCR

SEQ ID NO: 217231 - protein, 589 aa, Glycine max
  Coding DNA Sequence Number=SeqID_100453
  Gene Ontology: Mol. function=nucleic acid binding; Biological process= DNA integration
  Homolog annotation: Hit_ID=Q1SRP4; Match level="QueryCoverage=34%, HitCoverage=52%, E-value=1e-37, Identity=42%"; Hit description =Integrase, catalytic region
MAMKPVRALRVKGHQCNPKANVGEILFNTGKTLANGTPTPVTYTPMNQDIPPSSISTTNFSQQITEKLDKNFLLWRQQIEPAITALGLNSFIASPQIPPRYLSDANHDLDRVNPQFLMWQKQDKFLLIKTIIDDLTSVGDAATYHEHMDSILEGLPKDFDSVVALIESSLPHISIEEAEGLILAPELRLQKYVTHLVEQFLCANSESHSQKLLAVDVEEASTAVVVVVVAAVVGVQFSVKCVLSTITLPSLVTIDTILSIKPQTMAIMNSGSCPPQAMVANSDATSSTSWFPDSGALLHVTNNSQKIQQNSPFESPDQIFGKRQGLKISAPGHSNFLSPYNPNINLALINMIHVPQITKNLISVSKFVHDNHVFFEFHANRCFSKSQDSNEILLQGDIGPDGCISFLAGNSAQLSLLQLLGHPKSQPLKLVLNHCNLKFSVKDDMPFPSACCMGKIRLPSQSSQTVYKSPLELLYSVHLGQRQGLVHLRHRQGSMQLGQRQGPRQLDKVKARAYLKDKQRSDLDRPATGKFVSDVTGKKGYHALTKGLGSSSSMDSFASWKMNDSEMEKEEKEETPLQGEDESRKSSPP

SEQ ID NO: 217232 - protein, 195 aa, Glycine max
  Coding DNA Sequence Number=SeqID_100454
  Gene Ontology: Mol. function=inositol or phosphatidylinositol phosphatase activity
  Homolog annotation: Hit_ID=Q6H6B9; Match level="QueryCoverage=38%, HitCoverage=20%, E-value=3e-31, Identity=81%"; Hit description =Putative inositol-1-monophosphatase
  Pfam annotation: Domain name=Inositol_P; Domain location=21-192; Score=-61.8; E_value=0.039; Accession=PF00459.15; Description =Inositol monophosphatase family
MGSFILVRQKTDKITRLSLLEVQCVGIPAFSLQLQFSCRWWGILQWPKDPIIDESHKELPIVFRSRVIDYLGRQLIILSGRSFLLLKLTLVLDYQARKSINSMVAAKFQVEVERSLLVTGFGYDHDDAWATNIDLFKEFTDVSRGVRRLGAAAVDMCHVALGIVEAYWEYRLKPWDMAAGVLVCFEFYIIDNDSD

SEQ ID NO: 217233 - protein, 82 aa, Glycine max
  Coding DNA Sequence Number=SeqID_100455
MDSDVSGSNELDDVMDLVRVHHGFRSVRRESLAAIVQIAKVMMMVRICCRESGAAFMKLMTLRIWCGTYERNERSQQLGKQI

SEQ ID NO: 217234 - protein, 102 aa, Glycine max
  Coding DNA Sequence Number=SeqID_100456
MGARDSSFMNRDHLEVKTEHPWLAMMCSELEWAKDPKCSAPPPCQLHNLYLQRHPLPSSLHKWCCSRGDLWCLLQSSLRCRLRLRLLGYRSLTSPQRRRLDF

SEQ ID NO: 217235 - protein, 179 aa, Glycine max
  Coding DNA Sequence Number=SeqID_100457
MASRKRKTTASRPREPYDMTKFIFEVAWECYEQIVHSRNILLERNVTLYFMEYDEFRRELEWRQWHKALTKQSDGRIDVALVKEFYVNLFDPEDKSPRQVRVRGKLIKFDAETLNTFLETSMILEPVERYFTYSRFCHSHLDPQEFASKLCIPGRGFVLNAEEAPWKLLRKDLTTLAQT

SEQ ID NO: 217236 - protein, 186 aa, Glycine max
  Coding DNA Sequence Number=SeqID_100458
  Homolog annotation: Hit_ID=Q1SP02; Match level="QueryCoverage=31%, HitCoverage=12%, E-value=4e-09, Identity=49%"; Hit description=IMP dehydrogenase/GMP reductase
MCVSMHCDEEDCEEGIYSDVQAAPGSSEDPKCLLDVICEAPTCAGLSSNFVLLGTAPLGACCCQIQTREGYASVRLRPCVPDYMDWFFVISYPFMTVPQTVPPRDAYATQPSHIPHEVALASTHADPDANEPGHAVACHVIVEALEQHLNAPGTSTHEEVIQKCLRIAKGVTEDVRSRRWHRTDQQ

SEQ ID NO: 217237 - protein, 86 aa, Glycine max
  Coding DNA Sequence Number=SeqID_100459
MASYGVASPFIFLLLHSAAIRPQEAKESIDEEDPRPTSPNGATSEGMMQSYPVRALDRKLYVDWARDAREGPRIFMSLRVDFGPMG

SEQ ID NO: 217238 - protein, 116 aa, Glycine max
  Coding DNA Sequence Number=SeqID_100460
PVCHLQGHHMCAEKGKANWEQLLAGMLKARTQEITWLPKLKISSEEEAKVPEESKDVQALKVKLERTQVVKEKFKTTAIRVRKECDELRDVNVATAEALERETKRARKKEWGRNKF

SEQ ID NO: 217239 - protein, 222 aa, Glycine max
  Coding DNA Sequence Number=SeqID_100461
  Homolog annotation: Hit_ID=Q9LSK9; Match level="QueryCoverage=50%, HitCoverage=77%, E-value=1e-14, Identity=40%"; Hit description =Arabidopsis thaliana genomic DNA, chromosome 5, TAC clone:K21L13
MELQDTAASRVSIGFPLGSALLFVCLIFICGFFCCCLHWTKLQSFLQSHGIINTQSLAQTQIQAELASSYHKPAFPVVMMKQNYAKTIPVLMPGDDIPKFIATACPCEPPRDESITILVQKEEATDLCKDCCQLSHTTLHSPSGVTSPPRSSRIPRSVPAKLTWFSKQGACGMESEADNGAGLGCLGAEHGGGVDMEGGGGDGDYVEEEDGIGICNFRRMAS

SEQ ID NO: 217240 - protein, 101 aa, Glycine max
  Coding DNA Sequence Number=SeqID_100462
MPFILFCKLVPLTGADNGRFLPPLSIAEEMRKNLLPWLHTLQSHTSSSLYFSNSDHAIGIGLIAFSIEMTNKVKGKGKEVAGKGYAGKRKGAFDDDKTGGG

SEQ ID NO: 217241 - protein, 149 aa, Glycine max
  Coding DNA Sequence Number=SeqID_100463
MKVFNLTAAHSSSMVRVCYLQANTFLSPQISKLEYKKTNDNDKGLYVGPCSTGFGSHTLSEKPHTVFDENGVRERFTNNGRTRPQEENSKRRKSQAETNNYESERDDSSDGNVMGRVYERQGNNGEGQGIELREGNSGEVTDTNPTLSP

SEQ ID NO: 217242 - protein, 91 aa, Glycine max
  Coding DNA Sequence Number=SeqID_100464
MRERIPCARHTVAPPYTTDGLTAGFFDTVVSRVAGNGFWFEGLTVVSGGVERERKNAPSPPGAFSGGGTRLNAATKALEKLENDDTGAEEV

SEQ ID NO: 217243 - protein, 78 aa, Glycine max
  Coding DNA Sequence Number=SeqID_100465
MEGWLRGDERKIVVMEQNEFENGGRHGWCRVRCCREKLKLQCQSLHSHVLSIHFKIHKSVPDFVTLVIGFLVRNNINH

SEQ ID NO: 217244 - protein, 336 aa, Glycine max
  Coding DNA Sequence Number=SeqID_100466
  Gene Ontology: Mol. function=transcription regulator activity; Cellular component=nucleus; Biological process=regulation of transcription
  Homolog annotation: Hit_ID=Q9LSL1; Match level="QueryCoverage=97%, HitCoverage=97%, E-value=3e-65, Identity=45%"; Hit description =Arabidopsis thaliana genomic DNA, chromosome 5, TAC clone:K21L13
  Pfam annotation: Domain name=HLH; Domain location=168-217; Score =41.0; E_value=4.2e-09; Accession=PF00010.16; Description=Helix-loop -helix DNA-binding domain
MELHDHDFLEELMSLRRETWDTNPCSQENQLFSNGWSFDCFDQNYHQAFPPNSFSCQQVPQSYNHDYTYNEIYSSLLHEFSAPQVIDSSSYNTLDSTPHNTPPFLAQEDYPLSMMEEEDPGFLGEELQCLDLQTTCKMESSHSPEMPIFNTTSSCVERKNRAKKLQGQPSKNLMAERRRRKRLNDRLSMLRSIVPKISKMDRTAILGDTIDYMKELLEKINNLKQEIEVDSNMASIFKDVKPNEIIVRNSPKFDVERRNVTTRVEICCAGKPGLLLSTVNTLETLGLEIQQCVISCFNDFTVQASCSEELQQKTILSSEDIKQALFRSAGYGGRCL

SEQ ID NO: 217245 - protein, 277 aa, Glycine max
  Coding DNA Sequence Number=SeqID_100467
MWCYEWKKSEALRVGRLSLNSVDFAQVQKNACVWLVVESLVQNEFWMFASRSQREKSCDLVGVLAEFSAYALFCLAVIACARIDGDPVLRETRIWATWEYVSSDGGGQQGMLEMRKCRRVKLPAFIVDHRVVPGDMSRGSGDLGDVRRAPGSQQIKGTKTTKQEGLWWLASCEFCVICGLWPLVIDYQGLENEVRKLREPLVIDYQPIVMAAQLIRDRVEMECLEGAWETLEGNTRCRFRGTIRFTATSLVHPDEPARTLQRTVEWTAFFWISFIYF

SEQ ID NO: 217246 - protein, 135 aa, Glycine max
  Coding DNA Sequence Number=SeqID_100468
  Homolog annotation: Hit_ID=Q35DY1; Match level="QueryCoverage=80%, HitCoverage=50%, E-value=1e-36, Identity=67%"; Hit description =Similar to Uncharacterized conserved protein precursor
  Pfam annotation: Domain name=DUF1801; Domain location=17-127; Score =143.8; E_value=4.7e-40; Accession=PF08818.1; Description=Domain of unknown function (DU1801)
MATHAPNPADAGTPATELIDARIAELGDWRGEVLARVRALIHEALPDVQETWKWRGTPVWEHNGILCTGETYKQAVKLTFANGAALADPKGLFNASLEGNTRRAIDIHEGAMPNAAALKALLRAAAAFNAAKKKR

SEQ ID NO: 217247 - protein, 50 aa, Glycine max
  Coding DNA Sequence Number=SeqID_100469
MFNQFISNIELEDVAVVGVVQSLTGGLEHCPILLKEHLRSLSYFAKGVGD

SEQ ID NO: 217248 - protein, 137 aa, Glycine max
  Coding DNA Sequence Number=SeqID_100470
MARINDLGKKDELQPLFEEELSIRIQLQEMFWEMIRRNESLLRHKSRSNWLLDRDGPGKVKELVISFFTSRFSEDEIRRPYLDGAEFSKISQVDYGWSIFHENGSLWRDTLESKYEGESFGGGNWSEGIDGLNGRSH

SEQ ID NO: 217249 - protein, 163 aa, Glycine max
  Coding DNA Sequence Number=SeqID_100471
MGKLDHLKERLRAIEGGEDYAFASLEELFLVSNIITPPNFKVPDFDKYKGTNCPKNHLKMCCQKMGAYAKDEELLIHFFQESLTGVAATWYTNLEPSRVHSWKDLMVAFVRQYQYNFDMIPDRIQLQNMCKKGARIFQRICPKMERLGNSSGTYNDGERDDHK

SEQ ID NO: 217250 - protein, 54 aa, Glycine max
  Coding DNA Sequence Number=SeqID_100472
  Homolog annotation: Hit_ID=Q1SML3; Match level="QueryCoverage=94%, HitCoverage=4%, E-value=2e-11, Identity=67%"; Hit description =Tyrosine protein kinase, active site
MALMDKLDQRLPHPTKPIGKEVASIAKIAMACLTESPRSRPTMEQVANELVILF

SEQ ID NO: 217251 - protein, 129 aa, Glycine max
  Coding DNA Sequence Number=SeqID_100473
  Homolog annotation: Hit_ID=Q9FME7; Match level="QueryCoverage=53%, HitCoverage=5%, E-value=7e-15, Identity=58%"; Hit description =Kinesin-like protein
MSLGAGNSRIFALEKIIATSSTTLLSMASHLPKAEEPERVFSGKGRWNQVHSVLEAKNLMNHLFNLASSSSTGQTNTGELGADKKQKENMQATLPGGLRDQCQQQTLSWQPLIGRRRSCCWLGIMLHYH

SEQ ID NO: 217252 - protein, 143 aa, Glycine max
  Coding DNA Sequence Number=SeqID_100474
  Gene Ontology: Mol. function=RNA-directed DNA polymerase activity
  Pfam annotation: Domain name=zf-CCHC; Domain location=106-123; Score =6.0; E_value=0.1; Accession=PF00098.13; Description=Zinc knuckle
MVIHIRKSYCSLWEWVKKASNIRKEVTKIAAWICILQLPLELYNDHFLWRVGCKQGRPLKIDKLTSIHSRGHFAQMCVEINLSKRLIPHIIVRGVKLNLEYKGLHSVCFKFGHYGHKKERCPEVGVSDSQHPNLHGGIMRREK

SEQ ID NO: 217253 - protein, 593 aa, Glycine max
  Coding DNA Sequence Number=SeqID_100475
  Gene Ontology: Mol. function=protein dimerization activity; Cellular component=nucleus; Biological process=regulation of transcription, DNA-dependent
  Homolog annotation: Hit_ID=Q8S976; Match level="QueryCoverage=96%, HitCoverage=82%, E-value=1e-165, Identity=54%"; Hit description =Auxin response factor 10
  Pfam annotation: Domain name=Auxin_resp; Domain location=278-361; Score=159.4; E_value=9.3e-45; Accession=PF06507.4; Description=Auxin response factor
  Pfam annotation: Domain name=B3; Domain location=123-228; Score =107.9; E_value=2.9e-29; Accession=PF02362.12; Description=B3 DNA binding domain
  Pfam module annotation: Pfam domain module=Auxin_resp::B3; Domain location=278-361::123-228
MFMVMDSAERCLDSQLWHACAGAMVQMPPLNTKVFYFPQGHAEHAHGKRVDFPKNQTRVPPLIPCRLSAMKYMADPDTDEVYVKMRLTPLREHELLDSQDDCFLGNSAGGGGVDQGQEKPPTSFAKTLTQSDANNGGGFSVPRYCAETIFPRLDYSAEPPVQTIIAKDMLGQCWKFRHIYRGTPRRHLLTTGWSNFVNQKRLVAGDSIVFLRAENGDLCVGIRRAKKGIGGGTEFSSGGWNNPLFGGGFLCGSESNLMSGGDHEMLVGRVAAESVVEAVTCAVNGRPFEVVYYPRASSPEFCVKASVVKAAMQIQWCSGMRFKMPFETEDSSRISWFMGTISSVQVADPILWPDSPWRLLQVVWDEPDLLQNVKCVNPWLVELVSNMPTFNLSAYSPPRKKQRFLQDPYFQVINQLPMPSFSSNLLNYTNSICTIEDNNSSGGIQGARHPQFGLSPSDFPFNKLPADMLLGGFSRLDHAAAQPIMPHCGTFKNNTTTKANVDISCLLTVGNPGQNFKESNETKAPHILLFGKLIHTEQKSSNTTSSASTNGNSVSEGNSLKTSNASDGGSPWYKEQHKSDLGNDNVNTLCIAL

SEQ ID NO: 217254 - protein, 48 aa, Glycine max
  Coding DNA Sequence Number=SeqID_100476
MGLRLRFMLLVVIEDYPKVKSLAWVGSTWKHQSLEQGIRDLKKNLTRG

SEQ ID NO: 217255 - protein, 107 aa, Glycine max
  Coding DNA Sequence Number=SeqID_100477
MGKDWGPGAADAWYTDKSSHSTALGPYDWPPTGHPNAACRVPSSALLFYEGLVNGRPDELRGCNWHPIELAEICDQGQKSQCSVGLFQVHWVSWRRDPCKLLNGVRD

SEQ ID NO: 217256 - protein, 198 aa, Glycine max
  Coding DNA Sequence Number=SeqID_100478
MSCLVIITPTFLCRSVSWCMPPTRHPLDPDKCNRALGFLALITGLCQSFGVPVTPSKVIRPPITWAFIEKYCTPKQEQGDAPQAADAPLPPHQADPAGSLGMERYLHHLVRQQAANHRRQVQIHECLYQLSLSQQGQGFAPFACPTPEQFRAEVAWPGDWPKARAREALAGSPADAEEACMDEEMTDLLGFLGGSGAT

SEQ ID NO: 217257 - protein, 56 aa, Glycine max
  Coding DNA Sequence Number=SeqID_100479
MASSTHFQQISSQITITKHKPKMVTKGWSFNGGFNGEEEERKSNVREREKASEIFC

SEQ ID NO: 217258 - protein, 75 aa, Glycine max
  Coding DNA Sequence Number=SeqID_100480
MQRRSTAGFRSSSNSRRRTLIFRGIFYFSYCRDSHIEPVEDTIMAEEPRRVTLEDYSSSNVLQFFTSIAQPEVQA

SEQ ID NO: 217259 - protein, 236 aa, Glycine max
  Coding DNA Sequence Number=SeqID_100481
MDVRATSGGTDMKGTFIRLADRDGTGSRSDPLPLGAARGWQCDPKLCLNLPARWGTSKRWHMGDMKPQMRRKTGGIMSKVLDTRSGSRVDTGAKGIVGAAGETETSEDHWKTIDSLKPWAGWSSVSLRQRSGSPARYSTGSGAHDGSVWPRDTQGVSRANTGEGGTPGAVLGRARQVPRPVEARDSEPHSALAKVRGRRGAKLLVGNLWSQGSKAKGVSDKERQAGLCRGGIGTGE

SEQ ID NO: 217260 - protein, 117 aa, Glycine max
  Coding DNA Sequence Number=SeqID_100482
  Subcellular localization annotation: CTP_CleavageSite=84; ConfidenceScore=5.57e-01
MNSLPSAVHVSSTIESGAPRIHCLALFANSPFSTFIQRPMNSLPSAVHVSSTNESGAPRIHCLALFANSPFSTFIQRPMNSLPSAIHVSSTIEYGAPRIHCLALFANSSFSILFGDP

SEQ ID NO: 217261 - protein, 77 aa, Glycine max
  Coding DNA Sequence Number=SeqID_100483
MRLGGDGAVWGEVNDATRSRTRRTCGAGETVPILVVPVGKYLFPFPSSRGNIPCLWGPEQDSPFGDPRLWYKLIPLL

SEQ ID NO: 217262 - protein, 85 aa, Glycine max
  Coding DNA Sequence Number=SeqID_100484
  Gene Ontology: Mol. function=nucleic acid binding; Cellular component= oxygen evolving complex; Biological process=DNA integration
  Homolog annotation: Hit_ID=Q1SD84; Match level="QueryCoverage=91%, HitCoverage=7%, E-value=3e-22, Identity=48%"; Hit description =Integrase, catalytic region
MEVVCSKRGIVVSLQKYILDLLEETGMSGCRPADTPIDPNGKLWEKGSVSVDVGRYQRYLKRNPGKGLFFKKNSDLEKSKCLHTQ

SEQ ID NO: 217263 - protein, 111 aa, Glycine max
  Coding DNA Sequence Number=SeqID_100485
MEHPDIQDLSLEDEEEEEMVFTSNTIIKSGLNYSLCLVGRFLKKKTIRVNIMKERMTNVWSPVKGIVITKAGPIMQTQEQEDNAEAIGQQVQLANRPKRVVTKPSYLKDYV

SEQ ID NO: 217264 - protein, 1451 aa, Glycine max
  Coding DNA Sequence Number=SeqID_100486
  Gene Ontology: Mol. function=RNA-directed DNA polymerase activity; Cellular component=chromatin; Biological process=chromatin assembly or disassembly
  Pfam annotation: Domain name=Chromo; Domain location=849-897; Score =41.5; E_value=2.9e-09; Accession=PF00385.14; Description='chromo' (CHRromatin Organisation MOdifier
  Pfam annotation: Domain name=rve; Domain location=544-700; Score =118.0; E_value=2.6e-32; Accession=PF00665.16; Description=Integrase core domain
  Pfam annotation: Domain name=zf-H2C2; Domain location=485-526; Score =14.0; E_value=0.0049; Accession=PF09337.1; Description=His(2)-Cys(2) zinc finger
  Pfam module annotation: Pfam domain module=Chromo::RVT_1::Retrotrans _gag::rve::zf-H2C2; Domain location=849-897::30-199::1062-1152::544 -700::485-526
PISYPHYQKREIEEQVDLMLQKGLIQPSTSPFSSPVLLVKKQDESWHFCVDYRALNALTVRDRFPIPTIDELLDELGGACYFSKLDLLQGYHQIRMHSDDIPKTAFRTHHEHYEFKVMPFGFCNAPSSFQATMNQIFQPYLRQFIIFFFDDILIYSCSMDDHLRHLTLTFQVLLVNQFVLKLSKFYFAQPQVEYLGHLVSHKGVEPLPSKITAIQQWPIPHTTKAVRSFLDLAGFYRRFIQGYATLAAPLVKATTLEPFQWTPKAQLAFEKLKLALSSAPVLALPDFSIPFTVETDASGVGMGAILSQKGHPIEFFSKPFSAKLLRSSTYVRELFAITAAIKKWRQYLLGHHFIILTYHISLKELLTQAVQTPEQHMYLVRLMGYDYQILYRSGAHNQAADALSRVPESQSTFSMILYVPCFTFLEELAQQLDHNEDYLQLRRNINEAPAEFEGFSLTDSFILFRNRIWLPRTLPLIPTLLQEFHSTPTGGHAEITKTLIRLSENFFWSGMRADVSTFVANCFECQCTKYETKKMPGLLNPLPVPRQPWEDLSLDFITGLPPSNGHTVILVVVDRFSKGVHLGTLPTAHTAHTVASLFLNIVAKIHGPPHSLVSDRDPLFISKFWQELFRLSGTQLRMSSAYHPQSDGQTEVLNRVIEQYLRAFAHRRPTTWRKFLPWAEYSHNTSWSSSTGSTPYEVTFGKKPFNFPTYITGQSSIDAVDTMLTDRNEVFQMIHKKLLKAQEIMKTKVDTKRREVNYQIGDWMLLRLRPYRQSSAKGADQTTGKLSKRFFGPFQVVERVGKVAYRLQLPAEAKVHPVFHCSLLKLFHGDPEAVSASLPATIFTPQSSVAPLAILAARKAPNATTEVLVQWQGLSPDDATWEDWTELSNEFHLEDKVLPQGQWSDTGEQTIAVQAQNARPIMQTNAGPIMQTQEQEGGSGSSKTSFVFLPLIRTYQVVLSLPPMSDQPPLSSTKLKDILVALTTQQLTFSHKIDDLIQHIAPVLHPQPSITASIPRPYSIPAQQHRMKLEVPRFDGADPMGWIFKVNQFFDYHSTPEHERLQIAAFYMEGRALSWFQWMSANAQFTSWPAFIQALQTRFAPSQYEDPIGTLCKLMQKGTVATYLSEFKDVANRIVGIPPAFLLGCFISGLTPEIRREVQAHQSFTLTQAAGLAKLQEEKLLDSHPSPPPPRPRPPSTSFFPTLPLRHTNPLSLPPSLPSSSLRQSHSSLSPLPSPNPRPNPPPPFQCLTSEEIASRRERGLCFSCDEKYHRGHRCASRVFLLLAEDIDTPPLPETPLISHLDPDPDPLLDPAHHHDPYPTHDPDPYPAQLSLNSMAGHLAPETLCFIATISGNEVVLLVDGRSTHNFILKQLVDHLGLPSRSTTPLRVMVGNGQQLDCDTICEAIPILIQTHEFHVDLYVLPISGANVGDMDASLTSLLSFRRLTRKLDTP

SEQ ID NO: 217265 - protein, 147 aa, Glycine max
  Coding DNA Sequence Number=SeqID_100487
  Subcellular localization annotation: CTP_CleavageSite=36; ConfidenceScore=5.36e-01
MTRMKASSKSSNGRTRQLEPQPRPPRGRHCPLCRSQASMAAKLDALLLKMNTLLTSQHFPSFSSTKAPPAHAPMSTLLPMVAFHLPANSKPYATSSDLHFSHRLGSDDISSIYLAKLNNDSFAVMFAAKVMVFPMAPKDVRINLMVW

SEQ ID NO: 217266 - protein, 319 aa, Glycine max
  Coding DNA Sequence Number=SeqID_100488
  Gene Ontology: Mol. function=RNA-directed DNA polymerase activity; Biological process=RNA-dependent DNA replication
  Homolog annotation: Hit_ID=Q1SP50; Match level="QueryCoverage=65%, HitCoverage=35%, E-value=3e-14, Identity=37%"; Hit description=RNA -directed DNA polymerase
MVKHGWSQNVYDEIISKLDYCANALMPWGNQVCACFEKDIQRCKQKLEELRYLSNQHSIREFMCLRDELNCLFAQEEAYWRQHARVFWIHDGKLMPPSKELFPKSLLRLLFVWFQEKFQQERTLPYWLLLRKENLEQQFFRCTRINRFPGPDGFNPGRSILDNTLVQHMECKVRGKEAKITLKIDVSKSFDKVDWKYLNAILLQMGFDVTWEHPTAHKGANFSTTWCLSMSWDRKKHGKGINCLSWEHLSMRKEHGEYPESPSQPGKGSRPRECNAPSLVHHAETAQKHITMLLLVAATLKQFGRKLPYGTSSILFATR

SEQ ID NO: 217267 - protein, 139 aa, Glycine max
  Coding DNA Sequence Number=SeqID_100489
  Gene Ontology: Mol. function=RNA-directed DNA polymerase activity; Biological process=RNA-dependent DNA replication
MSGLSNPRAVVSLCDLIQTYKLDVLFLSETCIGRSGGLALFWRKPFGLINFSQNFINVEVHHPENPTWRLTRFYDLPERSRRKYSWDLLHSLATDKQFSWCIIGHFNDLLSTEDKKGRVDHPLWPMQGFHDVAIILMQT

SEQ ID NO: 217268 - protein, 201 aa, Glycine max
  Coding DNA Sequence Number=SeqID_100490
  Gene Ontology: Mol. function=DNA binding; Cellular component=nucleus; Biological process=regulation of transcription, DNA-dependent
  Homolog annotation: Hit_ID=Q6QAD0; Match level="QueryCoverage=50%, HitCoverage=24%, E-value=1e-17, Identity=46%"; Hit description=MYB transcription factor
  Pfam annotation: Domain name=Myb_DNA-binding; Domain location=9-54; Score=59.5; E_value=1.1e-14; Accession=PF00249.21; Description=Myb -like DNA-binding domain
MVVKFDDVKESWNEEEDRILIEAHKEVGNRWAEIARRMPGRTENTIKNHWNATKRRLNAKRLRNKRRGLKGPTLLESYIRQVTANEETQKEMIKNSMSNMNLKGESSSNTTTTNTNTNTNTRYPHLFRVWYESSEGGFSSEEDEAGWSVQQPHGVGGGYVPMMLNATVEDGTMGYDVAMEMAPEVQMKKEMDLMEMIIRKA

SEQ ID NO: 217269 - protein, 137 aa, Glycine max
  Coding DNA Sequence Number=SeqID_100491
  Gene Ontology: Cellular component=cellulose and pectin-containing cell wall
  Homolog annotation: Hit_ID=Q41695; Match level="QueryCoverage=50%, HitCoverage=17%, E-value=8e-18, Identity=60%"; Hit description =Pectinacetylesterase precursor
  Pfam annotation: Domain name=PAE; Domain location=5-136; Score= -188.5; E_value=0.00038; Accession=PF03283.4; Description =Pectinacetylesterase
MAPPLHTLILSFDFEDEDDVATLDCYLAGGQWNVNVVANVIKKNDVSATIFVPGWVYETKQLFICSPDQLDLMQGFRTEFLRPIIVLGNSSSKGMFIDSCYAHCQTKKQGTWLRSDSLEMKKTTIARVVANWFYSIR

SEQ ID NO: 217270 - protein, 55 aa, Glycine max
  Coding DNA Sequence Number=SeqID_100492
MVSKGWSFDGASMVEEEGRKSNLCHMSSFEWSKKRPTFPLDVTHTQSQEEKNLTF

SEQ ID NO: 217271 - protein, 156 aa, Glycine max
  Coding DNA Sequence Number=SeqID_100493
MTFEIRMIMRMREGDHDTGGNDNNDDGGSNANDHSGDHSGGDNENNNSYVGGNNDGDNDDHGGCDNNNDGHIDSDNNNHDGDCSDGGGCDNDLIELAFDSCSSCCREEEPRTTAAVKGASSTSTVEGSLEELTDQVIRKRFPDQVDLEHAYGSLDP

SEQ ID NO: 217272 - protein, 71 aa, Glycine max
  Coding DNA Sequence Number=SeqID_100494
MTDCYKESLWPLDQANTCNLCLSSYLIPQTAQIQGPMTRSMAKQLKDTLQQMVSDILNKVQVEKDEGSKTP

SEQ ID NO: 217273 - protein, 189 aa, Glycine max
  Coding DNA Sequence Number=SeqID_100495
  Gene Ontology: Mol. function=RNA-directed DNA polymerase activity; Biological process=RNA-dependent DNA replication
MTYGGNCSLHLTQLEGYYACGVKQLSNYKVEDAPWVGRKFTWYRPNGLAKSKLDRFLVSYDWFSKWPVTTQVTIDRNFSYHCPVMIRSKVIDWGPKPFKVWSKEQFGDTFKKVKHIQEELNKFEEDTMDRQLSPQEMMSKKQLQEALWVAAQSHESLLRQKSRSRWIKEGDCNSKYFHKLMNVSRRNNL

SEQ ID NO: 217274 - protein, 125 aa, Glycine max
  Coding DNA Sequence Number=SeqID_100496
MARRTASMVFAWMRPLSKDLSPYWPNLRSVLLDLVRLHHTHLGNSSIYGGSKGHPLQVNAPLARAAQALQTQQAGFALQGLAVMRKRIKQAHQASASSKRIKDPTHASAMQMGNCVAVAPEGITL

SEQ ID NO: 217275 - protein, 719 aa, Glycine max
  Coding DNA Sequence Number=SeqID_100497
  Gene Ontology: Mol. function=DNA-directed RNA polymerase activity; Cellular component=chloroplast; Biological process=transcription
  Homolog annotation: Hit_ID=Q20EX3; Match level="QueryCoverage=70%, HitCoverage=25%, E-value=1e-134, Identity=51%"; Hit description =Beta'' subunit of RNA polymerase
  Pfam annotation: Domain name=RNA_pol_Rpb1_4; Domain location=70-149; Score=104.3; E_value=3.5e-28; Accession=PF05000.7; Description=RNA polymerase Rpb1, domain 4
  Pfam annotation: Domain name=RNA_pol_Rpb1_5; Domain location=151-496; Score=33.8; E_value=3e-12; Accession=PF04998.8; Description=RNA polymerase Rpb1, domain 5
  Pfam module annotation: Pfam domain module=RNA_pol_Rpb1_4::RNA_pol _Rpb1_5; Domain location=70-149::151-496
LITWSLLTVGERQTIETVENLKALGFQFATQAGVSLSVDDLKIPPEKLSLVSQASQQVEATQQAYHRGNLTAIEKLQQLVDTWHRASETLKQTVVNHFLSTDKLNPVYMMAFSGARGNISQVRQLAGMRGLMADPQGQIIGFPIRSNFREGLTLTEYMISCYGARKGLVDTALRTADAGYLTRRLVDVSQHMIVKAATCATPRGIVLKDLQSSAKVILPLRERLIGRVLAEDVSGDNELPGGEQGSQGAAISTGSGHTTTVASSGRSIAVNGVSTQSRQAGLLAYRNQEISAKLAARIASCRDAVVVRSPLTCAIRHGVCQLCYGWSLSEGRLVTLGEAVGIIAAQSIGEPGTQLTMRTFHTGGVFSGDVMAEVRAPHDGIVDFPQPLQGLLIRTSHGKIAFLTKASGSLLLGSDRSLAIAGEGTLFSLEPLTVLFVRQHEKVARTQLIAEFSSMGTEMNETIEAKRILFSEMVGQVSFANVRLGTRRRESGGILQVSRNLGFVWVLSGRRSPVTPLLGIYGKGSHLVNPGSLVTRVANKSTWHGNRAPIRPESTDTQFRPTVSGVAPERLLVSKNRPHRPHRSSAFRRTDAIWQKTGFGVVIARLIDLRQCLESALLNWLPGTQGERRCEQLREWSSCLSEQVSSKGRPMLHEGPGPLGPVRDFIRANRILSALIANHSGLPVTFGSRESSLAALNIIGAVGVSGTSRAAMFYSIFIG

SEQ ID NO: 217276 - protein, 66 aa, Glycine max
  Coding DNA Sequence Number=SeqID_100498
  Gene Ontology: Mol. function=cytochrome-c oxidase activity; Cellular component=mitochondrion; Biological process=electron transport
  Homolog annotation: Hit_ID=Q8LD51; Match level="QueryCoverage=85%, HitCoverage=73%, E-value=1e-22, Identity=78%"; Hit description =Cytochrome c oxidase subunit 6b
  Pfam annotation: Domain name=COX6B; Domain location=1-60; Score=37.1; E_value=1.5e-08; Accession=PF02297.7; Description=Cytochrome oxidase c subunit VIb
MVIELKTAPADFHFPTTNHTRHCFTRYTEFHRCLATKGGNSGECERFAKYYRSLCPGEWCVLLNRG

SEQ ID NO: 217277 - protein, 65 aa, Glycine max
  Coding DNA Sequence Number=SeqID_100499
  Homolog annotation: Hit_ID=Q10CF2; Match level="QueryCoverage=100%, HitCoverage=31%, E-value=2e-11, Identity=54%"; Hit description =Expressed protein
MAEGNGDKTLRKIAEAFKDLANVVTDSQSAEVKVSPFSHACSLVSPLFGCLGVAFKFAEMDYVAK

SEQ ID NO: 217278 - protein, 334 aa, Glycine max
  Coding DNA Sequence Number=SeqID_100500
  Gene Ontology: Mol. function=phospholipase A2 activity; Biological process=lipid metabolic process
  Homolog annotation: Hit_ID=O80959; Match level="QueryCoverage=92%, HitCoverage=68%, E-value=1e-81, Identity=50%"; Hit description =Similar to latex allergen from Hevea brasiliensis
  Pfam annotation: Domain name=Patatin; Domain location=1-160; Score =49.9; E_value=8.4e-12; Accession=PF01734.12; Description=Patatin -like phospholipase
NARVADFFDAAAGSGIGGVLAALLFTRGKDGRPLCTAEEALRFLTDNRRRISRRSGILRRVLRPAEKLFRKTFGECTLKDTVKPVLIPCYDLVTRAPFVFSRADALEVDGFDFKMRDVCAATSADPSSAGPTEMLSVDGRTRIVAVDGGVAMNNPTAAAITHVLNNKHEFPFCNGVSDLLVLSLGNGESDFNAVKSPSGFVRIAGEGASDMVDQAVSMAFGECRMSNYVRIQSNGIMANKGTQAKSCKTASDLLSISEEMLAQKNVESLLFKGKKVAENTNMDKLELFGGELIKEQERRKTSILPTVVLKNNNASPSPSRTSSATTLSTLSSTS

SEQ ID NO: 217279 - protein, 675 aa, Glycine max
  Coding DNA Sequence Number=SeqID_100501
MLEGQEETGVVVKTRATLQGRVEDLVFETRGFIGHPSDGWIQICSVQWPELSNTSPLGEPGSNLFDQGTRYQFLGLAASKHPVKNGASFSKQEIVKIEGQHFRGIGAERRGQPNKTDTSKAEPDRYGTRFFKVPINTLQFVFATHRTNPLARKSAVGDKQSNSVERESQRKGRGFNKSNGKDAPSSAEGGLRTPRLETTIVVSRSAAGTSSPQQETRLGAKEKDSLKTSQVLQGQALQEPSLKSAPSDGFSLLLDGLVKGTNRPKEEVQVAWEARSDRLHLRIKPGWAYLPHEQANLLRSHESIQFCGGSQLDNLFFEPALVYLEAFKSGQFSYSTADTGLIASLRVQLLELGLVVRNMGERRRETGISPGIRRGGSIFQNLATQAFDIEREIEGCESIPPTHAWASHAPVSSFHRAGEKHFQSSIERTPRIWPLGQEILVRLRKMLWLSQAFAPRLAELGVDRSFLQALLPKRAGWEGVARHNHPNRRTDLYQMLFIRNLLNREPFLWLRAFPVQVQIVTNQKARHLGMVSPLHNRLSQANAVPITNLTLLQAGKEIEGVTTSERQLGQIKSHTYVVAGSELVQAKPHMGRGLLPLVQAEFLFPYGFTLGLVSSCLPVSLPLKFLKERAGTEATHKLVAATWQSARRIVQAVRPTRADRNRFQSTGWSTWQASQ

SEQ ID NO: 217280 - protein, 105 aa, Glycine max
  Coding DNA Sequence Number=SeqID_100502
  Gene Ontology: Mol. function=DNA binding; Cellular component=nucleus; Biological process=regulation of transcription
  Homolog annotation: Hit_ID=Q0PJJ6; Match level="QueryCoverage=94%, HitCoverage=50%, E-value=2e-49, Identity=91%"; Hit description=MYB transcription factor MYB181
  Pfam annotation: Domain name=Myb_DNA-binding; Domain location=17-64; Score=46.7; E_value=7.8e-11; Accession=PF00249.21; Description=Myb -like DNA-binding domain
MDKKQLCNTSQDPEVRKGPWTMEEDLILINYIANHGEGVWNSLAKAAGLKRTGKSCRLRWLNYLRPDVRRGNITPEEQLLIMELHAKWGNRRKRGPGPLDLTRTT

SEQ ID NO: 217281 - protein, 203 aa, Glycine max
  Coding DNA Sequence Number=SeqID_100503
  Gene Ontology: Mol. function=nucleic acid binding; Cellular component= mitochondrion; Biological process=DNA integration
MQGECEILMMGELNYFLGLRVKKMNHGTFLYQTKYCKELLKKFDMDKSKEVATLKAINYYLNADDKGKPIDQAKYRGNGLISWNSKKQTCVVLSLVEVEYITTRSCSAQILCLKQLLFDFGLHLEHIPFRCDNINFISLTKNPIMHSTTKHIEIRHHFIRDHIHKSDYDMEFVDTNSQLADIFSKPLPRDRFFHLRNDLGILS

SEQ ID NO: 217282 - protein, 154 aa, Glycine max
  Coding DNA Sequence Number=SeqID_100504
  Gene Ontology: Mol. function=RNA-directed DNA polymerase activity; Cellular component=chromatin; Biological process=chromatin assembly or disassembly
  Pfam annotation: Domain name=rve; Domain location=1-154; Score=15.5; E_value=0.0003; Accession=PF00665.16; Description=Integrase core domain
MDFIGGLPKAQGKDTILVVLDKLTKYAHFFALSHPYTAQEVAELFIKEVVRLHDFPASIVSDRDILFMSLFWKELFRRARTQLKMSTAYHPQTDGQTEEPPLLVKVAEIPSRLEEVNQLSKDRDELLQELSYNLLKAQDQMKRYANNHRSELVL

SEQ ID NO: 217283 - protein, 316 aa, Glycine max
  Coding DNA Sequence Number=SeqID_100505
  Gene Ontology: Mol. function=monodehydroascorbate reductase (NADH) activity; Cellular component=peroxisomal membrane; Biological process=hydrogen peroxide catabolic process
  Homolog annotation: Hit_ID=Q9LK94; Match level="QueryCoverage=75%, HitCoverage=51%, E-value=7e-84, Identity=64%"; Hit description =Probable monodehydroascorbate reductase, cytoplasmic isoform 2
VTAVNLRDGTTLSVDMVVVGIGIRPNTGLFEGQLTLEKGGIKVNGMLQSSNSSVYAIGDVAAFPVKAFGETRRLEHVDSARKSAIHVVSSIMEPNKTGEFDYIPFFYSRVFTLSWQFYGDNVGEVVYYGDMSGSAFGAYWVSKGHLVGAFLEGGTKEEYEAIAKATRLRPAIEDLTELERQGLSFAVTVSQKPVVPPPVEVRASDLLLEKPLYAWHATAGVIIAASIAAFAYFYGKKRRRCQRMPWILLRLMSRALQTNISGIGKLWIQIPILVQKIEAGHIIYQFQIVPFSFSTASDWSKFEDEIQCEQCLNPAE

SEQ ID NO: 217284 - protein, 71 aa, Glycine max
  Coding DNA Sequence Number=SeqID_100506
MEIYSKDYLMKTPMHIWQRETKRWLHLFKGNSLKTWEEVVEKFLKKYFPESKTAKGKAAISSFHQASLMNL

SEQ ID NO: 217285 - protein, 266 aa, Glycine max
  Coding DNA Sequence Number=SeqID_100507
  Homolog annotation: Hit_ID=Q9FNE4; Match level="QueryCoverage=67%, HitCoverage=13%, E-value=2e-33, Identity=43%"; Hit description =Arabidopsis thaliana genomic DNA, chromosome 5, P1 clone:MPO12
  Pfam annotation: Domain name=PWWP; Domain location=182-258; Score =59.6; E_value=1e-14; Accession=PF00855.8; Description=PWWP domain
MGTLEAGSKDPSGCSSPSPENDNNELREALCALKNGASENGVGFSGHGNQGSGDGGVVEVGKSRVSETKVSDEKGFEGREMEDDCQGLADSEMNGVSSLLKMRESGRNLMFLYGGASESAGKVNSEGGSFEVGVEGGERDGKKIEGEDDRNGKTVTADVPIADTSENKDVEMEDLGDEGCGGFLVGDFVWGKIKSHPWWPGRVYDPSDASDFALKLRQKSRLLVAYFGDGTFAWCHPSQLKPFEENFEDMMKQSSSRAFVNAVQKA

SEQ ID NO: 217286 - protein, 61 aa, Glycine max
  Coding DNA Sequence Number=SeqID_100508
MEYIKSKKLELDGLRRGKKMMLEKIDDLMRVHKKDYAKLKECFESILERLKAMEAAHVDDI

SEQ ID NO: 217287 - protein, 362 aa, Glycine max
  Coding DNA Sequence Number=SeqID_100509
MAMEAEHVNCEVFFFLGLVKERKNLERFAEERARGEGKKMQGGAAKVKWAVGYDTLFFEGSPVKGFLILWLCKSVRNVLCRAGRLRKVVLCKGWDGGFLIDVIVRLVRLFKLNQTWVRREKGNKYGCHGQPSVDGGGGFDGGDLGGESAGAGLAIEESTGIGGGGGRGGWTVEGNLCCISIFMLKRKKLLKDLSEASNVFLINTEPFFHDTPVGAWTFKRVISLEVLEVLIVVSASSLFPAGSWLLHLHELPVKLVLFLFEFNSHSLSWNPRILVKRKEMFFEFRMMCPSSDNGSSHCNFRVLVQVENERSANRRDVMNDALGIGGKAMLSLGLGSNGGNLGATLSAMNLMVVVWQIWIPRG

SEQ ID NO: 217288 - protein, 264 aa, Glycine max
  Coding DNA Sequence Number=SeqID_100510
  Homolog annotation: Hit_ID=Q9LK89; Match level="QueryCoverage=97%, HitCoverage=99%, E-value=1e-09, Identity=26%"; Hit description =Arabidopsis thaliana genomic DNA, chromosome 3, TAC clone: K16N12
  Pfam annotation: Domain name=DUF1645; Domain location=59-244; Score =47.0; E_value=6.3e-11; Accession=PF07816.2; Description=Protein of unknown function (DUF1645)
MQKEEQEKEYLESLTCPSFNCYSTDELPGIAQSRIQKDDASFSASQNDDPDFEFAAFRDDAFEFSNDDAVFPLFNSDVARDRRNSVSGGLDSDAAVLRFPITGEELRRGEHDPSLSPSSESSSEADELEVVPAGTYCLWRSNSPQASPRKCKKSNSTGSSSSLKKWKLLDLLRRSNSEGKESLMILTPAPEKKNVNERWSIEVAGKSKGNGFAGEKKVAVSPHEALYLRNRELRMVDKKKSFLPYKPGLVGFCTNRLGKAFPSF

SEQ ID NO: 217289 - protein, 660 aa, Glycine max
  Coding DNA Sequence Number=SeqID_100511
  Homolog annotation: Hit_ID=Q9FNE4; Match level="QueryCoverage=98%, HitCoverage=77%, E-value=3e-33, Identity=29%"; Hit description =Arabidopsis thaliana genomic DNA, chromosome 5, P1 clone:MPO12
MSSSCAADKTSSEFVRPLAANSGVKEGILIPENGIEKLSDVLIDPAEFLSRVKQIAEIISIANILELEILKAQLSAFYLSRGGYRLPMYEVPQPVPGLEDSLRDKTVNVGSSECAVEAPAHGPFEEDYSTMPMSPKSGELSHSHGISGNRLNHRIKQKSIAEIMGEDKDVNTKNQEGDATEKVTVRKKRKGSEDTMASKSVQMRKALFSNTDRNVAGAENDGGCWGKEDGDNGTLAQLKKKKKAFGIGKSSSGSKKETDLEGKFKGKNEKGSLSREKKKSKYLSPPFTIPAREQRKGEIETESPKVSGKDQESEPLTRASDQLLKSPVPLKLNDEAFQENVSKELVKEQDLPDSSNYRTPEYDENKTIDTTKIQVPLGEVLSEVRYAAINPQTPSNTNSLERIVDFIFIYRSSLFRQGSYYKIYKKHKPSKKRKKPESDLGILRKDQIQSDHISAINDSEPKKRRIKKETALGLPKEKLSAAAKIGKKGTDKNASGAALFVSFEPGSSLPSKSDLITLYGKFGALNESETAMFASDYTARVFFLKASNAEKALSHSQNLNPFDSSGASFRLEYLSAGSKSEKSKPKASSTKKKDKTPAKPSASLSPGTEASKLNYIKQKLQCLTSMLEASDAKLPDIKAKLESEMKRLLEDVNKMVESSS

SEQ ID NO: 217290 - protein, 119 aa, Glycine max
  Coding DNA Sequence Number=SeqID_100512
MEEHVAPILTPCAFELLQHEIESSIKYASSKGSNDSYIVRHHTKHDGGCSIQSLEVECLKTKDRVKVATEEIGRNVELMKDMFEVQEHSIELEVFQMTMRVMLKISQYLKQKVDQEDRG

SEQ ID NO: 217291 - protein, 50 aa, Glycine max
  Coding DNA Sequence Number=SeqID_100513
MDEACAGDVDADAHDLEAEEEILGLEAVDCVDFLGSTPYFFDALGEQMIN

SEQ ID NO: 217292 - protein, 143 aa, Glycine max
  Coding DNA Sequence Number=SeqID_100514
  Gene Ontology: Mol. function=nucleic acid binding; Biological process= DNA integration
  Homolog annotation: Hit_ID=Q1S7C5; Match level="QueryCoverage=96%, HitCoverage=11%, E-value=2e-17, Identity=37%"; Hit description =Integrase, catalytic region
MFQPFFSGVNKLSQLSSLIVFSDLLQIHKFRYVFFLRKIENSVYEAWEQQDQVLLTLLQSTLSTSILFRVLGCAYSDEVWERIHDYFHKQTRATARQPRTQLHATSLGGKLMCEFLSQIEWISDSLASVKSPIMLQKHIDSIA

SEQ ID NO: 217293 - protein, 306 aa, Glycine max
  Coding DNA Sequence Number=SeqID_100515
MEEAGDKGRKDVIRNGYERSQHKQSAVGEWWESYGNMTKCRKAADEEVVDTTASQAQKRTKKKMDTPLSKAAPAPQHLPSTLVALKAMGLSETDDDEDRLVFRKRKVTPPLDETTKPQRNKQSSTVAATNSPLVEIPPVGEQISIVQQFERSLRRTEVIHLKKKKRTKSNANMDGDIQHQAPLSPIHLVIDLNLITDDITSLQFLVAFLYENAYNIQRRLDVEFQPSIDWMQLPLDVKEEIVNCPPSMHNDDEVAPSFAALDQSTRIKVLPPPTWKHLHPKITKPTSQWPCAKVFKRFHPVPAEEC

SEQ ID NO: 217294 - protein, 311 aa, Glycine max
  Coding DNA Sequence Number=SeqID_100516
  Gene Ontology: Mol. function=protein tyrosine/serine/threonine phosphatase activity; Biological process=protein amino acid dephosphorylation
  Homolog annotation: Hit_ID=Q3S4H5; Match level="QueryCoverage=46%, HitCoverage=61%, E-value=7e-11, Identity=29%"; Hit description=Dual -specificity protein-like phosphatase 3
  Pfam annotation: Domain name=DSPc; Domain location=182-307; Score= -25.8; E_value=0.017; Accession=PF00782.11; Description=Dual specificity phosphatase, catalytic domain
MWSQIIYYSILDMTICENSLDNPSLWKRKVLKEQTSSFSLVLERPTSPFPIQLLHKMNDLEIVFNRGRVPIATWNKTLLASNLQSSSESCGNAGFLMFNSKFLKPNGSKLLGNQNQHTITHGERNIVTEHTTQLACVFTEEVCGDGDWAHGSFPLEEYIQALDRSKDEMYYNHSLGMRYSKGVTAVLNFQSGTEAENWGINAKSINESFQRKNILTINYPIREGDSYDMRKKLPFCVGLLLRLLRKNLRVFVTCTSGFDRAPACVIAYLHWMTDVSLHAAYTWVTGMHTCRPDRFILPNFKHFCIICLLFN

SEQ ID NO: 217295 - protein, 113 aa, Glycine max
  Coding DNA Sequence Number=SeqID_100517
MNACPKNMCKPNCPMGCFPTKSRANAIEAFHRTLGLGPSHTNPQFNLIKRENKPKLPHIFEHIPTIKSTKRRSKYTNEKLESLGMEYLLVGDEQKRETESKNAKSDDPKTANS

SEQ ID NO: 217296 - protein, 70 aa, Glycine max
  Coding DNA Sequence Number=SeqID_100518
MMRVVMVVGVGVQWCIWSGVEVFACSGGEWSRGGAMRLPWRFGREEARVFLGRRRIKRGYKEDRGAQSNP

SEQ ID NO: 217297 - protein, 309 aa, Glycine max
  Coding DNA Sequence Number=SeqID_100519
  Homolog annotation: Hit_ID=Q6ZGV8; Match level="QueryCoverage=35%, HitCoverage=7%, E-value=2e-45, Identity=77%"; Hit description =Eukaryotic translation initiation factor 3 subunit (EIF-3)-like
  Pfam annotation: Domain name=PB1; Domain location=58-139; Score=53.0; E_value=9.9e-13; Accession=PF00564.15; Description=PB1 domain
  Subcellular localization annotation: CTP_CleavageSite=47; ConfidenceScore=5.25e-01
MVYADICFKGTNATTHRLEGASPNFKAPSLSSTRTASKPPKSTLKFLCSYGGKILLRYPDGKLRYLGGHTCVLAVDRSIPFSELLLKLEELCGASVRHLRCQLPSEDLDALVSITSDEDLTKPHRGIRSRFIAEIIHFKYLICRTYHRHDAARAENALTLLYGNEPIGMQRDWNEELQSCREFPRTSPQKRILRDRALYKVTSDFVDAAINGAIGVISGCIPPINPTDPECFHMYVHNNIFFSFAIDADLEKLSKKLVDANSKSWSSNSLQSSSDKDSIPVHGESQVPNGGKDDGSSSEDLNSTEISEL

SEQ ID NO: 217298 - protein, 63 aa, Glycine max
  Coding DNA Sequence Number=SeqID_100520
MFVLNTTLKGFDDTPQSKSKAAARWIIIKYFNDARLFESERLKALRIQWATYYLKVKNETIGV

SEQ ID NO: 217299 - protein, 481 aa, Glycine max
  Coding DNA Sequence Number=SeqID_100521
  Gene Ontology: Mol. function=tyrosine decarboxylase activity; Cellular component=cellular_component; Biological process=amino acid and derivative metabolic process
  Homolog annotation: Hit_ID=Q9AXN7; Match level="QueryCoverage=98%, HitCoverage=95%, E-value=0.0, Identity=67%"; Hit description =Tyrosine/dopa decarboxylase
  Pfam annotation: Domain name=Pyridoxal_deC; Domain location=40-397; Score=593.9; E_value=1.5e-175; Accession=PF00282.9; Description =Pyridoxal-dependent decarboxylase con
MTMNPLDPQEFRRQGHMIIDFLADYYQNIANYPVLSHVEPGYLRELMPSFAPLNPEPIETILRDLQQHIVPGITHWQSPNYFAYFPSSGSTAGFLGEMLSTGFNLVGFNWVSSPAATELESIVMEWLGQVLKLPKAFLFSGSGGGVLLGTTCEAILVTLVAARDKVLSQIGRENICKLVVYVSDQTHCAVQKAAHIIGILPKNIRVVKTMKSTSFTLLPESLVSSIHTDVQKGLVPCYLCATVGTTSTTAIDPLGPLCKVAKEYGMWVHVDAAYAGSACICPEFRHLIDGVEDCCCLWVKDPASVIKSLSTNSVYLENSASDSNQVVDYKDWQITLSRRFRALKVWLVLRSYGVANLRNFLRSHVEMAKTFEGLVRMDKRFEIFVPRNLAVVCFRILPCAVARIGNGRVQNGYLTTEDAANEINRKLLDSINGSGLVYMTHAIVGGAFVIRCAIGATLTEKTHVIMAWKVVQEHADTILNH

SEQ ID NO: 217300 - protein, 221 aa, Glycine max
  Coding DNA Sequence Number=SeqID_100522
  Gene Ontology: Mol. function=metalloendopeptidase activity; Cellular component=proteinaceous extracellular matrix; Biological process =peptidoglycan metabolic process
  Homolog annotation: Hit_ID=Q8LET7; Match level="QueryCoverage=66%, HitCoverage=42%, E-value=2e-16, Identity=34%"; Hit description =Proteinase like protein
  Pfam annotation: Domain name=Peptidase_M10; Domain location=91-212; Score=70.6; E_value=4.9e-18; Accession=PF00413.14; Description =Matrixin
MFKTFFIIFLLSFSVFTPEPLLISATPSLQNPENIQKGVTLESVEITSARKYLKAFGYLEDYETNFNNTDTSNTHDLETSIKKNHETNIVTKMRHLRYVFESGTEGAPLGFLRRVFREAFRQWSFFSGDQGDEFSFDKFGPVLAHAFQPPDGRLHVDADKPWSVEVPIEREYYDFVWVAMHEIGHLLGLGHSSHRRAVMYASVHAGVNRIGGNLMWMMLQV

SEQ ID NO: 217301 - protein, 118 aa, Glycine max
  Coding DNA Sequence Number=SeqID_100523
  Gene Ontology: Mol. function=histone-lysine N-methyltransferase activity; Cellular component=nucleus; Biological process =multicellular organismal development
  Homolog annotation: Hit_ID=Q9SHE9; Match level="QueryCoverage=100%, HitCoverage=68%, E-value=5e-56, Identity=91%"; Hit description=LOB domain-containing protein 4
  Pfam annotation: Domain name=DUF260; Domain location=14-114; Score =248.5; E_value=1.4e-71; Accession=PF03195.5; Description=Protein of unknown function DUF260
MKEGGGRKQGAASPCAACKLLRRRCAQDCVFAPYFPADEPQKFANVHKVFGASNVNKMLQDLPMHQRGDAVSSMVYEANARVRDPVYGCVGAISSLQQQIDVLQTQLARAQAEVAHLR

SEQ ID NO: 217302 - protein, 358 aa, Glycine max
  Coding DNA Sequence Number=SeqID_100524
  Homolog annotation: Hit_ID=Q2QLS0; Match level="QueryCoverage=88%, HitCoverage=75%, E-value=8e-91, Identity=58%"; Hit description=CbbY protein, putative, expressed
MEKLIFFSSSYFLLLEALPERLTQTGFLWTRTALEIASPSIKRLRSLDSIAPTGLNLSIPIFQREVLEMRKRWCFCILIVNFFKERGKIGWPSSLPTNEQGLFAKRVLQQKIYENNLPSVLLFQKQIQKESIDGKKFPIGGREKALEEFVMSKSLPLRPGLEQFIDDAYNEGIPVVILTAYSKSGDNIARSIMEKLGDDRSIKVIIVGNKEVEQSLYGQLVSGKVIASGLDEELAKEAKRAVSAEKQRLAKEVASMLKLSVEIDTGSSESLAKIVAALRAGAEYAGIPVCNCVLVAGSQSGVAGATQVGMPCVVLRSSLTSRAEFPLANATMDGFGGVDLTISKLRNLLPKNSQRTEW

SEQ ID NO: 217303 - protein, 78 aa, Glycine max
  Coding DNA Sequence Number=SeqID_100525
  Gene Ontology: Mol. function=protein binding
  Homolog annotation: Hit_ID=Q8L405; Match level="QueryCoverage=92%, HitCoverage=13%, E-value=2e-20, Identity=66%"; Hit description =Tubulin folding cofactor E
MKDIRLSDNPITDSGRGGVPRFVLIARLAKIQILNGSEVTPRERKDSEIRYVRLVVSRLHASPEEIKQHPRFFRIFGF

SEQ ID NO: 217304 - protein, 159 aa, Glycine max
  Coding DNA Sequence Number=SeqID_100526
  Gene Ontology: Mol. function=hydrolase activity, acting on glycosyl bonds; Cellular component=cellulose and pectin-containing cell wall; Biological process=carbohydrate metabolic process
  Homolog annotation: Hit_ID=O22817; Match level="QueryCoverage=75%, HitCoverage=31%, E-value=1e-32, Identity=54%"; Hit description =Putative polygalacturonase
  Subcellular localization annotation: CTP_CleavageSite=67; ConfidenceScore=5.21e-01
TSYNVVDFGAKPDGTTDATSAFLGAWNKACSSPKPAGIHVPQGRFLIGRAVTFSGQCSNRAISITIRGTLLAPSQYTFLGNSLYWFTFDQVTGLSIHGGVLDARGSFLWDCKYKAMPNCPIGAAGLDAENGLWRIGRIKRLFNVYLPNHLFDMVEIVRK

SEQ ID NO: 217305 - protein, 103 aa, Glycine max
  Coding DNA Sequence Number=SeqID_100527
  Gene Ontology: Mol. function=protein binding
  Homolog annotation: Hit_ID=Q8L405; Match level="QueryCoverage=98%, HitCoverage=13%, E-value=3e-11, Identity=41%"; Hit description =Tubulin folding cofactor E
  Subcellular localization annotation: CTP_CleavageSite=59; ConfidenceScore=5.31e-01
MGEKPSLTKKLPATTTVEYQYYSSNVMLSLSRFKTTLLISFFSQVGKLKFLCESFFKLKSMKLKLYLREEGSPFPMLLDNDTSSLMDLGIGNDSIILVDEESS

SEQ ID NO: 217306 - protein, 269 aa, Glycine max
  Coding DNA Sequence Number=SeqID_100528
  Gene Ontology: Mol. function=hydrolase activity, acting on glycosyl bonds; Cellular component=cellular_component; Biological process =carbohydrate metabolic process
  Homolog annotation: Hit_ID=Q68UW1; Match level="QueryCoverage=89%, HitCoverage=60%, E-value=2e-91, Identity=66%"; Hit description =Polygalacturonase
  Pfam annotation: Domain name=Glyco_hydro_28; Domain location=2-267; Score=202.2; E_value=1.2e-57; Accession=PF00295.8; Description =Glycosyl hydrolases family 28
MASKEVRRSNEVIKFSRSRVMFLCQKTLRFTNSEHIVITGLTSENSQKVHILINACHNVKMHGVKLMADGNSPNTDGIHVQFSTDVTILAPRIQTGDDCISVGPGCRNLWIEDVACGPGHGISIGSLGWDLDEPGVKNVTVRKATFSKTQNGFRIKSWGRPSRGFVQDVHFEHATMNDVQNPIIIDQHYCPFRNGCPSQASGVKISDVSYKDIHGTSATQVAVKFDCSSEQPCERITLEDITFTYKINKAPQALCNHAGGITLGVVQPQ

SEQ ID NO: 217307 - protein, 63 aa, Glycine max
  Coding DNA Sequence Number=SeqID_100529
MSASSSAATRAYDWVSNWGEDKFPYMANASVALSLVAFVAFALASLVSGSIVVDLQLAELACI

SEQ ID NO: 217308 - protein, 293 aa, Glycine max
  Coding DNA Sequence Number=SeqID_100530
  Gene Ontology: Mol. function=protein serine/threonine kinase activity; Biological process=protein amino acid phosphorylation
  Homolog annotation: Hit_ID=Q9FHJ3; Match level="QueryCoverage=89%, HitCoverage=51%, E-value=8e-35, Identity=36%"; Hit description =Serine/threonine-protein kinase Mak (Male germ cell-associated kinase)-like protein
MSIEADEIYKICSVLGSPTTESWADGLKLARDINYQFPQLAGVHLSTLIPSRSDDAISLVTSLCSWDPCKRPTAAESCFYIPPSLRTRAVTRTPPSEMTYGSIGGDPKLVVFLVAAGTRGSLDRLGLKRYSGALPNTKITNNFTSPKVQASIASGKPVPVVPEIEITRHLSAALQKHDTHSFLNITGVQRKLDMANEDGIKSKKSLKTTQQSKYRLPGKGSPTSINKGRTARGVSETAEKLVNMSIGTRRLSLGQTRPPPMKAGVNWISESGNLLRSGQQIPTERTLTRKVAG

SEQ ID NO: 217309 - protein, 99 aa, Glycine max
  Coding DNA Sequence Number=SeqID_100531
  Gene Ontology: Mol. function=kinase activity
  Homolog annotation: Hit_ID=Q10M74; Match level="QueryCoverage=51%, HitCoverage=17%, E-value=1e-12, Identity=68%"; Hit description =Guanylate kinase family protein, expressed
MDSQVAETPILSTMKHTLDNFIFNDLTNKSNHSTFCETLPNLLLQHALVVTVDQSVLQQLLPLHHPKKLLLGDEDVVLPINLDRVAGRVVVVTRKWRVQ

SEQ ID NO: 217310 - protein, 67 aa, Glycine max
  Coding DNA Sequence Number=SeqID_100532
MEREGLTALARDVSFDGKCLGRVWKPLQKNDGRGRRRHEGPHVHADAMQQHTEVSLTCVGSMTRVGF

SEQ ID NO: 217311 - protein, 993 aa, Glycine max
  Coding DNA Sequence Number=SeqID_100533
  Gene Ontology: Mol. function=protein binding; Cellular component =membrane; Biological process=defense response
  Homolog annotation: Hit_ID=Q1SWU6; Match level="QueryCoverage=98%, HitCoverage=97%, E-value=0.0, Identity=55%"; Hit description=Disease resistance protein
  Pfam annotation: Domain name=LRR_1; Domain location=594-615; Score =11.0; E_value=2.5; Accession=PF00560.23; Description=Leucine Rich Repeat
  Pfam annotation: Domain name=LRR_1; Domain location=617-639; Score =11.2; E_value=2.3; Accession=PF00560.23; Description=Leucine Rich Repeat
  Pfam annotation: Domain name=LRR_1; Domain location=641-663; Score =9.8; E_value=4.2; Accession=PF00560.23; Description=Leucine Rich Repeat
  Pfam annotation: Domain name=LRR_1; Domain location=772-793; Score =7.0; E_value=14; Accession=PF00560.23; Description=Leucine Rich Repeat
  Pfam annotation: Domain name=LRR_1; Domain location=870-894; Score =1.6; E_value=1.4e+02; Accession=PF00560.23; Description=Leucine Rich Repeat
  Pfam annotation: Domain name=LRR_1; Domain location=899-921; Score =7.1; E_value=13; Accession=PF00560.23; Description=Leucine Rich Repeat
  Pfam annotation: Domain name=NACHT; Domain location=192-343; Score= -41.0; E_value=0.09; Accession=PF05729.3; Description=NACHT domain
  Pfam annotation: Domain name=NB-ARC; Domain location=151-453; Score =263.8; E_value=3.5e-76; Accession=PF00931.13; Description=NB-ARC domain
  Pfam module annotation: Pfam domain module=LRR_1::LRR_1::LRR_1::LRR _1::LRR_1::LRR_1::NACHT::NB-ARC; Domain location=594-615::617 -639::641-663::772-793::870-894::899-921::192-343::151-453
MAEFVLEIVLENLISLVRKELVLFLGFDQDLERLSSLFTTIKATLQDAEEKQFSNAAIKDWLGKLKYAAHVLDDFIDECAYEGLRLENQGVMCGPSDKVQCSCLSSLHPKRVVFRYKIVKKMKRISQRLIQIAEERTKFHLTEMVPERRSGVLEWRQTVSLLTEPKVYGREEEKDKILDFLIGDASHFEDLSVYPITGLGGLGKTTLAQFIFNHEKVVNHFELRIWVCVSEDFSLKRMTKVIIEAASGRACEDLDLEPQQRRLQDLLQRKRYLLVLDDVWDDKQQNWQRLKPVLACGAKGASILVTTRLLQVAKIMGTLPPHELSVLSDNDCWELFKHQAFGPNEGEQIELEKIGKEIVKKCQGMPLAAKALGGLLRFKRNKNEWLNAKESNLLELSHNENPISHVLRLSYLNLPIEHKQCFAYCAIFPKDESIGKQYIIELWMANGFISSNERLDALDVGDDLWNELYWRSFFQDIETNEFGNITSFKMHDLVHDLALSVAEDVCCTTKDSRVTTFPGRILHLSDHRSMQNVHEEPIDSVQLHLFKTLRTYILPDHYGDQLSPHPNVLKCHSLRVLDFVKREKLSSSIGLLKHLRYLNLSGGGFETLPESVCKLWNLQILKLDRCSRLKMLPNSLVCLKALQQLSFNGCPELSRLPPRIGKLTSLRILPKFFVGKERGFRLEELGPLKLKGDLDIKHLENVKSVMDVKEANMSSKQLNKSFLSWEKNENCELEDNVEETLEVLQPDTQQLWRLEVDGYEGAHFPQWISSLSLKYLNLKDCKNCLQLPPLYKLPSLNTLRILNMIHVEYLYEESYDGEVVFRALEELTLRRLPNLKRLSREDRENMFPCFSRLEIDECPKFFGEEVLLQGLRSLSVFNCGKFNVSSAVEDLQALQDMTSLQELRLTGLPKLESLPDCFGDIPLLHTFSIFYCSKLTYLPMSLRLTTSLQQLTIFGCHPELEKRCDKETGEDWPNIVHISHISLGIKHYDHNSD

SEQ ID NO: 217312 - protein, 71 aa, Glycine max
  Coding DNA Sequence Number=SeqID_100534
MGGCGLRFQLKLKLDKYSTDSPVHHQRMDKNRSWAVEAGGGGVVAPEGEIECGVRESFKKKTRAVETGKHE

SEQ ID NO: 217313 - protein, 266 aa, Glycine max
  Coding DNA Sequence Number=SeqID_100535
  Gene Ontology: Mol. function=cysteine desulfurase activity; Cellular component=chloroplast; Biological process=cysteine metabolic process
  Homolog annotation: Hit_ID=Q1SA25; Match level="QueryCoverage=90%, HitCoverage=48%, E-value=1e-96, Identity=75%"; Hit description =Aminotransferase, class V
  Pfam annotation: Domain name=Aminotran_5; Domain location=79-264; Score=-37.6; E_value=7.7e-11; Accession=PF00266.9; Description =Aminotransferase class-V
  Subcellular localization annotation: CTP_CleavageSite=40; ConfidenceScore=5.63e-01
MEVLLPKLPSFKFPSATYCCSITSRSSSYVRFGFRRVSVCASTVNETVAEPTVGSSSLGHSTRPHFPILHQEVNGSKLVYLDNAATSQKPTTVLKALQNYYEAYNSNVHRGIHFLSQMLYCIIVYGCSAKATDEYESARRKVASFINATDSREIIFTKNASEAINLVAYSWGLSNLKPDDEIILTVAEHHSAIVPWQIVAQKTGAVLNFVDLNQDEIPDIDKLKEMLSRKTKIVVVHHLSKIPDYITKRSLGFEGLYTGFNNVFPP

SEQ ID NO: 217314 - protein, 87 aa, Glycine max
  Coding DNA Sequence Number=SeqID_100536
MTRSSLAALRLHLRHPHHPSTILLYITSLGKLVSWFGCRCYLVGDGGSFVKMALFEKKKKMNRGRWRHVPLCFFTSKTGEEKGLLLG

SEQ ID NO: 217315 - protein, 394 aa, Glycine max
  Coding DNA Sequence Number=SeqID_100537
  Gene Ontology: Mol. function=protein binding; Cellular component =membrane; Biological process=defense response
  Homolog annotation: Hit_ID=Q1S6X1; Match level="QueryCoverage=91%, HitCoverage=51%, E-value=1e-68, Identity=43%"; Hit description =Disease resistance protein; Short-chain dehydrogenase/reductase SDR
  Pfam annotation: Domain name=LRR_1; Domain location=238-263; Score =1.2; E_value=1.7e+02; Accession=PF00560.23; Description=Leucine Rich Repeat
  Pfam annotation: Domain name=LRR_1; Domain location=279-299; Score =7.3; E_value=12; Accession=PF00560.23; Description=Leucine Rich Repeat
  Pfam annotation: Domain name=LRR_1; Domain location=301-323; Score =11.1; E_value=2.4; Accession=PF00560.23; Description=Leucine Rich Repeat
  Pfam annotation: Domain name=LRR_1; Domain location=325-347; Score =1.7; E_value=1.4e+02; Accession=PF00560.23; Description=Leucine Rich Repeat
  Pfam annotation: Domain name=LRR_1; Domain location=44-66; Score=0.7; E_value=2.1e+02; Accession=PF00560.23; Description=Leucine Rich Repeat
  Pfam module annotation: Pfam domain module=LRR_1::LRR_1::LRR_1::LRR _1::LRR_1; Domain location=238-263::279-299::301-323::325-347::44-66
MRNLFEESVNSVHLRLVKSLRTYILSDHYGDQLSPHSNVLKCHSLEVLDFVKRQNLSSSIGLLKHLRGFRLEELGPLKLKGDLDIKHLGNVKSVKDAEKANMSSKQLNNLLLSWDKNEESESQENVEEILEVLHPDTQQLWRLDVEGYKGFHFPQWISSSPLKHLMLKDCENCLQLSPIAKLPSLKTLRILNMIHVEYLYEESYDGEVVFRALEDLSLCRLPKLKRLSREDGENMFPCLSILEIDGCDRFLGEEVFLHRLHSLTLINCGKINVSAGFNCLEKLWISECRVESLQALQDMTSLKELRLRNLPKLETLPDCFGNLPLLHTLSIFFCSKLTCLPMSLSFSGLHQLTIFGCHSELEKRYEKETGEDWPNIAHIPHISVGSNLYDHISD

SEQ ID NO: 217316 - protein, 177 aa, Glycine max
  Coding DNA Sequence Number=SeqID_100538
MPPVVSLVTIEAQPALPVGCNLLRGQPLDGGGRVKAGVVWGVVGVAHQQSFPPADEPGLPPERGGKANRAVCEFFEGGKPCHEVNWWLLFIHWNQDKARPSMGSNRGRRRRRHWVREHRRKTVEELIKFQSHGLKGLSKGNLVGCKLADGFFEGKGRVGHGGGINESTKMIGGEIED

SEQ ID NO: 217317 - protein, 326 aa, Glycine max
  Coding DNA Sequence Number=SeqID_100539
  Gene Ontology: Mol. function=RNA-directed DNA polymerase activity; Cellular component=chromatin; Biological process=chromatin assembly or disassembly
MDGRALSWFQWMNSNHQFTSWQGFLQALQTCFAPSQYEDPTGTLFKLTQRGTVAEYLAAFEELANRTIGLPPPFLLSCFVSGLTPEIRREVAGLARLQEEKIADARPQLRPKPPPPLPSPSITQPLPLRTLNPNPTPLLPSPSRPTPPAVKRLTPEEIATHRERGLCFNCDERYHRGHRCSSRVFLLISEDDDLPPFQIPQPNPQPEPEPQTPDPIDPYPAQISFNSLAGNVAPETLHFMGTIGNRHVVLLVDGGSTHNFIQHQLVSQLSLTPRTTTPLRVLVGNGQQLECSSVCESVPVTIQATEFIVDLHVLPIAGANVVLGVQ

SEQ ID NO: 217318 - protein, 97 aa, Glycine max
  Coding DNA Sequence Number=SeqID_100540
MEKDASHVGPWNLGFNPFFFSQTFGNLNRSIRGEALENTRNITIDNRERLNDYIECCYSVIPKIIQVLEFENIMVRFEGLDLNQEGETLTDSSECRP

SEQ ID NO: 217319 - protein, 113 aa, Glycine max
  Coding DNA Sequence Number=SeqID_100541
MSSFGSGDLIQNFGMSVNTSITTIVGRVLGSPELKLGDPNRKIIKLTVDMEKCHWNLSGRSMVEGKPIEYWGILDFTSCGSYKYKLRGKEFIQKLIGSPIWYEESSMEDTCKL

SEQ ID NO: 217320 - protein, 940 aa, Glycine max
  Coding DNA Sequence Number=SeqID_100542
  Gene Ontology: Mol. function=binding; Cellular component=ubiquitin ligase complex; Biological process=protein ubiquitination
  Homolog annotation: Hit_ID=Q6H6D6; Match level="QueryCoverage=87%, HitCoverage=84%, E-value=1e-165, Identity=39%"; Hit description =Transducin-like
MASFGEQHSTQYPTPERPKHKLSQHEKKPLSAYICHDPRSLGSSKHKAEKGTTQTQSMSSSSQFTRGGSASERSNSKSLVSADSRRVGHLMDDVSIKAVIAILSGYIGRYVKDDKFRETMRDKCSSLLDRRRTTTTTKDSGGEVFVNMELGMKKVDRLVENQGTMEQVRMIKRLRNSIELLTIVSSLNSKTSRDASTCGVPNSHLSACAQLYLAIAYKLQKNDRVSSKHLLQVFCDSPNLARTYLLPDLWEHLFLPHLLHAKIWYNTELEFLSNEAHGQKEKKMKVLSKVYNEKMDMGTNLFAQYYKQWLKVGASEPPLPNVSLPSRPSYRSSRRSSDSFISNSSINPNLYKTVFGSKLEQKTTGLGDQNGVLAITTGLEIDEKLYVDEHRCSSVQKYDRVFVERSSQLGKSQAQLWPVPQRSDYFQCLSCRFIPEESFKNSNYRSKNVSTLSRDFVGAITTICSSDVLSECEFAIRVVTKAWLNSPGDPLVEEALTQPNVVEAMLEVLFSSTEDEILELIISILAELIGKNDAIRQIILNSDPQLEIFVRLLKSTSLFLKAAVLLYLSKPKAKQMLSSEWVPLILRVLEFGDKLQTLFTVQCSPQVAAFYVLDQILTGFDEDKNLENARQVLSLGGLTLLMRRIDGEVHERNNAAMIISCCIRAEGSCRSFLADNINKTSLLELIVIGSKQNSSGYALSVLAELLYLDRYMLRGLNFHTRRTKTLNFLRGLKDGWGGFNVMHIFFIYLQKSPPEERPIVAVILLLLDLMFTNAVAVVLQEDPFKGSLHRSEAIETLIEALNCQTCNDRVQQQSARALVLLVGHFSDSGESLMEKLLLQKAGFREICLEDSYPGKEIVVYDPIHKNVEEEEAESWQKRAACVLFKSGNKNLLSALADSIANGIPCLARASLITISWMSSYLNMVEDRKLPPMIFHHGVSQ

SEQ ID NO: 217321 - protein, 1006 aa, Glycine max
  Coding DNA Sequence Number=SeqID_100543
  Gene Ontology: Mol. function=protein binding; Cellular component =membrane; Biological process=defense response
  Homolog annotation: Hit_ID=Q1SWU6; Match level="QueryCoverage=99%, HitCoverage=97%, E-value=0.0, Identity=55%"; Hit description=Disease resistance protein
  Pfam annotation: Domain name=LRR_1; Domain location=593-614; Score =12.8; E_value=1.2; Accession=PF00560.23; Description=Leucine Rich Repeat
  Pfam annotation: Domain name=LRR_1; Domain location=616-638; Score =12.6; E_value=1.3; Accession=PF00560.23; Description=Leucine Rich Repeat
  Pfam annotation: Domain name=LRR_1; Domain location=640-662; Score =8.2; E_value=8.5; Accession=PF00560.23; Description=Leucine Rich Repeat
  Pfam annotation: Domain name=LRR_1; Domain location=774-795; Score =1.9; E_value=1.3e+02; Accession=PF00560.23; Description=Leucine Rich Repeat
  Pfam annotation: Domain name=LRR_1; Domain location=825-848; Score =0.8; E_value=2e+02; Accession=PF00560.23; Description=Leucine Rich Repeat
  Pfam annotation: Domain name=LRR_1; Domain location=851-876; Score =0.1; E_value=2.7e+02; Accession=PF00560.23; Description=Leucine Rich Repeat
  Pfam annotation: Domain name=LRR_1; Domain location=892-913; Score =6.2; E_value=20; Accession=PF00560.23; Description=Leucine Rich Repeat
  Pfam annotation: Domain name=LRR_1; Domain location=915-937; Score =10.6; E_value=3; Accession=PF00560.23; Description=Leucine Rich Repeat
  Pfam annotation: Domain name=NB-ARC; Domain location=151-452; Score =291.9; E_value=1.2e-84; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::NB-ARC; Domain location=593-614::616 -638::640-662::774-795::825-848::851-876::892-913::915-937::151-452
MAEFTLETVLRNLNTLVQKELPLFLGFDKDLERLATLFTTIKAALEDAEEKQFSDRAMKDWLGKLKDAALILDDIIDECAYEGLALENQRVKSGPSDKVQGSCLSSFNPKRVVFRYKIATKMKGINERLIEIAEERKKFHLTELVRERRSEVIQLRQTGSSITETQVFGREEDKNKILDFLIGDATHSEELSVYPIAGVGGLGKTTVAQLIFNHERVVNHFELRMWVCVSEYFSLKRVTKAIIEAAGHTCQDLDLESQQRRLHDLLQRKRYLLVLDDVWDDNQENWQRLKSALACGAKGASLLVTTRLLKVVAIMGTLPRHELSVLSDNDCWELFKHQAFGPNEEEHVELEDIGKEMVKKCRGMPLAAKALGGLLRFKRNKNEWLNVKENNLLELSHNENSIIPVLRLSYLNLPIEHKQCFAYCAIFPKDESIGKQYLIELWMANGFISSNERLDVEDVGDQVWNELYQRSFFQDIETDEFGKVTSFKMHDLVHDLAQSIAEDVCCIAEDNRVTTLPERIHHLSDHRSMWNVYGESKNSVLLHPVKSLRTYILPDHYGDQLSPHPDVLKCLSLRVLDFLKQETLSSSIGLLKHLRYLNLSGGGFETLPESLCKLWNLQILKLDRCNRLKMLPKSLVCLKALRQLSFNDCQELSSLPPQIGMLTSLRILTKFFVEKEKGFRMEELGPLKLKGDLDIKHLGNVKSVIDAKEANMSSKQLNKLRLSWDKNEDLKLQENVEEILEVLQPDAQQLWRLDVEEYKGVHFPGWMSSPSLKYLTLLNLLNCENCFQLPPLGKLPSLKILGIMKNNHVEYLYEESYNGEVVFGALEVLTIRHLPNFKRLSREDGKSMFPRISILEIDECPEFLGDEVLLKGLDSLSVFNCDKFNVSAGFQHLWKLWISNCRDVGDLHALKDMTSLKVLRLRNLPKLESLPNCFGNLPLLCELSIFFCSKLSCLPTSLSLINLQHLTIFGCHPDLEKRCEKETREDWSKIAHVPYISVGSKHYSPD

SEQ ID NO: 217322 - protein, 303 aa, Glycine max
  Coding DNA Sequence Number=SeqID_100544
  Gene Ontology: Mol. function=translation initiation factor activity; Cellular component=cytoplasm; Biological process=multicellular organismal development
  Homolog annotation: Hit_ID=Q9C793; Match level="QueryCoverage=84%, HitCoverage=30%, E-value=8e-57, Identity=43%"; Hit description =Pinhead-like protein
  Pfam annotation: Domain name=Piwi; Domain location=2-257; Score =146.5; E_value=7.3e-41; Accession=PF02171.8; Description=Piwi domain
MAKKSPGYKYLKWISETKLGIVTQCCLSNSANEGEDKFYTNLALKINAKLGGSNVELRVDVNHPGYQDTKSPSITAAVATVNWPATNRYAARVFPQYNRSEKILNFGDVCLELVACYRRMNGVRPERIVIRDGVSEYQFDMVLNEELLDLKRVFQGVNYFPTITLIVAQKRHQTRFFPVGISCRQQLWTQNYYGNLGTSKPTHYHVLWDKHKFTSDELQKLIYEMCFTFAKCTKPVSLVPSVYYVDLAVYRGRLYREARIGMQSPKSTASSSSKDASSASRTASFELGFYTLHADLENIMFLI

SEQ ID NO: 217323 - protein, 511 aa, Glycine max
  Coding DNA Sequence Number=SeqID_100545
  Gene Ontology: Mol. function=zinc ion binding; Cellular component =integral to membrane; Biological process=ubiquitin cycle
  Homolog annotation: Hit_ID=Q2QLR6; Match level="QueryCoverage=97%, HitCoverage=96%, E-value=1e-152, Identity=54%"; Hit description=Zinc finger family protein, putative, expressed
  Pfam annotation: Domain name=C1_4; Domain location=297-342; Score= -12.1; E_value=0.078; Accession=PF07975.2; Description=TFIIH C1-like domain
  Pfam annotation: Domain name=IBR; Domain location=265-337; Score =43.5; E_value=7.1e-10; Accession=PF01485.11; Description=IBR domain
  Pfam annotation: Domain name=zf-C3HC4; Domain location=198-249; Score= 14.1; E_value=0.0055; Accession=PF00097.15; Description=Zinc finger, C3HC4 type (RING finger)
  Pfam module annotation: Pfam domain module=C1_4::IBR::zf-C3HC4; Domain location=297-342::265-337::198-249
MGDQGVNVGREEEEDEFCSCCGDEDEEVWKETEEPVVEKGLKDELDEFSVKMFFKGLSMAGVENLSSGFSGIGVFMERSSGLPAIRVQKKLDFYAEESVVDYLALLDGLLEAVQKKIRRVFAFTDSELLHDQITFGKKLEMPLLTALRERILELANNFEDFVLKLIPSSDLEQPLHLAKVAIGLVTFPVNDERLLKNCSICCDDKPVPIMITLKCSHTFCSHCLRAYADGKVQSCQVPIRCPQPGCKYCTSVTECRSFLPFTSFESLEKSLSEANIGCSDRIYCPFPNCSVLLDPHECSSARDCSSSQSDNSCIECPVCRRFICVDCKVPWHSSMSCVEYQNLPEERDASDITFHRLAQNKRWKRCQQCRRTIELTQGCYHMTCWCGHEFCYSCGGEYREGQQTCQCAYWDEDNSDDSVAHSLQESEQWAWETFNSLSMIVDAYSDQERSQLALIQRFLTGGFSLSDHNPYQSPPRSTESYVDPMKDLHQLPWLERFVSVISDNYYEDYIQ

SEQ ID NO: 217324 - protein, 438 aa, Glycine max
  Coding DNA Sequence Number=SeqID_100546
  Gene Ontology: Mol. function=transferase activity, transferring glycosyl groups
  Homolog annotation: Hit_ID=Q7XAG2; Match level="QueryCoverage=87%, HitCoverage=84%, E-value=1e-114, Identity=56%"; Hit description=GDP -fucose protein-O-fucosyltransferase 1
  Pfam annotation: Domain name=DUF246; Domain location=69-403; Score= -144.3; E_value=3.1e-06; Accession=PF03138.5; Description=Plant protein family
MEVLAGALHSITSKCMVLLVTVLILRALLFASFPGFGGIEWGNLVYLRAPLLNFDFGIRQDKFLVVPQLVWGLNNQKIAFARACLTARLLNRTLLMPSLSASLFYKEIDLLQPISFDKVFQFEKFNALCRGFVRLGRYSDVLNRTEVLEMEKGSGRRWTVERDLSQLKEHSEGSFDDYEIIRIIGKNPFLWHDHWPVKDYARIFECLDLTEEIAKEADRVVSRIRAVGREVTGNTEAVEVKSSIITSDGSSFQPLPFVAVHMRIEIDWMIHCKNLERRLNTNRICSGKKAIVERVRNIAGLKTPVVVYLAVADKLLNNSSILDGWEEGFLPFEKKKLGVVGIYKKYPYLIQSAIDYEVCLKADIFVGNSFSTFSSLIVLERTQKMIRMSVTNMCGENVRWPSYAYNIPGESNGPMRWVTNMSESSLQAISYGTNHISC

SEQ ID NO: 217325 - protein, 64 aa, Glycine max
  Coding DNA Sequence Number=SeqID_100547
MAMKQIAGSQGASAIASCFSSWFVKLRHTWHNRVPQHIIRDKPRVLFGNIIVIINDQAYKHICN

SEQ ID NO: 217326 - protein, 142 aa, Glycine max
  Coding DNA Sequence Number=SeqID_100548
MTTTTVTIIIVVPSPLSSTITTSVAMTFIVVVATIVAVTTMIVIATTIVINYHHHCYRDCGSGDDNDSDDGHADGGGDSHGDGDGLMVIEIFYNVICLMNLLEIVHFFLTYVCELMLEKKKVLEDGAFSTIGYEGGEDQGKL

SEQ ID NO: 217327 - protein, 77 aa, Glycine max
  Coding DNA Sequence Number=SeqID_100549
MVATTTMKVIATEVVMVDDSGDGTTIMMVTVVPSILITMTATTFANRTIIVIVTTTVFVSSGGGNNDDMFGGKAGDG

SEQ ID NO: 217328 - protein, 175 aa, Glycine max
  Coding DNA Sequence Number=SeqID_100550
  Subcellular localization annotation: CTP_CleavageSite=50; ConfidenceScore=5.30e-01
MGFANLHMANLWKWKFGSIPKMSIGQAGRWMSPLPASLGCHRWSGLPELSSSSSTSSISILASTQLLGLPPLHEDDFKFKYLHLLERVLKQNVSQAPLVYKGLPNYAIGYLYANNHGIILYQAVARNGVYNPPWLVESDHDYGGTDNVLSSRPLVGGHNAILGVADPSSCRLRLC

SEQ ID NO: 217329 - protein, 158 aa, Glycine max
  Coding DNA Sequence Number=SeqID_100551
  Homolog annotation: Hit_ID=Q9LK80; Match level="QueryCoverage=79%, HitCoverage=24%, E-value=3e-40, Identity=59%"; Hit description =Arabidopsis thaliana genomic DNA, chromosome 5, TAC clone:K23F3
MQGKGFRALSQFAFKNTDICWEELEWKGKHGQSLAMVATKPHYFLDLDIQRTVENFLDNVPEFWSFEEFAESVKDDDIFFIDRSFFVHYFIALMHKQEFRDVWDVVNEFLMQQPFSSLCRLLLITLEDQDFATLWNCFISLSALNWNFNIPMTSLICL

SEQ ID NO: 217330 - protein, 152 aa, Glycine max
  Coding DNA Sequence Number=SeqID_100552
MPLSPRTTPVSSHRDALDQNEARIVALESSIEILKKTTSKQGNHIAEIKKSVEGINDMKGMLKRWMEKQGIMDEGDNILAKKCQEPYLEGIHNSTVEEVWQQWARHWKQRRKVSDIRIREIGTWVSGFNLQVATFYVATFQPADEEEETEEI

SEQ ID NO: 217331 - protein, 150 aa, Glycine max
  Coding DNA Sequence Number=SeqID_100553
  Subcellular localization annotation: CTP_CleavageSite=26; ConfidenceScore=5.06e-01
MSSRSASTPSRTLGGALVPTESQSFSTSKAGSVHVAKWENELNLKLDSADSANWAKRASIAKHSFGVLSATKESRRASILGLCAKHEISVLSVAVVFIQAQRMTGAKLKSTYSVRIQRITITHRSQSTTQCLFQEKALEAARGAAFAEIP

SEQ ID NO: 217332 - protein, 397 aa, Glycine max
  Coding DNA Sequence Number=SeqID_100554
  Gene Ontology: Cellular component=membrane
  Homolog annotation: Hit_ID=Q69NN6; Match level="QueryCoverage=94%, HitCoverage=53%, E-value=2e-62, Identity=37%"; Hit description =Mechanosensitive ion channel domain-containing protein-like
MEKTRPSDQVVLFLDQHNPKPPSIESENHQNKPKHPLKVRTLNRLSFSKPKSRILEYNYNVPRNKVAISEEISDVIQPTYKLSSNDDDKEDDEDDCEWDEDETEEDGSEHGPKLHQKRKCKIKWRLMMEWILFLNILTCLVCSLTISSITNMHLLGLEIWKWCLMAMVTFSGRLVSGWLVGLTVFIIERNFMLREKVLYFIYGLRKSIRNCMWLGLVLLSYWSVVFDDVQKKNHKFLNKVFQALVAVLVGATIWLLKIVLVKMLASSFHVTTYFDRMKESVFHHYILETLSDPPMMDDVAEQQHHLTRWNNAKNLNKSKKFGSRRIDMEKLRKLSMESTASAWSVKRLVNYVRSSGLSTISRTVDDFGNAESEINSEWEARNCAQRIFKNVAKPGAK

SEQ ID NO: 217333 - protein, 237 aa, Glycine max
  Coding DNA Sequence Number=SeqID_100555
MPSTTAAESRSLYTPPKIEVRSGGAFGHCIGGGRRLALPVRYGNDGGPGDVGVRLRARNGFRQEQRQQTSLVSIRGNHGKFGLGYKPTQADIRKSIAERKNRGQGSRLGQQVEGAPPCHISRSFISVGLRHEGQVVAICEDDSPSRSDLVRPCPPSFRLGNWRVEERPDIYATSIISDDESLEGTNTRDPAIDFKQEAGQTESEENEDVGLPPELERIVAQEDRKMGPDVPSFSSIF

SEQ ID NO: 217334 - protein, 440 aa, Glycine max
  Coding DNA Sequence Number=SeqID_100556
  Gene Ontology: Mol. function=calcium ion binding; Cellular component =membrane; Biological process=superoxide metabolic process
  Homolog annotation: Hit_ID=Q69NN6; Match level="QueryCoverage=64%, HitCoverage=37%, E-value=1e-79, Identity=51%"; Hit description =Mechanosensitive ion channel domain-containing protein-like
  Pfam annotation: Domain name=MS_channel; Domain location=210-418; Score=29.9; E_value=1e-07; Accession=PF00924.9; Description =Mechanosensitive ion channel
MVVQQYVEWVLERFNMKNVKLVSPPLANHFKLNKMSCPTSPNEKEATMVAIPYSSTVESLMYAMVYTRPDIANAVGVVSSKNVIYHSRTKHIDARYHWLGQEVEEHYIKLEKIHTDKSPTDIKTKVVAREKLQLCGKVIDMDCLYIEEEDLMRFLKRVEIHTIFPLFEGALETGHISRSSFRNWVIRAYYERKALAQSLNDTKTAVQQLHKIASAIVSVIIIIVMLLVMEVATLKIILFCITQTVLIGVAFQGTCKTVLEAIIFVFVMHPFDIGDRCVIDGVHMIVEEMNILTTVFLRYDNEKIYYPNAVLLSKPISNFYRSPEMCDSIDFTIDVSTSMETILALKKSIQMYIESKPKYWNPKHSMIAKGIENMDKLKLCLSVQHTINHQNYGERNVRITELLLELKKIFEIHGIKYHLLPQEIQITHMNIEHGKVLFQS

SEQ ID NO: 217335 - protein, 270 aa, Glycine max
  Coding DNA Sequence Number=SeqID_100557
  Homolog annotation: Hit_ID=Q7WES4; Match level="QueryCoverage=56%, HitCoverage=72%, E-value=5e-45, Identity=61%"; Hit description =Putative exported protein
RLLAPLQLARGRRGRWPRAGGFPEPRADRDPPVAAGYPYAGFHAGQRHRGRGGVRHRLGAAAAGDRGRSRGAAGAGHGADALAVCQHAGAAAHRVAALWAGHRRAGQGHGQARLAARAGVGDRHHADRGRGGGHRSQPARGAGARIPEVGRGQAVTVFSSPRRMAVATAARRPRTCSLRQALRRWKLTVLSLMSRMRAVSQLVLPMALQCSEADSRGESRTGAGARGMAEAGLADMTDRALIAWKKTTHAPTPDGHRTSGDAATYLTLNL

SEQ ID NO: 217336 - protein, 73 aa, Glycine max
  Coding DNA Sequence Number=SeqID_100558
MSLSLQSQSFTSFPCPTPDQFRAEVAWPGDWPEAQAGEAPAGAPAEAPDEAEEAREDEEMTDLLDFLGGSGAA

SEQ ID NO: 217337 - protein, 275 aa, Glycine max
  Coding DNA Sequence Number=SeqID_100559
  Gene Ontology: Mol. function=transition metal ion binding; Cellular component=nucleus; Biological process=regulation of transcription
  Pfam annotation: Domain name=Transposase_21; Domain location=105-275; Score=220.7; E_value=3.2e-63; Accession=PF02992.5; Description =Transposase family tnp2
MYDTLESDSKNSLYPGCKKSMTLLSVVLSLVNVKAKYGWSDKSFTSLLQVVQDMLPEENTLPKMKDDDERSNDESIKKGSPAKVLWYLRIIPRFKHLFANGDDAKDLTWHADGRNCDGMLRHPADSSHWKKINRLYPDFGKEERNLRLGFATNAMNPYGSLSTQHSSWLVLLVIYNLAPWLCMKQKYMMLSMMISGPRQQGIDIDVYHSPLIEDLTKLWDERVIVFYVYPKGTFKLRAMIFFTINDFPAYGNLSGYTVKSHHACPIYEEDTSYVQ

SEQ ID NO: 217338 - protein, 214 aa, Glycine max
  Coding DNA Sequence Number=SeqID_100560
  Gene Ontology: Mol. function=aminomethyltransferase activity; Cellular component=cytoplasm; Biological process=glycine catabolic process
  Homolog annotation: Hit_ID=Q1H016; Match level="QueryCoverage=98%, HitCoverage=64%, E-value=5e-48, Identity=49%"; Hit description =Glycine cleavage T protein
KVLVEDASDRLLTVGLASDKLSTSIEHLPATPHQLSSTNLGTLIRLADAGNQQRALLVVQSEGAQACWQSLVATFTPSSTSAWEALEIQAGIPQVYAATKEQFVPQMVNLDALNGINFKKGCYTGQEIVARTHYLGKVKRRTLLAQLSSEQAPQAGDILQDAQQQEAGQLVRVAPSTDRGWWLLAECRLEAKEAGTISWQGQPLAFKELPYALA

SEQ ID NO: 217339 - protein, 118 aa, Glycine max
  Coding DNA Sequence Number=SeqID_100561
  Gene Ontology: Cellular component=integral to membrane; Biological process=cell cycle
  Homolog annotation: Hit_ID=Q1H012; Match level="QueryCoverage=58%, HitCoverage=65%, E-value=5e-17, Identity=64%"; Hit description =Septum formation initiator
  Pfam annotation: Domain name=DivIC; Domain location=1-66; Score=46.3; E_value=1e-10; Accession=PF04977.6; Description=Septum formation initiator
SWLRVWQYAQQIEAHEKRNEYYRQRNETLRAEVRDLKQGQSAIEERARSELGLVKQDEVFFQVIQNKQPGLSNKSTSPLDAKPAAAKQLEAKPVDAKPAMVKPPGPNHDVPEPLPEAQ

SEQ ID NO: 217340 - protein, 48 aa, Glycine max
  Coding DNA Sequence Number=SeqID_100562
MTPRSTATKSEPWAWKGKPSSCRLKSEIPSMSHLRLSMNESSKPSFKW

SEQ ID NO: 217341 - protein, 125 aa, Glycine max
  Coding DNA Sequence Number=SeqID_100563
MVNIPRFSRARWEKSKPVEKEVLGYGGCGHECKGENGRKGKKGKKANTRGGGDKHDNSAMVEFTITKDIEEKCLRAYVGKVKNKGDSYLTRQKFHLEGLFGMRATPLGSSLVLLENANVKELVIT

SEQ ID NO: 217342 - protein, 105 aa, Glycine max
  Coding DNA Sequence Number=SeqID_100564
  Subcellular localization annotation: CTP_CleavageSite=59; ConfidenceScore=5.17e-01
MHSDCLVQFSILNLFRSPMNCLFVHASYTFEFGAMRSDCLVQFSILNPFRSPMNCLFVHASSTFEFGAMRSDCLVQFSILNPFSEPHELRFRSCVFHLRIWSHAQ

SEQ ID NO: 217343 - protein, 100 aa, Glycine max
  Coding DNA Sequence Number=SeqID_100565
  Homolog annotation: Hit_ID=P94078; Match level="QueryCoverage=85%, HitCoverage=8%, E-value=9e-28, Identity=67%"; Hit description=Alpha -mannosidase
IQGKLYLRIDHKGEGANWCRTVGQELYSPLLLAFTEQEGDNWLHFIPSTFSGIDSSYSLPDNTALLTLQEFKNGKVLLRLAHLYEVVFFFTDVLITLVLS

SEQ ID NO: 217344 - protein, 77 aa, Glycine max
  Coding DNA Sequence Number=SeqID_100566
MAKGSVVVVQPSCNPFLTASRYLTSIVRQSVEFRDMPEVEGKHCCTIRKVPQHSRSQRRGVQIAIRPTWAFQDVPTE

SEQ ID NO: 217345 - protein, 81 aa, Glycine max
  Coding DNA Sequence Number=SeqID_100567
GNLWVRMLDSKYEGLKGLDEGGVKSCESIWWRDLKLNKNMKSWETWELGKMRYGNGSFLGGDHGLIGKGTGSLSLRGCWRV

SEQ ID NO: 217346 - protein, 52 aa, Glycine max
  Coding DNA Sequence Number=SeqID_100568
  Homolog annotation: Hit_ID=Q9SH30; Match level="QueryCoverage=77%, HitCoverage=4%, E-value=8e-11, Identity=78%"; Hit description =Putative copper-transporting ATPase 3
VDCIVFDKTGTLTVGKPVIVRTELLTKMVLQEFYELVAAGEEGVSTISLSKA

SEQ ID NO: 217347 - protein, 125 aa, Glycine max
  Coding DNA Sequence Number=SeqID_100569
  Gene Ontology: Mol. function=signal transducer activity; Cellular component=membrane; Biological process=signal transduction
  Homolog annotation: Hit_ID=Q6D133; Match level="QueryCoverage=98%, HitCoverage=19%, E-value=3e-27, Identity=52%"; Hit description =Putative methyl-accepting chemotaxis protein
MSLGIKLSVLTSFSVAIVLFALTLTLSHNAARQLEQLAVDDMQNQVLGINEMATMFNATLSEEVANYTRLFQSFLPKRFSRDDSSRIQVGSFSTPTLRAGLKTLNLDQIAVDDFLDRTGAVSTIF

SEQ ID NO: 217348 - protein, 126 aa, Glycine max
  Coding DNA Sequence Number=SeqID_100570
  Gene Ontology: Mol. function=hydrolase activity
  Homolog annotation: Hit_ID=UPI00005F73C9; Match level="QueryCoverage =80%, HitCoverage=42%, E-value=8e-34, Identity=64%"; Hit description =COG1073: Hydrolases of the alpha/beta superfamily
MWLAFWPAARTLRPVIIILNGDGMIELATENLAGIECIHAAPAGQRLARLPTILFYHGFTSSKEVYSYFAVALAQAGFRVVMPDAEMHGARYNGDTDARMTHFWEILRQNIDEVPLLEAALRDNDW

SEQ ID NO: 217349 - protein, 147 aa, Glycine max
  Coding DNA Sequence Number=SeqID_100571
  Gene Ontology: Mol. function=translation initiation factor activity; Biological process=translational initiation
  Homolog annotation: Hit_ID=Q129Z2; Match level="QueryCoverage=70%, HitCoverage=76%, E-value=1e-29, Identity=59%"; Hit description =Translation initiation factor SUI1
MAEFFERGQDAVAVIALHLDDAVLDGAAGAAGGAQLLAQRLQRVVVQRQALDDGHGLAAAALGFARDAHAAGRRHGPGRRLALAIGERAAALRAHPAAVGGVDDHYAGAAAASPAWVRSLVEAARPQRFDQVVDEGLDARGDRGYCR

SEQ ID NO: 217350 - protein, 76 aa, Glycine max
  Coding DNA Sequence Number=SeqID_100572
  Gene Ontology: Mol. function=oxidoreductase activity, acting on single donors with incorporation of molecular oxygen, incorporation of two atoms of oxygen
  Homolog annotation: Hit_ID=Q4BTN1; Match level="QueryCoverage=96%, HitCoverage=41%, E-value=1e-21, Identity=61%"; Hit description =Similar to Aromatic ring-cleaving dioxygenase
  Pfam annotation: Domain name=DOPA_dioxygen; Domain location=11-76; Score=52.1; E_value=1.9e-12; Accession=PF08883.1; Description=Dopa 4, 5-dioxygenase family
MILDPAIVDSWHAHVYFNADSRDAAWALREQALDAFGDSIQMGRFHERPVGPHPQWSYQLAFAPAALPRVLTWLAQ

SEQ ID NO: 217351 - protein, 242 aa, Glycine max
  Coding DNA Sequence Number=SeqID_100573
  Gene Ontology: Mol. function=protein dimerization activity; Cellular component=nucleus; Biological process=regulation of transcription, DNA-dependent
  Homolog annotation: Hit_ID=Q9ZPJ6; Match level="QueryCoverage=70%, HitCoverage=38%, E-value=2e-67, Identity=69%"; Hit description =Transcription factor PERIANTHIA
VIDNSHREFDVIREQGFDVIKGALAFDIDYAHWVDEHQRLLNDLRTAVNSQMSDSDLHILVDSVMAHYNELFRLKSLGTKADVLHIHNGMWKTPVERCFMWLGGFRSSELLKIIKNHLEPLTDQQLMGIYNLQQSSQQAEDALSQGLEALQQSLVETLSSISLGPTDSGNVVDYMGQMALAMGKLADLESFVRQADLLKQQTLQQLQRILTTRQTARALLVQTDYISRLRALSSLWLARPRE

SEQ ID NO: 217352 - protein, 171 aa, Glycine max
  Coding DNA Sequence Number=SeqID_100574
MKSDSVDLQLEHSSPHHITKSDSSVGEAITLGSSTQEGVTSDPQPEKRLKKLQDLQSNMFSTLEGKRSLKQPSSTIGTKGSSLGNEKNVDMLLGSITQARCVMLVIIVIVIGLSMVECSFISLNRENFRSNDTKHGRKLVGDSLTDSSKLMRNAGVFLGSKDDLKSCSNTR

SEQ ID NO: 217353 - protein, 82 aa, Glycine max
  Coding DNA Sequence Number=SeqID_100575
MEGLSFLRCGIWGGHVGANFRSFGANRVLTTSLHQKETNSLLSSGQSMDKWGITTSKNDHSIDNSDNQKSSTPFLKRKTIEV

SEQ ID NO: 217354 - protein, 126 aa, Glycine max
  Coding DNA Sequence Number=SeqID_100576
  Gene Ontology: Mol. function=protein dimerization activity; Cellular component=nucleus; Biological process=regulation of transcription, DNA-dependent
  Homolog annotation: Hit_ID=Q0GPJ3; Match level="QueryCoverage=53%, HitCoverage=32%, E-value=5e-16, Identity=60%"; Hit description=BZIP transcription factor bZIP86
  Pfam annotation: Domain name=MFMR; Domain location=1-117; Score=9.5; E_value=5.7e-08; Accession=PF07777.2; Description=G-box binding protein MFMR
MGSSEMDKTTKEKESKTPPPPTSQEQSSTTGTGTINPEWPGFQAYSPIPPHGFLASSPQAHPYMWGVQARDGAVRHTNTTAKVMGIQYHAFPCTKKDTTGQARMVADGSRGMDAGAVIFRWCVGIE

SEQ ID NO: 217355 - protein, 296 aa, Glycine max
  Coding DNA Sequence Number=SeqID_100577
  Gene Ontology: Mol. function=protein dimerization activity; Cellular component=nucleus; Biological process=regulation of transcription, DNA-dependent
  Homolog annotation: Hit_ID=Q94KA8; Match level="QueryCoverage=84%, HitCoverage=54%, E-value=6e-79, Identity=65%"; Hit description=BZIP transcription factor 2
  Pfam annotation: Domain name=bZIP_1; Domain location=165-229; Score =89.7; E_value=9.1e-24; Accession=PF00170.11; Description=bZIP transcription factor
  Pfam annotation: Domain name=bZIP_2; Domain location=165-219; Score =31.6; E_value=2.8e-06; Accession=PF07716.5; Description=Basic region leucine zipper
  Pfam module annotation: Pfam domain module=bZIP_1::bZIP_2; Domain location=165-229::165-219
MVYFSKPVELIGFPFAIAYWRFMLIGKSWLCSGESASEGEGTSEGSDANSQNDSQLKSGGRQDSFEDEPSQNGSSAYTPQNGGLNIPHTVVNQTMSIIPISAGGAPGAVPGPTTNLNIGMDYWGTPGSSNIPGLGRKVPSTAVAGGMVTVGSRDSAQSQLWLQDERELKRQRRKQSNRESARRSRLRKQAECDELAQRAEALKEENASLRSEVNRIRSDYEQLLSENAALKPILLSQNPLISERFVGRLTMLSDLQERLGELPPNDDHHHRSGRNDQHVGNDTQQSGQTEAVQGGH

SEQ ID NO: 217356 - protein, 579 aa, Glycine max
  Coding DNA Sequence Number=SeqID_100578
  Gene Ontology: Mol. function=heat shock protein binding; Cellular component=integral to membrane; Biological process=protein folding
  Homolog annotation: Hit_ID=O82287; Match level="QueryCoverage=99%, HitCoverage=98%, E-value=3e-56, Identity=47%"; Hit description =Putative DnaJ protein
  Pfam annotation: Domain name=DnaJ; Domain location=60-121; Score =93.4; E_value=6.8e-25; Accession=PF00226.21; Description=DnaJ domain
MAEAESEALRLKAMAESKFKGSNNNAKSALKYAKRAHRLCPHLAGVSETVAALSVLAAPDWYRALGAEPFASSSVIRRQYKKLALLLHPDKNPHVASEEAFKLLGEAFSFLSDRNRRREYDAKLRRKIEAAEIESETFWTACSTCRLLHQFERKYLGQELVCPSCEKSFRAVEAAQSDDDDDDDDGDIRVRSRRLKLKEMEKREIGVKGKVGGEKGNELGSEKEGRLRKRMCSVGEVLERAKQSNSKRVKNGEEMMTLAEFQNQVKRKLQEGKLKEKEKEKEKEKEEEGIEKRRNPAERRRRRLGLRNNGGLEAGEVRGLKKSVKPAIEEKRKGLIIEKHRGGSSGGELETMAVVDSDFYDFDKDRVGRSFKKGQVWAVYDDDDGMPRNYALIDETVSVNPFGVRISWLDVQNSGDGRIVSREKMEFHIPCGRFKVARRKASVNSVNIFSHVVDCDRAAREVYKIYPKKGSVWMLYGEGSIDADEGKGCYDIVVFLTSYNEVNGLSMAHLEKVDGYKTVFKRLERGSGAIRFLGKDDMWLVSHQIPARKLLCDETPELLKDCWELDPASLPSDLLTIGG

SEQ ID NO: 217357 - protein, 139 aa, Glycine max
  Coding DNA Sequence Number=SeqID_100579
MRRSRKEEGGRIRVPESGKVESFIVVVRIEGLAGAGVIGGAGRGAAAATVVAGSDVGERGIGERRRVEFDGIGIGEGKAEEFGIGSREERTMREFEGEGCDANHEANIFGTNNEKFKLIKSCKHYFSSKLGERKQPKTS

SEQ ID NO: 217358 - protein, 223 aa, Glycine max
  Coding DNA Sequence Number=SeqID_100580
  Gene Ontology: Mol. function=cytochrome-c oxidase activity; Cellular component=membrane; Biological process=electron transport
  Homolog annotation: Hit_ID=Q9C9F2; Match level="QueryCoverage=69%, HitCoverage=45%, E-value=8e-25, Identity=35%"; Hit description=MtN21- like protein; 91922-89607
MPMQSLDWMILFQNLFYESLALTSATFASALYNLIPAITFVLAISCSFERLNLRVAKGKAKVLGTLLGIGGAMLLTFIKGAEINIWPFHINLMHPDQHQNSHMASLNVDSGNNKLLGAICSLASCFSFALWLTIQAKMSKEYPCHYSSTALMSTAGAIQATTFGFCFDRDLIQWKLGWNIRLLAVAYSIREGRFQTLDQCLLREYSMTLQAMHGQIFRDFCEV

SEQ ID NO: 217359 - protein, 111 aa, Glycine max
  Coding DNA Sequence Number=SeqID_100581
MRRKNLEGHLCPQLNFSSQLKHGPQSRRMAISSGDNLLIGMGGDFGEEGNNVEPYRFGDLCHQIMVLPTSCDEDVKQVELGSKESRKTMKQENGGYFQWRKRVGGAHPAWH

SEQ ID NO: 217360 - protein, 236 aa, Glycine max
  Coding DNA Sequence Number=SeqID_100582
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=81%, HitCoverage=22%, E-value=5e-30, Identity=32%"; Hit description=Chromo
MKFIHDGRIIELRGDRDVSLHLITLSQLRRLVETEETSAFFHIQIENQDESMSCSGLIHPSMSLFSSPVLLVKKQDGTWHFRINYGALNVITGYHQILMKEEDATVNDVFKPFLHKFTIVFFDDVLVYMEYLGHKVTKSGVEPLEEKIQAIQQGPLPRSVKALRGFLGLLEAIDAFEQLKNAVCKAPVMSLPDFALPFVIEIDALGVGMGIYENGGNTYSVITSPFSLITEDSKSS

SEQ ID NO: 217361 - protein, 107 aa, Glycine max
  Coding DNA Sequence Number=SeqID_100583
MDIDYAIRKDEPPIITDENAITDENIPTAIDDQFITSDMVLASTLIMIFYSFSLTSVKGVSVYIMHMRDISAQRKKLEVERLVMEMSESALLTTACGKNKATKSHAN

SEQ ID NO: 217362 - protein, 73 aa, Glycine max
  Coding DNA Sequence Number=SeqID_100584
  Subcellular localization annotation: CTP_CleavageSite=33; ConfidenceScore=5.23e-01
MYTLIFCSPHDQHSRANGQICPIKSRSFGTFSRGVALEQMPTGAKSTIGFTHNQGKELRRMRWRSLDHNHAFG

SEQ ID NO: 217363 - protein, 157 aa, Glycine max
  Coding DNA Sequence Number=SeqID_100585
MTLHSTSHWSESSVATSRIHDYPHKPTRDFLVCFVLIDMLFEKLSRRPPCGSNAFQDYVDDAKDSIQESRVKQVSRIKESFNQDSRFKGYICLGCNTENKRGYISCGSVQVEGTSTWLFKENKGGYIPYGSLLGLSEGSIYNHGAHQKGECKIHLDK

SEQ ID NO: 217364 - protein, 44 aa, Glycine max
  Coding DNA Sequence Number=SeqID_100586
  Gene Ontology: Mol. function=transferase activity, transferring hexosyl groups; Biological process=carbohydrate metabolic process
  Homolog annotation: Hit_ID=Q2HV81; Match level="QueryCoverage=84%, HitCoverage=6%, E-value=3e-11, Identity=76%"; Hit description =Glycosyl transferase, family 28
MNSCRHTHVVEYLKVPLHMFFTMPWTSTSEFLNPLSRVKKPIGN

SEQ ID NO: 217365 - protein, 61 aa, Glycine max
  Coding DNA Sequence Number=SeqID_100587
  Homolog annotation: Hit_ID=Q9LJA4; Match level="QueryCoverage=64%, HitCoverage=16%, E-value=2e-07, Identity=57%"; Hit description =Arabidopsis thaliana genomic DNA, chromosome 3, P1 clone: MTO24
MELHYDEPYIQASQAQLVYYVEDNKDNGWCTLVHLKPRDLFDMGDDGTMTTYENDDLCNLK

SEQ ID NO: 217366 - protein, 224 aa, Glycine max
  Coding DNA Sequence Number=SeqID_100588
MKVIEVYNLPPRDMIVVPFEGSQPSPTDADEILYRFLGKLAQDNNLFPICYEKLPKVLNKQKDKAWNYIIKQMCKRNAKNRPKLTINHIGGSKKLKRKKTKIVPNHFVSLQVINIVELGLLEKVNVNMEVSMGSLFIYTHKRADGTYISEEAQLVCEKIGEIESQGTGPMQISPNDFVSKQRPFYSASSSRPCAKREISALSATGVFSQAQCTTGAKPESTYPR

SEQ ID NO: 217367 - protein, 113 aa, Glycine max
  Coding DNA Sequence Number=SeqID_100589
  Gene Ontology: Mol. function=carboxypeptidase activity; Cellular component=cytoplasm; Biological process=cytoskeleton organization and biogenesis
MTMTIEFLHDAFKHVNIPTSNYDAKKLLNKLCLNYTKIHACFKNCMLHWGEDVDREKCKTCHAFRWKQKGHENASDHGLKMIFMSSKTIKSMVWHGEENKNDGLMRHPRDLKA

SEQ ID NO: 217368 - protein, 60 aa, Glycine max
  Coding DNA Sequence Number=SeqID_100590
MDVASDVALQYTCRPSMSTLVEEHRRLALSSQATRQSRLLHHRNNPYKQGSEAPTPLYEY

SEQ ID NO: 217369 - protein, 209 aa, Glycine max
  Coding DNA Sequence Number=SeqID_100591
  Subcellular localization annotation: CTP_CleavageSite=52; ConfidenceScore=5.90e-01
MVTTLVSSVNSVVAPPSTIVTPLLSVGVMTTSALEMPPLSSLVPSVASTSPSSSSRPSVSLDHIYISRDTNSMWSMGSLVIWEQNGQWYQEALSKVASLEVEVAKWRATARTFWRVECSKVANSIIVFVEAVSSNHQLSSKGEKNDLAGKVESIVVEKNELAKVTVDLKARLKESESRLEESELRASKEREASKELEKELLLYKKEAME

SEQ ID NO: 217370 - protein, 128 aa, Glycine max
  Coding DNA Sequence Number=SeqID_100592
MADGNSGFAKLVCETGCHGVSPFPLAKHPLLKSVGAVTRAVVAKSLCYVVANWLRWWSFQSHNFVVSNSGRLVPFSIGTSLRCTLISLKEERNKISLPLAFLFCLSPLVIAMSEREHFSGQEGDLISR

SEQ ID NO: 217371 - protein, 129 aa, Glycine max
  Coding DNA Sequence Number=SeqID_100593
  Homolog annotation: Hit_ID=Q94IP9; Match level="QueryCoverage=99%, HitCoverage=12%, E-value=2e-08, Identity=70%"; Hit description=WD-40 repeat protein
MYDDVVLCADFSRDSKMLASGSQDGKIKVCTARITLIFLLNRTEPPNIIHFVNFRLYGYEAQHFRIRIPSSIQKSQPPLILHGHIHILPSSFLATKSGVLGLVNACGVLNVLILKVSQVFPSLVMEASY

SEQ ID NO: 217372 - protein, 365 aa, Glycine max
  Coding DNA Sequence Number=SeqID_100594
  Pfam annotation: Domain name=F-box; Domain location=3-50; Score=30.6; E_value=5.3e-06; Accession=PF00646.23; Description=F-box domain
MKKVDRFLNSGILIEILSHVPAKDLLSLKRVCKEWHHVISSRCFVEAQLQRTKEEALNGFIFQEKFMWCNEDIKTISYISVEVTTKGGSKVNQKVFDFLPEDVVMMASCKGGNNCLRSMVLALAFDFDPSKGFVEKFKLVRVKLVEVEGEEEEAQEEEEEGEGELFITFELYSSEKGAWKTCNEICQCYNMINNGGIYIGGVMHWLNGDNVLTFNVENELSWLVLAPVPASEFMMVPEACIGESEGRLHYVVVSEQGVHVWCLEDYYDYKWAIVYCKPLEEIEGEWPLFLNLKSHALEKVNGPWVNPLAFKDGLLLIKVCVSLYLFDVKNNSMTKACSIQDLKSQCMFNPTVIAHSLSLVHLSPA

SEQ ID NO: 217373 - protein, 519 aa, Glycine max
  Coding DNA Sequence Number=SeqID_100595
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=79%, HitCoverage=33%, E-value=4e-63, Identity=32%"; Hit description=Chromo
  Subcellular localization annotation: CTP_CleavageSite=59; ConfidenceScore=5.03e-01
VVDSTNSKSNLDLEDAIAKVTSAQFHLSTKSEDLFQKVAHMETQPPSPSSSTTNPFAAPSSLPSHRMKLEVPRFDESDPFGALHWPGSNGCPETGSSCRGPAFYKLLKLSLANRIIDLPTPFLLSYFISRLTPEIRRKVQALQPLMLVQAVALVRLHEEKLADSRKLFQHRPPTPGPLGSLPQHSVPPGLCFNCDEKFSHDHWCSSKLFLLIADEDDNPLDDLVPPDEFGDIGEVVAPLPAQISLHSLAGHMAPETLCLVGYIVGQRGHDFWVHFHVLPLCGVDLVLGVEWLKSLGSVLMNYNKLNMKFHHVGRVMELKGDHDSGVGSITTNQLCHLMKTNATSEFFHLRVEPPSTQTPQSSLLMPEIKHLLRKFQHMFQALTTLPPSRTTNHAINYHPNSEPANVHPYRYPHFQKQEIELQVKSMLRNGVIRLSTSPFSSLVLLVKKRDDSWHFCVDYHALNAIMIKDRFSIPMVDELLDELRGAQWFLKLDLLQGYHQILMKDDDVSRTGFCTHHGH

SEQ ID NO: 217374 - protein, 263 aa, Glycine max
  Coding DNA Sequence Number=SeqID_100596
  Gene Ontology: Mol. function=chromatin binding; Cellular component =chromatin; Biological process=chromatin assembly or disassembly
  Homolog annotation: Hit_ID=Q1SAV4; Match level="QueryCoverage=64%, HitCoverage=50%, E-value=1e-49, Identity=50%"; Hit description =Integrase, catalytic region
  Pfam annotation: Domain name=rve; Domain location=34-196; Score=13.6; E_value=0.00043; Accession=PF00665.16; Description=Integrase core domain
MCNDVHQFVLTCLDCQLTKYEAKKPTGLLFPLPISSWPWEDLSLEFIVGLPPYHGNTIILVVVDRFPKGIDLGILSANYTTLTVALLFMEIVGKYHRMPKSLVSDRDPLFVSMFWKELFRLSETKLRISSSYHPQSDGQIEWCYNTSFHSATGALPFEITFGRKPPSIPLKSQERIKATADAHRQDASFEPREWVMHINNNPIIIPLSFLGTRWEMGEATHHLEDKVLLDGLGNDRPKTENGEDTRGRPKKGTTAPICLKDYV

SEQ ID NO: 217375 - protein, 112 aa, Glycine max
  Coding DNA Sequence Number=SeqID_100597
MEAFLTSHASKLETYQLGIVCKGMINHRRICEKEKENYILHGWRILLTTVVEAMPSKVILMMPKNQELSKFQRFKNQDSRIQESSFKNQDSRIIKIKIQDSRFKNQEKTQSR

SEQ ID NO: 217376 - protein, 52 aa, Glycine max
  Coding DNA Sequence Number=SeqID_100598
MPAGLHYLDPFCKDHAFETPSGPGKVQQGIGIPSFYHRSLPVLWGASYVMRT

SEQ ID NO: 217377 - protein, 102 aa, Glycine max
  Coding DNA Sequence Number=SeqID_100599
  Gene Ontology: Mol. function=ribonuclease H activity; Biological process=DNA integration
MDLVKYIFESPTLIGQMSQWQLNSPSMTFDKRVCPCKFSDGDLVLKKVSQAQKDHRGKWAPNYEASFIVKKAFSGGALLLMNMDDKKLSSPVNSDIVKRYYA

SEQ ID NO: 217378 - protein, 141 aa, Glycine max
  Coding DNA Sequence Number=SeqID_100600
MTSNPSRAKKKEKSFKYLDLEWFSQHEINFPNLLEVQGLSKLVQMEGTFYPKLVKVYYTCALYMVIDAAMWKEVVGLDIGGVRKFGETVNGYNKMQTYKGMLLDPTRILRNHLGVGGLTAEGRMLVYVITYILAPRSSNHA

SEQ ID NO: 217379 - protein, 144 aa, Glycine max
  Coding DNA Sequence Number=SeqID_100601
MVIDLSLKGVPNRVTCPQTYRIPLAENIIFLENHHTQGQTCIPIIGFPNPNYAPLYIAQRPLSFTFVSPNARFYIPNRRKLRIDFKNKVLLQGDVNLKFRPRQCDRGSVKISLSELISLSENALLVLRITFHAKRKPLLGWHLC

SEQ ID NO: 217380 - protein, 43 aa, Glycine max
  Coding DNA Sequence Number=SeqID_100602
MEDTPVSLASLARKREWGGRDTKEALGGEGRSLGRSRRMDLVH

SEQ ID NO: 217381 - protein, 95 aa, Glycine max
  Coding DNA Sequence Number=SeqID_100603
MYFFQESLIGVAVTWYTNLEPSQVHSWKDLMVAFIRQYQYNSDMAPDRMQLQNMGKKGHKSFKEYAQRWKDLAAQVAPPMMEREMITMIIDTVIP

SEQ ID NO: 217382 - protein, 573 aa, Glycine max
  Coding DNA Sequence Number=SeqID_100604
  Gene Ontology: Mol. function=malate transporter activity; Biological process=response to aluminum ion
  Homolog annotation: Hit_ID=Q5FAM2; Match level="QueryCoverage=96%, HitCoverage=94%, E-value=1e-121, Identity=43%"; Hit description =Putative expressed protein
  Pfam annotation: Domain name=UPF0005; Domain location=67-558; Score =684.4; E_value=8.5e-203; Accession=PF01027.11; Description =Uncharacterised protein family UPF0005
MAAARSVSLRQIFAERSKERLLSRKDFSDLRLNGTTATSASVATPHALSDRVAQFGEGVGRFFRELREMARSDPRKVVFAAKAGLSLALVSLFIYIKEEQLSKYSIWAILTVVVVFEFSVGATLNKGFNRSLGTISAGGLALGIAELAVLSGKFEELIIVLCIFIAGFCASYVKLLPAMKTYEYGFRVFLLTFCIVLVSGRTSREFFSTAFYRLILIAIGAGICLFVNIFIYPIWSGEDLHKLVVKNFNGVAASLEGCVNGYLQCVAYERVPSKILVYQASDDPLYRGYRAAVQSSSQEESLVDFALWEPPHGPYKTFNYPWRSYVKVSGALRHCAFMVMAMHGCILSEIQEEDADVCEPGRLVYSKMSEAPPEKRLVFSNELQKVGTEGAKVLRQLGSKVEKMEKLSNIDILLKVHEAAEQLSMKIDQQSFLLVNSESWQAAKKPKEVENHDNLFIDLKDHHEHKHSLISSLSETGVDSRLNINIEPSVPELHISQSLLSNKISWPRLSFYGDNMLLEQDSKVYESASSLSLATFASLLIEFVARLQNLVDEFQDLSEKANFKDPFDQTVLK

SEQ ID NO: 217383 - protein, 155 aa, Glycine max
  Coding DNA Sequence Number=SeqID_100605
MCARARVMGEIEEVQEWMKADMEAMKEQMATMLEAMMSMEKIMKVNATAVATTRAIAEVDPTPPSGLNQINHPTSNKYRQRVGKALNFCPQPQPLHFTTGRIPPAMVEKGKLDHLEERLKAIERGREYAFANLEELFLVSNVVIPPKFKVPDFDK

SEQ ID NO: 217384 - protein, 97 aa, Glycine max
  Coding DNA Sequence Number=SeqID_100606
  Homolog annotation: Hit_ID=Q1T2W1; Match level="QueryCoverage=41%, HitCoverage=5%, E-value=7e-07, Identity=51%"; Hit description =Integrase, catalytic region; Asp/Glu racemase
MVKGSEHMVYKPHNALYELGLAALNLTSSVKDSKKVKINYANMKEESRKMKHSSNKCLVFSKANNCYTLHNRSGVHCSSWMCLSSNLDDKNFEGVGI

SEQ ID NO: 217385 - protein, 192 aa, Glycine max
  Coding DNA Sequence Number=SeqID_100607
  Gene Ontology: Mol. function=DNA binding; Biological process=DNA integration
  Homolog annotation: Hit_ID=Q1S9A8; Match level="QueryCoverage=52%, HitCoverage=45%, E-value=4e-31, Identity=60%"; Hit description =Integrase, catalytic region
MDFDVLEMKVGETLTKYRAQVMGLAKKMRSNEGYMKEVTIVKKILRSLTKKFNYVVVSIEKSKDIDKLTIDELQSSQVVHEHKFIRPRLQTRKKHVLASQNKIFLTCGTVDMLILVTEGYNCYKLGKWFVVCLNYLPPQLYALIVSKGSNIVSQCQRKVNGEQAISCNWSMQTFVVQLLHHLTIKIDIFCAS

SEQ ID NO: 217386 - protein, 112 aa, Glycine max
  Coding DNA Sequence Number=SeqID_100608
  Homolog annotation: Hit_ID=Q2HVE2; Match level="QueryCoverage=54%, HitCoverage=7%, E-value=2e-07, Identity=40%"; Hit description =Ribonuclease H
MDAILKSRLKLLPHMKNSYSWISMGWKSPPQGWIKANADGSVRGGGHFAACGGVFRDSQGDKWCCGILPWKKSKSKMQKVKKQSQQNCTAQPQKDSPCSLHYLLHFVVVPCS

SEQ ID NO: 217387 - protein, 50 aa, Glycine max
  Coding DNA Sequence Number=SeqID_100609
MKMEHKAMKIPKVVDRLVQGEGGSFGDASRVQVALPYPPGIDYKIWLRAH

SEQ ID NO: 217388 - protein, 63 aa, Glycine max
  Coding DNA Sequence Number=SeqID_100610
MASAITWATWTLIRLGNGLLVDPVGLVPPLAELALLAFLQHLRVTQELAKGNCVKGNPLTPHP

SEQ ID NO: 217389 - protein, 166 aa, Glycine max
  Coding DNA Sequence Number=SeqID_100611
FHVPGGRLCPVARSGQAVGEILPPGQLRGFCPLLAWLGSAVLGYGPVISFGLVGPLLPPVISFVARILPTLACAPLAKSVPRQNEREPTNGSLFWPNIVEEERDTGLIGEGRIKATRAESQWIVAARPLCHLQYPVAYLSRLQRILPAARWELRFKASRRANPPHE

SEQ ID NO: 217390 - protein, 169 aa, Glycine max
  Coding DNA Sequence Number=SeqID_100612
  Subcellular localization annotation: CTP_CleavageSite=28; ConfidenceScore=5.19e-01
MNTLTQICMTLLLSNILSSGHNTDLPLRRNHARKTPSGPGGAQQGPGVFGSSNGPLLVLQCARSPQQGIAPARHPVDPKKSNRVLGFPALIMGLYQFYGVPIAPSKFIRPPINQAFIKKYCAPRQAQGETPQQPGDGQQQATNAPPPPLEHLSSSTKRLERCLRHMADQ

SEQ ID NO: 217391 - protein, 73 aa, Glycine max
  Coding DNA Sequence Number=SeqID_100613
MDQPYSEVSRSFVVRWKDELEHTWHLLYSSGSMHSFTYNQDMVSLALLLAGWIELREFYGFTGNHQVTLTHFR

SEQ ID NO: 217392 - protein, 193 aa, Glycine max
  Coding DNA Sequence Number=SeqID_100614
MVIKNHLSPLHKIDHVIVTHDLPSLWNANIKGFEFISTDKLLTKVDSKMMGYVGADISLDSIESYFICLLLLFSIGELERDLAGQETSKLQAQLVDQKSATEKKSVEHVQQLQQAFKIVHEDGFKKALYQLALFAHKINLKKFDVLKDVKDGELVRESQMESFEDDSDSETISKARNVEATLLPVLTLNRSTT

SEQ ID NO: 217393 - protein, 119 aa, Glycine max
  Coding DNA Sequence Number=SeqID_100615
  Gene Ontology: Mol. function=ribonuclease H activity; Biological process=DNA integration
MLCVNGACNPKGSRVGITFEGPRDVSLEQSLRLDFKTSNNQAGYEALIPGLKLAKEVGVKKIGCRSDSKFVIGQVNGDFQVKDTHMQIGIYDMHLEGRNMEARVLRVGYYWPTMLTNYA

SEQ ID NO: 217394 - protein, 47 aa, Glycine max
  Coding DNA Sequence Number=SeqID_100616
MKHQKRNTREIKEWSEGSREGLRRFEESEIRIGYGNQRIESCDSKNH

SEQ ID NO: 217395 - protein, 158 aa, Glycine max
  Coding DNA Sequence Number=SeqID_100617
MPQRKKVNQVIIVEAVGGSIMPTALPLNVVVPEKTHNLRKMAQTEVDNHKHIQVDSDVDEIGDNWSPMDFCNPQNEERSFWNMVFPHTIHNHTHKMSKADCEDLEKLSFMTVEVKPHDDDKGDDKKLKDQSKNNSSESRTIQEFKIRIKKNSRLKKKV

SEQ ID NO: 217396 - protein, 69 aa, Glycine max
  Coding DNA Sequence Number=SeqID_100618
MSTSVEHPRILNNISPSKWKGEIRPRISRRYQPLPNKFKIDAERKIKATREKHNLRKSKSKVGEKSVGR

SEQ ID NO: 217397 - protein, 106 aa, Glycine max
  Coding DNA Sequence Number=SeqID_100619
MYKRGIQIYNHSREALPKRFIYSPPSMLGSSPGPSSRYQEVRGLAQIQEAMAKLRVEGKYNSRVFLREFKEEDLVIKKAQPNLIINKLSPKWVGPYKIIQVVRWVT

SEQ ID NO: 217398 - protein, 336 aa, Glycine max
  Coding DNA Sequence Number=SeqID_100620
  Gene Ontology: Mol. function=RNA-directed DNA polymerase activity; Biological process=RNA-dependent DNA replication
MVVTTFYKGIWARTFSESLVCCHLDTMMNVHSRVLRDLMGPHPRVLVGFMGAKTKVQGYVDLEITFGDQRAKSFMIRYMVVNAPLTNNILIGRLSLNKLGAIMSRVHLKVKFPLEDRSVNTISVNQEISWKFNEESLKARKGFYGPAKQYEAKKVNIGTTFTPQLEDNLVEVLKRNSNAFEWSLRDMSRNVGATYQQLINKILAKLIGKTIETYVDDTVVKSSKVDKHTTNLHELFDMMDLYQIKLNPEKCLFDVWAGKFLGLMLTSRRNKANLNWCSVVIDMMSLTNIKEDMALTSRKRGAIKGQVLVDFVGLNSVIVEQSLNFNFSLTHNQVEY

SEQ ID NO: 217399 - protein, 178 aa, Glycine max
  Coding DNA Sequence Number=SeqID_100621
MGLSKLGTAITAITAVTLVFLFMEIVYVLWQRRQRLRPRVRVEPQEASPQCSSTSSSPSDDDDVELEIEQHVMKWQQCLNGNGNGPSRVLFTIKEEEREEVDSDNGNDNGLSEECNKSARAWLDHERVAAVVDEVVVVVEELLLLNETTTPCASPPYYTPYASPSREECRKDLNDSNG

SEQ ID NO: 217400 - protein, 151 aa, Glycine max
  Coding DNA Sequence Number=SeqID_100622
MKKERKEEKRRWIDGLRCLRFAGEVERWRMDSWTENDVFFSLGNVGVIIAVRHFKIESSTSDADHLRKIIWMIEEMKEMEELVRVGLQRFLGGSDQQRWWWRKIPFASLMILPFEGVPANFDRWVWKRIEKDEDWTLFKAIWLRNERDTQI

SEQ ID NO: 217401 - protein, 195 aa, Glycine max
  Coding DNA Sequence Number=SeqID_100623
LLCKLNHTKSSTVLRLKAIWLKAKLPFELWLGQCCPVDPYLKGRLIWKLQQAFRPKDLVVPPTSTYKSETFEYLEDMTLLRSWTEAWLKYVRWYYATALSPDVSIEDFIQAPVVTTRSFQRGVRTSLMLRLRLIENCCGETIAEAGLDPKPLTILGSRLGGSEKTKGDADYSIADSEEITDIVGTNLIFHDRPCY

SEQ ID NO: 217402 - protein, 196 aa, Glycine max
  Coding DNA Sequence Number=SeqID_100624
  Homolog annotation: Hit_ID=Q9LZR6; Match level="QueryCoverage=30%, HitCoverage=13%, E-value=8e-20, Identity=72%"; Hit description=Heat shock transcription factor-like protein
MSRKDNSRELERVPHDEAEARGVPRDDRVESRGVDEVEGLRKKRRNRVDHLQGLGTGRVVAIVGVHVQRRRMRRGEKRKEREVGILKGCEGGGGWRGDGGGRERPLHITLVSCNWGWLLLGCVLRPRLGLTRRTVVAVHWLGWILRATPSVVFTLDSAVNLSGRPTQLYHPIATACLFLGIFHGPAGLHFTTFIGK

SEQ ID NO: 217403 - protein, 237 aa, Glycine max
  Coding DNA Sequence Number=SeqID_100625
  Gene Ontology: Mol. function=protein binding; Cellular component =nucleus; Biological process=ribosomal large subunit assembly and maintenance
  Homolog annotation: Hit_ID=Q9LUG5; Match level="QueryCoverage=82%, HitCoverage=62%, E-value=2e-61, Identity=58%"; Hit description=Brix domain-containing protein 1 homolog
  Pfam annotation: Domain name=Brix; Domain location=1-156; Score=71.5; E_value=2.7e-18; Accession=PF04427.8; Description=Brix domain
MTSILFRRQFRLSQYGSHSKKRPDNLVIGRTYDHHIYDLVEVGVENFKPMESFSYDKKLAPKEGSKPFIVFIGEGFEAVEELKHLKEVLLDLLRGEVVENLNLAGVDRAYVCAALSPNRVFFTHCALRLKKSGTVVPRMELEEVGPSMDFVLRRHRPPNESLRKEALKTSREKPKKKEKNVKKDELQGKIGSIYIPDQKVGETPLPYKAKGVKRERRESKRKNESDGSASKRKKEDS

SEQ ID NO: 217404 - protein, 205 aa, Glycine max
  Coding DNA Sequence Number=SeqID_100626
  Gene Ontology: Mol. function=serine-type endopeptidase activity; Cellular component=extracellular region; Biological process =proteolysis
  Homolog annotation: Hit_ID=Q54483; Match level="QueryCoverage=100%, HitCoverage=19%, E-value=1e-117, Identity=98%"; Hit description=SSP -h1
MEKKLRGVKSARAAFGWPEIGVHRAQWSAMLICLTAIGGAQAANYIENGKAGDPASWRSSEFNAEWGLGAIHADQAYAAGYTGKGIKLGIFDQPVYAKHPEFAGENKVINLVTEGIREYTDPYIPVKKGDTFRYDGTPSVDSDGTLGSHGTHVGGIAAGSRDGGAMHGVAFNAQIISAENGDPGPEDGIILGNDGAVYQAGWDAL

SEQ ID NO: 217405 - protein, 56 aa, Glycine max
  Coding DNA Sequence Number=SeqID_100627
  Homolog annotation: Hit_ID=Q2PMM5; Match level="QueryCoverage=100%, HitCoverage=2%, E-value=1e-25, Identity=100%"; Hit description =Protein ycf2
MEREKQMNNHLLPQEIEEFLGNPARATRSFFSDRWSELHLSSNPTERSTRDQKLLK

SEQ ID NO: 217406 - protein, 148 aa, Glycine max
  Coding DNA Sequence Number=SeqID_100628
MNKQQLKRKSTSKSYGSHSYPKKDQGLGILGASPSKPKDDKGKPIEKQPPKASMEEKTSSINSQDETTTSPSSSESEEAKGEESREEIYPQEEEQPLMVKKECKEELLDEGLVHKSLNPCALYGATSCGIHVELVGLGSSSSMESFSS

SEQ ID NO: 217407 - protein, 161 aa, Glycine max
  Coding DNA Sequence Number=SeqID_100629
MAGVDPLGELVKNLLDVYQMPIELSWDGTKFGLPNVKDDFFITHTNVTKLILGDKCLNISTLQLWMITCKRILQDSGTLKRVAWGLDVGTRVWPNQYFKLVSCVTLKVLALMWCIVSGNLKNEWNRWFSNGTTLDNEAMTTLRKKWTTYFLQVKNIVFRQI

SEQ ID NO: 217408 - protein, 71 aa, Glycine max
  Coding DNA Sequence Number=SeqID_100630
MWRGSVKSLISMPCFMSNAAYLLLFARLEVVNLASDHGLMDARENALLCYGIEGDKRLVEMAKPINDPAGL

SEQ ID NO: 217409 - protein, 65 aa, Glycine max
  Coding DNA Sequence Number=SeqID_100631
MFQAWRSEEIKLWTSEEDKVTMAILKNWEVQEANKENMETLKLMAQILKLPITVTKSKSNCPVKL

SEQ ID NO: 217410 - protein, 77 aa, Glycine max
  Coding DNA Sequence Number=SeqID_100632
MEDDYVRKMSNEVDIEVDMNNNIRIDRNICKHYGQETGKIFDCSKAFITTKVFATQDELLKWAQDVAFEIDFFLLSF

SEQ ID NO: 217411 - protein, 122 aa, Glycine max
  Coding DNA Sequence Number=SeqID_100633
LLVIIPKVVISFLMVSRGIIPFEKHITAAGTTSNNMLSKRKTLDEGSLLSSKSETQHDHRFTSTPYVPMDTSIGPLFNLPPNSLKTIPSGVTNYVNLPFAGRATRGLTGASSKGGRHAESPP

SEQ ID NO: 217412 - protein, 63 aa, Glycine max
  Coding DNA Sequence Number=SeqID_100634
MSHGRLYQSIVENAFNKRVLSHKFSKGDLVLKKVLQAFSRGALFLMNMDDEELPSRVNSNVIK

SEQ ID NO: 217413 - protein, 176 aa, Glycine max
  Coding DNA Sequence Number=SeqID_100635
MGEVEEVKEQMKADTKALKEQMVTMMSIKEIMEVNAAAITATSIIAEVDLTPLYGLNQINHPTSDMVGLEGKELGGTGGPHLVQKTSMPSHHIACLPTIHHPMWQTLPVRMSITPLPYSLKVDNLKLIMIKVGLEKGKSDHPALMNVKIGANEKDENEGETLAMTAIPTRSNFPSA

SEQ ID NO: 217414 - protein, 139 aa, Glycine max
  Coding DNA Sequence Number=SeqID_100636
MWSSAPFPEMSASSGGDFFSLTSYLELHTVVSGGAQRQNLVILHPLSSRGGGPDDMRRQNLVILHPFAIQTQSCPVARRDKIWSFCTLCHPEAAGPMTCGDKIWSFRTPLPFRHSRVRWCAEAKFGHSAPFVIQRRRAR

SEQ ID NO: 217415 - protein, 93 aa, Glycine max
  Coding DNA Sequence Number=SeqID_100637
MSMMLVQHRWTLPVHHGVDLDVLRNNYTTKASCHREGIGGKRPNAIRSGDIKWKKLLLMRERESKSKSESKTESEGLMQSYPPRALDRRLQED

SEQ ID NO: 217416 - protein, 111 aa, Glycine max
  Coding DNA Sequence Number=SeqID_100638
MEVTKSGIIVTNNDGGDRMVAIVVVEWWWKGYAAGGGGSDDNNGGGGGIVVVVATMVVVEVPKVRCSGGGKAVTTGCGGGGCGKGGNDDDVVAMVGARMGTMVEWWLECVF

SEQ ID NO: 217417 - protein, 152 aa, Glycine max
  Coding DNA Sequence Number=SeqID_100639
  Gene Ontology: Mol. function=nucleotide binding; Cellular component =cytoplasm; Biological process=small GTPase mediated signal transduction
  Homolog annotation: Hit_ID=Q8VY57; Match level="QueryCoverage=99%, HitCoverage=100%, E-value=2e-65, Identity=71%"; Hit description=ADP -ribosylation factor-like protein
  Pfam annotation: Domain name=Arf; Domain location=6-148; Score=18.4; E_value=3.2e-11; Accession=PF00025.11; Description=ADP-ribosylation factor family
  Pfam annotation: Domain name=MMR_HSR1; Domain location=20-100; Score=- 17.2; E_value=0.037; Accession=PF01926.13; Description=GTPase of unknown function
  Pfam annotation: Domain name=Miro; Domain location=21-100; Score= -8.6; E_value=0.038; Accession=PF08477.3; Description=Miro-like protein
  Pfam annotation: Domain name=Ras; Domain location=24-150; Score= -76.5; E_value=0.0015; Accession=PF00071.12; Description=Ras family
  Pfam module annotation: Pfam domain module=Arf::MMR_HSR1::Miro::Ras; Domain location=6-148::20-100::21-100::24-150
MGLWESFLNWLRSLFFKQEMELSLIGLQNAGKTSLVNVIATGGYSEDMIPTVGFNMRKLEQFVQRENPDNLSISKSELHDLLSKPSLSGIPLLVLGNKIDKPGVLSKEALTDQMDLKSITDREVCCFMISCKNSTNIDSVIDWLVKHSKSKS

SEQ ID NO: 217418 - protein, 54 aa, Glycine max
  Coding DNA Sequence Number=SeqID_100640
MNAVQMWGRLAQPNSRIRKPEKDLGLAHRCALSEFCSSDWSATFAKRDVAGLAN

SEQ ID NO: 217419 - protein, 289 aa, Glycine max
  Coding DNA Sequence Number=SeqID_100641
  Gene Ontology: Mol. function=protein binding; Cellular component =integral to membrane; Biological process=protein amino acid phosphorylation
  Homolog annotation: Hit_ID=Q949G9; Match level="QueryCoverage=98%, HitCoverage=76%, E-value=2e-38, Identity=29%"; Hit description =HcrVf1 protein
  Pfam annotation: Domain name=LRR_1; Domain location=116-138; Score =14.4; E_value=0.41; Accession=PF00560.23; Description=Leucine Rich Repeat
  Pfam annotation: Domain name=LRR_1; Domain location=140-162; Score =17.2; E_value=0.062; Accession=PF00560.23; Description=Leucine Rich Repeat
  Pfam annotation: Domain name=LRR_1; Domain location=164-186; Score =20.9; E_value=0.0047; Accession=PF00560.23; Description=Leucine Rich Repeat
  Pfam annotation: Domain name=LRR_1; Domain location=188-210; Score =15.5; E_value=0.19; Accession=PF00560.23; Description=Leucine Rich Repeat
  Pfam annotation: Domain name=LRR_1; Domain location=212-234; Score =2.2; E_value=1.1e+02; Accession=PF00560.23; Description=Leucine Rich Repeat
  Pfam annotation: Domain name=LRR_1; Domain location=241-263; Score =1.5; E_value=1.5e+02; Accession=PF00560.23; Description=Leucine Rich Repeat
  Pfam annotation: Domain name=LRR_1; Domain location=265-287; Score =9.8; E_value=4.3; Accession=PF00560.23; Description=Leucine Rich Repeat
  Pfam annotation: Domain name=LRR_1; Domain location=39-60; Score=9.8; E_value=4.2; Accession=PF00560.23; Description=Leucine Rich Repeat
  Pfam annotation: Domain name=LRR_1; Domain location=65-87; Score=4.1; E_value=49; Accession=PF00560.23; Description=Leucine Rich Repeat
  Pfam annotation: Domain name=LRR_1; Domain location=89-114; Score =4.1; E_value=49; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=116 -138::140-162::164-186::188-210::212-234::241-263::265-287::39-60::65- 87::89-114
IPPQIGNLSNLVYLDLGGYSGFEPPLFAENVEWVSSMWKLEYLHLRNANLSKAFHWLHTLQSLPSLTHLYLSLCTLPHYNEPSLLNFSSLQTLYLYNTSYSPAISFVPKWIFKLKKLVSLQLRGNEIQGPIPCGIRNLTHLQNLDLSSNSFSSSIPDALGNLTSLVELDLSGNQLEGNIPTSLGNLTSLVEIDLSYSQLEGNIPTSLGNLCNLRVIDLSYLKLNQQVNELLEILAPCISHGLTRLAVQSSRLSGNLTDHIGAFKNIELLDFFNNSIGGALPRLFGNFHH

SEQ ID NO: 217420 - protein, 214 aa, Glycine max
  Coding DNA Sequence Number=SeqID_100642
  Gene Ontology: Mol. function=histone-lysine N-methyltransferase activity; Cellular component=nucleus; Biological process =multicellular organismal development
  Homolog annotation: Hit_ID=Q4VPE8; Match level="QueryCoverage=74%, HitCoverage=91%, E-value=5e-55, Identity=68%"; Hit description =Lateral organ boundaries-like 3
  Pfam annotation: Domain name=DUF260; Domain location=10-110; Score =234.2; E_value=2.9e-67; Accession=PF03195.5; Description=Protein of unknown function DUF260
MASSSSYNSPCAACKFLRRKCLPGCIFAPYFPPEEPQKFANVHKIFGASNVTKLLNELLPHQREDAVNSLAYEAEARVRDPVYGCVGAISFLQRQVQKLQKELDSANADLLRFACNDMPPPSLSVPPQIPQRSFSAGFGNNNESASGGEFYRPSPTTTYSYPYSLPWTDTSSEDINDGGASLGLFWLDVTDQVQLSTGMCSEHAELTCSVIVYD

SEQ ID NO: 217421 - protein, 83 aa, Glycine max
  Coding DNA Sequence Number=SeqID_100643
MQRQIMVILRLVSTKRNKFDSIGMMFGIDHFQIFAGSVAERPTWTLQKIPPEGGCFWRKPPCSPGQAELAWASWVANISPIFL

SEQ ID NO: 217422 - protein, 927 aa, Glycine max
  Coding DNA Sequence Number=SeqID_100644
  Gene Ontology: Mol. function=DNA binding; Cellular component=beta -galactosidase complex; Biological process=DNA integration
  Homolog annotation: Hit_ID=Q1SLU3; Match level="QueryCoverage=99%, HitCoverage=96%, E-value=1e-172, Identity=43%"; Hit description =Integrase, catalytic region
  Pfam annotation: Domain name=zf-CCHC; Domain location=246-263; Score =12.7; E_value=0.0078; Accession=PF00098.13; Description=Zinc knuckle
  Pfam annotation: Domain name=zf-CCHC; Domain location=282-299; Score =13.8; E_value=0.0053; Accession=PF00098.13; Description=Zinc knuckle
  Pfam module annotation: Pfam domain module=RVT_2::Retrotrans_gag::zf -CCHC::zf-CCHC; Domain location=476-731::77-192::246-263::282-299
MNEASINNTESYLYLHLSENPATALVSPVLDSTNYHSWSRSMVIALSAKNKVEFIDGSAPEPLKTDRMHGAWRRCNNMVVSWIVHSVATSIRQSILWMDKAEEIWHDLKSRYSQGDLLRISDLQQEASTMKQGSLTVTEYFTRLRVIWDEIENFRPDPICSCNIRCSCNAFTIIAQRKLEDRAMQFLRGLNEQYANIRSHVLLMDPIPSISKILSYVAQQERQLLGNTGPSINFEPKDISINAAKTTCDFCGRIGHVESACYKKHEVPSNYDAKNKSNIGRKTCTHCGKIGHTVDFCYRKHGYPPGYKPYSGRTTVNNVVAVESKATDDQAQHHESHEFVRFSPEQYKALLALIQEPSAGNTTPTQPKQVASISSCTVNTPINPVPSSNEPSNEQPLPHLRHSTRAKHASTYLQDYHRDLASSTPNTSVVVRYPLSSVLSYSRLSPAHRNFVMSISSTTEPSSYAEASSHDCWIKAMKVELQALQSNNTWRLTPLPPHKTAIGCRWIYKIKYRANGSIERHKARLVAKGYTQMEGLDYLDTFSPVAKLTTVHLLLALAALNQWHLRQLDVNNAFLHGELDEEVYMQIPPGLSVDNPQLVCRLQRSLYGLKQASRQWFMKLSSFLSSHGFQQSNADHSLFLRFTGVITTILLVYVDDIILTGNNIAEIQTMITLLDREFRIKDLGDLKFFLGLEIARTSEGIHLCQRKYTLDILCDSGMLGCKPNSTPMDYSTKLQANSGSLLSAESSSSYRRLIGKLIYLTNTRPDITYAVQQLSQYMATPTNTHLQAAFRILRYLKGCKDSRKSTTGYLVYLGSSLVSWQSKKQSTVSRSSSEAEYRALASTTCELQWLTFLLKDFRATFIQPTTLYCDNQSAIQIATNPVFHERTKHIEIDCHIVRQKINSGLIKLLPVSSSLQLADIFTKALTP

SEQ ID NO: 217423 - protein, 180 aa, Glycine max
  Coding DNA Sequence Number=SeqID_100645
  Homolog annotation: Hit_ID=Q1S4J3; Match level="QueryCoverage=24%, HitCoverage=9%, E-value=1e-12, Identity=71%"; Hit description =Histone deacetylase superfamily
MENLNTPRDLEKIRCQISKATIARFLSYVPEARGQGLNLSRIRASDFSCCHAYSAHISLSGCLCWWGVGLHWEVVTTYNFDYDLYPNAFSCLPADLTWSFPTPDYNIYAKNTLLEQLSRLPHAPSAPFQTTPSVIEVPEEEEEDMDVRPKRRIWSGEDFDSDHDDDMASSKNSDLTAQTR

SEQ ID NO: 217424 - protein, 181 aa, Glycine max
  Coding DNA Sequence Number=SeqID_100646
MVEVNAATVIAASTATEGDQTHPSSLNQVNPPVSDMVGQGGEALGSTSSPHVVQSKNSFPPYGLPPNYTLPNVAHAPDQNVNNFTPILIESQQSQSNYAHVSQPMGEAHEAPRDHNLANFEPHLGYAARGQAFCGVPLPNTLGEPSVSPTTTTLAFCEGKSPSCYGGKGEIQSYGGKAEVH

SEQ ID NO: 217425 - protein, 153 aa, Glycine max
  Coding DNA Sequence Number=SeqID_100647
MAPKKLSVKRSRRDVVVEGTSAAPEDDEYTDFQEEIAHRHWTSLVTPMAKFDLDIVLEFYANAWPIKEEVRDMRSWVRDALSQFLGDPLVLEEGQECEFSQRRNRADRFGEEAIAQLLCIPGQDFARTAAGRQVLAGVCHPDTDERPCGSVDC

SEQ ID NO: 217426 - protein, 115 aa, Glycine max
  Coding DNA Sequence Number=SeqID_100648
MNISVAKEKPIGDVDSGMKDAAAGELCVYLEDGGLAAAGGERVGLAATMGRGASKGVGFCCKSARRGGGIGMEASSVGDCTGEEDGKCGLVSSAMDGLMRSIAELAIEAFNESTK

SEQ ID NO: 217427 - protein, 295 aa, Glycine max
  Coding DNA Sequence Number=SeqID_100649
  Gene Ontology: Mol. function=histone deacetylase activity; Cellular component=nucleus; Biological process=histone deacetylation
  Homolog annotation: Hit_ID=Q1S4J3; Match level="QueryCoverage=59%, HitCoverage=37%, E-value=9e-69, Identity=70%"; Hit description =Histone deacetylase superfamily
  Pfam annotation: Domain name=Hist_deacetyl; Domain location=44-286; Score=62.6; E_value=1.3e-15; Accession=PF00850.10; Description =Histone deacetylase family
EKGLECLVDGSREKREKIMATRERAEIENGVSLPSVGMDANKRRVTYFYKPNIDAHYHGEEYPMNPFRVDITHNLIVHYGLHRLMQINRPFLADKVDIARFHSDDYVEFLSTVSPQILAENFDSNYCQLKRFNIGGDFPILNGLFDFCRVSAGGSIGAAVCLNCSNADITINWAGGWHHAKKTKASGFCYVNDIVLGILELLKVHRCGDGSTTMIGDMDGGGATWVELGEAMQGTIEEAFECDYNCKRGINTTRWWLDWIATIGEMRNDVTLKERQCEEEGLEIMSCKLVCEPID

SEQ ID NO: 217428 - protein, 606 aa, Glycine max
  Coding DNA Sequence Number=SeqID_100650
VVPIDDFSSEETHPKASDNGSSSFERFLDQCHVDEGSSRPCERVPPFVTLLEEELIPVMTILLSSPSTASGRGDNGVVRVLPRNRCSHSIGMSSPPPFVVDYEWVRDDVLKYQSLKTFVMSVATLWRQLDLANPRDSCKMTVQAYEKNEFPFMRAVPGFPPFFNLTLPLNSFQCALLEHLNIAPSQLHPNNWAMLNPLRFKSFDEDLMTLVDKAIVEKFPTSLDARTILSLPSVDDPLTVLDGMMDNFEWRSLVKGQPKARVNPPWDSEAGEDEVVEVAPDVPPPIPTKRKHDEEDRGSVPPSAPTQTIPTPPSFTPAMSTPSAAPTTTPLSSTVMPLLSVGVATMSMSTDLPHSSSALLGLAMIVLPSMTLASSSCPSISLDHVYTSCDTNSMWKIGYRPEQRTPSDYVSLFYQNLIRSIGVQNSTDATKVFLQRSVKILEENIQRHQEALNKAAFLEAEVTKWRANAWTVKDSELLDEEDIDVGEEDVGEEDDGANVQSDENGSLLGVILPFLKSLAELEFDEPWRVDEDYQGWTLGLMNLSKNFRWVAFHVLGIALPFNSYSMYAPLSKLATTLNRPSQLGPDFPARESFLASPQTRRTRSSG

SEQ ID NO: 217429 - protein, 385 aa, Glycine max
  Coding DNA Sequence Number=SeqID_100651
  Gene Ontology: Mol. function=RNA-directed DNA polymerase activity; Biological process=RNA-dependent DNA replication
  Pfam annotation: Domain name=rve; Domain location=203-365; Score =34.9; E_value=2.8e-07; Accession=PF00665.16; Description=Integrase core domain
PSSCPPVEDICKSDVGDCGVHLDYISVLQISVSIHSQLTHVCYRVMPLGQNVEVYVDDMVVKSHSVAQHVADLEEVFIEINKYDKTLNLKKCTFRVGDENFLGFIITHREIEANPDKCTTILEMHSLTNVREVQKLNAVADDKKGSVDTHNLGTTSQAVFPESPSEVGVRKLRCYSDSQLVQGQVANKCQAKAAARIKYYHVVKTLVDDFDCFEMYHMPRESNTRKDLLSKLVSTKKTGHLNTIIQETLQAPTIGTKEVEKFTWKHLIRRYGVPYAIVTDNDTQFKAQAYEEFLSRLSVKHLVTYVEHLQTNGQVEAANKVILKALRTGLDKLKSLSKEELPSILWAYHCSPQTTINETPCCLTYGTDAMILVKVRELSTRRFFF

SEQ ID NO: 217430 - protein, 131 aa, Glycine max
  Coding DNA Sequence Number=SeqID_100652
  Subcellular localization annotation: CTP_CleavageSite=37; ConfidenceScore=5.18e-01
MFAHSIKGCRPLGRACGVLIPSPCVNTTPEPFTKKVRRSRLFRFFRRFPQINVGGDSRNHPNLRWANPPQQQQQQQQPVPLFQNAASLSRPYVPPPMQQQQQQQRQQATEAPSQPSLEELVGKMTIQNMQF

SEQ ID NO: 217431 - protein, 56 aa, Glycine max
  Coding DNA Sequence Number=SeqID_100653
MPSKATTTEIMAEEVDGLKIIEDMVTKAINVEDFAPERSNKEVDPTNGVQRVTHGQ

SEQ ID NO: 217432 - protein, 174 aa, Glycine max
  Coding DNA Sequence Number=SeqID_100654
MEFENSKESKESRLYMEKLLKNGGPIPFFHFNGRCFGEPNKEVPLPPISKEDMARFQEVPITDGKFNDWCKPWKNSFMITMLGKRVLPLESSLRLIGYILSSENMLCKNLCGDRFRLIVAAKDYSPYRACRPWIFFINGVLYFLKFNGSGMEKEERWLETPLQGEDESRRNSPP

SEQ ID NO: 217433 - protein, 107 aa, Glycine max
  Coding DNA Sequence Number=SeqID_100655
  Homolog annotation: Hit_ID=UPI000044A741; Match level="QueryCoverage =66%, HitCoverage=17%, E-value=5e-09, Identity=53%"; Hit description =PREDICTED: similar to Ac1147, partial
IIAIVGLQRGIPSKRESSARVDYVPALCTHRPSLLPIEWSGEVFGLRRREPAEGSLSMPHNQIDPRTCLFIYRREGGDDHGAPCARPPRPRDKHKPRRFVRQGTQIC

SEQ ID NO: 217434 - protein, 63 aa, Glycine max
  Coding DNA Sequence Number=SeqID_100656
MAYQLATSRKITVSLRKKWYIDSGCSKHMTGDVSNFTHISPKKSGHVLSIACLALVNYVTKAI

SEQ ID NO: 217435 - protein, 156 aa, Glycine max
  Coding DNA Sequence Number=SeqID_100657
  Gene Ontology: Mol. function=transferase activity
  Homolog annotation: Hit_ID=Q30XB8; Match level="QueryCoverage=82%, HitCoverage=42%, E-value=6e-33, Identity=56%"; Hit description=Sugar transferase
  Pfam annotation: Domain name=Glycos_transf_2; Domain location=6-153; Score=-20.6; E_value=0.092; Accession=PF00535.16; Description =Glycosyl transferase
MNNFAPVVLFVYNRAEHTKKTLDALASNKYSSQTDLIIYSDAAKNLSAEESVRQVRKVIRKYSSLFSNVSIVERDINCGLAKNIIEGVTQVVNKYGQVIVLEDDIVTSPSFLEFMNSALDKYKNSDQVSYHGQPFSSLINFHYQACSQMHQGQWDH

SEQ ID NO: 217436 - protein, 92 aa, Glycine max
  Coding DNA Sequence Number=SeqID_100658
  Subcellular localization annotation: CTP_CleavageSite=32; ConfidenceScore=5.38e-01
FKEVFTKYKAKTRKRTSSYWAIRTGVWTSRSRGSKSSGLSVISEQIFTKSVRSRVMWITVLGSGYARVANHFYKILRYSKYPAQRETSTQGE

SEQ ID NO: 217437 - protein, 155 aa, Glycine max
  Coding DNA Sequence Number=SeqID_100659
  Gene Ontology: Mol. function=phosphatidate cytidylyltransferase activity; Cellular component=integral to membrane; Biological process=phospholipid biosynthetic process
  Homolog annotation: Hit_ID=Q2N2K0; Match level="QueryCoverage=87%, HitCoverage=42%, E-value=6e-61, Identity=88%"; Hit description =Probable phytol kinase 3, chloroplast precursor
  Pfam annotation: Domain name=CTP_transf_1; Domain location=3-155; Score=-50.0; E_value=0.0027; Accession=PF01148.10; Description =Cytidylyltransferase family
MDILDCFLWCIKKKFFFCTRELLKGPLYYAATITLAAIIYWRTSPISIAAICNLCAGDGMADIVGRRLGGEKIPYNKNKSFAGSIAMATAVYLTSIGYMWYFSSFGFIEGSWKLVLGFLLVSIVTAFVESLPISTELDDNLTVPLTSILVGSIIL

SEQ ID NO: 217438 - protein, 292 aa, Glycine max
  Coding DNA Sequence Number=SeqID_100660
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q9HW22; Match level="QueryCoverage=73%, HitCoverage=53%, E-value=8e-17, Identity=31%"; Hit description =Probable two-component sensor
MGAGPPCCAARSRGAQDTLRAGDQVAVGRKLAGKGFRSAADDGQGRAQLMAGIAAEALLAMQEPFELITVPGEGTGEYTDLVAGVLTGKGLPPALHGIGQLRDGRDDVRCHPATDQEGAEHADRNDHRGKGIDQVFQVAIGCSVLQQVVALAATVEHTQVPLVGSCFAVVAQAVLAQHHRHAMAVVQLATRGQGGALATGQCCLQLVHGTVLGPGDDRGPDLVVVHLFGQDDEAHRAGHQQHERNRDAGTQGQAAVESGRGHAGMRQPTLCTVAINVVSKLRSTCRRSSWLW

SEQ ID NO: 217439 - protein, 115 aa, Glycine max
  Coding DNA Sequence Number=SeqID_100661
MKDIELVEEEQAWIGADPSSGTSNKSENYKEEAWKKTQKHKPKRVESVNADAEAFAEAVEHTNKRDTGHQNVALDNKTGDSTMLKMGDSAKVVIKQDMKGRRHKYGFNNNEREKA

SEQ ID NO: 217440 - protein, 177 aa, Glycine max
  Coding DNA Sequence Number=SeqID_100662
  Subcellular localization annotation: CTP_CleavageSite=52; ConfidenceScore=5.47e-01
MEANAVTIAATSAVSKVNSMSPSDLNQMNHSTSDMVGKDLGSTDGPMMCKFKTSMPSRHMACLPTIHHPMWRTLLMRMSITPLPYSLKVDNLIIYAIEGQAVGGIPLQNTLEGPQFCPQPQPLHSTAEERLRAIEGGKDYAFANLKELFQVPNIITLPSSRCQTLTSTRGLLAPRTI

SEQ ID NO: 217441 - protein, 60 aa, Glycine max
  Coding DNA Sequence Number=SeqID_100663
ASAGRNTIVAWDGRQRATDAPPSPLEFTSAHPQKGLSIAYTTWLTNRRPSPKPKDAPSCS

SEQ ID NO: 217442 - protein, 78 aa, Glycine max
  Coding DNA Sequence Number=SeqID_100664
MDWSSVKLLVAFFLLTDVKQPPYWGNPLTHFPLPVRGVLYIYLKDMDRSTAAGEEKQMGNNKLDLKERKNKKSKLDVQ

SEQ ID NO: 217443 - protein, 369 aa, Glycine max
  Coding DNA Sequence Number=SeqID_100665
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=5e-46, Identity=31%"; Hit description= UPI00006A17C9 related cluster
VLNFSGLHALAFRGLHVLATRGLHVLAFRGLHVLTFRGLHAFAFRGQHTLTFRGLHALAFKGRHVLNFSRLHTHAFRGLHVLAIRGLHVLAFRGLHVLTLRRQHTFAFVGLHVLTFRGLHVLTIRGLHVLTFRGLHALTFRGLLAITFVGLHALNLRGLHVLAIRGGLHTLNFRGLHALAFRRLYALAFRGLHALAFKGRHVLSFRGPPALAFRGLHVLNFRGLHALTFRALHVLTSRGLHALTFRGLHLLTFRGLPVLTFRGLHALAFKGRHILNFSGLHALAFRGLHVFATRGLHILTLRGLHAFAFRGLHTLAFRGLHALTFKGRHILNIIGLHAYAFRGLHVLAITGLHVLTFRGLHALTFRGLH

SEQ ID NO: 217444 - protein, 141 aa, Glycine max
  Coding DNA Sequence Number=SeqID_100666
SRKQTLSLLPYPQDLSSPFATCHHRLLLTIVAAEQLHELGFVTATRLIIRWSLTSMQVGPIRVKWGERALILVACTQHGMGGAEEEESLILAFAVAFGFGNKEIKTNHTHPATSILIQAFTRAFFQLLIPFKRDFLVASTY

SEQ ID NO: 217445 - protein, 148 aa, Glycine max
  Coding DNA Sequence Number=SeqID_100667
  Gene Ontology: Mol. function=nucleic acid binding
KKGKAQADGEIGSNGVDKHVEGDDEMTEGIHEFKEAILEHSILNGRQIVFRPNDRVRARAKCNQKFGHVIFCSKVGRSEIYKIKTCRPKHHCGKVFKNKNASSEWVAMLSAEKLRSNNDIKLTQIMDDVIFRYGIAISLVVAWKLDDC

SEQ ID NO: 217446 - protein, 123 aa, Glycine max
  Coding DNA Sequence Number=SeqID_100668
MKKVEHKSNRRGNPTKRSTVGDLIHTDLEISATCRKRNSERIRNVLQDLEAATTPEEEPRSSEASSSFPIAGHSHIVHVEDTIIAEEPRRVTLEDYSSSNLPQLFTSIAQPAYQALPPHIHPH

SEQ ID NO: 217447 - protein, 41 aa, Glycine max
  Coding DNA Sequence Number=SeqID_100669
MVVTGMGTITKGKRPLEDSINAGVVATMEGGGKHGRPQVGQ

SEQ ID NO: 217448 - protein, 157 aa, Glycine max
  Coding DNA Sequence Number=SeqID_100670
MPISPSESIGWFVPSRHRGCAHKTPSGPGEVQQGPGVFSFGYGPLSVLQSCHHDIGIAPAGHLVDPKKSNRALGLPALITGLCQFYGVFVIPNKIIRPPTNRAFIKKYCAPRQAEGKTPQQPGDGQQQATNASPPPQEPFSSSTKRLKYCLRHMVDQ

SEQ ID NO: 217449 - protein, 988 aa, Glycine max
  Coding DNA Sequence Number=SeqID_100671
  Gene Ontology: Mol. function=translation initiation factor activity
  Homolog annotation: Hit_ID=Q9LV05; Match level="QueryCoverage=99%, HitCoverage=85%, E-value=1e-100, Identity=34%"; Hit description =Arabidopsis thaliana genomic DNA, chromosome 5, P1 clone:MYN8
MICSESKKIDELRSPEPDNQLERRMRKKRDDYSDGDKHQDNVEDGYDRHLSSRDDIAKDGKKKDDRRKEEKYRDKYREEIGRENKHRHDKQRDERPAKDHTTIRSDDKHAREEKNSLESRQKRTKLPESDKDHNRDADRDLESVRDRERHSERDRDYDIDRDHDYDRDRDWDWDRDHDRDRDRDRDRRRDRDGSHVDDRSGRGKESGTKKRTLDDRDDYSDSKSRAVKSYYLDSDKRSLSTSRAESDVDRGRSQPQQAHADSSGTSNKHRSSPASNTHIGKDDYRSLNAKAEDSKYRDPSVEQRTKGSREGYSGTSDRGSKYKLMEKPIKIDEFPAGDLSTERSSSAKASPGALMERSPSSTSIERRYVNRSSVKRNLEIDESGRRNSTNVRDFSASDDRLGRESTLEKPLLDEPSQADSSLYGRTNQSNAPLISPPPGFRATLDRPYMGSLEDDVRDNSNSRYRRSSEPGFGRGHGGNSWRAVPNWNSPVPNGYVPFPPGPAHGGFQTMVPQFTSQPLFGVRPPMEVNHAGIPYHIADADRFPGHLRPPLGWPNLMDGTGAAHLHGWDNNNGVFRDDPHMYGGSDWDRNRHSTNSHGWESGSETWKEQSCDSKKELPSPAYKDESVPALVDNGLSDQTSQMSQDEHNRDELAEKSPERKLSSLTSPAEVPLNSSSSTVLEKVPDTSMPSDNTSLFSRFYLSKLDISVDLVLPELYDQCMCALNMDKNASVDAVASTELLLKNGSRTRQKYAATLSRRSPFPEIDNSIFQRAIDLYKKHRVNLPNKREVDDTVVFHQMQVDESFPVPNLENGHVSVSACNGIKDVPMPTLESDKVETTSPAKEQLEGINQTYIQMEQDHDKTGMSSPSSSRVNQEETVAGLQEKEPKITYDKVNSGDAEEDYSLAAKNEAQLAHTLHQEGENIDSEAKTTGFAHCADEKLGFGDTKVNPNPLIVEDGSPKACDALMPGSNESESLILSRIHHSPESTH

SEQ ID NO: 217450 - protein, 308 aa, Glycine max
  Coding DNA Sequence Number=SeqID_100672
  Gene Ontology: Mol. function=nucleic acid binding; Cellular component= intracellular; Biological process=ATP synthesis coupled proton transport
  Homolog annotation: Hit_ID=Q1SPF0; Match level="QueryCoverage=99%, HitCoverage=58%, E-value=1e-142, Identity=80%"; Hit description=Zinc finger, U1-type
VTTEFEESWVVGKVQRWENDNQENGHVLAEHAPIDLDYYSTIEELMEVGPERLKEALAALGLKTGGTVQQRAERLFLTKHTPLEKLDRKHFAKGACGVEKNGVAAVPQEDGNSKEIALMEAKMTKLCHLLEETIARTKDNVVKKQALTYEEMEAEREEEETQEDSESEDEEQQIYNPLKLPMGWDGKPIPYWLYKLHGLGQEFKCEICGNYSYWGRRAFERHFKEWRHQHGMRCLGIPNTKNFNEITSIERVLTSVLRALEAKELWKKIQQRQGVNKWRPDLEEEYEDKEGNIYNKKTYTDLQRQGLI

SEQ ID NO: 217451 - protein, 81 aa, Glycine max
  Coding DNA Sequence Number=SeqID_100673
MLQNGAIKGLDDAPQPKSKASARWIVVKCNRQRGSTECGYYVKHWMSTIILGTFRNNWEATIGAREIKSIADLVGTILSPS

SEQ ID NO: 217452 - protein, 83 aa, Glycine max
  Coding DNA Sequence Number=SeqID_100674
  Homolog annotation: Hit_ID=Q1SFG0; Match level="QueryCoverage=44%, HitCoverage=2%, E-value=6e-11, Identity=89%"; Hit description =Glycoside hydrolase, family 10; DNA repair protein RadA
MKNQGVTEDRMVFLKGVSGAFRPGVLTALMGVSGVGKKRKSTASNLIFCGENELEDVKSFTRDLLKKRLLTKHNETQGRWKDS

SEQ ID NO: 217453 - protein, 154 aa, Glycine max
  Coding DNA Sequence Number=SeqID_100675
  Gene Ontology: Mol. function=catalytic activity; Cellular component =mitochondrion; Biological process=folic acid and derivative biosynthetic process
  Homolog annotation: Hit_ID=Q6K2P4; Match level="QueryCoverage=89%, HitCoverage=34%, E-value=3e-47, Identity=63%"; Hit description =Methylenetetrahydrofolate dehydrogenase-like
  Pfam annotation: Domain name=THF_DHG_CYH_C; Domain location=23-154; Score=143.4; E_value=6e-40; Accession=PF02882.9; Description =Tetrahydrofolate dehydrogenasecyclohydrolase, NAD(P)-binding domain
MQHLDEEKIINVVSPEKDVDGFHPLNIGNLAIRGRKPFFVPCAPKGCIELLLSHGVEIKGKRAVIIGRSKIVGLPTSLLLQRHHATVSVLHAYTKNPEHITSEADIVVVVDVGVPNIVRGNWLKKGVVVIDMGTNQVKNLVLYPNELSCLKSTR

SEQ ID NO: 217454 - protein, 83 aa, Glycine max
  Coding DNA Sequence Number=SeqID_100676
MDKSKIDIWGGQRLTCEKHVGKRFEHSLARNSHTLGFYMYNTCSASPCSSLLLLFLLLNRELFAQFRHARETEGRYMFLNCKV

SEQ ID NO: 217455 - protein, 239 aa, Glycine max
  Coding DNA Sequence Number=SeqID_100677
  Homolog annotation: Hit_ID=Q94F64; Match level="QueryCoverage=50%, HitCoverage=25%, E-value=3e-12, Identity=35%"; Hit description=CDPK adapter protein 1
MNNEKWRRGPHSGGGGGDNEKRFVLTEMPLFVWPYVGGVPVRRGFRVLGYHSGCKLGYKAWPLVVEVRQRRGDADRLFEVIDRSPEAAYRLIRNDESMALRVSRTPISCKEENKSLENDATIESNAGKDLTKEKTFDFQSVSSFSSCEGLPYAPKGWPNHGDIWGRKVGRRTNKAGYFHDRYLCLSRSLQSSSRKTRSFQSKLAVKWYIEPDFPNMKIEEFFPLFSRKVPTNKRTRTKG

SEQ ID NO: 217456 - protein, 327 aa, Glycine max
  Coding DNA Sequence Number=SeqID_100678
  Gene Ontology: Mol. function=inorganic anion transporter activity; Cellular component=integral to membrane; Biological process =inorganic anion transport
  Homolog annotation: Hit_ID=Q8XR86; Match level="QueryCoverage=75%, HitCoverage=53%, E-value=1e-109, Identity=78%"; Hit description =Probable nitrite/nitrate transporter transmembrane protein
HGEAGRKADERAEGADIQPAHQPVVLALEDHRLVGERGARIGDVVHAEPCRERGQRDGNDPDEAGVLQPQAALCVAGGNRLRLAAEGAEHAHRDHHRHHELHQRHAQVADAGIKARGQAFLVLGKEEADVGHAGAEVAAAQAAQQRQDQQRRERGGRVAQRKAHAQRRDQQRGGRDRGPLAAAEHRHQERIEDAQRGARQGRQRGQPEHLVLGQHEAGAVEVDHHHAPQHPDAERQHQRGNGNPQVAVGDAGAGLFPEAGAAWRRAVAALSGRKLKCMKMSETQTVPYSSMKALERTPVMSSSTPEQDRQDEVAQAAGQADDARDLR

SEQ ID NO: 217457 - protein, 87 aa, Glycine max
  Coding DNA Sequence Number=SeqID_100679
MVGHEEGLEIVRARRILVPLSLEEVYNFCLEMKGEGEGGVEGVGGDFEASIVQGEKKRVRKLSVKSSIPVWLINGSGLTEEDAKSYL

SEQ ID NO: 217458 - protein, 153 aa, Glycine max
  Coding DNA Sequence Number=SeqID_100680
  Subcellular localization annotation: CTP_CleavageSite=72; ConfidenceScore=5.39e-01
MSTLENLQTLHLSINHLNLSFIPPCLTSVSSFSRVYPLYLPNLSTNIVNSNIPKSLTNSTNLVVHLHSKSITSDARSIGACRPRIFFINGFLCFLEDEWQRNGERKRERRRHFKEKMSLEEAHHHRRPWIRAWRKKEMNEGRGREEHEILCSK

SEQ ID NO: 217459 - protein, 503 aa, Glycine max
  Coding DNA Sequence Number=SeqID_100681
  Gene Ontology: Mol. function=catalytic activity; Cellular component =mitochondrial matrix; Biological process=metabolic process
  Homolog annotation: Hit_ID=Q0K3L2; Match level="QueryCoverage=60%, HitCoverage=95%, E-value=1e-115, Identity=66%"; Hit description=HMG -like protein
  Pfam annotation: Domain name=HMGL-like; Domain location=196-467; Score=172.0; E_value=1.5e-48; Accession=PF00682.9; Description=HMGL -like
MESLIPEYSVFDHIRQPAGSSLPGIAPTNAYRCKDGKYALVAGNGDFIFQRLMQIIDRPDLAADPALAHNDGRVKQVEMLDAAIGEWTSQRSLQEVLASLNEGGIPAGKIYDAADIANDPHYKARDMLLPAQLSDGTPVTLPGIVPKLLSTPGSVRHAAPELGQHTEEVLSELGGRMTLQRQSPAGRIYMQEVCPRDGLQNEAVFVETQDKIALIDRLSQCGFVKVEVTSFTSPKAIPALKDAEAVMHGIRRMPGVEYSVLVPNQRGAERAMACRIDEANLVMSASESHNNTNLRMSREASFSQLSQVVHELSNTPVAINVSLSAAFGCPFEGDVPQNTVLNFVDRFASLGVRGVTLCDTTGMAFPTQVASLSRMVKQHFPHLEITLHFHDTRGLALANTVAALSEGIDRFDSSTGGLGGCPYAPGASGNVCTEDMVHMLELMGYQTNVDLPALLGLSRDLESLIGHKVHGAVVKSGQRSDLHQMPASLEQNFNNFNKTGSPT

SEQ ID NO: 217460 - protein, 281 aa, Glycine max
  Coding DNA Sequence Number=SeqID_100682
  Gene Ontology: Mol. function=transporter activity; Cellular component= integral to membrane; Biological process=transport
  Homolog annotation: Hit_ID=Q8UHT6; Match level="QueryCoverage=100%, HitCoverage=72%, E-value=1e-133, Identity=91%"; Hit description=ABC transporter, membrane spanning protein
MDIVKRLRRVGLPRLIVHASVLIVVLLWLLPTLGILVSSLRDKDQITVSGWWTAFSSSEQTQAVRLADASAQKQDGSRYVISGNVFENGQGGKVAAFGVRVQEPTAFKAGEAADIGDGETLLINEDGTYEYSKAASFEGSRGKRVYISVATPPVFTLDNYRTVLTSEGIGQSFVNSLTVAVPATVIPILIAAFAAYALSWMNFSGRNLLIAMVVGLIVVPLQMSLIPLLRLYNEIGTIFGVPSKTYAGIWLAHTAFGLPLAIYLLRNYISRPAERDHRKRP

SEQ ID NO: 217461 - protein, 258 aa, Glycine max
  Coding DNA Sequence Number=SeqID_100683
  Gene Ontology: Mol. function=acyltransferase activity; Cellular component=integral to membrane
  Homolog annotation: Hit_ID=Q69X62; Match level="QueryCoverage=97%, HitCoverage=48%, E-value=4e-98, Identity=67%"; Hit description =Putative beta-ketoacyl-CoA synthase
  Pfam annotation: Domain name=ACP_syn_III_C; Domain location=144-228; Score=8.4; E_value=1.9e-06; Accession=PF08541.1; Description=3 -Oxoacyl-[acyl-carrier-protein (ACP)
  Pfam annotation: Domain name=Chal_sti_synt_C; Domain location=87-230; Score=17.0; E_value=6.7e-05; Accession=PF02797.6; Description =Chalcone and stilbene synthases, C-te
  Pfam annotation: Domain name=FAE1_CUT1_RppA; Domain location=1-130; Score=44.1; E_value=3.5e-19; Accession=PF08392.2; Description =FAE1Type III polyketide synthase-lik
  Pfam module annotation: Pfam domain module=ACP_syn_III_C::Chal_sti _synt_C::FAE1_CUT1_RppA; Domain location=144-228::87-230::1-130
AHPNSYALVLSTENEISSMYWGNNPSMLLVNCLFRMGGSAALLSSHLSDRQRSKYELFHTLRTHVGADDNSYKCVFQEEDDENKVGVSLSKELMNVARDALKVHITSLGPVVLPISEKLKFLVNLIERKVLKTKIESYMPNFKLAFKHFCIHTGGRAVLDRMQKSLELEDWHMEPSRMTLYRFGNTSSSSVWYELAYCEAKGRIKKGDRVWQMAFGSGFKCNTAVWVALNTIEPGSIKSPWRDEIHNFPVKVDPLPVK

SEQ ID NO: 217462 - protein, 206 aa, Glycine max
  Coding DNA Sequence Number=SeqID_100684
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELA

SEQ ID NO: 217463 - protein, 112 aa, Glycine max
  Coding DNA Sequence Number=SeqID_100685
MYMVSFHVSEELVVESSIFEILKIKTTFYITVQRNSIVCDGCGISSNITTQRFTNPQKQNRPNVKLEVEEHGSRVDERKKEVCTKPNPNIQLHRDLTEYKVFKKAMNRGSGN

SEQ ID NO: 217464 - protein, 137 aa, Glycine max
  Coding DNA Sequence Number=SeqID_100686
  Homolog annotation: Hit_ID=Q6EPN8; Match level="QueryCoverage=27%, HitCoverage=8%, E-value=7e-09, Identity=73%"; Hit description =Putative Ste24p
MPLSWLLENLRPIASNNPSRKLGSLGGMLKYTSVETYSVLQASCLQHWFKNWQALRRNKLTASTFAAAIGFIALAEEIKARYDKAAVKVVDLILTLLQFGGYTLVQNSVDLYRSFGFDTQPVLIGLIIFQASSALDI

SEQ ID NO: 217465 - protein, 57 aa, Glycine max
  Coding DNA Sequence Number=SeqID_100687
MDEFDILVSLILSQTHLCLFNFHRNVSVGKTKMDTSEPYTRAMRGIVHEPQVNLGAD

SEQ ID NO: 217466 - protein, 62 aa, Glycine max
  Coding DNA Sequence Number=SeqID_100688
MVAPPDSTPSVEQINEMVAWPETQPSLHKEDAGPTAQDESSEATILEPFVIREEAEETQVRQ

SEQ ID NO: 217467 - protein, 222 aa, Glycine max
  Coding DNA Sequence Number=SeqID_100689
MQQINGMLNEAQRKKVTESTSSQTFAMEGSVAVSNENSHLEQSENMEQDVGEMEKDKGLNKAFDMERNGEGGNIKNAKATNETREIESDKDLAAQSAFIHEEFIGKQKVSKESVADQDIGLMRTECKVGEKKLKEIGVENQQANEKIRAPEMTAGDAEHSGTQTEKEGDTVTKADYRGTEAAGPAAVQETVNVQKTAQWFHVGQSTESKAKSSPKKKKKQKN

SEQ ID NO: 217468 - protein, 98 aa, Glycine max
  Coding DNA Sequence Number=SeqID_100690
MGHEDEEEDDDSNNTNNNDDDDDDDDHVPQQQHTITCDHPRTRGDRGHRTRGQKSPANPEQQQDEIPRRISRRIRWEGDHDDEVFGIKVVVTCLFMME

SEQ ID NO: 217469 - protein, 140 aa, Glycine max
  Coding DNA Sequence Number=SeqID_100691
MSYPYFIKLHLIKSAAKDDLEHLQLMKNVCLGSIPEIHMESCDMRKFGDDKSWIQLINFSYLHLNIRPYEEKSMILPLCMSNNGDFFMLKFTRNANDEYQTILYNQGDGKSQVSVIPSDSFRTLLWRNLKIFTKSLVIPY

SEQ ID NO: 217470 - protein, 319 aa, Glycine max
  Coding DNA Sequence Number=SeqID_100692
  Gene Ontology: Mol. function=transporter activity; Cellular component= integral to membrane; Biological process=transport
  Homolog annotation: Hit_ID=Q880U9; Match level="QueryCoverage=97%, HitCoverage=74%, E-value=2e-78, Identity=47%"; Hit description=Major facilitator family transporter
  Pfam annotation: Domain name=MFS_1; Domain location=21-318; Score =77.6; E_value=4e-20; Accession=PF07690.6; Description=Major Facilitator Superfamily
MNNSPGQRSRLSEENRLLIILFFVFGCVFVDRLTISFLFPMIAADLKLSNVHLGTLSAVLALTWALSGAGLGAIADRFNIRKPMLILSILVFSLFSALSGLVSGFAMLLIFRGLMGIAEGPVLPIAQSLMVEKSQPQRRGFNMGLIQGAAPGLLGGIIAPPLIIYLAQKWGWSMAFHLTAVPGIILAWLIYRYVNGKKDPAFSAAPAADKAANKGAYGELFKIKNVALCILISCVFVTWFMIIITFTPNFLVTDRGFSEGTMGGIMSAIGAAWVFWGVAVPAISDRLGRKPTLIFFSLLAVCCPLFLSYVDNPWLLGVL

SEQ ID NO: 217471 - protein, 293 aa, Glycine max
  Coding DNA Sequence Number=SeqID_100693
  Gene Ontology: Mol. function=transcription factor activity; Biological process=regulation of transcription, DNA-dependent
  Homolog annotation: Hit_ID=Q47V37; Match level="QueryCoverage=94%, HitCoverage=92%, E-value=4e-78, Identity=50%"; Hit description =Substrate-binding transcriptional regulator, LysR family
MADILIAGVRIDGVNAQYFAAVAGQDLGQLAVLQIFIHHAARHHGDTVAADHRFADRSRIVGRQVAVNLQLVDFVASRSFHQPVGGAALLVGVGQAVVAKQVFGATRFRVAFQVPRRADDHPAGIEDRPGNQARIRHGAGADRQIDTFFHQIDKAVFQPHLDLQAGVQSAKFRHALAQQQLAGNGRHRHANGAGQLFALFADGVQRLLHFGADLFGLLVERLAAFGQRQAAGGAVQQPGTQRFFQPPDAFTDHRAGDAGALCGLAERAAVDNQGEQNQVVGVFVSGEHGHPVE

SEQ ID NO: 217472 - protein, 95 aa, Glycine max
  Coding DNA Sequence Number=SeqID_100694
MDENTIYGAPKKSREWKIALSNHYAWLQTRGWRTHERKRNSWGSEKRGREWRIALSNHYAWLETRGWRMHERKRNSWGSEKRGREWRIALSNHYA

SEQ ID NO: 217473 - protein, 72 aa, Glycine max
  Coding DNA Sequence Number=SeqID_100695
MCLSGKEMRGEKVANAQDFVGNQRERATLGRGFWLKACRTAGHDTCQDLASGSGIKGMFPHYSHDTHATNDD

SEQ ID NO: 217474 - protein, 91 aa, Glycine max
  Coding DNA Sequence Number=SeqID_100696
MGDLASHCHERVTNTKRKQEPACAREAHMQSPSDISECALSRKVSWLDSHLDFMWDFTMRFVVSWGSLDFATVVAVEITVVGFYDRLRLRS

SEQ ID NO: 217475 - protein, 131 aa, Glycine max
  Coding DNA Sequence Number=SeqID_100697
  Homolog annotation: Hit_ID=Q9SWB3; Match level="QueryCoverage=99%, HitCoverage=21%, E-value=7e-33, Identity=61%"; Hit description=Seed maturation protein PM39
MEHQRILGKVTESEEVKRRLGGESVVTEKKYQEMYVNSPGKGVVDKFKGMVGTWFTNPAENQSSQVFRFSYLGRSVLRNKRNYDYQSATLILNLWFAWAEDSSMNYEAGRAEVEQVNQGAAGERRQQESSN

SEQ ID NO: 217476 - protein, 175 aa, Glycine max
  Coding DNA Sequence Number=SeqID_100698
  Homolog annotation: Hit_ID=Q2HRE8; Match level="QueryCoverage=79%, HitCoverage=59%, E-value=4e-15, Identity=50%"; Hit description =Lipopolysaccharide-modifying protein
  Pfam annotation: Domain name=DUF821; Domain location=3-169; Score= -205.5; E_value=1.6e-08; Accession=PF05686.3; Description=Arabidopsis thaliana protein of unknown function (DUF821)
MAYFVGRVERRHYEDTMAEQRALCLLERIGFENHKRGSANQTCQVNALIDIRCTLKVLLGQSVKNTFCHVTLPLYVYDYMFHLLNSYAKLFRYKPSISANATELCVESMVCGAEGSVKKFMMESLVKVPANTDPCTMPAPFDPPTLYATLQRKESSIQQVESWEKSCWDNQTITS

SEQ ID NO: 217477 - protein, 1978 aa, Glycine max
  Coding DNA Sequence Number=SeqID_100699
  Gene Ontology: Mol. function=protein binding; Cellular component =integral to membrane; Biological process=defense response to fungus
  Homolog annotation: Hit_ID=Q949G9; Match level="QueryCoverage=99%, HitCoverage=96%, E-value=0.0, Identity=36%"; Hit description=HcrVf1 protein
  Pfam annotation: Domain name=LRRNT_2; Domain location=1-33; Score =20.3; E_value=0.0067; Accession=PF08263.3; Description=Leucine rich repeat N-terminal domain
  Pfam annotation: Domain name=LRRNT_2; Domain location=865-905; Score =40.2; E_value=6.9e-09; Accession=PF08263.3; Description=Leucine rich repeat N-terminal domain
  Pfam annotation: Domain name=LRR_1; Domain location=1020-1043; Score =13.9; E_value=0.57; Accession=PF00560.23; Description=Leucine Rich Repeat
  Pfam annotation: Domain name=LRR_1; Domain location=1045-1066; Score =9.3; E_value=5.2; Accession=PF00560.23; Description=Leucine Rich Repeat
  Pfam annotation: Domain name=LRR_1; Domain location=1093-1114; Score =8.5; E_value=7.5; Accession=PF00560.23; Description=Leucine Rich Repeat
  Pfam annotation: Domain name=LRR_1; Domain location=1119-1141; Score =7.3; E_value=12; Accession=PF00560.23; Description=Leucine Rich Repeat
  Pfam annotation: Domain name=LRR_1; Domain location=114-136; Score =13.7; E_value=0.67; Accession=PF00560.23; Description=Leucine Rich Repeat
  Pfam annotation: Domain name=LRR_1; Domain location=1143-1168; Score =2.0; E_value=1.2e+02; Accession=PF00560.23; Description=Leucine Rich Repeat
  Pfam annotation: Domain name=LRR_1; Domain location=1170-1192; Score =14.3; E_value=0.46; Accession=PF00560.23; Description=Leucine Rich Repeat
  Pfam annotation: Domain name=LRR_1; Domain location=1194-1216; Score =11.7; E_value=1.8; Accession=PF00560.23; Description=Leucine Rich Repeat
  Pfam annotation: Domain name=LRR_1; Domain location=1218-1240; Score =12.8; E_value=1.1; Accession=PF00560.23; Description=Leucine Rich Repeat
  Pfam annotation: Domain name=LRR_1; Domain location=1242-1264; Score =20.3; E_value=0.0068; Accession=PF00560.23; Description=Leucine Rich Repeat
  Pfam annotation: Domain name=LRR_1; Domain location=1266-1288; Score =22.1; E_value=0.002; Accession=PF00560.23; Description=Leucine Rich Repeat
  Pfam annotation: Domain name=LRR_1; Domain location=1290-1312; Score =15.3; E_value=0.23; Accession=PF00560.23; Description=Leucine Rich Repeat
  Pfam annotation: Domain name=LRR_1; Domain location=1314-1336; Score =14.7; E_value=0.34; Accession=PF00560.23; Description=Leucine Rich Repeat
  Pfam annotation: Domain name=LRR_1; Domain location=1338-1360; Score =0.6; E_value=2.2e+02; Accession=PF00560.23; Description=Leucine Rich Repeat
  Pfam annotation: Domain name=LRR_1; Domain location=1367-1389; Score =1.6; E_value=1.4e+02; Accession=PF00560.23; Description=Leucine Rich Repeat
  Pfam annotation: Domain name=LRR_1; Domain location=138-160; Score =1.2; E_value=1.7e+02; Accession=PF00560.23; Description=Leucine Rich Repeat
  Pfam annotation: Domain name=LRR_1; Domain location=1391-1413; Score =12.3; E_value=1.4; Accession=PF00560.23; Description=Leucine Rich Repeat
  Pfam annotation: Domain name=LRR_1; Domain location=1415-1437; Score =10.4; E_value=3.2; Accession=PF00560.23; Description=Leucine Rich Repeat
  Pfam annotation: Domain name=LRR_1; Domain location=1439-1462; Score =8.2; E_value=8.3; Accession=PF00560.23; Description=Leucine Rich Repeat
  Pfam annotation: Domain name=LRR_1; Domain location=1464-1486; Score =0.7; E_value=2.1e+02; Accession=PF00560.23; Description=Leucine Rich Repeat
  Pfam annotation: Domain name=LRR_1; Domain location=1512-1534; Score =5.2; E_value=31; Accession=PF00560.23; Description=Leucine Rich Repeat
  Pfam annotation: Domain name=LRR_1; Domain location=1537-1559; Score =8.3; E_value=8; Accession=PF00560.23; Description=Leucine Rich Repeat
  Pfam annotation: Domain name=LRR_1; Domain location=1561-1584; Score =9.4; E_value=4.9; Accession=PF00560.23; Description=Leucine Rich Repeat
  Pfam annotation: Domain name=LRR_1; Domain location=1610-1631; Score =12.6; E_value=1.3; Accession=PF00560.23; Description=Leucine Rich Repeat
  Pfam annotation: Domain name=LRR_1; Domain location=162-185; Score =13.6; E_value=0.73; Accession=PF00560.23; Description=Leucine Rich Repeat
  Pfam annotation: Domain name=LRR_1; Domain location=1634-1656; Score =9.7; E_value=4.5; Accession=PF00560.23; Description=Leucine Rich Repeat
  Pfam annotation: Domain name=LRR_1; Domain location=1658-1680; Score =10.5; E_value=3.2; Accession=PF00560.23; Description=Leucine Rich Repeat
  Pfam annotation: Domain name=LRR_1; Domain location=1682-1705; Score =12.7; E_value=1.2; Accession=PF00560.23; Description=Leucine Rich Repeat
  Pfam annotation: Domain name=LRR_1; Domain location=1707-1729; Score =11.1; E_value=2.3; Accession=PF00560.23; Description=Leucine Rich Repeat
  Pfam annotation: Domain name=LRR_1; Domain location=1731-1753; Score =13.7; E_value=0.68; Accession=PF00560.23; Description=Leucine Rich Repeat
  Pfam annotation: Domain name=LRR_1; Domain location=1803-1825; Score =8.7; E_value=6.6; Accession=PF00560.23; Description=Leucine Rich Repeat
  Pfam annotation: Domain name=LRR_1; Domain location=1827-1849; Score =15.0; E_value=0.28; Accession=PF00560.23; Description=Leucine Rich Repeat
  Pfam annotation: Domain name=LRR_1; Domain location=1851-1873; Score =17.0; E_value=0.068; Accession=PF00560.23; Description=Leucine Rich Repeat
  Pfam annotation: Domain name=LRR_1; Domain location=187-209; Score =14.3; E_value=0.46; Accession=PF00560.23; Description=Leucine Rich Repeat
  Pfam annotation: Domain name=LRR_1; Domain location=1875-1896; Score =6.8; E_value=15; Accession=PF00560.23; Description=Leucine Rich Repeat
  Pfam annotation: Domain name=LRR_1; Domain location=242-264; Score =18.6; E_value=0.022; Accession=PF00560.23; Description=Leucine Rich Repeat
  Pfam annotation: Domain name=LRR_1; Domain location=266-288; Score =16.6; E_value=0.089; Accession=PF00560.23; Description=Leucine Rich Repeat
  Pfam annotation: Domain name=LRR_1; Domain location=290-312; Score =17.1; E_value=0.062; Accession=PF00560.23; Description=Leucine Rich Repeat
  Pfam annotation: Domain name=LRR_1; Domain location=314-336; Score =19.1; E_value=0.016; Accession=PF00560.23; Description=Leucine Rich Repeat
  Pfam annotation: Domain name=LRR_1; Domain location=367-389; Score =0.5; E_value=2.3e+02; Accession=PF00560.23; Description=Leucine Rich Repeat
  Pfam annotation: Domain name=LRR_1; Domain location=391-413; Score =10.0; E_value=3.9; Accession=PF00560.23; Description=Leucine Rich Repeat
  Pfam annotation: Domain name=LRR_1; Domain location=415-437; Score =11.6; E_value=1.9; Accession=PF00560.23; Description=Leucine Rich Repeat
  Pfam annotation: Domain name=LRR_1; Domain location=439-462; Score =7.7; E_value=10; Accession=PF00560.23; Description=Leucine Rich Repeat
  Pfam annotation: Domain name=LRR_1; Domain location=464-487; Score =3.4; E_value=65; Accession=PF00560.23; Description=Leucine Rich Repeat
  Pfam annotation: Domain name=LRR_1; Domain location=512-535; Score =6.4; E_value=18; Accession=PF00560.23; Description=Leucine Rich Repeat
  Pfam annotation: Domain name=LRR_1; Domain location=542-563; Score =12.2; E_value=1.5; Accession=PF00560.23; Description=Leucine Rich Repeat
  Pfam annotation: Domain name=LRR_1; Domain location=567-589; Score =2.5; E_value=96; Accession=PF00560.23; Description=Leucine Rich Repeat
  Pfam annotation: Domain name=LRR_1; Domain location=591-614; Score =13.0; E_value=1.1; Accession=PF00560.23; Description=Leucine Rich Repeat
  Pfam annotation: Domain name=LRR_1; Domain location=616-638; Score =7.5; E_value=11; Accession=PF00560.23; Description=Leucine Rich Repeat
  Pfam annotation: Domain name=LRR_1; Domain location=640-662; Score =12.1; E_value=1.6; Accession=PF00560.23; Description=Leucine Rich Repeat
  Pfam annotation: Domain name=LRR_1; Domain location=710-732; Score =7.9; E_value=9.6; Accession=PF00560.23; Description=Leucine Rich Repeat
  Pfam annotation: Domain name=LRR_1; Domain location=734-752; Score =4.2; E_value=46; Accession=PF00560.23; Description=Leucine Rich Repeat
  Pfam annotation: Domain name=LRR_1; Domain location=754-776; Score =13.2; E_value=0.92; Accession=PF00560.23; Description=Leucine Rich Repeat
  Pfam annotation: Domain name=LRR_1; Domain location=778-799; Score =8.6; E_value=7.1; Accession=PF00560.23; Description=Leucine Rich Repeat
  Pfam annotation: Domain name=LRR_1; Domain location=87-112; Score =7.0; E_value=14; Accession=PF00560.23; Description=Leucine Rich Repeat
  Pfam annotation: Domain name=LRR_1; Domain location=947-970; Score =12.3; E_value=1.4; Accession=PF00560.23; Description=Leucine Rich Repeat
  Pfam annotation: Domain name=LRR_1; Domain location=972-994; Score =14.1; E_value=0.5; Accession=PF00560.23; Description=Leucine Rich Repeat
  Pfam module annotation: Pfam domain module=LRRNT_2::LRRNT_2::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::...
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::...
  Pfam module annotation: Pfam domain module=LRR_1::LRR_1::LRR_1::LRR _1::LRR_1::LRR_1::LRR_1::LRR_1::LRR_1::LRR_1; Domain location=1 -33::865-905::1020-1043::1045-1066::1093-1114::1119-1141::114 -136::1143-1168::1170-1192::...
  Pfam module annotation: Domain location=1194-1216::1218-1240::1242 -1264::1266-1288::1290-1312::1314-1336::1338-1360::1367-1389::138 -160::1391-1413::1415-1437::1439-1462::1464-1486::1512-1534::1537 -1559::1561-1584::...
  Pfam module annotation: Domain location=1610-1631::162-185::1634 -1656::1658-1680::1682-1705::1707-1729::1731-1753::1803-1825::1827 -1849::1851-1873::187-209::1875-1896::242-264::266-288::290-312::314 -336::367-389::...
  Pfam module annotation: Domain location=391-413::415-437::439 -462::464-487::512-535::542-563::567-589::591-614::616-638::640 -662::710-732::734-752::754-776::778-799::87-112::947-970::972-994
MKFKNNLNDPSNRLWSWNHNNTNCCHWYGVLCHNLTSHLLQLHLHTSDSAFYHDAYHYRFYHRFDEEAYRRWSFGGEISPCLADLKHLNYLDLSANAFLGEGMSIPSFLGTMTSLTHLNLSYTGFYGKIPPQIGNLSNLVYLDLSYVVANGTVPSQIGNLSKLRYLDLSYNYFEGMTIPSFLCAMTSLTHLDLSYTPFMGKIPSQIGNLSNLVYLGLGSYDFEPLLPENVEWVSIIPLPLTSLVELDLSNNQLEGTIRTSLGNLTCLVELDLSANQLEGTIPTSLGNLTSLVKLQLSRNQLEGTIPTSLGNLTSLVRLDLSYNQLEGTIPTSLANLCNLMEIDFSYLKLNQQVNELLEILAPCISHGLTALAVQSSRLSGNLTDHIGAFKNIDTLLFSNNSIGGALPRSFGKLSSLTYLDLSINKFSGNPFESLRSLSKMSSLQIDGNNFQGVVKEDDLANLTSLMEFHASGNNFTLKVGPKWLPNFQLSYLDVTSWQLGPNFPSWIQSQNQLQHFGLSNTGILDSIPTWFWEALSQDEPMQLKILNLASNNLSGEIPDCWMNWTFLADSLQIRNNTLSGIFPTSLKKNKKLISLDLGENNLSGSIPTWVGEKLLNVKILRLRSNSFAGLISNEICQMSLLQVLDVAQNNLSGNIPSCFSNLSAMTLKNQSTDPRIYSQAQYNMSSMYSIVSVLLWLKGRGDEYRNILGLVTSIDLSSNKLLGEIPREITDLNGLNFLNLSHNQLIGPIGNMGLLQSIDFSRNQLSGEIPPTISNLSFLSMLDLSYNHLKGKIPTGTQLQTFDASSIIGNNLCGPPLPINCSSNGKTHSYEGSHGHGVNWFFVSATIGFVVGFWIVIAPLLICRSWRERETLLKFKNNLIDPSNRLWSWNHNNTNCCHWYGVLCHNLTSHLLQLHLSSSDYAFYDEEAYRRWSFGGEISPCLADLKHLNYLDLSGNDFEGMSIPSFLGTMTSLTHLNLSDSGFHGKIPPQIGNLSNLVYLDLSSVVDDGTVPSQIGNLSKLRYLDLSDNYFEGMAIPSFLCAMTSLTHLDLSSGFMGKIPSQIGNLSNLVYLGLGGSYDLLAENVEWVSSMWKLEYLHLSKANLSKAFHWLHTLQSLPSLTHLYLSDCTLPHYNEPSLLNFSSLQTLHLYRTSYSPAISFVPKWIFKLKKLVSLQLQSNEIQGSIPGGIRNLTLLQNLDLSGNSFSSSIPDCLYGLHRLMYLDLSYNNLLGTISDALGNLTSLVELDLSRNQLEGTIPTSLGNLTSLVELYLSNNQLEGTIPPSLGNLTSLIRLDLSYSQLEGNIPTSLGNLTSLVELDLSYSQLEGNIPTSLGNVCNLRVIRLSYLKLNQQVNELLEILAPCISHGLTRLAVQSSQLSGNLTDHIGAFENIVLLDFSNNSIGGALPRSFGKLSSLRFLNLSINKFSGNPFESLGSLSKLSSLYIDGNLFHGVVKEDDLANLTSLTEFGASGNNFTLKVGPNWRPNFRLSYLDVTSWQLSPNFPSWIQSQNKLQYVGLSNTGILDSIPTWFWETPSQILYLNLSYNHIHGEIETTLKNPISIQTIDLSSNHLCGKLPYLSSDVFQLDLSSNSFSESMNDFLCKHQDGPVQLEFLNLASNNLSGEIPDCWMNWTSLVYVNLQSNHFVGNLPQSMGSLADLQSLQIRNNTLSGIFPTSLKKNNQLISLDLGENNLSGSIPTWVGEKLLNVKILLLRSNSFTGHIPNEICQMSLLQVLDLAQNNLSGNIPSCFSNLSAMTLKNQSTDPHIYSQAQLVMLYTSWYSIVSVLLWLKGRGDEYRNILGLVTSIDLSSNKLLGEIPKKITNLNGLNFLNLSHNQLIGHIPQGIGNMGSLQSIDFSRNQLSGEIPPTISNLSFLSMLDVSYNHLKGKIPTGTQLQTFDASSFIGNNLCGPPLPINCWSNGKTHSYEGSDGHGVNWFFVGATIGFVVGFWIVIAPLLICRSWRSIRFPGGIRNLTLL

SEQ ID NO: 217478 - protein, 481 aa, Glycine max
  Coding DNA Sequence Number=SeqID_100700
  Gene Ontology: Mol. function=protein binding; Cellular component =integral to membrane; Biological process=defense response to fungus
  Homolog annotation: Hit_ID=Q949G9; Match level="QueryCoverage=87%, HitCoverage=87%, E-value=2e-81, Identity=32%"; Hit description =HcrVf1 protein
  Pfam annotation: Domain name=LRRNT_2; Domain location=65-105; Score =51.0; E_value=3.9e-12; Accession=PF08263.3; Description=Leucine rich repeat N-terminal domain
  Pfam annotation: Domain name=LRR_1; Domain location=154-179; Score =8.2; E_value=8.2; Accession=PF00560.23; Description=Leucine Rich Repeat
  Pfam annotation: Domain name=LRR_1; Domain location=181-203; Score =11.2; E_value=2.3; Accession=PF00560.23; Description=Leucine Rich Repeat
  Pfam annotation: Domain name=LRR_1; Domain location=232-253; Score =10.0; E_value=3.8; Accession=PF00560.23; Description=Leucine Rich Repeat
  Pfam annotation: Domain name=LRR_1; Domain location=258-280; Score =8.7; E_value=6.6; Accession=PF00560.23; Description=Leucine Rich Repeat
  Pfam annotation: Domain name=LRR_1; Domain location=282-307; Score =7.0; E_value=14; Accession=PF00560.23; Description=Leucine Rich Repeat
  Pfam annotation: Domain name=LRR_1; Domain location=309-331; Score =13.2; E_value=0.97; Accession=PF00560.23; Description=Leucine Rich Repeat
  Pfam annotation: Domain name=LRR_1; Domain location=333-355; Score =11.7; E_value=1.8; Accession=PF00560.23; Description=Leucine Rich Repeat
  Pfam annotation: Domain name=LRR_1; Domain location=357-379; Score =14.3; E_value=0.44; Accession=PF00560.23; Description=Leucine Rich Repeat
  Pfam annotation: Domain name=LRR_1; Domain location=381-403; Score =19.3; E_value=0.014; Accession=PF00560.23; Description=Leucine Rich Repeat
  Pfam annotation: Domain name=LRR_1; Domain location=434-456; Score =1.8; E_value=1.3e+02; Accession=PF00560.23; Description=Leucine Rich Repeat
  Pfam annotation: Domain name=LRR_1; Domain location=458-480; Score =10.0; E_value=3.9; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1; Domain location=65-105::154-179::181-203::232-253::258-280::282-307::309 -331::333-355::...
  Pfam module annotation: Domain location=357-379::381-403::434 -456::458-480
MDGLCGVSKGFKMNKWKTSRWTYGLETIISLDFVECPKVQDEKMKNLETAMLWLLSLPCRESVCIPSERETLLKFKNNLNDPSNRLWSWNHNNTNCCHWYGVLCHNVTSHLLQLHLNTTFSAAFYDGYYHFDEEAYEKSQFGGEISPCLADLKHLNHLNLSGNYFLGAGMAIPSFLGTMTSLTHLDLSLTGFMGKIPSQIGNLSNLVYLDLGGYSVEPMLAENVEWVSSMWKLEYLHLSYANLSKAFHWLHTLQSLPSLTHLDLSGCTLPHYNEPSLLNFSSLQTLHLSFTSFSPAISFVPKWIFKLKKLVSLQLWGNEIQGPIPGGIRNLTLLQNLDLSGNSFSSSIPDCLYGLHRLKFLNLRDNHLHGTISDALGNLTSLVELDLSGNQLEGNIPTSVGNLCNLRDIDFSNLKLNQQVNELLEILAPCISHGLTRLAVQSSRLSGHLTDHIGAFKNIDTLLFSNNSIGGALPRSFGKLS

SEQ ID NO: 217479 - protein, 601 aa, Glycine max
  Coding DNA Sequence Number=SeqID_100701
  Gene Ontology: Mol. function=protein binding; Cellular component =integral to membrane; Biological process=defense response to fungus
  Homolog annotation: Hit_ID=Q1SWI7; Match level="QueryCoverage=95%, HitCoverage=99%, E-value=1e-157, Identity=51%"; Hit description =Leucine-rich repeat
  Pfam annotation: Domain name=LRR_1; Domain location=114-136; Score =9.5; E_value=4.7; Accession=PF00560.23; Description=Leucine Rich Repeat
  Pfam annotation: Domain name=LRR_1; Domain location=138-161; Score =12.1; E_value=1.6; Accession=PF00560.23; Description=Leucine Rich Repeat
  Pfam annotation: Domain name=LRR_1; Domain location=163-186; Score =6.1; E_value=20; Accession=PF00560.23; Description=Leucine Rich Repeat
  Pfam annotation: Domain name=LRR_1; Domain location=211-233; Score =6.3; E_value=19; Accession=PF00560.23; Description=Leucine Rich Repeat
  Pfam annotation: Domain name=LRR_1; Domain location=236-261; Score =4.6; E_value=39; Accession=PF00560.23; Description=Leucine Rich Repeat
  Pfam annotation: Domain name=LRR_1; Domain location=271-293; Score =10.5; E_value=3.1; Accession=PF00560.23; Description=Leucine Rich Repeat
  Pfam annotation: Domain name=LRR_1; Domain location=295-318; Score =11.5; E_value=2; Accession=PF00560.23; Description=Leucine Rich Repeat
  Pfam annotation: Domain name=LRR_1; Domain location=320-342; Score =3.4; E_value=66; Accession=PF00560.23; Description=Leucine Rich Repeat
  Pfam annotation: Domain name=LRR_1; Domain location=344-366; Score =12.3; E_value=1.4; Accession=PF00560.23; Description=Leucine Rich Repeat
  Pfam annotation: Domain name=LRR_1; Domain location=37-59; Score =11.2; E_value=2.3; Accession=PF00560.23; Description=Leucine Rich Repeat
  Pfam annotation: Domain name=LRR_1; Domain location=416-438; Score =7.9; E_value=9.6; Accession=PF00560.23; Description=Leucine Rich Repeat
  Pfam annotation: Domain name=LRR_1; Domain location=440-462; Score =14.4; E_value=0.41; Accession=PF00560.23; Description=Leucine Rich Repeat
  Pfam annotation: Domain name=LRR_1; Domain location=464-486; Score =16.5; E_value=0.097; Accession=PF00560.23; Description=Leucine Rich Repeat
  Pfam annotation: Domain name=LRR_1; Domain location=488-509; Score =6.8; E_value=15; Accession=PF00560.23; Description=Leucine Rich Repeat
  Pfam annotation: Domain name=LRR_1; Domain location=61-83; Score =11.7; E_value=1.9; Accession=PF00560.23; Description=Leucine Rich Repeat
  Pfam annotation: Domain name=LRR_1; Domain location=85-107; Score =17.9; E_value=0.037; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1; Domain location=114-136::138-161::163 -186::211-233::236-261::...
  Pfam module annotation: Domain location=271-293::295-318::320 -342::344-366::37-59::416-438::440-462::464-486::488-509::61-83::85 -107
MEQFHLRLGISTICSIFALEGNEIQGPIPGGIRNLTLLQNLDLSGNSFSSFIPNCLCGLHRLKFLNLMDNNLHGTISDALRNLTSLVELYLSYNQLEGTIPTFLGNLRNSREIDLTFLDLSINKFSGNPFESLGSLSKLSVLHIDGNNFQGVVNEDDLANLTSLKEFIASGNNFTLKVGPNWIPNFQLTYLDVTSWQIGPNFPSWIQSQNKLQYIGLSNTGILDSIPTWFWEPHSQVLHLNLSHNHIHVEVNLQSNHFVGNFPPSMGSLAELQSLEIRNNLLSGIFPTSLKKTGQLISLDLGENNLSGCIPTWVGEKLSNMKILCLRSNSFPGHIPNEICQMSLLQVLDLAKNSLSGNIPSCFRNLSAMTLVNRSPYPQIYSHAPNNTEYSSVSGIVSVLLWLKGRGDEYGNILGLVTSIDLSSNKLLGEIPREITDLNGLYFLNLSHNQLIGPIPEGIGNMGSLQTIDFSRNQLSDEIPPTISNLSFLSMLDVSYNHLKGKIPTGTQLQTFDAFRFIGNNLCGPSLPINCSSNGKTHSYEGSHGHGVNWFFVSATIGFVVGLWIVIAPLLICRSWRHAYFHFLDHVWFKLQSFSSYSITV

SEQ ID NO: 217480 - protein, 268 aa, Glycine max
  Coding DNA Sequence Number=SeqID_100702
  Gene Ontology: Mol. function=protein binding; Cellular component =integral to membrane; Biological process=defense response to fungus
  Homolog annotation: Hit_ID=Q1SWI6; Match level="QueryCoverage=71%, HitCoverage=87%, E-value=9e-43, Identity=48%"; Hit description =Leucine-rich repeat, plant specific
  Pfam annotation: Domain name=LRRNT_2; Domain location=27-67; Score =50.8; E_value=4.5e-12; Accession=PF08263.3; Description=Leucine rich repeat N-terminal domain
  Pfam annotation: Domain name=LRR_1; Domain location=120-145; Score =7.8; E_value=10; Accession=PF00560.23; Description=Leucine Rich Repeat
  Pfam annotation: Domain name=LRR_1; Domain location=147-169; Score =14.9; E_value=0.29; Accession=PF00560.23; Description=Leucine Rich Repeat
  Pfam annotation: Domain name=LRR_1; Domain location=171-193; Score =1.4; E_value=1.6e+02; Accession=PF00560.23; Description=Leucine Rich Repeat
  Pfam annotation: Domain name=LRR_1; Domain location=195-218; Score =13.9; E_value=0.57; Accession=PF00560.23; Description=Leucine Rich Repeat
  Pfam annotation: Domain name=LRR_1; Domain location=220-242; Score =13.0; E_value=1.1; Accession=PF00560.23; Description=Leucine Rich Repeat
  Pfam module annotation: Pfam domain module=LRRNT_2::LRR_1::LRR_1::LRR_ 1::LRR_1::LRR_1; Domain location=27-67::120-145::147-169::171 -193::195-218::220-242
MNSSSIYILVFLHLWLFSLPRRESVCIPSERETLLKFKNNLNDPSNRLWSWNHNNSNCCHWYGVLCHNLTSHLLQLHLNTSRSAFEYDYYNGFYRRFDEEAYRRWSFGGEISPCLADLKHLNYLDLSANRFLGEGMSIPSFLGTMTSLTHLNLSHTGFMGKIPPQIGNLSNLVYLDLSSVSANGTVPSQIGNLSKLRYLDLSDNYFEGMAIPSFLCAMTSLTHLHLSYTRFHGKIPSQIGNLSNLLYLGLGGHSVVEPLLAENVEWVS

SEQ ID NO: 217481 - protein, 1387 aa, Glycine max
  Coding DNA Sequence Number=SeqID_100703
  Gene Ontology: Mol. function=RNA-directed DNA polymerase activity; Cellular component=chromatin; Biological process=chromatin assembly or disassembly
  Pfam annotation: Domain name=Chromo; Domain location=1281-1328; Score= 18.8; E_value=0.006; Accession=PF00385.14; Description='chromo' (CHRromatin Organisation MOdifier
  Pfam annotation: Domain name=RVP_2; Domain location=229-351; Score= -53.3; E_value=0.014; Accession=PF08284.2; Description=Retroviral aspartyl protease
  Pfam annotation: Domain name=RnaseH; Domain location=722-839; Score= -33.6; E_value=0.077; Accession=PF00075.14; Description=RNase H
  Pfam annotation: Domain name=rve; Domain location=975-1131; Score =102.5; E_value=1.3e-27; Accession=PF00665.16; Description=Integrase core domain
  Pfam annotation: Domain name=zf-H2C2; Domain location=916-957; Score =27.8; E_value=3.8e-05; Accession=PF09337.1; Description=His(2) -Cys(2) zinc finger
  Pfam module annotation: Pfam domain module=Chromo::RVP_2::RVT _1::RnaseH::rve::zf-H2C2; Domain location=1281-1328::229-351::483 -652::722-839::975-1131::916-957
MKLDVPRFDGTDPLGWIFKINQYFEYHGTPEYDRLTIASFYMEGRALAWFQWMTSNGHFTSWPMFLQALQTRFASSQYEDPTGLISLSRSLRQLASLASRKKSFATNAPPHYRHDLDPLLHLPHIPLDLLLYPPPLSPTLSPLPPPSPRPPQLPTTFKRLSPDEMASRREKGLCFSCDEKYHRGHRCASKVFFFIADEEEPPDPPHITLPSSDPDNNPSDSPPTHSETYPTQLSLNSLAGHLAPETLRFVATIAEHAVALLVDGGSTHNFIQQQLVTLLGLSPTTTTPLRMKVGNGQQLDCDSVCQDVPISIHDTVFVVDLHVLPISGANVVLGVQWLKSLGPVLTDYNTLAMQFFYNHKLVQLQGDIDASMNPLSPSQFRRLYRKQGPGFYYHITMLPQSPPELTEHIPDAFRPLLLKYEALFQPPQTLPPPPRATDHHIHLLPQATPVNVRPYRYPHYQKHEIETQVDAMLQQGLIQPSTSPFSSPVLLVKKHNRSWRFCVDYRALNALTIRDRFPIPTIDELLDELGGACCFSKLDLLQGYHRIRMHPDDIPKTTFRTHHGHYEFKVMPFGLCNAPSSFQATMNMLFRPYLCQFIIVFFNDILIYSSSLEDHLLHLDIAFQVLLDNHFVLKISKCFFGQSQVEYLGHLVSHKGVEPLATKVTAIIHWPSPRSTKALRSFLGLAGFYRRFIKGYATIAAPLVKATTIALVLALPDFKLPFTVETDASGVGMGAVLSQQGHPIAFYSKPFSEKLLRSSTYVRELFAITAAVKKWRQYFLGHHFTIITDHRSLKELLTQVIQTPEQHLYLVRLMGYDYEIQYRSGSHNPAADALSRLPEHGPSVSLLLSVTGPHFLTELHHQFEADSTYRQRRDDIRNSPESHPDLSISGALILYRGRIWLPHNFPLIPTLLTEFHATPTGGHAGIAKTLARVSENFYWEGLRADVTQFVNKCVDCQYTKYETKKPAGLLCPLPAPHRPWEDLSLDFIVGLPPFHGNTVILVAVDRFSKGIHLGMLPQHHSAYSVAVLFINIVVKLHGVPRSLVSDRDPLFVSQFWRELFELSGTHLRMSSAYHPQSDGQTEVLNRVIEQYLRVFVHHRPRSWGRLLPWAEWSHNTSWVAATGTTPYELTFGRKPPNFPNYLQGSSSIAAVDELLTDREETFRAIRKKLLKAQAFIKAYADTKRREVTYAIDDWVLLRLRPYRQLSARDSQATSGKLAKRFYGPFKVLEKIGGAAYRLQLPEGTKIHPIFHCSLLKPFRGVPDDVKIATLPATFIDDQPLITPTAILDYCKSSTNPANWEVLVQWDGLSLDDTSWEDWDQLCQQYHLEGKVILQGPRGDREADHNTQAGADIHEEVQTATEKQDTGVLVGNKPKRRIAKPTYLKDYV

SEQ ID NO: 217482 - protein, 43 aa, Glycine max
  Coding DNA Sequence Number=SeqID_100704
MVRINESTSCYKQKCKPGFEDQDITGSEFVMLVSYYSTSSKQG

SEQ ID NO: 217483 - protein, 120 aa, Glycine max
  Coding DNA Sequence Number=SeqID_100705
  Gene Ontology: Mol. function=protein binding; Cellular component =integral to membrane; Biological process=xylan catabolic process
  Homolog annotation: Hit_ID=Q1SWI7; Match level="QueryCoverage=96%, HitCoverage=18%, E-value=7e-41, Identity=67%"; Hit description =Leucine-rich repeat
  Pfam annotation: Domain name=LRR_1; Domain location=27-51; Score=5.7; E_value=25; Accession=PF00560.23; Description=Leucine Rich Repeat
  Pfam annotation: Domain name=LRR_1; Domain location=3-25; Score=14.8; E_value=0.32; Accession=PF00560.23; Description=Leucine Rich Repeat
  Pfam module annotation: Pfam domain module=LRR_1::LRR_1; Domain location=27-51::3-25
MGSLQSIDFSRNQLSGEIPPTISNSSFLSMLDLSYNHLKGKIPTRKQLQTFDASSFIGNNLCGPPLPINCSSNGKTHSYEGSDEHGVNWLFVSAAIGFIVGFWIVIAPLLICRSWRLINL

SEQ ID NO: 217484 - protein, 237 aa, Glycine max
  Coding DNA Sequence Number=SeqID_100706
  Homolog annotation: Hit_ID=O21999; Match level="QueryCoverage=27%, HitCoverage=42%, E-value=1e-14, Identity=62%"; Hit description=LacZ -alpha
DLPSQWLLFLSAVPPVQLLTGWCVTAKAPPDISAGKCSGRVPFAIQAAQLLGRAIGAGLFAITPAGERGMCCKAIKLGIRCDMIKSVHDNNGRGRAAYVVDSCLDQWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 217485 - protein, 229 aa, Glycine max
  Coding DNA Sequence Number=SeqID_100707
  Homolog annotation: Hit_ID=Q47522; Match level="QueryCoverage=22%, HitCoverage=64%, E-value=1e-23, Identity=100%"; Hit description=LacZ protein
MKHFTDTLISANIGTKAGTGPPLEVDGIDKLDVDYGDDFSPSEFTDELIPKLDDTQQPIEEIPLLLVQLTRFHSGGDCEGLAIGVTFAHPLIDATGLIHFINSWASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 217486 - protein, 56 aa, Glycine max
  Coding DNA Sequence Number=SeqID_100708
MHHQKTKTLDEASLLSSEWETQHDHRSTSTPYGSHRPRVLPLLLRILKCDEEFRPM

SEQ ID NO: 217487 - protein, 65 aa, Glycine max
  Coding DNA Sequence Number=SeqID_100709
GLDLNQEGEAQTDSSESRPWGESDRVYPLCGVLCHVLLSASVLFFTDMVSLHMMSHMLEMERLSL

SEQ ID NO: 217488 - protein, 122 aa, Glycine max
  Coding DNA Sequence Number=SeqID_100710
  Gene Ontology: Mol. function=oxidoreductase activity; Biological process=electron transport
  Homolog annotation: Hit_ID=UPI00005FA78E; Match level="QueryCoverage =92%, HitCoverage=83%, E-value=1e-35, Identity=63%"; Hit description =COG1393: Arsenate reductase and related proteins, glutaredoxin family
  Pfam annotation: Domain name=ArsC; Domain location=8-119; Score =140.3; E_value=5.2e-39; Accession=PF03960.6; Description=ArsC family
MTAQWVMYGIKNCDTIKKARNYLSTSGIDFHFHDYRADGLDAALLQSFIDQLGYDVLLNTRGTTWRQLPEAERDAIRDAASAKALMLAHPALIKRPVLAAPDGTLLVGFKEPVYHAFIQEKS

SEQ ID NO: 217489 - protein, 78 aa, Glycine max
  Coding DNA Sequence Number=SeqID_100711
  Subcellular localization annotation: CTP_CleavageSite=59; ConfidenceScore=5.38e-01
KIEENDGTSARTCCPLKVRASSPTKAKARTCCPLKARTCTPLKVRTCSPRKVRTCSPTKARACSPLKTTVLVPKGPPL

SEQ ID NO: 217490 - protein, 70 aa, Glycine max
  Coding DNA Sequence Number=SeqID_100712
MMLSANSNGHNFCVECVMMPIIYQDAQNEQQKLAKNSHGYNFSLGCTILVHHISSPPKLNTEALGKFKQP

SEQ ID NO: 217491 - protein, 40 aa, Glycine max
  Coding DNA Sequence Number=SeqID_100713
MMNALSVPAALSRMFILLMSFNEELTKRIYALSESSVSDT

SEQ ID NO: 217492 - protein, 285 aa, Glycine max
  Coding DNA Sequence Number=SeqID_100714
MSACIFSTIHNVPYANDVVRVSVVEVIFGDAEIPIPTSEIKFVKEALGSFVPWPTDLVKPILPEEAEKDVSSPLKTVEEEKAAEVIDPLGELVKNLFDIYQRPVEVSWDGAKFGINNVKDGFFITHADVSEIILGDKCLNISILQLWLMFIHDWSASIGYGPLYGFLEPQYIHNASSRHQECENYIGRWLKEAGKQIYIAPYLNQAHWQLVVLCPGDNVVVWFCSLKKKPDAAIKGAVNSAMKSVTKTAEGKPPQHGPQWIEAKSHVQIGNYECGYYVMQWIWCI

SEQ ID NO: 217493 - protein, 58 aa, Glycine max
  Coding DNA Sequence Number=SeqID_100715
MAFIPRGYNKMKPSKVSYQNIKQKMKFGNQGLPVLTNEFHYPVREAVNDKFNCLIDNI

SEQ ID NO: 217494 - protein, 208 aa, Glycine max
  Coding DNA Sequence Number=SeqID_100716
  Gene Ontology: Mol. function=DNA binding; Cellular component =chromatin; Biological process=chromosome organization and biogenesis (sensu Eukaryota)
  Homolog annotation: Hit_ID=Q9LTA2; Match level="QueryCoverage=74%, HitCoverage=55%, E-value=5e-15, Identity=32%"; Hit description =Similarity to AT-hook DNA-binding protein
  Pfam annotation: Domain name=DUF296; Domain location=82-207; Score =80.7; E_value=4.7e-21; Accession=PF03479.5; Description=Domain of unknown function (DUF296)
  Subcellular localization annotation: CTP_CleavageSite=26; ConfidenceScore=5.51e-01
MAISNSQNSVSFDLDLTSSWLNQTSSCSQRPRCPPSPATNQPLENLPLTNPPTKKPRGRPAGSKNKPKTTPFLVAQPMEPYMKVIIVHVTPSSDIIESILDVAQRGHVSLTVLSASGTITGVTLNNFSHGVDALTLRGPFTLLSLNGSYLYNNHYTLHPGATPAPPLSFGISFSTSQGQVFGGAIGGRVIAGNDVSLTICTFKNPVMH

SEQ ID NO: 217495 - protein, 54 aa, Glycine max
  Coding DNA Sequence Number=SeqID_100717
MAKTSKNSIVLNCKCDYWPLICGFSFVVILKRVEKLWTNATDIVAIVAIETSKT

SEQ ID NO: 217496 - protein, 73 aa, Glycine max
  Coding DNA Sequence Number=SeqID_100718
  Pfam annotation: Domain name=PSK; Domain location=4-71; Score=35.3; E_ value=2.1e-07; Accession=PF06404.3; Description=Phytosulfokine precursor protein (PSK
  Subcellular localization annotation: CTP_CleavageSite=22; ConfidenceScore=5.00e-01
MARSLFMINTNSPDVVPHRPVSSSHVTTMSLEKTRFNDDGGACKGLDRTECVVKTTMVAHTDYVYTQDINNGP

SEQ ID NO: 217497 - protein, 82 aa, Glycine max
  Coding DNA Sequence Number=SeqID_100719
MTVVVVSVVGVGVVAMGCGSDGNDNNNDGMVMVTTMSMVWRWRWNDDSGGGNNDNGRSDTSDNSGSDNNNDNVVVVWVIMTV

SEQ ID NO: 217498 - protein, 411 aa, Glycine max
  Coding DNA Sequence Number=SeqID_100720
  Gene Ontology: Mol. function=oxidoreductase activity
  Homolog annotation: Hit_ID=Q5PHS2; Match level="QueryCoverage=99%, HitCoverage=59%, E-value=3e-89, Identity=72%"; Hit description =Putative periplasmic protein
KNRGQLLVTPRGEVEPMLDLPWEITPERITISDGRWNAVYAGYPLSGRVALSVGDWQKGTEEMEISGRLNVLTHGEAGKGNAVLNIGPGKLSMDHSDMPLSLTGEAKLDDMIFYAVLPAKLSGPLTTPELAFHPGALLRSRGRVIDSLNIDEIRLPLAGVKVTQQGVDGRLQAILRAHEQEMGDFILHLDGQADNFMPDRGRWSWRYWGDGHFTPMQARWDAWWPKQALSVFQPLIPPDWKMTLREGDMYAQVAFSAAAGQGFEAGGHGVLKGGSAWMPDNQINGVDFVLPFRFSGGSWQLGTRRPVSLRIGEIVNQFTAKNLSADLQGTWPWSEQDPLELSNVNVDILGGKLSMQQLRMPQHQPALLRLQNISSSELISAIKVKQFAVSGAFNGALPLWLNNDKWIIKTA

SEQ ID NO: 217499 - protein, 58 aa, Glycine max
  Coding DNA Sequence Number=SeqID_100721
MATDRMQLQNMCKREHKSFKQYAQSWSDLAVQVVPSMMQREMITMMVDTLPVFYCEKM

SEQ ID NO: 217500 - protein, 65 aa, Glycine max
  Coding DNA Sequence Number=SeqID_100722
MASVETSAIARSQIVPHEEMHMTQMHFTNMGAREIVPFLDTTFGQHGARHMHLRRRHEPSVGLTK

SEQ ID NO: 217501 - protein, 212 aa, Glycine max
  Coding DNA Sequence Number=SeqID_100723
  Gene Ontology: Mol. function=transcription factor binding; Cellular component=intracellular; Biological process=regulation of transcription, DNA-dependent
  Homolog annotation: Hit_ID=Q39861; Match level="QueryCoverage=78%, HitCoverage=83%, E-value=1e-84, Identity=90%"; Hit description=GTP binding protein
  Pfam annotation: Domain name=Arf; Domain location=3-169; Score=-74.0; E_value=0.00046; Accession=PF00025.11; Description=ADP-ribosylation factor family
  Pfam annotation: Domain name=Miro; Domain location=13-124; Score =48.7; E_value=2e-11; Accession=PF08477.3; Description=Miro-like protein
  Pfam annotation: Domain name=Ras; Domain location=30-171; Score =277.6; E_value=2.4e-80; Accession=PF00071.12; Description=Ras family
  Pfam module annotation: Pfam domain module=Arf::Miro::Ras; Domain location=3-169::13-124::30-171
MVTSVSDSQSIIRVKVDMLRLFFRDSDSHDDSYIESYISTIGVDFKIRTVEQDGKTIKLQIWDTAGQERFRTITSSYYRGAHGIIIVYDVTDEESFNNVKQWLSEIDRYASDNVNKLLVGNKCDLEANRAVSYETAKAFADGIGIPFMETSAKDATNVEQAFMAMTASIKDRMASQPANNARPPTVQIRGQPVAQKEQLDQSLGIDTLSTFG

SEQ ID NO: 217502 - protein, 115 aa, Glycine max
  Coding DNA Sequence Number=SeqID_100724
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=75%, HitCoverage=16%, E-value=1e-29, Identity=77%"; Hit description=NADH -plastoquinone oxidoreductase subunit 2
  Pfam annotation: Domain name=Oxidored_q1; Domain location=1-114; Score=-71.0; E_value=0.00069; Accession=PF00361.10; Description=NADH- Ubiquinoneplastoquinone (comple
MILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSGRLIFLSFQ

SEQ ID NO: 217503 - protein, 123 aa, Glycine max
  Coding DNA Sequence Number=SeqID_100725
MFSSGGPVAIDDRPRPVGNEGSFGRPKPLVVYFTRDVAPQTPRYPSVVKPIPFPYQNNHAAPWRYAPPSERKEEVTDISSLSAKITNITGLREEEVIDSQIAVVCSHPLTYRHNPQTLKGRQK

SEQ ID NO: 217504 - protein, 352 aa, Glycine max
  Coding DNA Sequence Number=SeqID_100726
  Gene Ontology: Mol. function=oxidoreductase activity; Cellular component=cytoplasm; Biological process=flavonoid biosynthetic process
  Homolog annotation: Hit_ID=UPI00005DC227; Match level="QueryCoverage =97%, HitCoverage=96%, E-value=1e-116, Identity=58%"; Hit description= oxidoreductase, acting on paired donors, with incorporation or reduction of ...
  Homolog annotation: Hit description=molecular oxygen, 2-oxoglutarate as one donor, and incorporation of one atom each of oxygen into both donors
  Pfam annotation: Domain name=2OG-FeII_Oxy; Domain location=201-300; Score=123.2; E_value=7.4e-34; Accession=PF03171.10; Description=2OG -Fe(II) oxygenase superfamily
  Subcellular localization annotation: CTP_CleavageSite=51; ConfidenceScore=5.23e-01
MEGDHSASSFTSAVSLDKLGVSSIPQRYVLPPSQRPSPHVPMISTTLPIIDLSTLWDQSVISRTIDEIGIACKEIGCFQVINHEIDQSVMDEALEVATEFFNLPNDEKMRLFSQDVHKPVRYGTSLNQARDEVYCWRDFIKHYSYPISDWIHMWPSNPSNYREKMGKYVKAVQVLQNQLLEIIFESLGLNRSYLHEEINGGSQTLAVNCYPACPQPGLTLGIHPHSDYGSITVLLQTRSGLEIKDKNNNWVPVPFVEGALVVQLGDQMEVMSNGQYKSVIHRATVNGDDKRFSIVSLHSFAMDRKMGPALELVNDQHPKSYKEFCFREFLDFISGNDITKGRFLDTLKMKKL

SEQ ID NO: 217505 - protein, 218 aa, Glycine max
  Coding DNA Sequence Number=SeqID_100727
  Gene Ontology: Mol. function=protein-tyrosine kinase activity; Cellular component=integral to membrane; Biological process=protein amino acid phosphorylation
  Homolog annotation: Hit_ID=Q1SX48; Match level="QueryCoverage=99%, HitCoverage=20%, E-value=9e-79, Identity=66%"; Hit description =Tyrosine protein kinase, active site
  Pfam annotation: Domain name=Pkinase; Domain location=46-218; Score= -20.4; E_value=2.4e-07; Accession=PF00069.15; Description=Protein kinase domain
  Pfam annotation: Domain name=Pkinase_Tyr; Domain location=46-216; Score=-75.7; E_value=7.9e-08; Accession=PF07714.7; Description =Protein tyrosine kinase
  Pfam module annotation: Pfam domain module=Pkinase::Pkinase_Tyr; Domain location=46-218::46-216
MYILYLKARKKRVQAKDKAQSEEVFSLWSHDGRNMFENIIEATNNFNDELLIGVGGQGSVYKVELRPSQVYAVKKLHLQPDEEKPNFKAFKNEIQALTEIRHRNIIKLCGFCSHPRFSLLVYKFLEGGSLDQILSNDAKAAAFDWKMRVNVVKGVANALSYMHHDCSPPIIHRDISSKNVLLDSQNEALISDFGTAKILKPGSHTWTTFAYTIGYAAP

SEQ ID NO: 217506 - protein, 223 aa, Glycine max
  Coding DNA Sequence Number=SeqID_100728
  Gene Ontology: Mol. function=helicase activity; Biological process =viral genome replication
  Homolog annotation: Hit_ID=Q2R0W4; Match level="QueryCoverage=99%, HitCoverage=18%, E-value=8e-46, Identity=33%"; Hit description=AT hook motif-containing protein, putative
PTSFEDLRTVDNVQYPTYREACLAMGFLQDDKEFIEAIKEAKDWGSAHYIRKLFVLLLLTATMNKPKQVWDQTWHWMADDIVYNYRKSSASPTLQLDDRTLQNLVLLEIEQLLQANQRSLKDYPSMPYPEDIVEAVNKDEGDMFSLYGYGGRTAHSKFKIPVPVFEDSTCNIHKGTQLAELLNQTSLIIWDEAPMAHKLCFEALDHNLRDIIKHNSKDNKIFG

SEQ ID NO: 217507 - protein, 395 aa, Glycine max
  Coding DNA Sequence Number=SeqID_100729
  Gene Ontology: Mol. function=triacylglycerol lipase activity; Cellular component=chromatin; Biological process=lipid metabolic process
  Homolog annotation: Hit_ID=Q8H9B3; Match level="QueryCoverage=93%, HitCoverage=80%, E-value=1e-134, Identity=64%"; Hit description=DAD1
  Pfam annotation: Domain name=Lipase_3; Domain location=143-305; Score= 189.6; E_value=7.7e-54; Accession=PF01764.16; Description=Lipase (class 3)
MEKMMNMPQLQSSSLSSSPPLSKKVGKRWKEYQGMNNWDGLLDPLDENLRAEILRYGHFVEAAYKSFEFDPSSPNYATCKFQKNTLFEQCGLRNTGYKVTKHLRATSGIKLPSWVATQSSYVGYVAVCNDKEEIKRLGRRDIVVAFRGTATCLEWLENLRATLTHVSVPSVATGITAEPCSMDGNGAMVESGFLSLYTSAGSSKQSFTSLQDMVRKEIGRILKTYEGENLSLTITGHSLGAALATLTAYDIKNSFIRQPPVTVISFGGPRVGNRSFRRQLEETGIKLLRIVNSDDVITKVPGFVFDDVDKTDDDVACNGGAHVVQRWIRKRAEEVQWLLYSEVGKELRLCSRDSPYLRGVNIATCHDLNTYLHLVDGFVSSTCPFRATAKRFLQH

SEQ ID NO: 217508 - protein, 41 aa, Glycine max
  Coding DNA Sequence Number=SeqID_100730
MTPPKLLNLQSLIRLNIQASFADPSCKTTPDLDSPLRFRLT

SEQ ID NO: 217509 - protein, 404 aa, Glycine max
  Coding DNA Sequence Number=SeqID_100731
  Gene Ontology: Mol. function=transporter activity; Cellular component= membrane; Biological process=transport
  Homolog annotation: Hit_ID=Q12AM8; Match level="QueryCoverage=62%, HitCoverage=89%, E-value=6e-79, Identity=59%"; Hit description =Extracellular solute-binding protein, family 1 precursor
MGKVMDQALGPAFAQQHDGKYEGQGQGAYGMARLLASKKITADVFVSVTPGPMQILKTAGLIDNAVPVASTSMVIAYNPKGPFAPQFAAAKGNDGRWLQLLAAPGLKFGRTDPVNDPKGQNIIFTLLLAQKYYRQPGIADNILGGYQNPAQTHLEGGLLTRLESGQVDAAAGYESEVISAHLPYIALPDEINLSNPAMATKWYNTVSFSVKDSQGKDKMLHTQPLVYYAAVLRNAPHVRQDRRCLNSKAMPRRRAMGFTPHENPPCWRAVAVAARPGAAGRTVYHPDGRHTLATPAAGSGRDRAGADLSDRLTAGLVAVAGAGKNALAGGNAGDDPAADAAAGDGNPAGQRVRSVQFARPAAEQAGLDAGEQSRRLYSGAVVWRAALLCHQRTLGVYRGAAGDP

SEQ ID NO: 217510 - protein, 95 aa, Glycine max
  Coding DNA Sequence Number=SeqID_100732
MAACAGKLNPPAAVINSRVINQTIAEMVDEQQTLDVLSLRRRLREMAENETNEEMVLCYWQASKVLTRLPPTVTASQLIEEARHAFRSPPSHDSL

SEQ ID NO: 217511 - protein, 165 aa, Glycine max
  Coding DNA Sequence Number=SeqID_100733
  Subcellular localization annotation: CTP_CleavageSite=46; ConfidenceScore=5.10e-01
MYTCNKHTYNNATMINYTFEKLTSLSRRKRLARELSRLDLLSRRLLGSGGGSRSSSRRLELLGGDELRRVLSVVTQQIKRVRGCHLSELFVFPTPKRHRTFPNTRPQLTLATKHGTSPSEIKEKKKVEGMERLKVKNPNPSRNRREKESECVREQTGQPNLEQRL

SEQ ID NO: 217512 - protein, 106 aa, Glycine max
  Coding DNA Sequence Number=SeqID_100734
MVVGVSGGAMIGADDAGFVGKTMFVGKDNCAFYCQNNRNILARKNGSSKSGSFDDSMNKMSFFSSKGQNNEIFNLTFVQVDINYHFGVAESAQNPMVYDENSNMSW

SEQ ID NO: 217513 - protein, 167 aa, Glycine max
  Coding DNA Sequence Number=SeqID_100735
  Gene Ontology: Mol. function=RNA-directed DNA polymerase activity; Cellular component=chromatin; Biological process=RNA-dependent DNA replication
MSGIYLGIIYHKLTICPQAKPISQKKKKMGEEWRKVVKEEVDKLLLANFIREVRFSTWLANVVMVKKANGKWRMCTDYTHLNRVCPKDAYPLPSIDRLVDGVSGYQVLSFLDAYSRYNHIRMHPPDKEKMEKMTFITEEAKFCYKVMPFGLKNIGTIYQGLMDRVFK

SEQ ID NO: 217514 - protein, 44 aa, Glycine max
  Coding DNA Sequence Number=SeqID_100736
MAGRKIGGKGFREKEGLQGCVVIDYTNMVIDYQRATLPEITACN

SEQ ID NO: 217515 - protein, 104 aa, Glycine max
  Coding DNA Sequence Number=SeqID_100737
MEKSDKMNFKEKKENKGHITWEDNVINYSSDSEKKIISLCIIMKDYENEEEQSQYIDSNFSKHMACIKVVVIIKKGENVNHEDFDDVKKIKPWIMLVIIKKGEN

SEQ ID NO: 217516 - protein, 92 aa, Glycine max
  Coding DNA Sequence Number=SeqID_100738
  Subcellular localization annotation: CTP_CleavageSite=22; ConfidenceScore=5.08e-01
MQWRFQSQKRCKDKMKLTRNKRRTMVTSKENKSCRPNFEKIQRLMKSGRHFYRGSSCSFLKKLPQEASLRGFLKKLPRGFFEKLSQESSLRS

SEQ ID NO: 217517 - protein, 78 aa, Glycine max
  Coding DNA Sequence Number=SeqID_100739
MSVVTSERVRVRVRVRVRVGSVVVCEGMNEAEREGSCIVTEIGEVRIYIAASITPIVTEENIIESILLKCSLVIDPAR

SEQ ID NO: 217518 - protein, 118 aa, Glycine max
  Coding DNA Sequence Number=SeqID_100740
  Gene Ontology: Mol. function=protein binding
  Homolog annotation: Hit_ID=Q9LUN3; Match level="QueryCoverage=69%, HitCoverage=23%, E-value=1e-11, Identity=64%"; Hit description =Leucine-rich repeat disease resistance protein-like
DSELGESVELGRDGAGDYSGGEDELSQLASGREVVPRERMVTRERKHVTPEKEEQGSGAVRFHVEKNDFVGETSVRVFLMERRALSGHCLCSIELFLRESYGAEGEESVTDKDAVNET

SEQ ID NO: 217519 - protein, 135 aa, Glycine max
  Coding DNA Sequence Number=SeqID_100741
  Gene Ontology: Mol. function=nucleic acid binding; Cellular component= endoplasmic reticulum membrane; Biological process=DNA integration
  Homolog annotation: Hit_ID=Q1SXA8; Match level="QueryCoverage=94%, HitCoverage=8%, E-value=3e-37, Identity=58%"; Hit description=Zinc finger, CCHC-type; Polynucleotidyl transferase, Ribonuclease H fold
MRSDHWRSCALVFEIEPKTIEESLIDDDLIISMEEELHQFNRNNIWTLVSKPKKKSMIGIRWVLRNKLDEQGKVVRNKARLVAQGYKQQEGIDFTETFAPVARFEAIRIMLAFVAHKNIKLFQMEVKGAFFEWLY

SEQ ID NO: 217520 - protein, 95 aa, Glycine max
  Coding DNA Sequence Number=SeqID_100742
MHHQKRKTLDEAPLSSSESETQHDHRLTSTPYGSHRPGSLVESPSVATYPSAEGRGEIKVLLLMKKMCGVVTNVYSRKTLEKSKRQKSADFENEG

SEQ ID NO: 217521 - protein, 150 aa, Glycine max
  Coding DNA Sequence Number=SeqID_100743
  Gene Ontology: Mol. function=sugar porter activity; Cellular component=integral to membrane; Biological process=carbohydrate transport
  Homolog annotation: Hit_ID=Q1SZN1; Match level="QueryCoverage=87%, HitCoverage=20%, E-value=3e-22, Identity=45%"; Hit description=Sugar transporter superfamily; Major facilitator superfamily MFS_1
MMEVVIVAIAATLVNLLMGWDSSTIAVIGYDRALGYSCLLEFMAWDLWSSSYAQGFSESHSFPKSPRGLTRISIIGTVVTIFSGTWFGNVVIVLLARIIDGVVIALAVTLTPLYISEVVPADIRGQLNTYSQNLGPLQATGVRVWIIFNI

SEQ ID NO: 217522 - protein, 503 aa, Glycine max
  Coding DNA Sequence Number=SeqID_100744
  Gene Ontology: Mol. function=RNA-directed DNA polymerase activity; Cellular component=nucleus; Biological process=RNA-dependent DNA replication
MEEKMLMQRAKVDWIRKGDGNNSFFHAIIKSRNNRRNIYMLQKTDGTLLENQSEIEDEIMDFYKKLMGTEDSQLHHIDIDAMRNGKQVNMEQRRYLVSNITEQDIERALKGIGDDKSPGIDGFGAKFFKASWCIVKEDVIAAILEFFNIGRLYRGFNNIVVTLIPKGDNARYVKDYHPIVGCTIVYKIIAKIITERLGKILPSIISHSQAAFVPGQNIHNHILLAYELLNGYGRKGGTPRVMMQLDLHKAYDMVNWRAMECILKEIGLPMQFVSWIMTGVSTVSYRFNVNGTYSDIMQAKRGIRQGDPMSPMLFVIIMEYMHRTLVKMQQNPDFNHHSKCEKIGLTNLTFADDVLLFCRGDSKSVSMMMETIRKFSDSTGLKVNPAKCQMFFGGMDGCSKENLRRITDFAEGKLPVRYLGMPLSCKRLTIQQYMPLIDKIVDRVKHWTSKLLSHAGRIQLVKSITSAIAMYWMQCFPLPQFVLRKINDICRSFVWTEILRIFG

SEQ ID NO: 217523 - protein, 154 aa, Glycine max
  Coding DNA Sequence Number=SeqID_100745
  Gene Ontology: Mol. function=3'-5' exonuclease activity; Cellular component=intracellular
  Homolog annotation: Hit_ID=Q2V9B5; Match level="QueryCoverage=76%, HitCoverage=35%, E-value=4e-40, Identity=73%"; Hit description=3'-5' exonuclease domain-containing protein-like
MEVFYIGESEKCVEDDESRVPIHIVTAASQLPVDFLEPSPQSKLVIDFDCEGVDLCRKGTLCVMQLAFSDAVYLVDAIEGGEELSIACKLALESNYITKVIHDCKRDSIILSVWHQVEQRSGYPGLEGKSSLQSPEWSVHNSIRSHFFLTAHNL

SEQ ID NO: 217524 - protein, 163 aa, Glycine max
  Coding DNA Sequence Number=SeqID_100746
  Gene Ontology: Mol. function=protein binding; Cellular component =cellulose and pectin-containing cell wall; Biological process =protein amino acid phosphorylation
  Homolog annotation: Hit_ID=Q9LUN3; Match level="QueryCoverage=68%, HitCoverage=29%, E-value=3e-30, Identity=54%"; Hit description =Leucine-rich repeat disease resistance protein-like
MVKHGALCLRSRRHPASADWTRHHHRRRQHHAVVGQAQRRRIGDQRSLPHRNPREVVVLKVQRSGAAAAHALNVHLRHAPNKLVIIQEQALHAIKHGGELSAQSVMAQIDYRSGLGSESRSRWSNGEVTVLGNVPVRVFEARMRTLSWGNSVRLGGSDPASWL

SEQ ID NO: 217525 - protein, 497 aa, Glycine max
  Coding DNA Sequence Number=SeqID_100747
  Gene Ontology: Mol. function=pyridoxal phosphate binding; Biological process=amino acid biosynthetic process
  Homolog annotation: Hit_ID=P27735; Match level="QueryCoverage=52%, HitCoverage=60%, E-value=1e-140, Identity=96%"; Hit description =Threonine synthase
  Pfam annotation: Domain name=DUF328; Domain location=1-246; Score =457.5; E_value=1.7e-134; Accession=PF03883.5; Description=Protein of unknown function (DUF328)
MLVIISPAKTLDYDSPLATERFTQPEMLDKSKQLIKICRELTPAQIASLMSISDKLAGLNAARFSEWQPKFTPDNARQALLAFKGDVYTGLQAQDFSEADFDFAQQHLRMLSGLYGVLRPLDLMMPYRLEMGIRLENPKGKDLYSFWGDKITQKLNEALEQQGDDVVVNLASDEYFKAVKPAKLHGALIKPVFLDEKNGKYKVISFYAKKARGHKKSRRKTAFRILACRTSGRQRHQELAQLGKAGRQRVRQQRQIGPQRQRFRQRQLLAEDRFYALFKLGRVRGAEKQTELPFLQPIAQRAIGNGRVRFGDITQLGQFTHRFPGGLIADRRVAQLFQLPDLTTEQLFHARPVVRLADVHGVGQRRDRGVRLPLAAGQEARHGVVGVGGGNKALHRQAQRLGQQPGGQIAEVAARHRNHQLIARFLRQLRHRFEVVADLRQQAADVDRVGRVQVQRVLQFPIVERLLHQRLASIEVAVDRYGVNVAAQGTDASPAAD

SEQ ID NO: 217526 - protein, 96 aa, Glycine max
  Coding DNA Sequence Number=SeqID_100748
MEEENGVPNYDELTCKGERAAWFKLGLRFSSSAAKDDVPKPSSSFLSKFVKAYSESKKQAQLQPIHDNLKKSLLSSLGFRAGIGTTIEVEDEVGAE

SEQ ID NO: 217527 - protein, 236 aa, Glycine max
  Coding DNA Sequence Number=SeqID_100749
RGFVLNSEGHPRKILRKDLMTLPQMDMNVGALISGQITSIAQSNSSRLGFPALIIALCKARGVNSDSLVFEHLSSVINLAYIRKNCWNPDDLTVSIRGARRARTRLAEPPSTSTAPVPARSIPSMEQFAELVAWPGTQSSLRKEDEGPTAQAEETQEAAATLERSLEAASELPAQGEDIPSPQLAADPSTPVLELSEDQTALVLTMNTSPPTTPVLHLTDEEDVQIQDTQDQSQEF

SEQ ID NO: 217528 - protein, 134 aa, Glycine max
  Coding DNA Sequence Number=SeqID_100750
MTWGLRPQDTQWTRRSPTRPWGFQLWLRASVSPIGCLFPPARSCHLDIGKDCARKTPSGLEEVQQGHGFPALITGLCQFYGVSVAPSKVIRPPINRTFIEKYCAPGRHRARHHSSGQQAHRRHLQSPSAHPQKG

SEQ ID NO: 217529 - protein, 899 aa, Glycine max
  Coding DNA Sequence Number=SeqID_100751
  Gene Ontology: Mol. function=protein serine/threonine kinase activity; Biological process=protein amino acid phosphorylation
  Homolog annotation: Hit_ID=Q1T627; Match level="QueryCoverage=94%, HitCoverage=95%, E-value=0.0, Identity=70%"; Hit description=Protein kinase
  Pfam annotation: Domain name=Pkinase; Domain location=421-656; Score =238.1; E_value=1.9e-68; Accession=PF00069.15; Description=Protein kinase domain
  Pfam annotation: Domain name=Pkinase_Tyr; Domain location=421-656; Score=80.8; E_value=4.3e-21; Accession=PF07714.7; Description =Protein tyrosine kinase
  Pfam module annotation: Pfam domain module=Pkinase::Pkinase_Tyr; Domain location=421-656::421-656
  Subcellular localization annotation: CTP_CleavageSite=72; ConfidenceScore=5.29e-01
MPSWWGKSSSTKKKANKESFINAFHRKFKIPSEGKPNSRSGGSRRHSNDSISEKGAQSPPESRSPSPSKVGRCQSFVDRPHAQPLPLPGLHPSNISRADSEISIPSSRARHEKGSKPSLFLPLPKPVCIRGRLNPADLDGDLVTASVSSESSADSDEPVDSRNRSPLATDCETGTRTAAGSPSSALSTSWALIQGLMVKDQSTTVSQINSREAKKPANILGNHTSSTSPKRRPLSNHVTNLQIPPHGAFCSAPDSSRSSPSRSPLRSFGTEQVLNSAFWAGKPYPEVNFGGSGHCSSPGSGHNSGHNSMGGDMSGQLFWQPSRGSPEYSPVPSPRMTSPGPSSRIQSGAVTPIHPRAGGTPNESQTGRVDDVKPQSHRLPLPPLAVTNTLPFSHSNSAATSPSMPRSPGRADNPISPGSRWKKGKLLGRGTFGHVYVGFNKESGEMCAMKEVTLFSDDAKSKESAKQLMQVGDKLYIYLEYVAGGSIYKLLQEYGQFGELAIRSFTQQILSGLAYLHAKNTVHRDIKGANILVDTNGRVKLADFGMAKHITGQSCPLSFKGSPYWMAPEVIKNSNGCNLAVDIWSLGCTVLEMATTKPPWSQYEGVAAMFKIGNSKELPTIPDHLSCEGKDFVRKCLQRNPHNRPSASELLDHPFVKYAAPLERPILGPESPSDPAVSGITQGATTSGIGQGRNPSKLDSDRLSLHSSRFLKTNPHASEIHIPRNISCPVSPIGSPLLRPRSPQHMNGRMSPSPISSPRTASGASTPLNGGSGAIPFSNHLVYIQEGLGSLPKSSNGVYVSVPAAHHDLNIDIFRGMQQTSHITSELVPSESDVLGKQFARSPHNEPYDVQSVLADRVCRQLLGDNQVFDVRQNDPFIVLFAEEAQASGVQNLSLEVPN

SEQ ID NO: 217530 - protein, 128 aa, Glycine max
  Coding DNA Sequence Number=SeqID_100752
  Gene Ontology: Mol. function=oxidoreductase activity; Cellular component=mitochondrion; Biological process=metabolic process
  Homolog annotation: Hit_ID=Q0VH86; Match level="QueryCoverage=87%, HitCoverage=34%, E-value=4e-39, Identity=74%"; Hit description=3 -ketoacyl-CoA reductase 3
MWWLGRKGPSGFSASSTAEEVTQGIDGSDLTAIVTGATSGIGVETARALALRGVHVVMGIRNMTAGGEIKETILRYNPIAKIDMMELDLSSMESVRTFASQFNSRGLPLNILVYVTADTSLLARVICT

SEQ ID NO: 217531 - protein, 90 aa, Glycine max
  Coding DNA Sequence Number=SeqID_100753
MKITIYNPIVAHDYPTNVIIYIKGDNIDGVMRVAILGSLEKRMQRDYIDDVIKPPTKNRFVLGQEGKNEVDDSYVSIGCVNQMPFACTPS

SEQ ID NO: 217532 - protein, 113 aa, Glycine max
  Coding DNA Sequence Number=SeqID_100754
  Gene Ontology: Mol. function=oxidoreductase activity; Cellular component=mitochondrion; Biological process=metabolic process
  Homolog annotation: Hit_ID=Q0VH86; Match level="QueryCoverage=99%, HitCoverage=34%, E-value=5e-39, Identity=75%"; Hit description=3 -ketoacyl-CoA reductase 3
MWPFRGKGASGFSSSSTAEEVTHGIDGSGLTAIVTGASSGIGAETARVLALRGVHVIMGVIDMTNAENVKESILKEIPIAKIDVMKLDLSSMASVQNFASEFNSSNLPLNILM

SEQ ID NO: 217533 - protein, 54 aa, Glycine max
  Coding DNA Sequence Number=SeqID_100755
MEGVRCGGLWTKCGSEGGGGGQSVTMRVKDEEETYVMERRCHISHYLSLNAHTS

SEQ ID NO: 217534 - protein, 68 aa, Glycine max
  Coding DNA Sequence Number=SeqID_100756
  Subcellular localization annotation: CTP_CleavageSite=44; ConfidenceScore=5.17e-01
MVILMRYGAICFFGGKSKKSWPVWGCFGAGFTLGTSTIVGAFFMVVHRQVVILSMFGFVINVGDEFLM

SEQ ID NO: 217535 - protein, 351 aa, Glycine max
  Coding DNA Sequence Number=SeqID_100757
  Gene Ontology: Mol. function=zinc ion binding
  Homolog annotation: Hit_ID=Q1RWU1; Match level="QueryCoverage=58%, HitCoverage=51%, E-value=6e-25, Identity=36%"; Hit description =Resistance-like protein HAAS-2-related
FARRQREVAPVAEDVQHVDHADDEERPKLNLSSHGRKVEKFGRPAPEIEGLETSSFHLLVGDVTITLDDVVSLLHLPITSVFHSFEPFHVDDVIFLLVKLLEWIVEARAYLLHLVGCTLFANKSSTHVHVVFLDAFRDLTQSGSCACGVAALVHMYENLNDASKSTTKQLAGHITLLQCWIYEHFPFVASSIASSIDVEDYDERKSRVYYWKEFKIIFLFSEHFKWGPSIVTHQPKRVVRQFGYVQTIPPHPIAHFLCIEDIDDRWIQFSEYIAPMGQICVAPEQCLSYYKKWFYMIFHPFMSSTQLGDPPRHPLVVHDDTFVELDVPQHPMAAVAMDESPEDAYVDVEHP

SEQ ID NO: 217536 - protein, 145 aa, Glycine max
  Coding DNA Sequence Number=SeqID_100758
  Homolog annotation: Hit_ID=Q9ZPW2; Match level="QueryCoverage=38%, HitCoverage=29%, E-value=3e-19, Identity=80%"; Hit description =Anaphase-promoting complex subunit 10
  Pfam annotation: Domain name=APC10; Domain location=40-145; Score= -60.5; E_value=0.00048; Accession=PF03256.7; Description=Anaphase -promoting complex, subunit 10 (APC10)
MRNLFTMIIPNPIIRLEPILVKKPLGQHPHCPTFISILSETAGWNPQNLLSKKSRRKPYTAIGTVWVEKTLHCSWNNRGCSKLSTLPVNKLIVLFLVFKLDESYTPSKVSIRAGDGFHNLKEIKTVELVKANGWVYLSLSGADPR

SEQ ID NO: 217537 - protein, 70 aa, Glycine max
  Coding DNA Sequence Number=SeqID_100759
MAKFGMSSLVGMFAVARDGDGVDVGATSEYLIAIDTIDGDEVDDDGLSLGGSSLTTSFFLPTCPFSTGVM

SEQ ID NO: 217538 - protein, 69 aa, Glycine max
  Coding DNA Sequence Number=SeqID_100760
MFAHKSDREEERRTITMENKTMTKAMVTCGANRDTNGGSGVATKKIQKQGEKKTQAVWTCSGRRKRLHF

SEQ ID NO: 217539 - protein, 144 aa, Glycine max
  Coding DNA Sequence Number=SeqID_100761
  Gene Ontology: Mol. function=ribonuclease H activity; Cellular component=mitochondrion; Biological process=DNA integration
MVVVGDGESAWDVRNGFGRKKEEMVFFLSYTKAKAENAYGVTLVEVQEGSFGTHANRHGMAQKILRAWYYWHTRENDCCIHMIKCHKCQALADNVNALPVPLNVLVAPWPFSMWGTDVIEAIEPKASNKHRFILVVIDYFTKWV

SEQ ID NO: 217540 - protein, 161 aa, Glycine max
  Coding DNA Sequence Number=SeqID_100762
MPLKRNGSEETPNQEVEKRCRWIWMTLLLSNIFPNDHSSDLPLLKCYLVYAILTQFAGITLPRHLVDSKKSNRALGFPVLITCLCQFYGVSVTPTKLIWPPISRAFVEKYCMPRQVQGQAPQQLKEDQQQPATGSRPAGAPGDDEGAQEDDDMADMLDFFT

SEQ ID NO: 217541 - protein, 72 aa, Glycine max
  Coding DNA Sequence Number=SeqID_100763
MRGGGCTTARLDKLVTLALSFLVAQKYKRSKDKETNFVQAISPSDQPAVEVQAVKPVKRKSTKGIRHIKKRP

SEQ ID NO: 217542 - protein, 132 aa, Glycine max
  Coding DNA Sequence Number=SeqID_100764
MVSTQSSLRRETPLEDSHPHSAAMIDIDTLQQLQTRMVEMERRNKEELRKLKVAHDQLEASVKHPQGEKHFAYTLLECTQRESHPRRTINTVDDLSLSHIHPPTRQTTCRHPFVDCILELDIPLGWKPLNLE

SEQ ID NO: 217543 - protein, 116 aa, Glycine max
  Coding DNA Sequence Number=SeqID_100765
MEVMNLSGGKEKKEVKVGTCMSTSIQDELVALLRDFQDTSSDIVQHQLTLNPECSSIKQKLGRMKPEMPLQLKEEVKKKFDAGFLPVALQPNKDGTGGHGKDDLNHPMGNVLLQSD

SEQ ID NO: 217544 - protein, 832 aa, Glycine max
  Coding DNA Sequence Number=SeqID_100766
  Gene Ontology: Mol. function=calcium ion binding; Cellular component =extracellular region; Biological process=pathogenesis
  Homolog annotation: Hit_ID=Q8XQP2; Match level="QueryCoverage=99%, HitCoverage=91%, E-value=0.0, Identity=42%"; Hit description =Probable hemagglutinin/hemolysin-related protein
NGSVIGSAQADANGNWSFTPDPALEAGTHSLTTIVTDTAGNSGPASDAFDFTIDLTTPTAAADVVLNNDNGETPQPINSGTATNDTTPQLSGTADAGSTVTILDGNTVLGSVLVGAGGTWSYAVPALSQGEHSLTTTVTSPAGNVSAPSAAIDFTVDTTAPAEPTGLLLVNDEVDPAVPVASGGATNDTTPVLSGSAEPDSVVIVRDNGVIIGSVTAGNDGSWRFTPDTALEAGSHSLTASVTDPAGNVGPESAPYTFTVDLTPPAAPVDVVLSNNDGSTLVAIAANGATNDTTPQLSGSATAGSIITVYDGDSTTPIGSVTVVADGSWQFVTGTLDEGDHSLTVTVTDAAGNVSDPSAPISFTVDTTAPDAVVDLLLVNNNVDPATPITSGSNTNDSTPLLSGTAEPNSTIIVYDGQTPIGTATAGNDGAWSFSPELTDGSHSLSVTVTDAAGNVSAPSASVAITVDTVAPSAVTQLSVASDNGNGDPVTIPNGGLTSDNTPVLSGSGDPGSLIVITSQDGPVGSVTVGSSGSWSFTPASALSDGSYTLTVVARDAAGNVSAPVTAQLVIDATAPDQVTEISLSNDNGSALVDIPSGSTTSDTTPLLAGVAEPGSTVNILDNGAPIGTAIAGSDGAWSFNVPTLTNASHSLTVTVTDAAGNTGPASAPITFTVDNQAPAQATLEVNNDNGTDLVLVPDGTFTNDNTPRLSGTAEADSLVTIYDGNVVLGSTTANADGEWVFLSPMLTDGQHTLTATVTDSLGNVSAPSSSFTVQVDATPPQPVSAVLLQNDNDPDNPVTIANGGVTNDNTPLLSGSGEAGGLVNVYNGNVL

SEQ ID NO: 217545 - protein, 109 aa, Glycine max
  Coding DNA Sequence Number=SeqID_100767
MEFFGINAFVKNHCEFLSLEDKLSVRLTLSSNSLTRAKHDVEIRKPFLSLICIELKGEENGSLLRGLKSVNFRGHRVEQGAKFSSFREISEFLSDCEIPRGGGDIPTPL

SEQ ID NO: 217546 - protein, 87 aa, Glycine max
  Coding DNA Sequence Number=SeqID_100768
MGPKFFYPIPLGDRIASKCPKIPISNGEFLGWCKPWKGALMVKVLGRRVHFRLIVNKLKQEWPSKGHLKIIDLPKDFYHYILVQLWA

SEQ ID NO: 217547 - protein, 66 aa, Glycine max
  Coding DNA Sequence Number=SeqID_100769
  Subcellular localization annotation: CTP_CleavageSite=47; ConfidenceScore=5.03e-01
MFLLVWWFGGKQRRLLQMKISLSELVSLSGSLLLSLSATILAERNSSCAKRKNSRSRNSLLGWNCA

SEQ ID NO: 217548 - protein, 86 aa, Glycine max
  Coding DNA Sequence Number=SeqID_100770
MSRNFTYCATKGSKYLEAVKQRLHAIKQWSSDEIKAINSWGSGLDGGGCLNDNQFMGLQTRFIGGGCTNSARESIRGASDSMVEDA

SEQ ID NO: 217549 - protein, 270 aa, Glycine max
  Coding DNA Sequence Number=SeqID_100771
  Homolog annotation: Hit_ID=Q6YXT2; Match level="QueryCoverage=100%, HitCoverage=53%, E-value=7e-49, Identity=44%"; Hit description =Calmodulin-binding protein family-like
  Pfam annotation: Domain name=IQ; Domain location=127-147; Score=30.4; E_value=6.1e-06; Accession=PF00612.17; Description=IQ calmodulin -binding motif
  Pfam annotation: Domain name=IQ; Domain location=149-169; Score=17.9; E_value=0.036; Accession=PF00612.17; Description=IQ calmodulin -binding motif
  Pfam module annotation: Pfam domain module=IQ::IQ; Domain location =127-147::149-169
MGKKGSGSSWLTAVKRAFRSPTKDSDKRSGRRREDCDQEEDEEKKREKRRWIFRKTHMSHEGGNNNNNTQQKLKHDVAASGGGSRTDQDQKHAVAVAVATAEAAMATAQAAVEVARLSKPASHAREHYAAVVIQTAFRGYLARRALRALKGLVKLQALVRGHNVRKQAKMTLRCMQALVRVQARVLDQRIRSSLEGSRKSTFSDTASVWDSRYLQDISDRKSISREGSSITDDWDERHHTVEEVKAMLMQRKEAAAMKRDKTLSQAFSQQ

SEQ ID NO: 217550 - protein, 307 aa, Glycine max
  Coding DNA Sequence Number=SeqID_100772
  Gene Ontology: Mol. function=nucleic acid binding; Cellular component= nucleus; Biological process=type I hypersensitivity
  Homolog annotation: Hit_ID=Q5N8W4; Match level="QueryCoverage=76%, HitCoverage=78%, E-value=2e-57, Identity=52%"; Hit description =Putative RRM-containing protein SEB-4
  Pfam annotation: Domain name=RRM_1; Domain location=18-88; Score =78.5; E_value=2.1e-20; Accession=PF00076.12; Description=RNA recognition motif. (a.k.a. RRM, R
MVGGNNPDQYNDTTFTKIFVGGLAWETQRDTMRRYFEQFGEILEAVVITDKNTGRSKGYGFVTFKDPESAMRACQNPSPVIDGRRANCNLASLGASKNRPPTFQHDLTHPRQEGTTFKGWLFSESAGRFRPPPGLVASPPAYHGSSSTFFHQPPRQYTFPYSAYRYSGYSQDTLYPTSYYNVYGVQQFSPYYPSAGASGEVGLIHNIYPFYGQYAQSIQAPGFGVQYPQMAQFPFLPQHYGSSTGILSYPSSVTVPTTSAVTGIATTTTTTTTSASVAATVVGTTSQASQAASEQTSTSTRSQNLQG

SEQ ID NO: 217551 - protein, 180 aa, Glycine max
  Coding DNA Sequence Number=SeqID_100773
  Gene Ontology: Mol. function=phosphoglycolate phosphatase activity; Biological process=methionine biosynthetic process
  Homolog annotation: Hit_ID=Q2R483; Match level="QueryCoverage=98%, HitCoverage=33%, E-value=2e-62, Identity=66%"; Hit description =Haloacid dehalogenase-like hydrolase family protein, putative, expressed
MEMIKGIKGHGYYDELVVPIIENTAYEYELTEALAKAIEAYTKTTAVLVRNHGIYVWGDSWISAKTLAECYHYLFDATIKLHQLGLDWSTPNHGPIQSIRSLMIAGESNASDKTRKANGEIDPFPCCIVLDIEGNTTPISFVTEVLFPYACQNVGRHLSMTYDTPETESDIKLLCSQVRF

SEQ ID NO: 217552 - protein, 202 aa, Glycine max
  Coding DNA Sequence Number=SeqID_100774
  Gene Ontology: Mol. function=nucleic acid binding; Cellular component= nucleus; Biological process=DNA integration
MALVAHFDPELHQMNVKTTFLNGNLKEEVYMAQHMGFENEKDQCIYLKVNGNEILLTSIDLGLLHDTKIFLEQNFDMKDMGEASYVIGIEIHSDRSLRTVGLSQKAYIEKLKGKKFSLNQCPQTTLEREEMKRIPYASIVGSLVYAQVSTRPNIAFAIGMLKRYQKDPGMEHWKAAKKVMRYLQGTKDYKLTYNTSILMIWK

SEQ ID NO: 217553 - protein, 61 aa, Glycine max
  Coding DNA Sequence Number=SeqID_100775
MLDHVSNKVICKSLKIFIGGLSSKKAPNIIQVDWHPRWIKCNTDGASHGAPGRASCRGISS

SEQ ID NO: 217554 - protein, 248 aa, Glycine max
  Coding DNA Sequence Number=SeqID_100776
  Gene Ontology: Mol. function=sequence-specific DNA binding; Cellular component=nucleus; Biological process=regulation of transcription
  Homolog annotation: Hit_ID=Q2HTS9; Match level="QueryCoverage=82%, HitCoverage=71%, E-value=9e-37, Identity=49%"; Hit description=DNA -binding WRKY; VQ
  Pfam annotation: Domain name=VQ; Domain location=54-84; Score=50.1; E_ value=7.3e-12; Accession=PF05678.4; Description=VQ motif
  Subcellular localization annotation: CTP_CleavageSite=14; ConfidenceScore=5.02e-01
MEISLRLQDTETPPSMNNSPRSNLSNNCCTNYNNSIGIQIPTTPKTILRSDSTNPYPTTFVQADTSTFKQVVQMLTGSSETTKPQLQQQQQQQQQDLVQPQSSSSKNFNIPPMKATPKKQQGFKLYERRNNNNNHHLKNTLMINTLVPNFAHSSGFSSSHHNKPEILSPSLLDFPSLTLSSPVTPLNDDPFDKSSSPSLGSTSSEEERAIAEKGFYLHPSPMSTPRDSEPQLLPLFPVTSPRVSESPS

SEQ ID NO: 217555 - protein, 118 aa, Glycine max
  Coding DNA Sequence Number=SeqID_100777
  Gene Ontology: Mol. function=nucleic acid binding
  Homolog annotation: Hit_ID=Q1SKZ9; Match level="QueryCoverage=86%, HitCoverage=20%, E-value=6e-27, Identity=56%"; Hit description=Zinc finger, CCHC-type
MVWICFRGLNLFYYDESILSTLASVVGRSIKVDSNTKGVWRGHFACVEIDLMKPVVGNIWLKDFWCKVEYESIHRICSNYGCYGHLTREFLYQPTVKEEESNNPDGSLLEKLLWRLDL

SEQ ID NO: 217556 - protein, 131 aa, Glycine max
  Coding DNA Sequence Number=SeqID_100778
MDCKYANIIIRRYLARKCIQQEGYKVQLGSPESAQRNLFSKEVELQDLHFLCFIIFNGQVQMEANDSSSQKEEQMKPMRNKIGWEKDIPVDLATVSVFAHWRSTLVTVVSVVLHDESFGTLATVVSVVLQE

SEQ ID NO: 217557 - protein, 339 aa, Glycine max
  Coding DNA Sequence Number=SeqID_100779
  Homolog annotation: Hit_ID=Q6YXT2; Match level="QueryCoverage=68%, HitCoverage=37%, E-value=2e-48, Identity=51%"; Hit description =Calmodulin-binding protein family-like
MATKPWENRGRASTDQRDHIKTVEIDTSQPYSYLGTNYRRSHPKYQYNPNHHQPQRHSIASPLHRSHQNGSSLHQSPATPSPAKSRPIQVRSASPRCIRDDRSYHTSQTPSLRSNYHYAGNLYQNGRVVGTGTSNGGATATLPNYMAATESAKARIRSQSAPRQRPSTPERDRVGSAKKRLSFPAPDPYGVGVSYGNYGHSLRSPSFKSVSGSHFGGLEQQSNYSSCCTESIGGGQVSPSSTDAKIKSEPYVVAYLTWDVVLMLKELPRPSEIAFNGLSCHNNIFKPRYLFFPNSSSRLVRASLAVYNGLQLDNLFFTETHNQRYLGIMSCLGSHPTEH

SEQ ID NO: 217558 - protein, 223 aa, Glycine max
  Coding DNA Sequence Number=SeqID_100780
  Gene Ontology: Mol. function=catalytic activity; Cellular component =membrane; Biological process=electron transport
  Homolog annotation: Hit_ID=Q1T3J7; Match level="QueryCoverage=90%, HitCoverage=55%, E-value=9e-69, Identity=64%"; Hit description=FAD linked oxidase, N-terminal
  Pfam annotation: Domain name=FAD_binding_4; Domain location=55-194; Score=87.2; E_value=4.9e-23; Accession=PF01565.13; Description=FAD binding domain
MSNKAFESTTLVFLLLSVVFSTPPEDPIKCTTSENTTCTITNSYGSFPDRSICKAAQVLYPTTEQELVSVVASATRNKTKMKIATRYSHSIPKLVCPDGENGMLISTKYLNKIVKVDVEANTMTVESGVTLQQFINEAAKVGLALPYAPYWWGVTIGGLMGTGAHGSTLRGKGSAVHDYVVGLRIVRPAGHEDGYAKVESLNERHEDLNATKVSLGVLGVISQ

SEQ ID NO: 217559 - protein, 379 aa, Glycine max
  Coding DNA Sequence Number=SeqID_100781
  Gene Ontology: Biological process=electron transport
  Homolog annotation: Hit_ID=Q60CX0; Match level="QueryCoverage=93%, HitCoverage=68%, E-value=1e-130, Identity=62%"; Hit description =Putative FAD binding domain containing protein, identical
  Pfam annotation: Domain name=ALO; Domain location=25-329; Score= -181.1; E_value=0.051; Accession=PF04030.4; Description=D-arabinono-1, 4-lactone oxidase
MQYFYQQTSKISNNQSWHLSSHSTITLKLERLFKRSITYVAKNDSDLGDQVAAFGHAHEFADIMWYPSQRKVVYRVDDRVPFNTSGNGLYDFIPLRPTPSNISIFRRTTEDIQESTNDAIGKCIDANASSNALFTVAYGLTNNGISFTGYPVIGFQNHLQSSGSCLDSPQDALITTCGWDPRVEGLFYYNTAFSIRLSVVKKFIEDVQKLVQLEPKGLCILGLYNGIVMRYVTASSAYLGKQEDALEFDFLYYRSRDPMTPRLYEDILEEVEQLGIFKYGGLPHWGKNRNLAFQGVIKKYKNAKKFLKVKNKYDPKGLFSNTWTDQVLGLKDGVTILKDGCALEGLCICSQDSHCNPSKGYYCRPGKVYKKARVCTHLK

SEQ ID NO: 217560 - protein, 405 aa, Glycine max
  Coding DNA Sequence Number=SeqID_100782
  Gene Ontology: Mol. function=protein serine/threonine kinase activity; Cellular component=cytoplasm; Biological process=protein amino acid phosphorylation
  Homolog annotation: Hit_ID=Q8S5V9; Match level="QueryCoverage=86%, HitCoverage=63%, E-value=1e-133, Identity=68%"; Hit description =Putative serine/threonine kinase
  Pfam annotation: Domain name=NAF; Domain location=225-287; Score =114.5; E_value=3.1e-31; Accession=PF03822.5; Description=NAF domain
  Pfam annotation: Domain name=Pkinase; Domain location=1-187; Score =165.3; E_value=1.6e-46; Accession=PF00069.15; Description=Protein kinase domain
  Pfam annotation: Domain name=Pkinase_Tyr; Domain location=1-185; Score=-76.3; E_value=8.6e-08; Accession=PF07714.7; Description =Protein tyrosine kinase
  Pfam module annotation: Pfam domain module=NAF::Pkinase::Pkinase_Tyr; Domain location=225-287::1-187::1-185
MASKTKIYIVLELVNGGELFDKIAKYGKLKEDEARSYFHQLINAVDYCHSRGVYHRDLKPENLLLDSNAILKVTDFGLSTYAQQEDELLRTACGTPNYVAPEVLNDRGYVGSTSDIWSCGVILFVLMAGYLPFDEPNHATLYQKIGRAQFTCPSWFSPEAKKLLKRILDPNPLTRIKIPELLEDEWFKKGYKPTTFVEEEDVNVDDVAAAFNDSKENLVTERKEKPVSMNAFELISRSQSFNLENLFEKQTQGIVKRETHFTSQRPANEIMSKIEEAAKPLGFNVHKRNYKMKLQGDKSGRKGHLSVATEVLTAEPFVVFEVAPSLHMVELRKTGGDTLEFHKACEHFNCDFGLEEQEKIISSFCSSFLLFSLVEPMFLVLLQFYKSFSSSSGLQDIVWHSEAKQ

SEQ ID NO: 217561 - protein, 170 aa, Glycine max
  Coding DNA Sequence Number=SeqID_100783
  Homolog annotation: Hit_ID=Q84VH5; Match level="QueryCoverage=83%, HitCoverage=25%, E-value=8e-56, Identity=69%"; Hit description =Envelope-like protein
KLSAGKLSVKYAILHRIGTANWVPTNHTSTVATESFAVKLPIAFPTVLCGIMLSQHPNILNNIDSVKKRESPLSLHYKLFEGTHVPDIVSTSGKAAASGAVSKDDLIAELKDTCKVLEATIKANTEKKMELERLIKRLSDNGVDDGEAAEEEEDAAEDTESDDDDSDATP

SEQ ID NO: 217562 - protein, 165 aa, Glycine max
  Coding DNA Sequence Number=SeqID_100784
MSSRGKETIPLLRVLPLIGQNFEKSPNLGAGIRPPKASRKWGGRNTEKIFGAIDVFLAYHNHKESPVVAMLADLYDTFDRRCEESNARIVCCTPALYVGLVSHLFLQEGRPVYPLQGYRSCVEKGKANWDQLLASMGGRLLIGSLARRKEESRFYLHAKDVQMFP

SEQ ID NO: 217563 - protein, 163 aa, Glycine max
  Coding DNA Sequence Number=SeqID_100785
  Gene Ontology: Mol. function=oxidoreductase activity; Biological process=electron transport
  Homolog annotation: Hit_ID=Q2XFA1; Match level="QueryCoverage=84%, HitCoverage=36%, E-value=4e-51, Identity=66%"; Hit description =Salicylate hydroxylase precursor
MKRIAVIGAGLGGLAAGSLLQKAGFHVTVYEQSPAFSRLGAGIHMGPNVLKVFRRMGIEQQLEDLASHPDFWFSRDGETGEYLSRIPLGAYARKEYGAAYVTVHRGDLQAMQMTSLEPGSVQFGKCLSSVEDSGNDVVLRFQDGSEARADIVIGADGINSKLP

SEQ ID NO: 217564 - protein, 53 aa, Glycine max
  Coding DNA Sequence Number=SeqID_100786
MAVNQSQLGQMFEQVLRLSKVDASQSVAILKSHYSDARTVQAATDAALRLGAK

SEQ ID NO: 217565 - protein, 107 aa, Glycine max
  Coding DNA Sequence Number=SeqID_100787
MGNPAAGAAYRPALQRHSLLAGDDGVNASAGAHFRHADESGTGDGRTLRHAVPRRTADAAAVAGAAGDHCRVGRLDADHETESGTYKRSRYQRAAINSAGSAGYLTG

SEQ ID NO: 217566 - protein, 242 aa, Glycine max
  Coding DNA Sequence Number=SeqID_100788
MTIRNVPLGNDQVKVYVEEVQDADARVPVPTQEVQLVGQTLNTFLAWPTYLVKIFSKQGVEGLVKPIDMLDLGIDPLYLMILTILQFLLKPLQVSWDATMVGVYNDNFLLYIKHEDLSEIVHNGQCLNISVIQLLIFTYWQIVIILPKDNVVIWFCSLHNRPDIYLKGIIVEAKLHGESKNNSRVQYKNQEEFKTQEESLESRIKIQGSRSQESRSRFKTQDSRIKRRLNQDKYEKFFSKIE

SEQ ID NO: 217567 - protein, 81 aa, Glycine max
  Coding DNA Sequence Number=SeqID_100789
  Subcellular localization annotation: CTP_CleavageSite=41; ConfidenceScore=5.06e-01
MILHEIRRPNSHKTVPSGVVNCRNLPFGGRATRGSWVCLPRKENARSCHQRLFEENVGKIEKGRFPCSYVFLNCDKEIRPT

SEQ ID NO: 217568 - protein, 76 aa, Glycine max
  Coding DNA Sequence Number=SeqID_100790
MQSQVLALPPEPEDGRSATRISTKENVVIWFCSLHNRLDFLKGIIIRQKGSPACEYYVMHRMSTIILGSFKNNWKM

SEQ ID NO: 217569 - protein, 99 aa, Glycine max
  Coding DNA Sequence Number=SeqID_100791
MQSHGLALPPKPEVGPSVARVSTKESCADPSGKTQTWVTQTNVGCLWMKILFAWLPLEEFMRGRPPSTTSLWAMIKSRSVLKKFEMLMLVFLYPLKRFS

SEQ ID NO: 217570 - protein, 89 aa, Glycine max
  Coding DNA Sequence Number=SeqID_100792
MVKSFKVQVQMQFSEVTRQKSLLLNPTMTLSDIITAIQSSIIDNDVTPIITTLWYRCLVYEFNGEVQYRAIQIIDEEVGSTWSRSWAIP

SEQ ID NO: 217571 - protein, 243 aa, Glycine max
  Coding DNA Sequence Number=SeqID_100793
  Gene Ontology: Mol. function=DNA binding
  Homolog annotation: Hit_ID=Q1SFS3; Match level="QueryCoverage=72%, HitCoverage=33%, E-value=1e-19, Identity=33%"; Hit description =Lambda repressor-like, DNA-binding
MAEVSTEAITCLAQYYDQPLRCFTFGDFQLSPMVEEFEEIIGCPLGGRRPYLFSGFYPSLARISKIVQISTQELDHRKQVKNGVVGIPRKCLEAKARILAGKGEWALFIDILALLIYGGVLFPNVDGLVDLAVIDAFLAYHDHKESPIVAMLADLYDTFDQRCEKRSTRIVCYTPVSYPNFVRGPLLDDMRPFFGPCEVLGIHHWAICEIPGHAEKPKKYIDAQSVSFRDTPEIKWKHRCIIK

SEQ ID NO: 217572 - protein, 230 aa, Glycine max
  Coding DNA Sequence Number=SeqID_100794
MLLWCFALRLPGGAVLLDESSISRGPDALAGGDRYSVEMTETRAIPCRGGYEHPVGLIEARNQSWKPQGPVGLFRVHWVSLGGRLALRSLGRMLLSSNVIYICVRVVMLVRMIRTRLFAAARVKSCPGMHSSCVIASLSGCARTVGPPPISGGGPGTVWIWSPLKVRTRSPLKARACSPLKFRTCRLSKARECSSMMARTCNPLKVRACPHFENAGTCSPLKVRTCSPLK

SEQ ID NO: 217573 - protein, 79 aa, Glycine max
  Coding DNA Sequence Number=SeqID_100795
MKGEARCRLEFRSILQSKSLVRTCSNRKERRIFKKEFPGSKKYLRSTKLRQERGLRAIGQFELVYGRVEVEAARVLDLA

SEQ ID NO: 217574 - protein, 200 aa, Glycine max
  Coding DNA Sequence Number=SeqID_100796
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=100%, E-value=1e-25, Identity=24%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=10; ConfidenceScore=5.34e-01
VRACSPLKVRARRPLKVRTCSPLKVKACNPLKARTCSPLKLRARNALKVRACSPLKVRACNPLEAMMCSPLKVRACSPLKVRTCCPLKVRSCSPLKVRTHTPLKVRPCSPLKVRTCGPQSVRACNTLKVRMCSPLKVRVCSPLKVRTCSPLMVRACNPLMARTCSPLKVRVCSPLKVRSCSPLKVWVHSPLKVSTCSPLR

SEQ ID NO: 217575 - protein, 180 aa, Glycine max
  Coding DNA Sequence Number=SeqID_100797
MGTRGCISYNPVPSIRQLGYPMRGAPLEEEIVPKVRKAWEVLQKKDKELRGSNNGPIGGYREWLKAHVQGSDWLPSLRATKREEDEAPEEDEGVQALRTELKQAQTVKERFKSAALKIRKENAELRDVNIATTKALEQETKRARREEHSRNKFRGALWGSNSELKLRREERDQSRVDRMS

SEQ ID NO: 217576 - protein, 91 aa, Glycine max
  Coding DNA Sequence Number=SeqID_100798
MSVKILIKHLRVYDKTNHTLGDQSRSHCLTRMLQPCGIGTSLKEHSNRVYLPTRPRLRRVFQSLSILIQVQPRKNFNMQTPSMNYKKHMTP

SEQ ID NO: 217577 - protein, 64 aa, Glycine max
  Coding DNA Sequence Number=SeqID_100799
TIRHITDRNGQIVDICPMNLQTKFREDPTVNECKRAFLPRWLQAASLRSFSREASLRSFLERLL

SEQ ID NO: 217578 - protein, 232 aa, Glycine max
  Coding DNA Sequence Number=SeqID_100800
  Gene Ontology: Mol. function=protein-N(PI)-phosphohistidine-sugar phosphotransferase activity; Cellular component=intracellular; Biological process=phosphoenolpyruvate-dependent sugar phosphotransferase system
  Homolog annotation: Hit_ID=UPI00005F7388; Match level="QueryCoverage =98%, HitCoverage=36%, E-value=1e-106, Identity=79%"; Hit description= COG3711: Transcriptional antiterminator
MITRVRYQIHIPNPLLSNIKQHYPMAYDVTLAAVTSWGKYTPYTISENEIGFLVLHIGVGLERHYDVGYQRHPQVLLVCDSGNSTLRMIEALLLRKYPQLVVTARLSQRDYEVRAHIDEDFVISTARLSEKNKPVVMMSPFPTEFQLEQLGKLVLVDRTRPYMLEKYFDAQHFMVLDRPMSQSALFRLLCDRLEAEGYVDADFYPSVEEREAIVSTMLGEGIALPHSRGITG

SEQ ID NO: 217579 - protein, 211 aa, Glycine max
  Coding DNA Sequence Number=SeqID_100801
  Gene Ontology: Mol. function=carboxypeptidase activity
  Homolog annotation: Hit_ID=Q8RV74; Match level="QueryCoverage=91%, HitCoverage=56%, E-value=6e-53, Identity=43%"; Hit description=Leaf senescence protein-like
  Pfam annotation: Domain name=DUF231; Domain location=5-194; Score =95.7; E_value=1.4e-25; Accession=PF03005.6; Description=Arabidopsis proteins of unknown function
MAAFWTTHLVRSKEADAKGPGPTGLCNLYLDEPDEKWITQVEDFDYVILNGGHWFTRKAFRTAFRAINRLENFKGTVFLRTFAPSHFENGLWNEGGNCIRTKPFKSNETQLEGLNLEFYMIQLEEFKIAEKEAKKKGLKYRLFDITQASLLRPDGHPSRYGHWLNENVTLYNDCVHWCLPGPIDTWSDFLLGMLKMEGVSSAEERLHLHSN

SEQ ID NO: 217580 - protein, 42 aa, Glycine max
  Coding DNA Sequence Number=SeqID_100802
MKFVQELNMVRIKIAASKTSISKYDSDAVGVNRGSNPPSCTL

SEQ ID NO: 217581 - protein, 291 aa, Glycine max
  Coding DNA Sequence Number=SeqID_100803
  Gene Ontology: Mol. function=transition metal ion binding; Cellular component=chromatin; Biological process=cytoskeleton organization and biogenesis
  Pfam annotation: Domain name=Transposase_21; Domain location=7-145; Score=32.2; E_value=2.3e-17; Accession=PF02992.5; Description =Transposase family tnp2
MGCLGTEHFGEEPRNLRLKLASDGMNPFDLGKLWVDEIDVYDGNLGQTFRLRAMVFCTINDFLAYENLSGYSVQGHHACPVYEKETSYIQLKHAKKTIYTRLQRFLKHYHPYRQLKKAFNGNQEYESVPKPLAGNEVYDRLKDILTIFGKTQKKDACEKNIWKKRSIFFDLPCRSDLNVRHCIDVMHVEKNLCDSLIGPLLNIKGKTKYGHEVDYDLDILVTLVCKEQEFIRPVLSMMHEVAKLANVDRAALWFHLCASEDEFVRVREESKNEISNMAKEKTMISQKLSES

SEQ ID NO: 217582 - protein, 494 aa, Glycine max
  Coding DNA Sequence Number=SeqID_100804
  Gene Ontology: Mol. function=proline dehydrogenase activity; Cellular component=mitochondrion; Biological process=glutamate biosynthetic process
  Homolog annotation: Hit_ID=Q6JA03; Match level="QueryCoverage=99%, HitCoverage=99%, E-value=0.0, Identity=72%"; Hit description=Proline dehydrogenase
  Pfam annotation: Domain name=Pro_dh; Domain location=132-481; Score =316.9; E_value=3.6e-92; Accession=PF01619.8; Description=Proline dehydrogenase
  Subcellular localization annotation: CTP_CleavageSite=80; ConfidenceScore=5.48e-01
MATRVIPPRILRKLRYNTATKPLNSSHPPLSPSLSPSPCLLPAPLPSPAVLRPSAAASDDLSFRDVEKLFSSVSTTSLLRSSAVLHATAVEPMVDFGTWLLRSNLMHVHGIRDLILATVRNTFFDHFCAGEDAITTAASIRHLNRAGLRGMLVYGVEDANDNDACHRNFKGFLHTIDVSRSLPPSSVSFVIVKITAICPMSLLERMSDLLRWQHKDPCFSLPWKQDCFPIFSESSPLYHTSNKPEPLTPEEEKDLQLAIQRFHELCHKCVQVNIPLLVDAEHTSVQPAIDYFTYSSAILHNKGDNPIVFGTMQTYLKDAKERLLLAAEAADNMGIPMGFKLVRGAYMSSETKLAESLGYSSPIHDTIEDTHKCFNDCSSFMLEKVANGPGGLVLATHNVESGKLAAAKAHELGIGKVNHKLEFAQLHGMSEALSFGLSNAGFQVSKYMPFGPVETVMPYLLRRAEENRGMLAASGFDRQLMRKELGRRLKAAVF

SEQ ID NO: 217583 - protein, 246 aa, Glycine max
  Coding DNA Sequence Number=SeqID_100805
  Gene Ontology: Mol. function=protein-tyrosine kinase activity; Biological process=protein amino acid phosphorylation
  Homolog annotation: Hit_ID=Q9LKY3; Match level="QueryCoverage=55%, HitCoverage=34%, E-value=1e-47, Identity=72%"; Hit description=Pti1 kinase-like protein
MTRMKLAYDAATTPMAWDSVRGGLSLRERTRAREEYSFSVCFAFRSLRLGATTCLLGFCCCWCLVAIIGRQQKRRRRRGEVDATVARCRSMENDDANDMEKLEMEKMNHWNPSYHGRHTTVTAPQTVNFQPNVVPSVIVDELKSLTNYFGSKYFIGEGAYGKVYQEVVIKKLDSSNQTKQEFLSQTVKGNMLLFSTSDSHLVQVSIVSRLKHENVVELVNYYVDGSFRALAYEYAPKGSLHNILHG

SEQ ID NO: 217584 - protein, 100 aa, Glycine max
  Coding DNA Sequence Number=SeqID_100806
MATYAAMKPTKLSLEEPREQIHKTSGSVLREPVRMPTKALHITSRKSLCGEVLNMHALCIRSSFAIYLLVCKAVASLRETTGVIVKASLHKAIVYGPELG

SEQ ID NO: 217585 - protein, 236 aa, Glycine max
  Coding DNA Sequence Number=SeqID_100807
DDMTSYTLQKQHGFKTNLGDLHDLLFKFYMVLGIDYEHDQTYMDCDMLESDDRGNGDNEAEKSVGIKGEARKEHFLEVPLPTNMGSLRVEKDKVVVGDISGGATLDDMVAAIKHLGQKMENMDNHNKRRLDAMEKTNTIMLKAMCNLVKQDYNQSAKDVVKDVAMSGTHNTSTYDETLRCRNPNKAISKATVRCRRKKAYGKCKAYFKNIETIFIPGDDDDDFPMPKHNVVKAKFQ

SEQ ID NO: 217586 - protein, 116 aa, Glycine max
  Coding DNA Sequence Number=SeqID_100808
  Subcellular localization annotation: CTP_CleavageSite=39; ConfidenceScore=5.80e-01
MINAVDHLRRFFPTILFPSPTTSATRKTQSRPFNSALVTAAVVPSVVVGYGKAIMLFAAARADRRERRKEGENETPPPEIPSGDGTRCFAAEDVPLFLSAAYHVTGSIPNHSEFQF

SEQ ID NO: 217587 - protein, 82 aa, Glycine max
  Coding DNA Sequence Number=SeqID_100809
VSHLHPSLRHTSVVHRCIAVLEWSRKSGVFNVEVTTQQTNEILQTLVLDDETIEVKNTGFGDFSSVPIGRISYRCKSKDGNR

SEQ ID NO: 217588 - protein, 63 aa, Glycine max
  Coding DNA Sequence Number=SeqID_100810
MVMLGLGRLVVTLKSKIRSLKLKKPYDKMEKSESMRVEIRSRKARKLIEETLKIADSPNKTLQ

SEQ ID NO: 217589 - protein, 601 aa, Glycine max
  Coding DNA Sequence Number=SeqID_100811
  Gene Ontology: Mol. function=binding; Cellular component=anaphase -promoting complex; Biological process=cell division
  Homolog annotation: Hit_ID=Q8LGU6; Match level="QueryCoverage=99%, HitCoverage=91%, E-value=1e-171, Identity=50%"; Hit description =HOBBIT protein
  Pfam annotation: Domain name=TPR_1; Domain location=381-414; Score =7.9; E_value=0.61; Accession=PF00515.18; Description=Tetratricopeptid e repeat
  Pfam annotation: Domain name=TPR_1; Domain location=39-72; Score =22.8; E_value=0.0012; Accession=PF00515.18; Description =Tetratricopeptide repeat
  Pfam annotation: Domain name=TPR_1; Domain location=443-476; Score =29.1; E_value=1.6e-05; Accession=PF00515.18; Description =Tetratricopeptide repeat
  Pfam annotation: Domain name=TPR_1; Domain location=477-510; Score =10.4; E_value=0.31; Accession=PF00515.18; Description=Tetratricopepti de repeat
  Pfam annotation: Domain name=TPR_1; Domain location=511-544; Score =12.4; E_value=0.18; Accession=PF00515.18; Description=Tetratricopepti de repeat
  Pfam annotation: Domain name=TPR_1; Domain location=545-578; Score =12.8; E_value=0.16; Accession=PF00515.18; Description=Tetratricopepti de repeat
  Pfam annotation: Domain name=TPR_2; Domain location=381-414; Score =9.9; E_value=2.3; Accession=PF07719.7; Description=Tetratricopeptide repeat
  Pfam annotation: Domain name=TPR_2; Domain location=39-72; Score =25.6; E_value=0.00018; Accession=PF07719.7; Description =Tetratricopeptide repeat
  Pfam annotation: Domain name=TPR_2; Domain location=443-476; Score =21.5; E_value=0.003; Accession=PF07719.7; Description=Tetratricopepti de repeat
  Pfam annotation: Domain name=TPR_2; Domain location=477-510; Score =12.2; E_value=1.3; Accession=PF07719.7; Description=Tetratricopeptide repeat
  Pfam annotation: Domain name=TPR_2; Domain location=511-544; Score =20.4; E_value=0.0063; Accession=PF07719.7; Description =Tetratricopeptide repeat
  Pfam annotation: Domain name=TPR_2; Domain location=545-578; Score =13.3; E_value=0.89; Accession=PF07719.7; Description=Tetratricopeptid e repeat
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2; Domain location=381-414::39-72::443-476::477-510::511-544::545-578::381 -414::39-72::443-476::...
  Pfam module annotation: Domain location=477-510::511-544::545-578
MAQSRYLFAISCFQMGLLSEAEAALCPANEPSVEVPNGAAGHYLLGLIYRYTDRRKSAIHNFKQALSMDPLMWAAYEELCILGAAEDATAVFGEAAALCIQKQYLHCSTSSKLHSSAEDCNIVDTRHSASEDTSPRQLKLMQSMKDIPGNHHGPSILGGTAQPINSGVAPPPLCRNVQPNGQNLSSLNADTSPKSTVNSTIQAPRRKFVDEGKLRKISGRLFSDSGPRRSSRLSSDASVNANANATAVLGNGTSNSSKYLGGSKLSTMAFRSMTVRKGQSWANENADEGIRNDVLDDSRLNVASTTSSSSSTMEAKSYEQETANFPIGGQIVSGSKVISGASEILTILRIFGEGCRLSYLYRCQDALDTYMKLPHKHYNTGWVLSQVGKVYFELVDYLEAEQAFGLARQIMPYSLEGMDVYSTVLYNGIKCYQSALRVDARHYNAWYGLGMVYLRQEKFEFSEHHFRMAFHINPRSSVIMSYLGTALHALKRSEEALMVMEKAILADKKNPLPMYQKANILISLEKFDEALEVLEELKEHAPRESSVYALMGRIYKRRNMHERAMLHYGISLDLKPSATDAAAIKAAIEKLHVPDEMEDNL

SEQ ID NO: 217590 - protein, 85 aa, Glycine max
  Coding DNA Sequence Number=SeqID_100812
MDQDDDNDAGNDLVFEDDVGPCGLRYLKKGGGQPFPCVQESFTTRDPRSLNPFSEVKEKKKKSLLEETDCTMKINHNSLFEYASV

SEQ ID NO: 217591 - protein, 131 aa, Glycine max
  Coding DNA Sequence Number=SeqID_100813
MFLKISCFMLSNPNLNYAQQFFVECNINTGFLPPSFQIIPQHQGVLCVSIDDASSIGACRPRIFFINGFLCFLEDEWQRNGERERERRRHFKEKMSLEEAHHHRRSWIRAWRKKEMNEGRGREEHEILCSK

SEQ ID NO: 217592 - protein, 107 aa, Glycine max
  Coding DNA Sequence Number=SeqID_100814
  Homolog annotation: Hit_ID=Q9SGA8; Match level="QueryCoverage=44%, HitCoverage=10%, E-value=5e-10, Identity=58%"; Hit description =Putative UDP-glucosyl transferase
MARPHDIVVPYPVQWIRNEKITCILADQNIGWAVKIAEKKRIRMQAFCPASAAQLVLGLSIPKMIDTGSQTKMYEESNLSIPWTQPRYEPQTGKSKHSTKMPQHYAL

SEQ ID NO: 217593 - protein, 291 aa, Glycine max
  Coding DNA Sequence Number=SeqID_100815
  Gene Ontology: Mol. function=protein binding; Cellular component =nucleus; Biological process=multicellular organismal development
  Homolog annotation: Hit_ID=Q1SXD6; Match level="QueryCoverage=97%, HitCoverage=61%, E-value=1e-131, Identity=78%"; Hit description=WD40- like
  Pfam annotation: Domain name=WD40; Domain location=104-141; Score =30.4; E_value=6.4e-06; Accession=PF00400.22; Description=WD domain, G-beta repeat
  Pfam annotation: Domain name=WD40; Domain location=161-199; Score =11.3; E_value=1.7; Accession=PF00400.22; Description=WD domain, G -beta repeat
  Pfam annotation: Domain name=WD40; Domain location=206-245; Score =34.8; E_value=3.1e-07; Accession=PF00400.22; Description=WD domain, G-beta repeat
  Pfam annotation: Domain name=WD40; Domain location=249-286; Score =9.5; E_value=2.8; Accession=PF00400.22; Description=WD domain, G -beta repeat
  Pfam annotation: Domain name=WD40; Domain location=38-76; Score=35.2; E_value=2.2e-07; Accession=PF00400.22; Description=WD domain, G-beta repeat
  Pfam module annotation: Pfam domain module=WD40::WD40::WD40::WD40::WD4 0; Domain location=104-141::161-199::206-245::249-286::38-76
MQNYVCEETITVATASKDRTLRLWKLNAEGPVNNPMRVRAYKIFRGHKSSVNCVAAQTSGEMVCSASWDCTINLWQTNDFNAEDDLVSKKRKIGAQVEESQLEGEAFTTLVGHTQCVSAVVWPQQESIYSASWDHSIRKWDVETGKNLTDLCLLCWSKWNPVMGITLFCGKVLNCLDIGGEGSALIAAGGSDPVIRIWDPRKPGTSAPVFQFSSHTSWISACKWHDQSWFHLLSASYDGKVMLWDLRTAWPLSVIESHSDKVLSADWWKSNSVISGGADSKLCISSEIPVK

SEQ ID NO: 217594 - protein, 100 aa, Glycine max
  Coding DNA Sequence Number=SeqID_100816
  Homolog annotation: Hit_ID=Q1SXD6; Match level="QueryCoverage=86%, HitCoverage=20%, E-value=7e-31, Identity=80%"; Hit description=WD40 -like
  Pfam annotation: Domain name=NLE; Domain location=14-82; Score=108.8; E_value=1.6e-29; Accession=PF08154.2; Description=NLE (NUC135) domain
MNMNEESVEGSARRIQVRFVTKLGEPYKVPTTAIAIPADLARFGLSSLVNALLQSNDADHQLEPFDFLIDGEFVRMSLEQFLLAKGISAVFGVKFHGMGI

SEQ ID NO: 217595 - protein, 195 aa, Glycine max
  Coding DNA Sequence Number=SeqID_100817
  Gene Ontology: Mol. function=chitin binding; Cellular component =extracellular region; Biological process=chitin metabolic process
  Homolog annotation: Hit_ID=UPI00006A17C9; Match level="QueryCoverage =82%, HitCoverage=98%, E-value=4e-17, Identity=36%"; Hit description =UPI00006A17C9 related cluster
MSKSCGFGMTGPLDESISCFLIRVDPWLPSPLRGLHVLALRGLHVLTIRGLHVLTFRGLHVLALRGLHALTLGLHVLALRGLHIRGLHALTSRGLHVLALRGLHAFTLGTSYPHRQRTTRPRLERTTRPQHQRAAHPRLQRTSRPRLHRATCPHLLRASRPRHQRTARPRHQRAAHPHLQRTTHPRLERAARPHL

SEQ ID NO: 217596 - protein, 202 aa, Glycine max
  Coding DNA Sequence Number=SeqID_100818
MEEKSKRGHEEHSCTESPTLNIDPPSSVSRHLKWKIARTKRHDQMTSEVAQEITDKIDSLQEQATHGSFFSHGLQDILNMAFGRPEHQGHVRVAWTGVTISQYFGQASRASSTLSPSINQQQLANIIGGIKDDIKKQLQDEIRNEVQDEIRKESAPIKALEIQALLARVSTKGSCARLEGSGLLKELLNGDDDLMGLFVVVG

SEQ ID NO: 217597 - protein, 247 aa, Glycine max
  Coding DNA Sequence Number=SeqID_100819
  Homolog annotation: Hit_ID=Q1SP02; Match level="QueryCoverage=55%, HitCoverage=29%, E-value=2e-15, Identity=38%"; Hit description=IMP dehydrogenase/GMP reductase
MELLEVSHEEATFETRQAGGPHVRLGWLRDLYQSPCRTRRWVVAARLYTAAGRLYYTSPAHTSVVHDAYDEGSPRACRWLTGKAYITGIKGAPYRRRLDALSVTDVCWMPYGEHRRVRAFDLISSYTGQLRWGQIVVYVRPERVLRQFGYLQTVPLPPVCDSLTGDDIDDRWLNFPDHLVPSGELCVVPGQVVADYMEWFFRISHPFVTRTEETAAPRHPPPPHHEEFIEPPIPEVLVMTDLPTHSV

SEQ ID NO: 217598 - protein, 100 aa, Glycine max
  Coding DNA Sequence Number=SeqID_100820
TFFGAGLLPPARLGERRSPGRAGRQPPPPFSYEKAEGGCSKDPGAPWLCISAVLGEKNCFREENPSRGASVTLPRCFRKQIREGFRLFFIVLHPFFVLQR

SEQ ID NO: 217599 - protein, 75 aa, Glycine max
  Coding DNA Sequence Number=SeqID_100821
MSGHRVRHRGSCSFTSALDFYLALYSNSSILGQDQLQYSRAGCQDIVSDIVDPATSILHLTFYLALCIVQPDFIP

SEQ ID NO: 217600 - protein, 117 aa, Glycine max
  Coding DNA Sequence Number=SeqID_100822
MRGAPTEESLSPFLVRDLGAQSLKVIQRVHKAWRSPLRKDKELRGIQNGVIGGYHGWLRVHTRGLDWLSKLKVINEENFEALEEDEEVQALKLELGKARLAKEKFKSTATHIRKECT

SEQ ID NO: 217601 - protein, 128 aa, Glycine max
  Coding DNA Sequence Number=SeqID_100823
  Subcellular localization annotation: CTP_CleavageSite=23; ConfidenceScore=5.36e-01
MAPDRMQLQNMGKKGSPMESPTVATYPSAGGRSVTHGRVFQERNTRGVATNELFLHTGKVLALQALQPLPFNNVEELAAQWSNEGRMPTNNGHQTKLGVAGDIHFKFRVQFENIIQLTKGAKDTIIIT

SEQ ID NO: 217602 - protein, 165 aa, Glycine max
  Coding DNA Sequence Number=SeqID_100824
  Subcellular localization annotation: CTP_CleavageSite=51; ConfidenceScore=5.12e-01
ARLAGVSSKGGKCAESPPTFICGKRRKNRRKPVMKNIPDSGVVFMFKEGISTSHDESSDSFYLEGGPFKALDLKITHFYLVRKTEGKEGEACHLARPGELARLLEELPGRPNMLQNFTDCATMLSFDFRPVTELHGLPNDRCQVPRSGEAKRCHANQTNGPRTTL

SEQ ID NO: 217603 - protein, 113 aa, Glycine max
  Coding DNA Sequence Number=SeqID_100825
MSINKLLVAMSLALALAACSKQEAAQDAAASANEAATEAQAAADQAAAAGAQTADAAQQAADTAATAADASVDAAASTAAAATDAAAGEAKDAAKAAEATAEQAKDAAEEAKK

SEQ ID NO: 217604 - protein, 129 aa, Glycine max
  Coding DNA Sequence Number=SeqID_100826
  Gene Ontology: Mol. function=acetyl-CoA C-acetyltransferase activity; Cellular component=cytoplasm; Biological process=lipid metabolic process
  Homolog annotation: Hit_ID=Q3BVT1; Match level="QueryCoverage=98%, HitCoverage=32%, E-value=3e-56, Identity=81%"; Hit description =Acetyl-CoA C-acetyltransferase
  Subcellular localization annotation: CTP_CleavageSite=24; ConfidenceScore=5.43e-01
MAIAVASPPPMHRVAMPRLPPCVRRALTKVTTRRAPEAPIGWPSAQAPPFTLSLSCGMPSSRIGAIATTAKASLISNRSTWSSDQPVLSSSLCSAPIGAVVNHSGSCEWVAWPTMRASGVMPRAAASSS

SEQ ID NO: 217605 - protein, 149 aa, Glycine max
  Coding DNA Sequence Number=SeqID_100827
MCSGVKWRHPWHVCGVRGGVCGLVQCMQGIGGGLLGSGSGLVGSVAGGFGGLVHGVTDGSAGAVGGLLRVLLSLFGFRTHAGGQGQQQGGGQQRGGDRANLHGGLRYCNGWGRQPIHAVVKTGSRSEVRAQAAGQRKSRWRTSGFSGTA

SEQ ID NO: 217606 - protein, 99 aa, Glycine max
  Coding DNA Sequence Number=SeqID_100828
  Gene Ontology: Mol. function=transporter activity; Cellular component= integral to membrane; Biological process=oligopeptide transport
  Homolog annotation: Hit_ID=Q9CAS0; Match level="QueryCoverage=95%, HitCoverage=19%, E-value=1e-11, Identity=48%"; Hit description =Putative peptide transporter; 37139-33250
MHTPAKYMIIEQIMSTLSVPKPKIQFLFWRGSCVKLTDGKGNNAWSNPTCMCPQPANTGLKLRCQVEYLLGKCIAGEKCNLGDEVVASRLLVLESPFPN

SEQ ID NO: 217607 - protein, 226 aa, Glycine max
  Coding DNA Sequence Number=SeqID_100829
MAHSNSSRLGFPALIIALCRTRRVGSDALTSYRSLRPVINLAYIKRKCWNVNDQIVNFLGARKTRSTAAGVPFSFAPAADIPSSSTLDSKLQSLFEGQMLIMLIMSVEQLIEQVAWPGARPSFVRDNVSSRAQAPQQQKLEPENDQSSEATILGAFDVSEGRSEMRSDKAAYPELVPVPADPPSLVVDPSFPAPEVALPSTPIIISNDPTVRTPEWIPTPPATPEL

SEQ ID NO: 217608 - protein, 138 aa, Glycine max
  Coding DNA Sequence Number=SeqID_100830
MTSRDQVWSFCTPDTRRYLTVIRTLLPFRHSRVRWQAETKFGHSAPMIRGDTLRLSAPFCHPEAAGPMTSRDQVWSFCTHDTRRYLMGLTQPFAPFVPPGTTKSFTCGNFMVARDSRQPRGAKLVPYTDFRGPLLDDM

SEQ ID NO: 217609 - protein, 49 aa, Glycine max
  Coding DNA Sequence Number=SeqID_100831
MDKDFTLHFNQWSSNLKEGLDQTYLREVAKEKKHRLLTMLECDEHDARP

SEQ ID NO: 217610 - protein, 118 aa, Glycine max
  Coding DNA Sequence Number=SeqID_100832
  Gene Ontology: Mol. function=structural constituent of ribosome; Cellular component=ribonucleoprotein complex; Biological process =translation
  Homolog annotation: Hit_ID=Q2QD65; Match level="QueryCoverage=80%, HitCoverage=74%, E-value=7e-38, Identity=85%"; Hit description =Ribosomal protein S12
  Pfam annotation: Domain name=Ribosomal_S12; Domain location=1-117; Score=151.2; E_value=2.8e-42; Accession=PF00164.15; Description =Ribosomal protein S12
MGQKGLIAKKDFLFLLEDRDWIHICLSGSKGDLSVNFSTITPKKPNSALRKVARVRLTSGFEITAYIPGIGHNLQEHSVVLVRGGRVKDLPGVRYHIVRGTLDAVGVKDRQQGRSSAL

SEQ ID NO: 217611 - protein, 120 aa, Glycine max
  Coding DNA Sequence Number=SeqID_100833
MEEAAKSGSTNTVIDPPSPIIRHVKWKMACTEKTGQMTSHVAKEIVDKIISWRSRSHRVPLSPMDVRIYKLLPLGDQNTLIICMLLGRCHDQAILRNGSKYLLHVFIHGSRRPGEANAKK

SEQ ID NO: 217612 - protein, 74 aa, Glycine max
  Coding DNA Sequence Number=SeqID_100834
KVAATGVSLSQANALSKRYLLSETSVRLASQGNLEENLPCMHAPSAPSACPTSILSLPALSAPGSLSQKSLTRA

SEQ ID NO: 217613 - protein, 72 aa, Glycine max
  Coding DNA Sequence Number=SeqID_100835
MLLNVSDVVDKYEVIVRDRTKQGNRQSMDGAINTILSRKFNLLGHYEHTLGIENWFVPRTFSAPYGPTFLDA

SEQ ID NO: 217614 - protein, 94 aa, Glycine max
  Coding DNA Sequence Number=SeqID_100836
MTTLTQIWMTLLLSNIPPDDHNADLPPAKVSVGLCHRDIGITPTRHPVDPKKSNRALGFPALVTGLCQSYRAPAPPASSCHRDIGKYAHLSTDF

SEQ ID NO: 217615 - protein, 105 aa, Glycine max
  Coding DNA Sequence Number=SeqID_100837
MENPKRHCKAIISTIECDMRGEEEEEVKQSTMLEEEMKAQANPSTQEILQGKKEEPPIEKLKWNLLYKKQSFKNYFDDAKEFQRSFKMNFKDEESNMSSKAKISR

SEQ ID NO: 217616 - protein, 274 aa, Glycine max
  Coding DNA Sequence Number=SeqID_100838
MENHIDLALVKEFYSNLYDPEDHSPMQWKVRGKMIKFDAAILNTFLETLVVLDPGERKDLTTLTQTWSVLSYSNLAPTSHTYDLNMDRASPSARPSIWHICWNPEDPSITFPGSRKAKARAPSDALVPPPPTPISAPTGPFVPSSAAIVPMLQSIHHDLFLVMQSMQNLSQQRLIMSMEDFLAQVAWSGVQPSFWGGEALVAQEPQTQAAEDTPEAGEAKDTPKAEAEAQDTPVEAAEEGVSGAAKADIDDDYVVAVTTAQGTWDPWLTPAQDY

SEQ ID NO: 217617 - protein, 883 aa, Glycine max
  Coding DNA Sequence Number=SeqID_100839
  Homolog annotation: Hit_ID=Q7XDI4; Match level="QueryCoverage=93%, HitCoverage=83%, E-value=0.0, Identity=48%"; Hit description =Expressed protein
  Pfam annotation: Domain name=DUF810; Domain location=1-830; Score =1288.3; E_value=0; Accession=PF05664.2; Description=Protein of unknown function (DUF810)
MHATLQAGRRAETIILPLELLRHVKPSEFSDSNEYHMWQKRQLRVLEVGLLTHPSIPLDKATTFAMRLRDIIRSGESKIIDTSKNSDTLRTLSNSVVSLAWRSSNSTPTDVCHWADGFPLNIHLYSSLLQAIFDNRDDTLVLDEVDELLELMKKTWSILGITRPIHNVCFTWVLFQQYVATGQIEPDLLCATQAMLSEVAIDAKRERESFYVKLLTSVLSSIQRWAEKRLIDYHEHFQRGNIGQIENVLPVVLSVTMILGEDLVISDGGEGVEKRDITIVDSSGYRIDYYIRSTIKNAFEKVIEAANAKAGELEIKGEFSEFLLQLAQETEELAMKERENFTPMLKKWHPAPGAVAALMLHSCYGHVLRQYLGDVTSLTHETVEVLHRAEKVEKVLLQMVVEEDCGEGEDNDKTVMREMVPYEVDSIILNLMRKWINEALSNGKECLQRAKETETWNPKSKSEQYAPSAAELVQLAKTTVEEFFQIPVGKTEDIVQELADGLESLFQDYMMFVAACGTKQSYIPSLPPLTRCNRDSKLIKLWKKASPCGANISELEHIHEGHNPRPSTSRGTQRLYVRLNTLHYLLSNINTLEKSLSHTPGVVPSSSRKHSGPYLEIVNSSIPAACQHVSEVAAYRLIFLDSNSVFYGSLYVGDVANSRIRPALRILKQNITLMTTLVADRAQALAMKEVMKASFDAFLMVLLAGGSSRVFNRSDHVMIQEDFESLNRVFCTCGEGLIAENLVEREAAVVEGVIALMGQYTEQLVEDFSIATCETSGIGVMGNGLKLPMPPTTGRWNRSDPNTILRVLCSRNDRAANHFLKRTFQLAKRRDILLAMMHIVALQFLPCDTEGEQGSIFESTQSGCQMEKYGTKKAMLMSLSIET

SEQ ID NO: 217618 - protein, 76 aa, Glycine max
  Coding DNA Sequence Number=SeqID_100840
MVVRSKIWKMTGKHTVVGDKEQMVPLAEVQAQTDQIQAKGVQTATNKRRMVRPAYLSDFRIVQEHCVQDGRFDAGF

SEQ ID NO: 217619 - protein, 153 aa, Glycine max
  Coding DNA Sequence Number=SeqID_100841
  Gene Ontology: Mol. function=protein binding
  Homolog annotation: Hit_ID=Q5ZDH7; Match level="QueryCoverage=59%, HitCoverage=14%, E-value=7e-12, Identity=37%"; Hit description =Senescence-induced receptor-like serine/threonine kinase-like
MMINYIFKEIKFSRTKTLIDNLSNNSWEKKAFYDVGFMMVVQKSMSFGGKAGNAAVVDEDEVVGVGEGDGVDLNEFNGGNERRISDEAVEAEIEGGGGVGERGEEVAISAFVGNGISPRSALVEDDGGGECDVEGGRTELGIHKRANQLHFIP

SEQ ID NO: 217620 - protein, 60 aa, Glycine max
  Coding DNA Sequence Number=SeqID_100842
MWLKGVQTPVVLFGNRDEHAKHASKRPTALSSTLSLDGTDKLILPQGEINIVVAGRNVAK

SEQ ID NO: 217621 - protein, 574 aa, Glycine max
  Coding DNA Sequence Number=SeqID_100843
  Gene Ontology: Mol. function=enzyme inhibitor activity; Cellular component=cell wall; Biological process=cell wall modification
  Homolog annotation: Hit_ID=Q1SEP8; Match level="QueryCoverage=92%, HitCoverage=92%, E-value=0.0, Identity=74%"; Hit description =Pectinesterase; Pectinesterase inhibitor
  Pfam annotation: Domain name=PMEI; Domain location=46-201; Score =100.2; E_value=6e-27; Accession=PF04043.6; Description=Plant invertasepectin methylesterase inhibitor
  Pfam annotation: Domain name=Pectinesterase; Domain location=262-557; Score=577.0; E_value=1.8e-170; Accession=PF01095.10; Description =Pectinesterase
  Pfam module annotation: Pfam domain module=PMEI::Pectinesterase; Domain location=46-201::262-557
MEKKATLVSAVSLILVVGVALGVVAYVSTNNSGSDNSESNDSGQVSTHTKAVQAVCQNSDDKKFCSDTLSSVNTSDPTAYVKTVLKKTMDGVIKAFNLSDTLTVEHSKTNSSVKMALEDCKDLLDFAIDELQASQVLVKDNNVNNINDGVSDLKNWIGAVVAYQQSCLDGFDTDAEKEVQSKLQTGGLDSMGKLTALALDVISSFAELLSGFNLNLTTSVKPPTSSSRRLLDVDQDGYPSWISMPDRKLLADAKKGDSVPPNAVVAKDGSGQYKTVLDAINSYPKNHKGRYVIYVKAGVYDEYITVDKKKPNILIYGDGPTKTIITGSKNMKDGVKTMRTATFATVAEDFIAKSMAFENTAGARGHQAVALRVQGDRSAFFDCAIHGYQDTLYAHAHRQFYRNCEISGTVDFIFGYGTTLIQSSKLIVRKPDPNQQNIVVADGTDQKNMPTGVVLQNCEIIPEAALVPDKMKFRSYLARPWKAYSRAILMENTIGDFIQPDGFLPWNGNLYLDTCFFAEYANTGMGADTQRRVKWSRGVLNKADATKYTADQWLQANTWLPATGIPFDLGLTKA

SEQ ID NO: 217622 - protein, 101 aa, Glycine max
  Coding DNA Sequence Number=SeqID_100844
MHIGGIDPKRRKRANSTMSFGNSVREERGLKLHRSSHHEACSTTMVPLPHHHHRRRSRGGLTSRRHASMAPERNTTLRGGFSYCDTIWGARSSRVVSTLMP

SEQ ID NO: 217623 - protein, 498 aa, Glycine max
  Coding DNA Sequence Number=SeqID_100845
  Gene Ontology: Mol. function=RNA-directed DNA polymerase activity; Cellular component=chromatin; Biological process=chromatin assembly or disassembly
  Pfam annotation: Domain name=Chromo; Domain location=369-422; Score =30.3; E_value=6.6e-06; Accession=PF00385.14; Description='chromo' (CHRromatin Organisation MOdifier
  Pfam annotation: Domain name=rve; Domain location=99-219; Score=7.5; E_value=0.0014; Accession=PF00665.16; Description=Integrase core domain
  Pfam annotation: Domain name=zf-H2C2; Domain location=40-81; Score =27.3; E_value=5.5e-05; Accession=PF09337.1; Description=His(2) -Cys(2) zinc finger
  Pfam module annotation: Pfam domain module=Chromo::rve::zf-H2C2; Domain location=369-422::99-219::40-81
MTLPENYLEFTIANNLILKKGRFWLPRDLLIIPALLEQYHATPTGGHKGVAKTIARLSENFQWPGLREVVAKFIENCIECQYTKYETKRPVGLLCPLPVPSRPWEDLSLDFITNLLVYHGKTVILIVVDRFSKGIHLGLLPSAHTTHMVATLFVDIVVKLHGIPQSLVSDRDPLFFSHFWQDLFQLSGTKWGKLLLWVEWSHNTSWNMGTGSTPYEITFGRKPFNFSEYLLGSSNIDAVDDMLTHRDEVFHNIRKKLLKAQATMKHQADSRRREVIYQPGDWVLLKLRPYRQQSAKEKHKVYGKLVKCYYGPFQILERVGPVACRLKLPEGALIHSVFHCSLLKPFHVQPDAASLPEFLEQFFKDQPVIFPLAVLNYRQSSTTEDGPREVLVQWCGLSPDETSWENWDQLKRDHHLEDKQELKEESRNLHTSGTISEEEGAELAIEICWISLSAAKVLTERGIFLVMADKIKGYSLDIQLNNIQLSRYQQQASTGTNG

SEQ ID NO: 217624 - protein, 561 aa, Glycine max
  Coding DNA Sequence Number=SeqID_100846
  Gene Ontology: Mol. function=enzyme inhibitor activity; Cellular component=cell wall; Biological process=cell wall modification
  Homolog annotation: Hit_ID=Q1SEP8; Match level="QueryCoverage=93%, HitCoverage=93%, E-value=0.0, Identity=66%"; Hit description =Pectinesterase; Pectinesterase inhibitor
  Pfam annotation: Domain name=PMEI; Domain location=41-196; Score =90.6; E_value=4.9e-24; Accession=PF04043.6; Description=Plant invertasepectin methylesterase inhibitor
  Pfam annotation: Domain name=Pectinesterase; Domain location=248-544; Score=545.1; E_value=7.3e-161; Accession=PF01095.10; Description =Pectinesterase
  Pfam module annotation: Pfam domain module=PMEI::Pectinesterase; Domain location=41-196::248-544
MKGKVLGSTVSLILVVGVVIGVVAVVQSPKGVNNSNGGEVKSTNRAVTALCQGSDDKKLCHDVLSSSNSTDPKEYIATVVRSSMDSVIKALNMSDRLTVEHGNSSAGMKMALEDCKDLLQSAMHDLEASGVLVKESSLQDVHQRTAELKNWLGAVVAYQQSCLDGFDTDGEKKVQEQLQSGSLDNVGKLTGLALDVVSGITHILQSLDLDLALKPASRRLLDVDDDGFPTWVSSADRKLLANDPVLPHATVAKDGSGQFHTVLDAINSYPKHHQGRYVIYVKAGIYDEYITVDKKKPNLLIYGDGPSKTIITGRKNFHEGTKTMRTATFSTVAEDFMAKSIAFENTAGAEGHQAVALRVQGDRSVFFDCAMRGYQDTLYAHAHRQFYRNCEISGTIDFIFGYSTTLIQNSKILVRKPMPNQQNIVVADGTGQKNMPTGVVLQNCEIMPDASLFADRMIVKTYLARPWKAFSRAVFIENVMGDLIQPEGYIPWNPIEPNTQDCYFAEFGNTGPGSVTQARAKFAKGLISKQEAAKFTAEPWLTTSTWLPSAAVPFDPSFTKA

SEQ ID NO: 217625 - protein, 224 aa, Glycine max
  Coding DNA Sequence Number=SeqID_100847
MTPTLVLEVSVSTVKGQLQVPEMFIKGGAVNKNIVEEDDNKMAKIRLEYEIHGGLKGRRAITQPKRHDLELIMAMVALRSIVHHRARPRDKKAQIIVIRNKKENPSGALVASVELFVTSETETLLVAYGNFVWRKAFQGGRVGTGLWRKQGGKVRRVRVEGGSGGVKRRRRRVRWRCAVTQMRPLVKKLLFVQACQPCSLNHGHWLLRLDLTTNIGRESRNKVA

SEQ ID NO: 217626 - protein, 185 aa, Glycine max
  Coding DNA Sequence Number=SeqID_100848
  Gene Ontology: Mol. function=enzyme inhibitor activity; Cellular component=cell wall; Biological process=cell wall modification
  Homolog annotation: Hit_ID=Q1SEQ0; Match level="QueryCoverage=69%, HitCoverage=22%, E-value=2e-44, Identity=66%"; Hit description =Pectinesterase; Pectinesterase inhibitor
  Pfam annotation: Domain name=Pectinesterase; Domain location=10-161; Score=-24.9; E_value=8.7e-20; Accession=PF01095.10; Description =Pectinesterase
MTSLSICHLVSSVNKKTCMTLAGLKKHWRHVSVLGLCNARLPIHITSQTNMATGIVIQNCDIVPEEALYRARFKVKSYLGRLWKRYSRTVVMESNIGDFIRPEGWSAWDGNQNLGTLYYAEYANVGAGANFTERVNWKGYHCNISVDEAAKFTAEQFLRAGPTGRADWLKATGIPLFPSFISTRP

SEQ ID NO: 217627 - protein, 134 aa, Glycine max
  Coding DNA Sequence Number=SeqID_100849
MTHFDGLYLFSSYVLVGKHKPKRVESVNADAEAFGDHWESSDCSMHSEAEALEHMKKRDRGHQSVSLENKTGDSTVLKIGDSAKVVIKQDMKGGEYKYGFNNNKREKAEKVRVVDDETGEHELYEVLRMPSRCV

SEQ ID NO: 217628 - protein, 67 aa, Glycine max
  Coding DNA Sequence Number=SeqID_100850
  Gene Ontology: Mol. function=protein phosphatase type 2A regulator activity; Cellular component=protein phosphatase type 2A complex; Biological process=signal transduction
  Homolog annotation: Hit_ID=Q8L6I7; Match level="QueryCoverage=77%, HitCoverage=10%, E-value=1e-12, Identity=54%"; Hit description =Protein phosphatase 2A B'kappa subunit
MRINRVPISPDPTVCSESGSALLGSNNFDHYVQLLTTLEAESPVCFALSDSECAHCSIANVLFQPPE

SEQ ID NO: 217629 - protein, 213 aa, Glycine max
  Coding DNA Sequence Number=SeqID_100851
  Gene Ontology: Mol. function=nucleic acid binding; Biological process= DNA integration
  Homolog annotation: Hit_ID=Q1RWN2; Match level="QueryCoverage=95%, HitCoverage=15%, E-value=1e-64, Identity=61%"; Hit description =Peptidase S8 and S53, subtilisin, kexin, sedolisin; Integrase, catalytic region; Zinc finger, CCHC-type
MSSQGHFVQFDGHYDHWSMLIENFLHSKKYWHVVESGVETPNADVALTETQQKELEGMKLKDLKAKNYLFQAIDRSILETILGKETSKDIWDSMKKKYQGSNRTKRAQLQALRKELEMLHMKSDESVTNYFARTMTIANKMQFHGENMEDVVIAEKILSSMAPKYNYVVCSIEESEDVDTLSLDKLQSSLLVHEQKMNQDTITEEQALKASTS

SEQ ID NO: 217630 - protein, 309 aa, Glycine max
  Coding DNA Sequence Number=SeqID_100852
  Homolog annotation: Hit_ID=Q1T6L1; Match level="QueryCoverage=38%, HitCoverage=30%, E-value=1e-14, Identity=45%"; Hit description=Zinc finger, RING-type; RINGv
MIFFFMQWVETTLLETSRNDTTSGNRHADDENLVVVAGDSESDVVEGESVTLTHGRAVSKSALHVLSDLGNLRGRHSVIEIRDEGYDSIRRTVSMDHSFQRGSGFSIVDVLHVNEEHEGCSNGVGPPKNSRGFHEFVTEVLMLSLLHDSNLVKLIGYCTDGDQRLLVYEVVSIKWRRPLFDNEIEMAVSFIQKVEGLRITPLISDHWVWEPDPTGQYSVKSAYNVLRQHVPVEAQGKKQIDLQDYLCPFCRSVEESATHLFFHCRKIIPVWWESLSWVNLVNVFLYHPRQHFIQHVSQIIEGMAASRWK

SEQ ID NO: 217631 - protein, 48 aa, Glycine max
  Coding DNA Sequence Number=SeqID_100853
MDERKGERKASLKGDMKGSEIDDGNEWVAEEGRPQLQPTSMSRWSTVS

SEQ ID NO: 217632 - protein, 99 aa, Glycine max
  Coding DNA Sequence Number=SeqID_100854
MESRGSRQTAECKRRQYVHTEMRGANWETRGIGQQGLKWRGEKTIKLGNGPCVKSLGMGKIGCTTIVESVNFNPHIRYFLLLGGYDSKPESVRHGFGLD

SEQ ID NO: 217633 - protein, 600 aa, Glycine max
  Coding DNA Sequence Number=SeqID_100855
  Gene Ontology: Mol. function=nucleic acid binding; Cellular component= chromatin; Biological process=DNA integration
  Pfam annotation: Domain name=rve; Domain location=35-170; Score =105.6; E_value=1.5e-28; Accession=PF00665.16; Description=Integrase core domain
  Pfam module annotation: Pfam domain module=RVT_2::rve; Domain location=286-490::35-170
MVTGLPPIAAPSQLCEYCVVSKQHCSQFPKNKSWRAKDVLELVHSDICGPINKSETFTAFKFFKAHVENEAGKNIKTLPTDRGGEYCSKVFENFCAEHGIRRELTTAYTPQQNGLSERKNRTILNMVRSLMTRGRVPKNIWPEVVNWSVHILNRSPTFAIQNMTPEEAWSGRKPDVNHFKKFGCIAFAHVPDQKRKKLDGKAEKCVFIGKTLGIRIGNNLPKYFLMKMMRKDKLQPLVHLKELLQQLLKLLHQTVTMKKNYLPVLEKGQLGWMTFFAIKEEKWRKAMNDEIDAIERNDTWELCDLPKEHKTIGVKWVLKTKWKENVARHDTIKLMIALAAQNSWPIFQLDVKSAFLHGYLKEQVFIEQPLGYVKIGSEYKVYILKKALYELKQAPQAWYSRIEAYFLKAGFTKYPYEHTLFVKSGDKDFKKSMMDEFEMTYLGMMHYFLGIEVNQTTDEIFICQKKYMGEVLDRFQMKDCNPANTPSEFSLKLHKDLEGNKGEKSNLLGFIDSDYAGDQDDRKSTSGYIFMLGTGVISWLSKKRPIVTLSSTKAEFVAATTCACQAIWLRRILKELKFKQLGNEAMMAPLINSIVKARIK

SEQ ID NO: 217634 - protein, 35 aa, Glycine max
  Coding DNA Sequence Number=SeqID_100856
LTFSPGVKVYGESGFWLKTCRMDRHGTCQGLVWFK

SEQ ID NO: 217635 - protein, 85 aa, Glycine max
  Coding DNA Sequence Number=SeqID_100857
FTRNSPQISVSPHQLDLAPYASEPYHAQWNAPGLLRDKHTLRSSRILGEMEVDEPWLGLWLPLNYQVDMGASGVRHWKCGRQTLW

SEQ ID NO: 217636 - protein, 133 aa, Glycine max
  Coding DNA Sequence Number=SeqID_100858
MEAMKEQMATIMEAMMSMKKIMEANAVAVAATGVVAKVNRCPQASQVASSRSNSLLEEYSGRPNTSQGPKKGRMSSSKGPRTKLGYDRSQELRRWLAKAKAMADTYSTPEEINGLLSYCQHMIDAILSRKGIG

SEQ ID NO: 217637 - protein, 180 aa, Glycine max
  Coding DNA Sequence Number=SeqID_100859
MSVHVAQLIDDAIYLFARLAPTRHPLDLEKSKRALGFSALIRGLCQSYGVPVTPSKVIRPPITRAFIGKYCTPRQVQGDAHQATGASPPPRQADPAGPLGVERYLQHLVRQQAANHRGQGSAPFVCPTPKQFGAEVTWPGDWPDAQAGEDPTGSPGKADESHMDEDMTNLLGFLGGSGAT

SEQ ID NO: 217638 - protein, 54 aa, Glycine max
  Coding DNA Sequence Number=SeqID_100860
MTNLWLSEGCLAKPSVARAKRRPRGLSAIHCGMHKAKPALLAKPLFEIKVLQAK

SEQ ID NO: 217639 - protein, 81 aa, Glycine max
  Coding DNA Sequence Number=SeqID_100861
MVVQDTESGWGISSNTRRAESKLPALACAERMVFHEKAMGVRGGAGFDVEVEEVVCEEDAEVAKAVFDDSSVNASSDEWVS

SEQ ID NO: 217640 - protein, 411 aa, Glycine max
  Coding DNA Sequence Number=SeqID_100862
  Gene Ontology: Mol. function=binding; Cellular component=nucleus; Biological process=regulation of transcription
  Homolog annotation: Hit_ID=Q6ZIP5; Match level="QueryCoverage=99%, HitCoverage=78%, E-value=3e-65, Identity=29%"; Hit description =Pentatricopeptide (PPR) repeat-containing protein-like protein
  Pfam annotation: Domain name=PPR; Domain location=190-224; Score =45.2; E_value=2.1e-10; Accession=PF01535.11; Description=PPR repeat
  Pfam annotation: Domain name=PPR; Domain location=292-326; Score =43.2; E_value=9e-10; Accession=PF01535.11; Description=PPR repeat
  Pfam annotation: Domain name=PPR; Domain location=55-89; Score=21.4; E_value=0.0032; Accession=PF01535.11; Description=PPR repeat
  Pfam module annotation: Pfam domain module=PPR::PPR::PPR; Domain location=190-224::292-326::55-89
MYAKCGDSVMAKVVFDRMRLKDTSTWNTMISMHMQFCQFDLALALFDQMTDPDIVSWNSIITGYCHQGYDIRALETFSFMLKSSSLKPDKFTLGSVLSACANRESLKLGKQIHAHIVRADVDIAGAVGNALISMYAKSGAVEVAHRIVEITGTPSLNVIAFTSLLDGYFKIGDIDPARAIFDSLKHRDVVAWTAMIVGYAQNGLISDALVLFRLMIREGPKPNNYTLAAVLSVISSLASLDHGKQLHAVAIRLEEVSSVSVGNALITMYSRSGSIKDARKIFNHICSYRDTLTWTSMILSLAQHGLGNEAIELFEKMLRINLKPDHITYVGVLSACTHVGLVEQDVVAWGSLLSSCRVHKYVDLAKVAAEKLLLIDPNNSGAYLALANTLSACGKWEDAAKVRKSMKDKSS

SEQ ID NO: 217641 - protein, 78 aa, Glycine max
  Coding DNA Sequence Number=SeqID_100863
DRARKTPSGPEEVQQGIGVSNSDYGPLQAQGETPQQHGDGRQQATDAPPPPPKPLSSSTKVGAFTTRGRPAGNQVQSQ

SEQ ID NO: 217642 - protein, 101 aa, Glycine max
  Coding DNA Sequence Number=SeqID_100864
LLVEETGGFHVLKGMSGRMIESIKLAGKLLYNNRKSISRSIVTIKDSTRSNTEHGEQEIGPNTETTQEAEFKLETGSSKEKASRPKREIVKPQYLKDFVEK

SEQ ID NO: 217643 - protein, 125 aa, Glycine max
  Coding DNA Sequence Number=SeqID_100865
MMIWKQRAKLVMATARWVLKHPIYGIVILRLGIYTRRRSYRKTLQGSGISTNIIDDNESLKSWKQDNIQVLNDGTYEFGDPTVMWLRMPPDSWVTVTNGGVIDKSRAFAPTYPQFVMRNSDLRSS

SEQ ID NO: 217644 - protein, 231 aa, Glycine max
  Coding DNA Sequence Number=SeqID_100866
  Gene Ontology: Mol. function=RNA-directed DNA polymerase activity; Cellular component=chromatin; Biological process=chromatin assembly or disassembly
MKPQPLQQDTKINSEMTQLPMERNTIVLNNSVFKWSETMNTINEYVIKENDHVPVKQRPGNLIHGGLKSSWGNTESKRHDSIFRMNIMGMKKHFMHILRLQPNLMETGSEIVLGEKSHQAQLIKQLLRSGGGNQSFTVKAFNAWLNPTIFKVFGYLILNFNLLDMQVFVWMNVDKSELWQHGNSMVNEPWWRQLRGFIKQECEFLEKLFKLGNGNQGWGRGLWCCFFENVK

SEQ ID NO: 217645 - protein, 79 aa, Glycine max
  Coding DNA Sequence Number=SeqID_100867
  Homolog annotation: Hit_ID=Q7CKD2; Match level="QueryCoverage=56%, HitCoverage=6%, E-value=1e-17, Identity=93%"; Hit description =(P)ppGpp synthetase I
  Subcellular localization annotation: CTP_CleavageSite=46; ConfidenceScore=5.50e-01
MLSCPCSASRGFPPSPDHATAAARRRGDSGSAAHNNARLRPIAHMTAATSGARSLINSAIDSRCPVCGNISNIRTRARR

SEQ ID NO: 217646 - protein, 104 aa, Glycine max
  Coding DNA Sequence Number=SeqID_100868
MDKGLEFILILGHEEECKKVWETQVLFPTSLNTQNICFACPYRLTLDYEAISNWFPIYKNEHPIIHKETIRSDFLKPACFGVSLWSSYFNLNGHSCDNWPQTFG

SEQ ID NO: 217647 - protein, 269 aa, Glycine max
  Coding DNA Sequence Number=SeqID_100869
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=4e-41, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLTFRGLHVLTFRGLHALAFRGLHVLTSKGLHALACRGLHVLTSKGLHALACRGLHVLAFRGLHTLAFRGRHVLNFSGLHAHAFKGLHVLAIRGLHVLAFRGLHVLTFRGLHAFAFVGLHVLNFTGLHALTFRGLHVLIFRGLHVLTLRGLHALTFRGLHAFAFIGLHALSFKGLHVLTFSGLHALTFRGLHILTFRGLHVLTFKGLYVLTFRGLHVLTFRGLHTLAFKGLHVLAFRGLHILTFRGLHVLTFRGLDVLACTPSPLED

SEQ ID NO: 217648 - protein, 168 aa, Glycine max
  Coding DNA Sequence Number=SeqID_100870
  Gene Ontology: Mol. function=nucleic acid binding; Cellular component= nucleus; Biological process=abscisic acid mediated signaling
  Homolog annotation: Hit_ID=Q10JI3; Match level="QueryCoverage=82%, HitCoverage=44%, E-value=1e-27, Identity=50%"; Hit description =Expressed protein
  Pfam annotation: Domain name=DUF1675; Domain location=29-160; Score =55.1; E_value=2.3e-13; Accession=PF07897.2; Description=Protein of unknown function (DUF1675)
MNFTFFYCFLSSFIYFLNIHGLVFNTFHGSSSCGEAKSPISNISAQEQSSQDPAGSGGKTNENVTRTSKADQGENPSRKHHPSQKTMGRHIGTNSMEDMPCVFTKGDGPNGRRIEGILYKYGKGEEVRIMCVCHGNFLSPAEFVKHAGGGDVAHPLRHIVVNPSAAPF

SEQ ID NO: 217649 - protein, 129 aa, Glycine max
  Coding DNA Sequence Number=SeqID_100871
MAERRVVASASCMRGIPELQLINELTNSKVFEAFQGWGLNARPFDPRGGDGPIYLVRVRSGADWPGPLLMRASLTRGGLARLPTPNNNNILGHHQPSHRPPLALLVAPPPASAHAITSRHHQLPPTLKL

SEQ ID NO: 217650 - protein, 271 aa, Glycine max
  Coding DNA Sequence Number=SeqID_100872
  Pfam annotation: Domain name=DUF1675; Domain location=91-261; Score =66.4; E_value=9.1e-17; Accession=PF07897.2; Description=Protein of unknown function (DUF1675)
MEDYKNRHSYQQQQQKQEEEEEEKKVVCEKMERYPRDLLQGFSLSGVTTVRDGNNNNNNINNNMMHQHHHHHVLHHHHEQQQQQHEVDDEEVELNLGLSLGGRFGVDKNAKKKKLLRSSSVVGTMPLFREDDAVAPSAAAFPALMRTSSLPTETEEEWRRRKEMQTLRRMEAKRRRSEKQRGSREVAGAGEEVEAGRSVAMGFNKFGSSAEAAVPPPPGWGVPGKQVVLGDVMGKGKGFQGLFGQPSSHGSADSQGGSSSSLSEMDSKAFL

SEQ ID NO: 217651 - protein, 47 aa, Glycine max
  Coding DNA Sequence Number=SeqID_100873
MDTSEPYTGAMKGTMHKPQANLGFMMKDKVDTSKPYTWAMRGTEHEP

SEQ ID NO: 217652 - protein, 265 aa, Glycine max
  Coding DNA Sequence Number=SeqID_100874
MANLQGGPDFDKIFHFLSICILAFINEGSSSLSSAFMNEPWSWGISIPISLYVKFALEIHTHLGICVGVGVPSLVYWGATRGAIDWYWEAALKFNHEIFKTCLFNVVIGLLHLLVSKLAHYIIEWVRDHKPMNNKGLLSHLLVLANLDLEALSKHPLLRPISFKTLFLKLIELLVVFFYNGNILLLSWCFSGQVYSYEVGKAISWVSLGSSMFVWIKSLVRELGGTQQEPLEEKPCMKVAEEDNCSPIQSVETKDDQALICSSEC

SEQ ID NO: 217653 - protein, 153 aa, Glycine max
  Coding DNA Sequence Number=SeqID_100875
  Gene Ontology: Mol. function=molecular_function; Cellular component =mitochondrial inner membrane; Biological process=ubiquinone biosynthetic process
  Homolog annotation: Hit_ID=Q9ZPR0; Match level="QueryCoverage=96%, HitCoverage=70%, E-value=9e-63, Identity=71%"; Hit description =Ubiquinone biosynthesis protein COQ4 homolog
  Pfam annotation: Domain name=Coq4; Domain location=1-148; Score =180.2; E_value=5.1e-51; Accession=PF05019.3; Description=Coenzyme Q (ubiquinone) biosynthesis protein Coq4
MVLLDRPRVVSAEVGHAWDLPANTFGAAYARFMGSRNFSPDDRDHLLATRAREVHDFWHTLFELPTNLVGETALKVIELEQMHLPMCLLSVLGGTARFSDKQRKLFYQHYFPWAVRDGMQCSDLMCVYYEWHFDEDLEDIRRILGIFPAPAVS

SEQ ID NO: 217654 - protein, 177 aa, Glycine max
  Coding DNA Sequence Number=SeqID_100876
  Gene Ontology: Mol. function=ATP-dependent helicase activity; Cellular component=membrane; Biological process=mRNA processing
  Homolog annotation: Hit_ID=Q69TI6; Match level="QueryCoverage=98%, HitCoverage=45%, E-value=2e-63, Identity=69%"; Hit description=RNA helicase-like
  Pfam annotation: Domain name=DEAD; Domain location=33-173; Score= -28.7; E_value=0.0015; Accession=PF00270.19; Description=DEADDEAH box helicase
MPSVPRGNFSNRQTQFSERRQKIIQQRKSLPITPVEKRLVEEVRKHDVLIIVGETGSGKTTQIPQFLFDAGFCRDGRVIGITQPRRVAAVTVAKRVAEECGVELGQKVGYSVRFDDATSGSTRIKYMTDGLLLREALLDPYLSKYSVIIVDEAHERTVHTDVLMGLLKNVQLARSSS

SEQ ID NO: 217655 - protein, 629 aa, Glycine max
  Coding DNA Sequence Number=SeqID_100877
  Gene Ontology: Mol. function=nucleoside-triphosphatase activity; Cellular component=nucleus; Biological process=protein transport
  Homolog annotation: Hit_ID=Q9ZPR1; Match level="QueryCoverage=90%, HitCoverage=90%, E-value=0.0, Identity=71%"; Hit description=Cell division control protein 48 homolog B
  Pfam annotation: Domain name=AAA; Domain location=342-529; Score =283.4; E_value=4.4e-82; Accession=PF00004.19; Description=ATPase family associated with various cellular activities (AAA)
  Pfam annotation: Domain name=AAA; Domain location=50-263; Score =208.1; E_value=2e-59; Accession=PF00004.19; Description=ATPase family associated with various cellular activities (AAA)
  Pfam annotation: Domain name=AAA_2; Domain location=338-471; Score= -41.9; E_value=0.014; Accession=PF07724.4; Description=ATPase family associated with various
  Pfam annotation: Domain name=AAA_5; Domain location=342-476; Score =0.7; E_value=0.0016; Accession=PF07728.4; Description=ATPase family associated with various
  Pfam module annotation: Pfam domain module=AAA::AAA::AAA_2::AAA_5; Domain location=342-529::50-263::338-471::342-476
MESCASNNHWRAEEAIGGNAEALQALRELIIFPLHFSHQAQKLGLKWPRGLLLYGPPGTGKNKKKKMEMEIRQGGDAVQWQQEKTSLVRAVVRECGAHLTVISPHSVHRAHAGESERILREAFSEASSHVALGKPSVIFIDEIDALCARRDSKREQDVRVASQLFTLMDSNKPTFSTPGVVVVASTNRVDAIDPALRRSGRFDAEIEVTVPNEDDRFQILKLYTKMIPLDPVLDLKSIAALCNGYVGADLEALCREATMYAIKRSSNTKDASNFSLTMEDWKHARSVVGPSITRGVTVEIPKVTWEDIGGLKELKKKVQQAVEWPIKHSAAFSRMGISPVRGILLHGPPGCSKTTLAKAAAHAAQASFFSLSGAELYSMYVGEGEALLRKTFQRARLAAPSIIFFDEADVVAAKRGDSSSNSATVGERLLSTLLTEIDGLEEAKGILVLAATNRPYAIDAALMRPGRFDLVLYVPPPDLEARHEILCVHTRKMKTGNDVDLRRIAEDTELFTGAELEGLCKEAGIVALREDISAAVVCDRHFQIAKSSLKPALTKSEIDSYSSFMKTSSRALPGHFEAGLKPDKSKKNRLDPFSLVKIGVVSCLLLAAAAAAAEYYIMYGDQIVHDIAT

SEQ ID NO: 217656 - protein, 160 aa, Glycine max
  Coding DNA Sequence Number=SeqID_100878
  Homolog annotation: Hit_ID=Q0ZCD0; Match level="QueryCoverage=94%, HitCoverage=16%, E-value=2e-07, Identity=25%"; Hit description =Integrase
MERSMIDAASHGALGDMTPVEARNLIEKMASNSQQFSARNDVIVLRGVHDVATDSSSSAENKKLEGKLDALVNLLSGVNEQLDAHAANIYNRLPQQQNQQQQNNYDLSNNRYNPGWRNHPNLRWGKSSKTTTAAQQQSVPPFQNVVGPSRPYVPPPMQQQ

SEQ ID NO: 217657 - protein, 88 aa, Glycine max
  Coding DNA Sequence Number=SeqID_100879
  Gene Ontology: Mol. function=ribonuclease H activity; Biological process=DNA integration
  Homolog annotation: Hit_ID=Q1SYR3; Match level="QueryCoverage=95%, HitCoverage=3%, E-value=2e-30, Identity=71%"; Hit description=RNase H, putative
MSHGRMYQQRIKNAFDKKVRPCKFKERDLVLKNISHAIKDNRGKWAPNYEGPFVVKRAFSGGALVLTNMDGEELPSPVNSDVVKRYYA

SEQ ID NO: 217658 - protein, 173 aa, Glycine max
  Coding DNA Sequence Number=SeqID_100880
MVDREGKELGSVGSPHFVQVQNEHPFPPYGLPPNYMPPNVALTPDENVNNSNLILVENQQPQSDHAHVSQCMGETHEIPYHNLADFEPRLGYTTKGQIVGGVALPNTLEGSQFRPQPQPLHCMAGRILPAMAEKGKLDQSYKLDFYITCIATVLKYLFHFKNFKKLMILRQFS

SEQ ID NO: 217659 - protein, 85 aa, Glycine max
  Coding DNA Sequence Number=SeqID_100881
  Subcellular localization annotation: CTP_CleavageSite=44; ConfidenceScore=5.46e-01
DPILLKKQRSISKKSIDVSLSAIFLRQSLNFGVRTSWWVELWTNAAMNKLRRNSSSSSLLLSTLSSLERFFKMQQSKVLVGCKNT

SEQ ID NO: 217660 - protein, 112 aa, Glycine max
  Coding DNA Sequence Number=SeqID_100882
MRVPNNCSFDTLKRRMHNTLQLTNNQLLDEIYYRQPFIDAELLCTIIRTPDAILNLLQSTITPTYDAIMYYNGKWNIPRQGEFLGYSFTGTNPIRFGIPSGCDMEKLKDLIK

SEQ ID NO: 217661 - protein, 173 aa, Glycine max
  Coding DNA Sequence Number=SeqID_100883
GIALPLEPEVGPSAARVITKGSCVDPSTTDVDTGRVYEGSTIIHNISLLHDQVKVGVKEVKDADAPIPVPTDEVMWDASLFRLFNSNFPLYIKHEDLSEIAHGGQCLSISVIQLWILHLTETSMQLGNSDVYGFLEPQSIQRSGQSQFESESYINNWMQSSKQGVYLGAYLNG

SEQ ID NO: 217662 - protein, 146 aa, Glycine max
  Coding DNA Sequence Number=SeqID_100884
  Homolog annotation: Hit_ID=Q7XYU6; Match level="QueryCoverage=25%, HitCoverage=11%, E-value=1e-12, Identity=81%"; Hit description =Integrase
MVLGKPWSLTTSLKKSFEMWEASSTLWHGIKCAILLNLLSQPTLRREGDARAHRCVFHGRKMRRVATNVYSRKTLKKPKRCGLRTLSVKGSGVVFTHGEGEKRQGVGPLTISWGGRQKRGFCSYVSSIAMRKSDLRSSCKSSKVMC

SEQ ID NO: 217663 - protein, 234 aa, Glycine max
  Coding DNA Sequence Number=SeqID_100885
  Pfam annotation: Domain name=Rep_fac-A_C; Domain location=72-171; Score=-56.3; E_value=0.009; Accession=PF08646.1; Description =Replication factor-A C terminal domain
MINDLVLEIQEFRESLLDLGIEVRSILAPIGQGSSQVSGSSQLSSKDAFLSKTEVKNISQINASSEEFVCVTVAKITTIVMDNYSWCYPACGQCYKKADMQIVPFTCPCGKENDQPVLRYRVEVMDGDVDLNASPQALDRLLGCFLAFKVKVQPRFRNSVVLKYSDESELINVVLDMIPDSEQSLSITIDHDRSMLGSSEPTKFESNLAYWSINILCSNLCLLPRIMTLFSGFH

SEQ ID NO: 217664 - protein, 398 aa, Glycine max
  Coding DNA Sequence Number=SeqID_100886
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=40%, E-value=0.0, Identity=91%"; Hit description=DNA -directed RNA polymerase beta chain
  Pfam annotation: Domain name=RNA_pol_Rpb2_3; Domain location=42-111; Score=135.4; E_value=1.5e-37; Accession=PF04565.7; Description=RNA polymerase Rpb2, domain 3
  Pfam annotation: Domain name=RNA_pol_Rpb2_6; Domain location=157-389; Score=40.4; E_value=4.9e-16; Accession=PF00562.18; Description=RNA polymerase Rpb2, domain 6
  Pfam module annotation: Pfam domain module=RNA_pol_Rpb2_3::RNA_pol _Rpb2_6; Domain location=42-111::157-389
MVRGTICGAIRHKLIPTPQNLVTSTPLTTTYESFFGLHPLSQVLDQTNPLTQIVHGRKLSYLGPGGLTGRTASFRIRDIHPSHYGRICPIDTSEGINVGLIGSLAIHARIGSWGKSLALNRDIQEEQTVPARYRQEFLTIAWEQVHLRSIFPFQYFSIGASLIPFIEHNDANRALMSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQ

SEQ ID NO: 217665 - protein, 557 aa, Glycine max
  Coding DNA Sequence Number=SeqID_100887
  Gene Ontology: Mol. function=sodium-dependent phosphate transporter activity; Cellular component=membrane; Biological process=phosphate transport
  Homolog annotation: Hit_ID=Q6D018; Match level="QueryCoverage=83%, HitCoverage=84%, E-value=1e-159, Identity=66%"; Hit description =Putative sodium/phosphate cotransporter
MLGTAQALGAGDVAGQEHRQPQAQVADQPLVQPIQFRQSFRREGAARGVRLGAHVAGHALDDVARLFQVKRHFDDLRPAARVFLAQIFLLDLRQIQLDGGVQHVDVIVEAPHFFIHALLAVQHFALQDHHVFHHVAHAQRFARRIGQRQRRRVQRAGVQMARPHARIVGRHVDDQPLAQRRHRPGQRDHHQTTDQVVEHVEVDHQLFAAARQLSHHIRQIGNERQHQHTGHQLEQQAAERHAPPGGVLAAGVDHRQQAAAEVGADHQAERHLQRNHAGRGQGDGQQHRRQAGIADDGEQRAGQGVQHHVAGQRREQHFHPGRLGDRRGGGHDQLQRQHDQPKADQDAPDLADPHLLAAEEQEDADQDQQRRQPGKIEGQHARHQRGADVSAEHDHQRRRQPHQPLRNERGHQQRRGVAALYQRGHADAGNERQRLFLNAVAQHAPQIGAVNPHDPGAHDVGAPHQQRHGGKQVKKGQHGRYAPLTPGQRRLVPDACQAVRKDGTVLFALAAAGRPKDDGYSARSRLPGVGLAGQRAGGRPQKRRVNAAAERPRRRAA

SEQ ID NO: 217666 - protein, 436 aa, Glycine max
  Coding DNA Sequence Number=SeqID_100888
  Gene Ontology: Mol. function=binding; Cellular component=outer membrane; Biological process=hemolysis by symbiont of host red blood cells
  Homolog annotation: Hit_ID=P15320; Match level="QueryCoverage=99%, HitCoverage=27%, E-value=0.0, Identity=84%"; Hit description =Hemolysin precursor
MRKENQLSGNIDLGAGSSDSKEKTGGSLSVGGAFDIAKVNESATERQGATLASDGKVTLSANGKDDDALHLQGAKVSGGSAALEAKNGGILLESAKNEQHKDNWSLGIKANAKGGQTFNKDANGKVDPNTGKDTHTLGAGLKVGVEQQDKTTHANTGITAGDVALNSGKDTRLAGARVDADSVQGKVGGDLRVESRKDVEKGVKVEVDAGLSHSNDPGSSITSKLSKVGTPRYAGKVKEKLDAGVNKVADATTDKYNSVARRLDPQQDTTGAVSFSKADGKVTLPATPAGEKPQGPLWDRGARTVGGAVKDSITGPAGRQGQLKVNADVVNNNAVGEQSAITGKHGVALQVGGQTQLTGGEIRSQQGKVELGGSKVSQQDVSGQRYQGGGRVDAAATVGGLLGGAAKQSVDGNVPFVSGHASTQQADAKAGVFSGK

SEQ ID NO: 217667 - protein, 213 aa, Glycine max
  Coding DNA Sequence Number=SeqID_100889
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=100%, E-value=6e-25, Identity=28%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MKPEGLHVLAIRGLHALTFRGLHILAVVGLHTLTFRGLHALTFSGLHVLPIRELHALANRGLHALTFRGLHALAFRGLHGLAYKGLHVLFIRGLHTLTFRRLRVLAFKGLRALAFVGLLALTFRGLHVLAYRGLHALAIRGLHVVIVRGLRALAFIGLHALAFVGLHALTIRGLHILAFSALHVLAFRGLHVLPTRGLVTGADNLIGDFCFDS

SEQ ID NO: 217668 - protein, 142 aa, Glycine max
  Coding DNA Sequence Number=SeqID_100890
  Homolog annotation: Hit_ID=Q20CD0; Match level="QueryCoverage=56%, HitCoverage=25%, E-value=3e-09, Identity=45%"; Hit description =Fgenesh protein 81
MKKAIAKGSKAEQKAKKKQVEEEVCQLSAKLKGNHAKELVALGYSSGNGNEKSNLDSLVKAIVGVSVTSQPEDTKVYQQSIGAVCILDWAKETMVLQFVSIEVDAQQLMKAEVHNLAFTSIKPGFYTVSYRGVPNVKPGFYY

SEQ ID NO: 217669 - protein, 110 aa, Glycine max
  Coding DNA Sequence Number=SeqID_100891
  Gene Ontology: Mol. function=DNA binding; Biological process=DNA integration
  Homolog annotation: Hit_ID=Q1SKC8; Match level="QueryCoverage=79%, HitCoverage=25%, E-value=1e-14, Identity=47%"; Hit description =Integrase, catalytic region
MEHMAYWTIKLKLLELEELRIHAYDSSKNNKERVKAYHDNKLIIGTSMLLKSKWSRLFLVKEGKPYGAVELVNPFATELARSWVVNGQRLKSYLSGEIERLTTLIHLKDA

SEQ ID NO: 217670 - protein, 65 aa, Glycine max
  Coding DNA Sequence Number=SeqID_100892
MDDRMKSEQARANPQNNLVAWLASALINSNRNVPSYQLPVGYWVQNGHWSTRWCLDELYEQDRLA

SEQ ID NO: 217671 - protein, 98 aa, Glycine max
  Coding DNA Sequence Number=SeqID_100893
MSLSSAVHVSSTYEFGAMRSDSLVQFSNLAFFSEPHECHCLALFMHPPPTSLEPHEGIAYNCSPILHFHFFSEPHECHCLALFVCPPPMSLEPRIFIA

SEQ ID NO: 217672 - protein, 46 aa, Glycine max
  Coding DNA Sequence Number=SeqID_100894
MEKQIVGKVKEGKERVMKTVLLGSPIVNSWRWQPVDQVNAGNKGMI

SEQ ID NO: 217673 - protein, 155 aa, Glycine max
  Coding DNA Sequence Number=SeqID_100895
  Homolog annotation: Hit_ID=Q9LLB2; Match level="QueryCoverage=22%, HitCoverage=14%, E-value=2e-09, Identity=82%"; Hit description =Expansin 2
MTSLFLTCYLLIDFLRSPYWFVNLLDETLHFGHEVDTRLDIFYKLTSWCPNFKLPIGWCHIETCHSSTITGGDLKREGLSIELRVDLTANETQKVFDRILTKLGHTAPPVLGFRMQKGGNKLHFLYHALAYLRCVWRFSFLPSENEKESYFTYYC

SEQ ID NO: 217674 - protein, 148 aa, Glycine max
  Coding DNA Sequence Number=SeqID_100896
  Gene Ontology: Mol. function=nucleic acid binding; Biological process= DNA integration
  Homolog annotation: Hit_ID=Q53KJ4; Match level="QueryCoverage=72%, HitCoverage=15%, E-value=2e-20, Identity=49%"; Hit description =Transposable element protein, putative
MVEDQPQRVTLEDYSSSIVSQFFTSIARSEVQAHNITYPHSLIQLIQGNLFLGLPNEDPYAHLTTYIEICNTVKIAGVPKDAVRLSLFSFSLAGEAKRWLHSFKGNNLKTWEEVVEKFLKKYFPESKTAEGQAAISSFHQFPDESLSE

SEQ ID NO: 217675 - protein, 71 aa, Glycine max
  Coding DNA Sequence Number=SeqID_100897
MKVVYFLVAILALTSSLVSLLMTLVLFKIFVWQPKKKMVLAKLEDFFLHVESGNTDNTNNAQVSLLINYHD

SEQ ID NO: 217676 - protein, 515 aa, Glycine max
  Coding DNA Sequence Number=SeqID_100898
  Homolog annotation: Hit_ID=Q1SKA4; Match level="QueryCoverage=71%, HitCoverage=38%, E-value=1e-168, Identity=83%"; Hit description =Calcium-binding EF-hand
MLDRSDAVSKVAFESVGRFFQEFSSKRMSKLAGDKLVDSENSLAIRSNWVSSMVDFVWRKRRALMARSLILPVENFRTTVFPVVYSVKAVASGGVEVIRKLSKAASSSASSNAAGAEVDSHAEKLVGVSDVVTHLAPFLVSSLEPALIYEVGINMLYLADVPGGKPEWASQSIIAILTLWDRLDFASARESIVRAVVTNLHLLDLHMQVSLFKRLLLMVKNLRAESDRMYALACICRTALCVHLFAKESVRRGQKPLPGTDIASLFEDARVNDDLNSITSKSIFREELVASLVESCFQLSLPLPEQNNTGMESRVIGALAYGTGYGALNWTEPALEVVEVCRPCVKWDCDGRTYAVDCYLKLLVRLCYIYDTRGGVKRVKDGASQDQILNETRLQNLQRELVKDLHELKIPRKTLQLYLASTFNSAVLSACIDVTTVMSLPITQSLFLQPLMDALKQEQDTNAPSQIHIALCLGEAVEAAPDPERRHSGSWLLRLVELLKNTCKAPGNVLATDAH

SEQ ID NO: 217677 - protein, 113 aa, Glycine max
  Coding DNA Sequence Number=SeqID_100899
MAGQSREIDQIGISPKRLAKHGRDVICGGFANTTSETWFRQVDWRYSWYTWQQAQCISPLRMTTYFRYGKLIKLETVVTFDKNVRFTMARCKFIVMSLHTLLLDLWSWLVVAS

SEQ ID NO: 217678 - protein, 780 aa, Glycine max
  Coding DNA Sequence Number=SeqID_100900
  Gene Ontology: Mol. function=protein binding; Cellular component =cytoskeleton; Biological process=signal transduction
  Homolog annotation: Hit_ID=Q1SKB0; Match level="QueryCoverage=95%, HitCoverage=99%, E-value=0.0, Identity=80%"; Hit description=Ankyrin
  Pfam annotation: Domain name=Ank; Domain location=114-143; Score=0.7; E_value=24; Accession=PF00023.20; Description=Ankyrin repeat
  Pfam annotation: Domain name=Ank; Domain location=170-202; Score =13.2; E_value=0.39; Accession=PF00023.20; Description=Ankyrin repeat
  Pfam annotation: Domain name=Ank; Domain location=216-248; Score=8.0; E_value=2.2; Accession=PF00023.20; Description=Ankyrin repeat
  Pfam annotation: Domain name=Ank; Domain location=302-334; Score =38.1; E_value=3e-08; Accession=PF00023.20; Description=Ankyrin repeat
  Pfam annotation: Domain name=Ank; Domain location=339-371; Score =22.5; E_value=0.0015; Accession=PF00023.20; Description=Ankyrin repeat
  Pfam annotation: Domain name=Ank; Domain location=372-404; Score =23.8; E_value=0.00063; Accession=PF00023.20; Description=Ankyrin repeat
  Pfam annotation: Domain name=Ank; Domain location=476-508; Score =31.3; E_value=3.4e-06; Accession=PF00023.20; Description=Ankyrin repeat
  Pfam annotation: Domain name=Ank; Domain location=543-575; Score =33.2; E_value=9.2e-07; Accession=PF00023.20; Description=Ankyrin repeat
  Pfam annotation: Domain name=Ank; Domain location=576-608; Score =45.7; E_value=1.5e-10; Accession=PF00023.20; Description=Ankyrin repeat
  Pfam annotation: Domain name=Ank; Domain location=79-111; Score=20.1; E_value=0.0079; Accession=PF00023.20; Description=Ankyrin repeat
  Pfam module annotation: Pfam domain module=Ank::Ank::Ank::Ank::Ank::An k::Ank::Ank::Ank::Ank; Domain location=114-143::170-202::216-248::302- 334::339-371::372-404::476-508::543-575::576-608::79-111
MTVFSAKQVFPVNYEAEVSQRLLEASHSGDLPLAFRCIADPSVDVNFAGAVTLKTASTDLLLLPESPSQLRLDFQEFVSDVSPLFLAVHADHAALVKKLLSVGADVNQKLFRGFATTAAVREGHFNILEILLKAGASQPACEEALIEASCHGQARCVELLMNSDLIRPHVAVHALVTASCRGLVDVVETLIKCGVDASATDRVLLQSLKPSLHTNVDCTALVASVIHRQVPVVDLLLQNGVRLDFRVRLGAWSWDTSTGEELRVGAGLGESYGITWCAVEYFEKNGAILRLLLQHVSSKPHRGRTLLHHAILCGNVEAVKVLLECGADVEAPVKTTSKTHFLPIHMASRKGLPTIIQGLIDFGCDLNSTTDSGETALMICAKYKQEECLKVLTMAGADFGLVNTAGQSASSIAESNKWSLGFQQAVLDTIKRGKIPESSNTTSFSPFIFVAQVGDTEALKIVIESGEFNLDYQDDSGFSAVMHAASKGHVDCFRLLVYAGADVKLCNKSGETAITLSEMNQNCDLFEKVMLEFELEKGNINAGGFYALHRAARRGDLDAVTLLTSKGYDVNAPDGEDYTPLMLAAREGHASICELLISYGANCNAKNARGETALLLARKFTGGKNYAEAVILDELARKLVLGGAYVLKHTKGGKGSPHGKQMQMLGSAGVLCWGKSSRRNVVCCEAELGPSSTLHRNRYKKGDADEPGMFRVLTGKSREVHFVCDGGLEVAELWVRDFDLSTVVHPFLEVRETENWKAVLLLLLVPVGLSGSNSLQKLAS

SEQ ID NO: 217679 - protein, 113 aa, Glycine max
  Coding DNA Sequence Number=SeqID_100901
MKNFFNSPLFDTSMKNVFGLVPLHGEPLTISTPLLCFPHESTTAELSKVQKEVLDARIPSPPLLLNLLLGQQRLFRTPWRIASMQHEPPPPPRATSMPSFPSSLTNLSPNKHD

SEQ ID NO: 217680 - protein, 78 aa, Glycine max
  Coding DNA Sequence Number=SeqID_100902
MIRFQSYYNHFHHVTFVSLSKCLDQTWGKKWEEFEVQEALEHISKEEKKDEEDHYEPQNEVIIVDEGDQVAQNEEVGA

SEQ ID NO: 217681 - protein, 228 aa, Glycine max
  Coding DNA Sequence Number=SeqID_100903
MAPHKRKVIASLSQASYDSSIFESRDAWDRYADNILGRNILPERNVKLYINEFDDFRREVKRRNWHKELTNFSEGSINVAIVKEFYANLYVPEEKKPKQVRVRGHLIKFDADSLNTFLKTLVVLEEGESLPSYSRFCRLRPDPQELASRLCIPGRGFFLNAEGLPWKLLRKDLTTLAQTWSVLSYSNLPLTSHTFDLNLDMAKLVYGLVMKMDMNIGALIAGQISLIA

SEQ ID NO: 217682 - protein, 84 aa, Glycine max
  Coding DNA Sequence Number=SeqID_100904
MFLCNNNDHDDGDDVSSNNDNKNINGSRVTKVIVVIMVMSMVVTMMTWCGSGVSEDNKWWRYGCDANDGSNVGGDSDSGGWWWW

SEQ ID NO: 217683 - protein, 73 aa, Glycine max
  Coding DNA Sequence Number=SeqID_100905
MELILVDMKDFLMVIYDEKGSKSGGNEKGKCDADCLSVPWLLTPPWILGVLAAFATLRKLPPETCHSPCKLNM

SEQ ID NO: 217684 - protein, 402 aa, Glycine max
  Coding DNA Sequence Number=SeqID_100906
  Gene Ontology: Mol. function=RNA-directed DNA polymerase activity; Biological process=RNA-dependent DNA replication
MEVEDIPMVGRKFTWYRVNDHSKSRLDRVLVSSDWPFNVLHCWFQDHGFLEMVKDLWDSYQVQGWASFVLKERLKDVIDEAEGLDEVEMQNRWSLMGEFWSVSRRNESHLHQKSRVDERWEDEPIKKNFMSMMKEFWENARMPRGANSSFITFIPKKENAQGLDEDRPITLICCIYKVISKVLAKRVKRGGHGFQSRLPKDMTQCHEIFLLYDAEVEVGPFNEFILQRGLGVRRVATKALRCFEMGSRLKHAKLQVDDHLAAGANPRRVPPCVVKRIIKLQRNFLWRGEENKRKIAWVKWEEWRLALDQSSLWAVVLKSKYGKFGNAEVQRSSRNDSLWWRDLVEVCRVGKNKECYDKSVAWKEKCSDSEGAVEMHILPNGGGGYYTFAIQHLERVEREEVK

SEQ ID NO: 217685 - protein, 520 aa, Glycine max
  Coding DNA Sequence Number=SeqID_100907
  Gene Ontology: Mol. function=oxidoreductase activity; Cellular component=integral to membrane; Biological process=electron transport
  Homolog annotation: Hit_ID=P48422; Match level="QueryCoverage=94%, HitCoverage=95%, E-value=0.0, Identity=73%"; Hit description =Cytochrome P450 86A1
  Pfam annotation: Domain name=p450; Domain location=28-507; Score =153.6; E_value=5.3e-43; Accession=PF00067.12; Description=Cytochrome P450
METLPLLLTLVATLSAYFLWFHLLARTLTGPKPWPLVGSLPGLFRNRDRVHDWIADNLRGRGGSATYQTCIIPFPFLARKKGFYTVTCHPKNLEHILKTRFDNYPKGPKWQTAFHDLLGQGIFNSDGETWLMQRKTAALEFTTRTLKQAMSRWVNRSIKNRLWCILDKAAKERVSVDLQDLLLRLTFDNICGLTFGKDPETLSPELPENPFAVAFDTATEATMHRFLYPGLVWRFQKLLCIGSEKKLKESLKVVETYMNDAVADRTEAPSDDLLSRFMKKRDAAGSSFSAAVLQRIVLNFVLAGRDTSSVALTWFFWLLTNHPDVEQKIVAEIATVLADTRGGDRRRWTEDPLDFGEADRLVYLKAALAETLRLYPSVPQDFKQAVADDVLPDGTEVPAGSTVTYSIYSAGRVETIWGKDCMEFKPERWLSVRGDRFEPPKDGFKFVAFNAGPRTCLGKDLAYLQMKSVAAAVLLRYRLSLVPGHRVEQKMSLTLFMKNGLRVFLHPRKLESGPGVATSP

SEQ ID NO: 217686 - protein, 110 aa, Glycine max
  Coding DNA Sequence Number=SeqID_100908
MGHGKEVKTYNIRIVDKYMHIYLLEESYLNQLARHLCEVNNDSYRPLDPNLPSSSQRPRDSYPSDRIILQNTNEGQIRTEIYVPEPEFQKVEDLVDDYSALERDWEDYSA

SEQ ID NO: 217687 - protein, 425 aa, Glycine max
  Coding DNA Sequence Number=SeqID_100909
  Pfam annotation: Domain name=AT_hook; Domain location=119-131; Score =14.9; E_value=0.061; Accession=PF02178.9; Description=AT hook motif
MKWRKASGVLCDAKVPIKLKGKFYRTAVRPAILYGTECWAVKSQHENRVGVAEMRMLRWMCGKTRQDKIRNEAIRERVGVAPIVEKMVENRLRWFGHVERRPVDSVVRRVDQMERRQTIRGRGRPKKTIREVIKKDLEINGLDRSMRAANTGWGREEDKPKWGHDKFDGPKKERRSGNNQSNHIAETRDRDSFSRARNNDAELDNQPKRSDRKEMTKRWHDDDDDKFEGRENNSRREEKRSRRHEDDDKFEGRENNSKRELNRSRRHEDDDKFDGRENNSRREEKRSRRHEDDEFEHKFREYRYKREEKGSRRDDYDGMKLEPKDHHLREEKRSIKPDDVEVEPKSRDSDIREDKRSRRRDNDDIVSKSREPHGYSEDRKSRKHSEGESAPKPREDYDRKQDKRSYRNYSNQTESKERYAFDRRE

SEQ ID NO: 217688 - protein, 466 aa, Glycine max
  Coding DNA Sequence Number=SeqID_100910
  Gene Ontology: Mol. function=transferase activity, transferring glycosyl groups; Cellular component=integral to membrane; Biological process=metabolic process
  Homolog annotation: Hit_ID=Q5IFH7; Match level="QueryCoverage=99%, HitCoverage=99%, E-value=1e-163, Identity=61%"; Hit description =Triterpene UDP-glucosyl transferase UGT71G1
  Pfam annotation: Domain name=UDPGT; Domain location=8-466; Score= -103.7; E_value=2.1e-05; Accession=PF00201.9; Description=UDP -glucoronosyl and UDP-glucosyl transferase
MAEMKKKAELIFFPIPEIGHLASFLELAQLLINHHNHLSITFLCMKLPYAPSLDAYIRSVIASQPQIQVIDLPQVEPPPQELLRPLSHYIWSYLQTLKPHVKGIVQNILSSHSNPIIGLLLDVFCSPLIDVGNDLGIPSYLYNSSNVGFFSLMLSLQKRQIGYVFNDSDPEWLIPGLPDPVPSSVFPDALFNKDGYATYYKHAQRSKDSKGIIVNSFSELEQNLIDALCDDQSQTPPIYAVGPLIDLKGNKSNPTLDQGQHDRILKWLDEQPDSSVVFLCFGSKGSFDPSQTREIALAIQHSGVRFLWSIHSPPTTDIEERILPEGFLEWMEGRGMLCEWAPQVEILAHKAIGGFVSHCGWNSILESIWFGVSILTWPIYGEQKMNTFRMVREFGLAVELKLDYRRGSDLVMAEEIEKGLKQLMDRDNVVHKNVKEMKDKARKAVLTGGSSYIAVGKLIDNMLGSN

SEQ ID NO: 217689 - protein, 198 aa, Glycine max
  Coding DNA Sequence Number=SeqID_100911
  Gene Ontology: Mol. function=protein serine/threonine kinase activity; Cellular component=membrane; Biological process=protein amino acid phosphorylation
  Homolog annotation: Hit_ID=Q93XL9; Match level="QueryCoverage=93%, HitCoverage=23%, E-value=2e-39, Identity=46%"; Hit description=CTR1 -like protein kinase
MEMPARRSNYSLLSQIPDDQFSSAAAPSSSGDGKAGRAGKSDRAAFEWDLVADHRAANRIGNVYSSIGLQRQSSGSSYGESSLSGGGDFYAPTISTAAASDVDAFGYLHDERSKFSEAAPARIAGSSSGKSWAQQTEESYQLQLALALRLSSDATCADDPNFLDPVPDDGALRLLWSAEAVSHRFWLVSGHRCSLTLV

SEQ ID NO: 217690 - protein, 717 aa, Glycine max
  Coding DNA Sequence Number=SeqID_100912
  Gene Ontology: Mol. function=DNA binding; Cellular component=beta -galactosidase complex; Biological process=DNA integration
  Homolog annotation: Hit_ID=Q1SLU3; Match level="QueryCoverage=97%, HitCoverage=79%, E-value=2e-99, Identity=45%"; Hit description =Integrase, catalytic region
  Pfam annotation: Domain name=zf-CCHC; Domain location=265-282; Score =14.2; E_value=0.0046; Accession=PF00098.13; Description=Zinc knuckle
  Pfam module annotation: Pfam domain module=RVT_2::Retrotrans_gag::zf -CCHC; Domain location=488-717::87-202::265-282
LHFSFLFTLLAMNETTPNIESYLYLHPSENPTVALVSPALDSNNYHSWSRSMVTALSAKNKVEFINGNAPEPLRIDRTYSVWSRCNNMVVSWIVHSVSVAIRQSILWMNKVEEIWNDLKSRYAQGDLLRVSDLQQEASSMKQGTLSITEYFTKLRIIWDEIENFRPDPTCSCTIKCTCSVLTTIAQRKLEDRAMQFLRGLNEQYNNVRSHVLLMEPMPTIPKIFSYVAQQERQLSVGHTESVCYKKHGVPISYEGRSKTYSRNVKTCTHCGKIGHTIDVCYKKHGYPPRYKFGNSKVVNNIMEGKAASDQVQRQESHDLVHFSPEQYQALLALIQQPSSGSSVPTQPQVASISSCPTNTSPDHFPLFPDTSASPPTSTSISPLPFSNNPDSFAYPTPPNANLSSQHIPSTSIRRSTRLKKAPTYLQDYHHALTSQADTNTHGVRYPLHSVLSYSRLSPSHKHFVMSISVNTEPKSYNEASQFDCWIKAMQTEIQALQQNQTWTLTPLPPHKTAIGCRWVYKIKYKADGTVERYKARLVAKGYTQLEGLDFLDTFSPVAKLTTVRLLLALASLHNWHLRQLDVNNAFLHGDLDEEVYMTLPPGLHVHDHNLVCRLQCSLYGLKQASRQWFTRLSSFLISHDFRQSTTDHSLFLHFHNHDITAVLVYVDDIILAGNNLDTITHITNLLDTAFSIKDLSTLKFFLGLEVARNNKGIHLSQ

SEQ ID NO: 217691 - protein, 84 aa, Glycine max
  Coding DNA Sequence Number=SeqID_100913
  Gene Ontology: Mol. function=metal ion transporter activity; Cellular component=integral to membrane; Biological process=metal ion transport
  Homolog annotation: Hit_ID=Q1SX80; Match level="QueryCoverage=52%, HitCoverage=12%, E-value=6e-11, Identity=65%"; Hit description =Zinc/iron permease
MAKNPVKGNVDHENEGKHGCWSASVARMTPRAKTLVATKRLPSVQRIVIVGVATTKDNVELVAKVDDASGQGKSQRKCKRLKGL

SEQ ID NO: 217692 - protein, 97 aa, Glycine max
  Coding DNA Sequence Number=SeqID_100914
MAEHHEHEEVKGQSLSEKIYGKIHDHDSSSSLVSDNDKTNATDSLKSNVFRLFGIQKPIHHVLGGGKQKYKLGKPSHFHFLNQSKVYELDGISSAEE

SEQ ID NO: 217693 - protein, 140 aa, Glycine max
  Coding DNA Sequence Number=SeqID_100915
MYGPSPSKSGEASHIISACIEQMADPQPNDFFFIELRVTIPRSEQRWTLAINLLAFHYNGLLIIHYVPDEPIIVTQPIDFHAHLPEVERIVGYTPSNPQGRVTTHSYRRLLRALRERGRVSGREGRDATREDDEPSTTPH

SEQ ID NO: 217694 - protein, 71 aa, Glycine max
  Coding DNA Sequence Number=SeqID_100916
  Gene Ontology: Mol. function=carbonate dehydratase activity; Cellular component=extracellular region; Biological process=one-carbon compound metabolic process
  Homolog annotation: Hit_ID=Q9SUB5; Match level="QueryCoverage=97%, HitCoverage=46%, E-value=3e-19, Identity=60%"; Hit description =Carbonic anhydrase-like protein
LLNNIKSIRDKDIDLGVINPGDIYFRSRKYYRYVGSLTNPPCTEGVVWSFVKEVKTVSMEQLSALKGAVHH

SEQ ID NO: 217695 - protein, 134 aa, Glycine max
  Coding DNA Sequence Number=SeqID_100917
  Gene Ontology: Mol. function=carbonate dehydratase activity; Cellular component=extracellular region; Biological process=one-carbon compound metabolic process
  Homolog annotation: Hit_ID=Q9SUB4; Match level="QueryCoverage=75%, HitCoverage=38%, E-value=1e-25, Identity=50%"; Hit description =Carbonic anhydrase-like protein
MILPTYLNFFSVLLLLLILYFSSVLASEAEFSYAKGTSNGPENWWHLNPKWKVCQYGKLQSPIDLRDRWVKVLPQLGELQKVYKPAPAVLKNMGHYITVRWNGDAGQLRINGNYYKLIQFHWHTPSEHTLNGLK

SEQ ID NO: 217696 - protein, 246 aa, Glycine max
  Coding DNA Sequence Number=SeqID_100918
  Gene Ontology: Mol. function=protein serine/threonine kinase activity; Cellular component=membrane; Biological process=protein amino acid phosphorylation
  Homolog annotation: Hit_ID=Q93XL9; Match level="QueryCoverage=99%, HitCoverage=27%, E-value=9e-61, Identity=55%"; Hit description=CTR1 -like protein kinase
VLADAIDLPCRIAKGCKYCKRDDASSCLVRFGIEREYLVDLIGKPGNLSEPDSLLNGPSSISFSSPLRFPRLKPAETTIDFRSLAKQYFSDCVSLELVFDNNSAAVANVDSGFSISEQFDGKCKDRNNPRPILTDSNRSSHLPLHPQDSHPSSREQGSETYQSCNPPQNIVDSTVGKYPPPIKHKRPAGIPTPLALTNTNDDMIEGKRFAEGSQLIPSKHARELNLDMEDLDIPWCDLVLREKIGS

SEQ ID NO: 217697 - protein, 152 aa, Glycine max
  Coding DNA Sequence Number=SeqID_100919
  Gene Ontology: Mol. function=protein serine/threonine kinase activity; Cellular component=membrane; Biological process=protein amino acid phosphorylation
  Homolog annotation: Hit_ID=Q5YKK5; Match level="QueryCoverage=94%, HitCoverage=13%, E-value=8e-32, Identity=56%"; Hit description=CTR1 -like protein kinase
  Pfam annotation: Domain name=Pkinase_Tyr; Domain location=5-152; Score=-157.7; E_value=0.0086; Accession=PF07714.7; Description =Protein tyrosine kinase
MEQDFLAERFKEFLREVAIMKRLRHPNIVLFMGAVTQPPNLSIVTEYLSRLYSSTCSSSFSLKEGSFSRLWIIGYFDLEILRVLDLSAGVAYIGCCIGLVPKKYWMSGVGLAKGMNYLHKRNPPIVHRDLKSPNLLVDKKYTVKVGMEFSLV

SEQ ID NO: 217698 - protein, 96 aa, Glycine max
  Coding DNA Sequence Number=SeqID_100920
  Gene Ontology: Mol. function=protein serine/threonine kinase activity; Cellular component=integral to membrane; Biological process=protein amino acid phosphorylation
  Homolog annotation: Hit_ID=Q1T066; Match level="QueryCoverage=68%, HitCoverage=10%, E-value=1e-24, Identity=83%"; Hit description =Leucine-rich repeat, typical subtype
MRVYNCTGYITGGSHVQKHNKWAHSEAANADSHVTIVVRGTVGHIALEYLSTGQSSDKTDVFGFDILLLELITGMTAVEFGKIVNKKGAMLEWILC

SEQ ID NO: 217699 - protein, 297 aa, Glycine max
  Coding DNA Sequence Number=SeqID_100921
  Homolog annotation: Hit_ID=Q9LUY5; Match level="QueryCoverage=76%, HitCoverage=43%, E-value=1e-109, Identity=75%"; Hit description =Similarity to damage-specific DNA binding protein 2
  Pfam annotation: Domain name=WD40; Domain location=166-205; Score =21.4; E_value=0.0032; Accession=PF00400.22; Description=WD domain, G- beta repeat
  Pfam annotation: Domain name=WD40; Domain location=210-249; Score =17.9; E_value=0.035; Accession=PF00400.22; Description=WD domain, G -beta repeat
  Pfam annotation: Domain name=zf-CCHC; Domain location=105-122; Score =7.7; E_value=0.053; Accession=PF00098.13; Description=Zinc knuckle
  Pfam annotation: Domain name=zf-CCHC; Domain location=80-104; Score =0.1; E_value=0.94; Accession=PF00098.13; Description=Zinc knuckle
  Pfam module annotation: Pfam domain module=WD40::WD40::zf-CCHC::zf -CCHC; Domain location=166-205::210-249::105-122::80-104
MAPVTRRTSFPKVLIERDSDSEQSSSEEEEILEEEEEEEEEEEEEEEVGVSTANEKAEKLDLGSDANRKGKAPITISLKKVCKVCKKPGHEAGFKGATYVDCPMKPCFLCKMPGHTTLTCPHRVSTEHGVVPAPRRKTCKPLDYVFERQLRPSLPSIKPKYVIPDQVNCAVIRYHSRRVTCLEFHPTKNNILLSGDKKGQLGVWDFGKVYEKVVYGNIHSCLVNNMRFNPTNDCMVYSASSDGTISCTDLETGISSSPMNLNPDGWQGPNTWKMLNGMDINSEKGLVLVADSFGFLH

SEQ ID NO: 217700 - protein, 148 aa, Glycine max
  Coding DNA Sequence Number=SeqID_100922
  Homolog annotation: Hit_ID=Q1T097; Match level="QueryCoverage=18%, HitCoverage=2%, E-value=8e-10, Identity=96%"; Hit description =Transposase family tnp2, putative
MDIGSGTIGQKEVSFGIFLIGKIIYCDTILMLCVATCPSRASERRGSRVRFPKEERCAESPPTFICGKRWENRRKLVKMRILSSGVVFTLEEVFEVDKSGAFAPTYPPLERKSDLCSSSLCMDQVILLRGDHFKALDLKNDPFYLARN

SEQ ID NO: 217701 - protein, 274 aa, Glycine max
  Coding DNA Sequence Number=SeqID_100923
  Gene Ontology: Mol. function=nucleoside-triphosphatase activity; Cellular component=membrane; Biological process=defense response
  Homolog annotation: Hit_ID=Q1SI25; Match level="QueryCoverage=93%, HitCoverage=28%, E-value=3e-98, Identity=71%"; Hit description=NB -ARC domain, putative
  Pfam annotation: Domain name=NACHT; Domain location=60-214; Score= -18.4; E_value=0.0016; Accession=PF05729.3; Description=NACHT domain
  Pfam annotation: Domain name=NB-ARC; Domain location=21-274; Score =71.9; E_value=2e-18; Accession=PF00931.13; Description=NB-ARC domain
  Pfam module annotation: Pfam domain module=NACHT::NB-ARC; Domain location=60-214::21-274
MDEPNGEQTNESEAIKTIVENVKPLLDKTELFVADNPVGVEPRVQEMIELLDQIQSNGVLLLGMWGMGGIGKTTIAKAIYNKIGRNFEVKSFLASIREVWGQDAGQVYLQEQLIFDIGKETNTKIRNVDSGKVMLKERLRNKRVLLILDDVNNLHQLNVLCGSREWFGSGSRIIITTRDMHILRGRRVDKVFRMKGMDEDESIELFSWHAFKQASPREDFIELSRNVVAYSAGLPLALEVLGKYLFDMEVTEWKNVLETLKKIPNDERKEYFLI

SEQ ID NO: 217702 - protein, 91 aa, Glycine max
  Coding DNA Sequence Number=SeqID_100924
IVPARHPVDPKESNRVLELPALITGLCRFYGVHVAPSKVIRPPTNRAFIKKYCAPRQAQDETPQQPGDGRQRATDAPPPPLEFTSAHPQKG

SEQ ID NO: 217703 - protein, 1363 aa, Glycine max
  Coding DNA Sequence Number=SeqID_100925
  Gene Ontology: Mol. function=nucleoside-triphosphatase activity; Cellular component=integral to membrane; Biological process=transport
  Homolog annotation: Hit_ID=Q94A18; Match level="QueryCoverage=96%, HitCoverage=98%, E-value=0.0, Identity=39%"; Hit description =Pleiotropic drug resistance protein 1
  Pfam annotation: Domain name=ABC2_membrane; Domain location=1068 -1297; Score=202.4; E_value=1.1e-57; Accession=PF01061.14; Description=ABC-2 type transporter
  Pfam annotation: Domain name=ABC2_membrane; Domain location=457-650; Score=132.2; E_value=1.4e-36; Accession=PF01061.14; Description=ABC -2 type transporter
  Pfam annotation: Domain name=ABC_tran; Domain location=184-407; Score= 57.7; E_value=3.9e-14; Accession=PF00005.17; Description=ABC transporter
  Pfam annotation: Domain name=ABC_tran; Domain location=801-991; Score= 107.5; E_value=3.8e-29; Accession=PF00005.17; Description=ABC transporter
  Pfam annotation: Domain name=PDR_assoc; Domain location=655-719; Score=112.2; E_value=1.6e-30; Accession=PF08370.2; Description=Plant PDR ABC transporter associated
  Pfam module annotation: Pfam domain module=ABC2_membrane::ABC2 _membrane::ABC_tran::ABC_tran::PDR_assoc; Domain location=1068 -1297::457-650::184-407::801-991::655-719
MAASDGSEYFEIGSFGSESFARASNADMVREDEEELQWVALSRLPSQKRINYALLRASSSRPQPPTQGTGTGTENLMDVRKLSRSSREQVVKKALATNDQDNYRLLAAIKERFDRVGLKVPKIEVRYKNLSVTADVQIGSRALPTLINYTRDVFESILTKLMICRPKRHSLTILNDVSGVIKPGRMTLLLGPPGAGKTSLLLALAGKLDSNLKTTGSITYNGHELDEFYVRRTSAYISQTDDHIAELTVRETLDFGARCQGAKGFAAYTDELGRREIERNIRPSPEVDAFMKASSVGGKKHSVNTDYILKVLGLDICSDTIVGNDMLRGVSGGQRKRVTTGEMIVGPRKTLFMDEISTGLDSSTTFLIVKCIRNFVHQMEATVLMALLQPAPETFELFDDLVLLAEGHVVYEGPREDVLEFFQSLGFQLPPRKGIADFLQEVTSKKDQAQYWADPSKPYQFVSVAEIARAFRNSKFGRYMESLQTHPYDKSECHDLALARTKYAVATWELPLMITRLPVFYKQRDNLFYPAWAWSLSSWILRVPYSIIEAIIWTVVVYYSVGFAPSAGRFFRYMLILFVMHQMALGLFRMMAAIARDMVLANTYGSASLLVVFLLGGFIVPKGMIKPWWIWGYWVSPLTYGQRAITVNEFTASRWMKKSETGNSTVGYNILHSNSLPTGDYWYWIGIAVLIGYAFFFNNMVTVALTYLNPIQKARTVIPSDDDSENSSSRNASNQAYELSTRTRSAREDNNKGMILPFQPLTMTFHNVNYFVDMPKELSKQGIPETRLQLLSSVSGVFSPGVLTALVGSSGAGKTTLMDVLAGRKTGGYIEGEIKISGHPKEQRTFARISGYVEQNDIHSPQVTIEESLLFSSSLRLPKEVGTSKRHEFVEQVMKLVELDTLRHALIGMPGSSGLSTEQRKRLTIAVELVANPSIIFMDEPTSGLDARAAAIVMRAVRNTVDTGRTVVCTIHQPSIDIFEAFDELLLMKRGGRVIYGGKLGVHSRIMIDYFQVEGIRGIPPIPSGYNPATWVLEVTTPATEERIGEDFADIYKNSDQYRLERDDTDKTVFFENGKKTMMGVEYSVLQFGHPPAGSEPLNPAYNAMRLYFTTISALIFGTIFWDIGSKRESTQELFVVMGALYSACMFLGVNNASSVQPIVSIERTVFYREKAAGMYSPIAYAAAQGLIEIPYIAVQTVLFGVITYFMINFERTPGKFFLYLVFMFLTFTYFTFYGMMAVGLTPSQHLAAVISSAFYSLWNLLSGFLIPKSSIPGWWIWFYYICPIAWTLRGIITSQLGDVETKIIGPGFEGTVKEYLVVSLGFETKINGFSAVGLSVIVLLGFIILFFGSFAVSVKLLNFQKR

SEQ ID NO: 217704 - protein, 86 aa, Glycine max
  Coding DNA Sequence Number=SeqID_100926
VWLLELHKIKNVKDVDFLEEGEIVKIPEVGERSKDKGALEAEVEGGVVDDIGEVLTKYFSNLFTSSLPHGMAEIASLVEGRNYGEM

SEQ ID NO: 217705 - protein, 130 aa, Glycine max
  Coding DNA Sequence Number=SeqID_100927
MAKDDIDLTKVNFTHCELICQYQCTLEILIEGVFDVVSEPLVDNTNKQVLDERVVVAYTSAKVVYPLYDISLDYGNLNETNMWLHNNLLQRWGRIMMETWVDDIEESFDDDDDERDLNFVIDILGECPLL

SEQ ID NO: 217706 - protein, 185 aa, Glycine max
  Coding DNA Sequence Number=SeqID_100928
  Homolog annotation: Hit_ID=Q6UEI6; Match level="QueryCoverage=45%, HitCoverage=56%, E-value=1e-17, Identity=50%"; Hit description=Early flowering 4
  Pfam annotation: Domain name=DUF1313; Domain location=34-127; Score =103.4; E_value=6.7e-28; Accession=PF07011.2; Description=Protein of unknown function (DUF1313)
MDETAVTTKPDWLNNRARVAGERTEEFFCGGDDEEECDDEAWDMLTRSFWQAQTVLDENRALIDEVNSNHESKIPDNMAKNVGLITQIHGNISKVRSIYSDLSVNFPNIIRQRGVAAVNHRNRDGDVEEDEDEAENSEENSAEHVLDKSEEVLWNWEVGKGKGTGQGLNLCVVFAMVKIETASAL

SEQ ID NO: 217707 - protein, 149 aa, Glycine max
  Coding DNA Sequence Number=SeqID_100929
MEAINLKGLKIVDDEEELFIHTEVTNEEQPNLSLCLEVEIPKEIPLFKVPSGFNTMGVEQSIANYVKEFLDYEEKNNSGLSHSQSLMRTKKIRKQGGEAKEVLFKYEKLGVFCYYSGLLGHILKTTVKGFFLQALMMALVCGEKGLGLN

SEQ ID NO: 217708 - protein, 66 aa, Glycine max
  Coding DNA Sequence Number=SeqID_100930
MVQQDKATGSTHFCRKMKARIHGKEVVFFLNLSWNADDLVGMGFKQSNPVGIVMDVMEEFVVYCLW

SEQ ID NO: 217709 - protein, 360 aa, Glycine max
  Coding DNA Sequence Number=SeqID_100931
  Homolog annotation: Hit_ID=Q10QC4; Match level="QueryCoverage=94%, HitCoverage=95%, E-value=5e-71, Identity=41%"; Hit description =Expressed protein
MADSICRTLRDGALEGELAPTLTIKDSLASPFAFHVFSHILLQLSSHVIAQKSQSQGIVIVALSRSPSSYTSLLKMNGMDVASSNKWIHILDCYTDPLGWKDKARKSANVTDPSQQISLATSSYKTVKDVDKLFLVIAELGRGLVGENKARFCVAIDSLSELLRHASMQSVAGLLSNLRSHDQISSMFGLLHSDLHEERAVAVLEYMSSMVASVDPYHHSADGQKRFKRRNGRVRVTVISFFLFCEEFKVEPGGISFSPVSSVDGTVIAGIVPKVQFNLQLSEKERIDRSNVVLPFEHQGNGKPIQIYDGRRSLEESNSEANPISSGKKEDSAMGEIIYFRDSDDEMPDSDEDPDDDLDI

SEQ ID NO: 217710 - protein, 70 aa, Glycine max
  Coding DNA Sequence Number=SeqID_100932
MTAPLDLAIHLLVKDWRKAHRAVRDISEGVVLKSIVEEEIRKDFEVLVIHWKEALHEAAGISRFVVLNPT

SEQ ID NO: 217711 - protein, 63 aa, Glycine max
  Coding DNA Sequence Number=SeqID_100933
MTYRRGSNKCRDITDPVTYLLAAIGAMFVSKRCLSVEFSIRALIPVEEYRAPMSLQLEEVAEN

SEQ ID NO: 217712 - protein, 400 aa, Glycine max
  Coding DNA Sequence Number=SeqID_100934
  Gene Ontology: Mol. function=phosphoinositide phospholipase C activity; Cellular component=intracellular; Biological process =intracellular signaling cascade
  Homolog annotation: Hit_ID=O49952; Match level="QueryCoverage=95%, HitCoverage=69%, E-value=1e-100, Identity=49%"; Hit description =Phosphoinositide-specific phospholipase C
  Pfam annotation: Domain name=PI-PLC-X; Domain location=118-263; Score= 159.6; E_value=8.3e-45; Accession=PF00388.9; Description =Phosphatidylinositol-specific phospholipase C, X domain
  Pfam annotation: Domain name=PI-PLC-Y; Domain location=307-397; Score= 15.0; E_value=2e-06; Accession=PF00387.9; Description=Phosphatidylinos itol-specific phospholipase C, Y domain
  Pfam annotation: Domain name=efhand_like; Domain location=38-120; Score=50.3; E_value=6.4e-12; Accession=PF09279.1; Description =Phosphoinositide-specific phospholipas
  Pfam module annotation: Pfam domain module=PI-PLC-X::PI-PLC-Y::efhand_ like; Domain location=118-263::307-397::38-120
MATTSRHPSRNKTPKQHFKVCFCFRRMFRLKGTEPPDEINTVFEEYSLDGIMSMHDLGNFLVHFQGEEEGDSINKHAQTIFDSLKHLNIFHRKGIHVEAFFRYLLSDLNGPLAEVHHDMKFPLAHYFLYTGHNSYLTGNQVSSASSTSAIIKALKKGVRVIELDLWPNSRGDDVLVHHGGTLTSSVKLKACLKAINDYAFFASPYPVVITFEDHITQFLQAKVAQMVDDIFGDILFRPEYSQQMTQFPSPEQLKGKILISTKPPESPESQDQRVREEAHRLEYDDDRTRVNYKDDLEEQEEEDDTLEYRDLISIRAGKPKGKLRNWLIDHEQVRRLSLSEQELEDIAKNHGTDIVRFTQRNLLRIYPKGTRLDSSNYDPMIGWMHGAQMVAFNMQGKEAT

SEQ ID NO: 217713 - protein, 95 aa, Glycine max
  Coding DNA Sequence Number=SeqID_100935
  Homolog annotation: Hit_ID=Q1SKJ3; Match level="QueryCoverage=40%, HitCoverage=4%, E-value=2e-09, Identity=61%"; Hit description=Zinc finger, CCHC-type; Endonuclease/exonuclease/phosphatase
  Pfam annotation: Domain name=zf-CCHC; Domain location=53-70; Score =6.3; E_value=0.09; Accession=PF00098.13; Description=Zinc knuckle
MVDIGNQYFMVKFDREEDQLKVMEGGPWMVFDHYFTIQQCGHLYRVKYKGLPRVCGTCECYGHLTRECKQFPMQIAKDGVGDSPSQPITASSSMV

SEQ ID NO: 217714 - protein, 201 aa, Glycine max
  Coding DNA Sequence Number=SeqID_100936
  Gene Ontology: Mol. function=protein serine/threonine kinase activity; Cellular component=cytoplasm; Biological process=protein amino acid phosphorylation
  Homolog annotation: Hit_ID=UPI000034F1DC; Match level="QueryCoverage =41%, HitCoverage=11%, E-value=6e-29, Identity=73%"; Hit description =ATP binding / kinase/ protein kinase/ protein serine/threonine kinase/ protein-tyrosine kinase
MEKYGDKLEPIVGCSTSDVILRKQQQQEHQNIKIKSQNTPIRHVNRNGSRKSSTNRKFRRRCFWSASGRRGSFDEGVSGALAVAGVEHASEDAEVSELDLVVIIEENILSLDIAVNVAVSVEILQHLESPLEDRSDGGLFESLGISGLHEVQAGAFAVNLKASDSWSSLVSSVTASLVLLIFRGRGVVRVNAKGHSVWTVR

SEQ ID NO: 217715 - protein, 327 aa, Glycine max
  Coding DNA Sequence Number=SeqID_100937
  Homolog annotation: Hit_ID=Q10AS2; Match level="QueryCoverage=50%, HitCoverage=40%, E-value=9e-55, Identity=67%"; Hit description=RNA -binding protein Luc7-like 2, putative, expressed
  Pfam annotation: Domain name=LUC7; Domain location=3-201; Score =126.6; E_value=6.8e-35; Accession=PF03194.6; Description=LUC7 N _terminus
MVGANFLNLEHLLNDLEGKSDLKIRALEVVEELRTKRADKQSMLLLDAFNKDRASLPTPLPNPPPLAPLPVVAPDARTQEMINEKLKKAEDLGEQGMVDEAQKALEEAEALKKLPARQEPVLDSSKYTAVDVRITDQKLRVCDICGAFLSVYDSDRRLADHFGGKLHLGYMQIREKLAELQCMTIRQKERTKETDGGVDFVWSGVVFFVIGRILNHAVFWLRKKGTRAERLIGLMTGDQKNGVGIETGSLVGTVNLVIVVNEGETMIVGAEIMIGIMIEIVDMIETVTETQTAPAPMTQEVVGGHALDPESDLEIMIDIGTEFLDYP

SEQ ID NO: 217716 - protein, 224 aa, Glycine max
  Coding DNA Sequence Number=SeqID_100938
  Gene Ontology: Mol. function=oxidoreductase activity; Cellular component=mitochondrion; Biological process=metabolic process
  Homolog annotation: Hit_ID=Q1S682; Match level="QueryCoverage=76%, HitCoverage=55%, E-value=7e-72, Identity=80%"; Hit description=Short- chain dehydrogenase/reductase SDR
  Pfam annotation: Domain name=KR; Domain location=59-223; Score=-68.5; E_value=0.0022; Accession=PF08659.1; Description=KR domain
  Pfam annotation: Domain name=adh_short; Domain location=56-219; Score= 43.3; E_value=8.5e-10; Accession=PF00106.15; Description=short chain dehydrogenase
  Pfam module annotation: Pfam domain module=KR::adh_short; Domain location=59-223::56-219
MAKAFHAPATNENQKITAQLKLVLYCIAKPHVGGLHFRLPFLHFSIQVPHRLWLFGLPVLAVELLASLGAKLIISARNEVELNRVRTQLKGKHAPDEVKILPLDLSSGEDSLWIAVEKAESFFPDSGVDYMMHNAAFERPKTSILDVTEEGLKATFDVNVLGTITLTKLLAPFMLKRGHGHFVVMSSAAGKTPAPGQAVYSASKYALNGYFHTLRSELCQKGIQ

SEQ ID NO: 217717 - protein, 348 aa, Glycine max
  Coding DNA Sequence Number=SeqID_100939
  Gene Ontology: Mol. function=unfolded protein binding; Cellular component=endoplasmic reticulum; Biological process=protein folding
  Homolog annotation: Hit_ID=Q1S678; Match level="QueryCoverage=92%, HitCoverage=85%, E-value=1e-162, Identity=76%"; Hit description =Concanavalin A-like lectin/glucanase
  Pfam annotation: Domain name=Calreticulin; Domain location=28-303; Score=346.7; E_value=3.8e-101; Accession=PF00262.8; Description =Calreticulin family
MAENASIELNKFVFFCLLVLIQVAVSEIIFEERFDDGWRGRWVKSDWKSSEGKAGSFKHTAGKWASDPDDKGIQTSSDAKHFAISAKIPEFTNKNRTLVLQYSVKFEQEIECGGDLCGTDTKKLHVILSYHGQNYPIKKDLQCETDRPDATYSVLVDNRERDSGSMYTDWDILPPRKIKDVKAKKPKDWEEREYIEDPNDVKPEGYDSIPREIPDPNAKEPENWDEEEDGKWKPPKIPNPAYKGPWKRKKIKNPNYKGKWKTPWIDNPEFEDDPDLYVLKPIKYVGIEVWQVKGGSVFDNVLICDDPDYAKQVVEEVFANREVRFSLAFDLAPHLTYRWHMGYILNNN

SEQ ID NO: 217718 - protein, 140 aa, Glycine max
  Coding DNA Sequence Number=SeqID_100940
MGQVAQLFDSTLRGRRFWGDVEELSWKVVRTYIRVQETRISTYKLQNGEQSKAIVEIEGENSTTKDNNDRETDVESDVARREFDLIEEMVLVVKKESRPKLLIQVSKNRSEANKAKISGISLSESSQAEVICFHLQQLGR

SEQ ID NO: 217719 - protein, 266 aa, Glycine max
  Coding DNA Sequence Number=SeqID_100941
  Gene Ontology: Mol. function=acetyl-CoA carboxylase activity; Cellular component=acetyl-CoA carboxylase complex; Biological process=fatty acid biosynthetic process
  Homolog annotation: Hit_ID=Q42783; Match level="QueryCoverage=91%, HitCoverage=93%, E-value=1e-55, Identity=56%"; Hit description =Biotin carboxyl carrier protein of acetyl-CoA carboxylase, chloroplast precursor
  Pfam annotation: Domain name=Biotin_lipoyl; Domain location=185-253; Score=67.1; E_value=5.6e-17; Accession=PF00364.12; Description =Biotin-requiring enzyme
  Subcellular localization annotation: CTP_CleavageSite=65; ConfidenceScore=5.57e-01
MASSLAPATKAATNLRLTHSLRFSPKPNNLRFATKPGNTLLCARVKAQLDEVALDSSSNATPPIKAKSKEEPPAKPLAEPSSSVLATQESVSQFITQVASLVKLVDSRDIVELKLKQHDVEVTIRKKEAMPQPPPPPQPAVVYSSPPPVLPPPSVPASTPAPTLARATPSPTSAPAVKSAKSSLPPLKSPMAGTFYRSPAPGEPPFVKVGDKVKKGQVVCIIEAMKLMNEIESPEFVPQNEIVNPVGDVLDRRISLKGKKRYEEEG

SEQ ID NO: 217720 - protein, 181 aa, Glycine max
  Coding DNA Sequence Number=SeqID_100942
  Gene Ontology: Mol. function=oxidoreductase activity; Biological process=metabolic process
  Homolog annotation: Hit_ID=Q1S682; Match level="QueryCoverage=68%, HitCoverage=39%, E-value=8e-58, Identity=83%"; Hit description=Short- chain dehydrogenase/reductase SDR
MDFFLSCLGALESAPTTNQTHAKWLETTAGGACRQMFMTALMSSAAAKAPAPGQAVYSASKYAVNGYFHTLRSELCQKGIQVTVICPGPIATSNNAGSRVPSEKRVPSERCAELTIIAVTHGLKEAWISYQPVLTVMYLVQYMPTIGYWVMDKIGKSRVEAAEQKGNTYSLSLMLGKKKAT

SEQ ID NO: 217721 - protein, 258 aa, Glycine max
  Coding DNA Sequence Number=SeqID_100943
  Gene Ontology: Mol. function=translation release factor activity, codon specific; Cellular component=cytoplasm; Biological process =translational termination
  Homolog annotation: Hit_ID=Q1S684; Match level="QueryCoverage=99%, HitCoverage=55%, E-value=1e-117, Identity=82%"; Hit description =Peptide chain release factor 2
  Pfam annotation: Domain name=PCRF; Domain location=72-184; Score =178.8; E_value=1.3e-50; Accession=PF03462.9; Description=PCRF domain
  Pfam annotation: Domain name=RF-1; Domain location=208-258; Score =0.4; E_value=5.9e-05; Accession=PF00472.11; Description=Peptidyl -tRNA hydrolase domain
  Pfam module annotation: Pfam domain module=PCRF::RF-1; Domain location=72-184::208-258
MSQRVGEIRESSGLQLLEQELGNLEEQAADSSFWDNRGKAQETLSTLADVKDKIKLLNDFKTQVEDAETIVSLTEEMDSIDRGLFEEASNLIKELNKSIDRYELTQLLSGPYDKEGAVISITAGAGGTDAQDWADMLLRMYMRWGEKQKYKTRVVEKSPGEEAGIKSATIEVEGRYAYGYLSGEKGTHRIVRQSPFNAKGLRQVMPLLPDESMNVEIPEEDLEISFSRAGGKGGQNVNKVETAVRITHIPTGVTVRCT

SEQ ID NO: 217722 - protein, 496 aa, Glycine max
  Coding DNA Sequence Number=SeqID_100944
  Gene Ontology: Mol. function=acyltransferase activity; Cellular component=integral to membrane; Biological process=biosynthetic process
  Homolog annotation: Hit_ID=Q2QCW7; Match level="QueryCoverage=98%, HitCoverage=100%, E-value=0.0, Identity=87%"; Hit description=3 -ketoacyl-CoA synthase
  Pfam annotation: Domain name=ACP_syn_III_C; Domain location=382-467; Score=21.4; E_value=8.6e-08; Accession=PF08541.1; Description=3 -Oxoacyl-[acyl-carrier-protein (ACP)
  Pfam annotation: Domain name=Chal_sti_synt_C; Domain location=326 -469; Score=12.2; E_value=0.00017; Accession=PF02797.6; Description =Chalcone and stilbene synthases, C-te
  Pfam annotation: Domain name=FAE1_CUT1_RppA; Domain location=80-369; Score=736.7; E_value=1.5e-218; Accession=PF08392.2; Description =FAE1Type III polyketide synthase-lik
  Pfam module annotation: Pfam domain module=ACP_syn_III_C::Chal_sti _synt_C::FAE1_CUT1_RppA; Domain location=382-467::326-469::80-369
MPHILPDFSNSVKLKYAKLSYQYLVNHIKTLTLIPIMLGISIETLRLGPDEILNLWNSLHVNLVQIFLSTFLLIIIATIYFMSKPRTIFLVDYACFKPPVTCRVPFATFMEHSRLILKNNPKSVEFQMRILERSGLGEETCLPPAIHYIPPKPTMEAARGEAEHVVFSAVDSLFKKTGLKPKDIDILIVNCSLFSPTPSLSAMVINKYKLRSNIKSFNLSGMGCSAGLISIDLARDLLQVHPNSNAVIVSTEIITPNYYQGNERAMLLPNCLFRMGGAAILLSNRKQERKRAKYRLVHVVRTHKGSNEKAFRCVFEEEDKEGKVGISLSKDLMAIAGEALKSNITSMGPLVLPASEQLLFLLTLIGRKIFNPRWKPYIPDFKQAFEHFCIHAGGRAVIDELQKNLQLSAEHVEASRMTLHRFGNTSSSSLWYELNYIESKGRMKRGDRVWQIAFGSGFKCNSAVWRCNRSIQTPFDGPWADCIDRYPVHIPEIVKL

SEQ ID NO: 217723 - protein, 108 aa, Glycine max
  Coding DNA Sequence Number=SeqID_100945
MVLMTGRRDGIEDESRKNNGGEGTDSQHNREGKKALMVLWCNMREGGMSEWYQSFWMPKRNVRKNLKCRKQHPQRWSIGSILHGRCEHKSHTRWTTEVPKVKLIEENG

SEQ ID NO: 217724 - protein, 261 aa, Glycine max
  Coding DNA Sequence Number=SeqID_100946
  Gene Ontology: Mol. function=DNA-directed RNA polymerase activity; Cellular component=membrane; Biological process=defense response
  Homolog annotation: Hit_ID=Q19PJ3; Match level="QueryCoverage=66%, HitCoverage=10%, E-value=8e-42, Identity=49%"; Hit description=TIR -NBS-LRR type disease resistance protein
  Pfam annotation: Domain name=TIR; Domain location=22-157; Score =151.6; E_value=2e-42; Accession=PF01582.10; Description=TIR domain
MSSFLLRFPPERYQEDNRNYDVFLSFRGDDTRASFTSHLYTALHNAGISVFKDDETLPRGNKISTSLGLAIEESRLYVVVFSKNYAGSLWCLQELEKIMECHKATGQVVVPVFYDVDPSEVRHQTGHFGQAFRNLEAYINLKMEEEMQPGWQKMVHECPGISGPSVFRDCNGQSEILERIHRLVEDWRVSLRKIVSISPGSGFGRGMLIAEQLIDLLVKHWRTTLRKIMEMPSNIDLLLKHWSEALWKAAGISGGADLISK

SEQ ID NO: 217725 - protein, 397 aa, Glycine max
  Coding DNA Sequence Number=SeqID_100947
  Gene Ontology: Mol. function=nucleotide binding; Biological process =protein folding
  Homolog annotation: Hit_ID=O80875; Match level="QueryCoverage=98%, HitCoverage=38%, E-value=1e-60, Identity=41%"; Hit description =Expressed protein
MPTPVSVVRQCLTDEAARALDDAVAVARRRSHAQTTSLHAISALLALPSSALRDACGRARSGAGAGTSAARFSAAYSPRLQFRALELSVGVSLDRLPSSKSTSAGEEEPPVSNSLMAAIKRSQANQRRHPESFHMFQQSQQGTASTSFLKVELKHFVLSILDDPIVSRVFAEAGFRSCDIKLALLQPPLPPVQHRFNWSPPVFLCNLDPAQPDENIRRIMEVLARKNKRNPLLMGVYAKSALKGFVEMVRNGRGGSALGSELRVVRLEREIGEFVKKGGSGEEKFGVRLKELEQQCEGSGSGVVVSFGEIEVFVGEDVDVDVVRFVVSGLTRLLEIRGEKVSLLGVAETSHAYSKFLGLFPNVENDWDLHLLTVTSATPSMEGLYSKSRFLHVDSCK

SEQ ID NO: 217726 - protein, 712 aa, Glycine max
  Coding DNA Sequence Number=SeqID_100948
  Gene Ontology: Mol. function=protein binding; Biological process =protein metabolic process
  Homolog annotation: Hit_ID=O80875; Match level="QueryCoverage=99%, HitCoverage=60%, E-value=3e-89, Identity=34%"; Hit description =Expressed protein
  Pfam annotation: Domain name=AAA_2; Domain location=342-494; Score= -16.9; E_value=0.00017; Accession=PF07724.4; Description=ATPase family associated with various
MGSFVPFGGFFSTPEIRSPVSCANGSFTRCDTCNKKCEQEVADLLKVDPSSSYSTSSHWLQKVVNMDAHRGSDVAKKELHHPVQTNEENTSLNDKILGFQKKWSDICQRLHHTSSLPQFDISQTRSQAPTVEVLRFGLAFKESSNKDPSHSEFQYSSQISCMPKELHSIFPSKQLSVPLPSDTVCINTGTDHVPKVSETLQIHMNTPWVAPSLMANKSALDHRSSSFRTPVTTDLGLGTLYTSTAQDPDTPKLQDQRKHLQHLSDSVSTDCDGMNENTSHRIARFSCSGSNLEGKFDLADFKSLDRLLTEKVGWQDQAICAISQTLSLCKSGAGKRRGSNGRADIWLAFLGPDRLGKRKIASVLAETIFGNPESLISVDLGFQDSFYPLNSVFEYQKSRCYDVLRRKTILDYIAGELSKKPHSVVFLENVDKADVLVQNSLLQAVRTGKFSYSHGRVISINNTIFLVTSTVCKGNGSFVLEESKMFSEERILEAKRCQMQLLLGHASEDAGRIGSTNVKVVPGKGFSKSSSLNKRKQADISDSKEGATSKMQKQDSEASRSYLDLNMPVEDGEEGVNDDHESESITENTDAWLSDFFDQIDEKVVFKSFNFDELAEEVLKRIGMLFQRTFGSELQLEIDYEVITHILAAAWLSDKKNAVEDWVEHVLGKGFVEAQQKYLPAAQYVVKLVNCESIFVEEQAPDVCLPARINTD

SEQ ID NO: 217727 - protein, 56 aa, Glycine max
  Coding DNA Sequence Number=SeqID_100949
  Subcellular localization annotation: CTP_CleavageSite=17; ConfidenceScore=5.26e-01
MESNHSSKYCSSRPSILANTSSQQNKNNQVFNRSRPDFYPASSTLQQIAYDSLFSY

SEQ ID NO: 217728 - protein, 68 aa, Glycine max
  Coding DNA Sequence Number=SeqID_100950
MKINLENSPKLEVLANESLSESVRDTYAASNDDVDVINGMEAWLDLLAWSFGGSSILHESHISILDPS

SEQ ID NO: 217729 - protein, 66 aa, Glycine max
  Coding DNA Sequence Number=SeqID_100951
MKAGYTGFQWEESEKLLSIEGMEQWQFFIFKSQVRQDHIDASEQCELGLYDGYDNEELSLVTSYYY

SEQ ID NO: 217730 - protein, 690 aa, Glycine max
  Coding DNA Sequence Number=SeqID_100952
  Gene Ontology: Mol. function=nucleic acid binding; Biological process= regulation of transcription
  Homolog annotation: Hit_ID=Q0GIK4; Match level="QueryCoverage=99%, HitCoverage=99%, E-value=1e-179, Identity=50%"; Hit description=Cys -3-His zinc finger protein
  Pfam annotation: Domain name=Ank; Domain location=108-143; Score =39.7; E_value=9.9e-09; Accession=PF00023.20; Description=Ankyrin repeat
  Pfam annotation: Domain name=Ank; Domain location=73-106; Score=11.3; E_value=0.73; Accession=PF00023.20; Description=Ankyrin repeat
  Pfam annotation: Domain name=zf-CCCH; Domain location=266-291; Score =25.5; E_value=0.00019; Accession=PF00642.15; Description=Zinc finger C-x8-C-x5-C-x3-H type (and similar)
  Pfam module annotation: Pfam domain module=Ank::Ank::zf-CCCH; Domain location=108-143::73-106::266-291
MCGVSKGKPSQFGLVMEEYAKEGMHHIISALLEFSAADDLVSFKDAVEKEGHDIDGVGFWYGRCVASKKIGYEERTPLMVASMFGSLGVSTYILSTGSVDVNWASRSDGATALHCAVAGGSAASIEVVKLLLDASADVNAIDANGNRPIDLIGSVTNSIFSQRSRVLQALLEGTSDADQACLALPEVIDQIEEQRQDMTTPRVSKDYPIDLSLPDIKNGIYGTDEFRMYTFKVKPCSRAYSHDWTECPFVHPGENARRRDPRKYHYSCVPCPEFRKGSCSKGDTCEYAHGIFECWLHPAQYRTRLCKDESGCTRRVCFFAHKPEELRPLYASTGSAIPSPRSYSASASALEMGSVSPIALGSPSVLMPPTSTPPLTPSGASSPIAGSMWSQSNVSVPTLQLPKSRLKTASTARDIDLDIELLGLETHRRRQQLMMDEISALSSPNWKNSMPNSPSFHVPLSDHTELNRLSGVKPANLEDMFGSLDPSILSKYHGISLDVAGTQLQSPTGIQMRQNVNQQLGGYSSSLSTSNVIGSRSFRLDQSGEAATVALNPRAAAFAKRSQSFIERSVVNHHSEIPSPNPSTFSNWGSPGGKLDWAINGEELNKLRKSASFGFRSSSSPLTKASNKISANVDDEPDVSWVNSLVKDAPPESGEYSVEDHRKLLQCHNGTDAIPAWLEQLYLDQEQMVA

SEQ ID NO: 217731 - protein, 725 aa, Glycine max
  Coding DNA Sequence Number=SeqID_100953
  Gene Ontology: Mol. function=hydrolase activity; Cellular component =intracellular; Biological process=RNA processing
  Homolog annotation: Hit_ID=Q6YU42; Match level="QueryCoverage=94%, HitCoverage=93%, E-value=0.0, Identity=47%"; Hit description =Calcineurin-related phosphoesterase-like protein
  Pfam annotation: Domain name=Metallophos; Domain location=46-265; Score=48.6; E_value=2.1e-11; Accession=PF00149.18; Description =Calcineurin-like phosphoesterase
MNLRTQNHRGRSTRLLLLLLLILYGICVAESNEGVEHVRGGPDSVVWVVQLSDLHFSVHHPNRALDFAKLVGPALSVINPSLVLITGDLTDGKSKDLLTMKQNEDEWVEYRTVLDTVIKRSRLHKSLFFDLRGNHDSFGVPVVGGSFDFFSKYSINGQLGRNGSINSVTLETQDRKHLFVGFDSTMLTGLRGPTNLFGHPTDQLLKDLDLELSKWDSQSEKPVTKISFGHFPLSFSAPSSSGRTLEDVFLKHSISAYLCGHLHTKFGMNLKRHHQWQKLCQFNIHQSAFESTVNCSLGAPPIQEFWEWEMGDWRKSRAFRILAIDRGHVSYVDVDFKSGTKRAIILPTFPLDSRFMLTSSCRHNYECQSVSPSSYETIRALVFSVSPIVSVVARVYDSRSGNLDLVVETHMIKHAGDNSRGDLYVAPWNYRAFEDASPDRFWLQIEANDIAGRSTLTELMPFSINGHNLKLSWSWKEFLVMGCQWASLYYPLFWSALYFLFIFLLLPKALLVFPKKIYTYKNFIANKGLVNGVLWFLQELCRIPKLWFGWLGYLFYLTLFPWFMGQVFTEGKNMVYMTYMGWAIETSNGKGEVEYVGSPDIMVVVLPHLLFVVLPAILVTGALTAERAICREHMLAILVKKKDDLRIDSRKSVWNGSMVSNVHLSKRWIRKLLFVVCLAICWKHFMNCRTLLKAYEMNPVLHLLGYGISIPLLLAYAISKTRSAE

SEQ ID NO: 217732 - protein, 656 aa, Glycine max
  Coding DNA Sequence Number=SeqID_100954
  Homolog annotation: Hit_ID=Q9SXY0; Match level="QueryCoverage=93%, HitCoverage=83%, E-value=1e-57, Identity=40%"; Hit description=FAS1
  Pfam annotation: Domain name=TolA; Domain location=74-468; Score= -145.4; E_value=0.034; Accession=PF06519.2; Description=TolA protein
  Subcellular localization annotation: CTP_CleavageSite=50; ConfidenceScore=5.04e-01
MAAPTEIIDVDAENSPTPTTISPQDSKSNRAKTTTRKRKKVPSVLQSLKSAEEKQAHIETLEKELDALFRYYKEAMAQKVRVELSLCGGSRNVVVAALMEESDLPLSKLVDEINDKLNGEVSNGAIVLAEPVTYATVKSSVLFVGQRVTYGVSNADADVLEDHAESCLWCWETRDLKLMPKSVRGELGVRRTCRRRIHERIMAVSEMIAALKKQESQPDYNDGLIKASAKVNKAFPEADIRLLVDGLLQKNSEDMDKKRASQENKLLIKQLERNRKEAEKEKEKESMHNELQRETLLNESNLKLSQDEARNDEKASEKKKQQKKQVDEAEKDQRRKEKAEAELKKKRSLQKQASIMERFLKRSKNSPSPSEKDKVSTKSTASDLLRCKNKSLFESATLSMDCTLASSSDVMLEDIRNWTWRNMSTDWEKCSSDISSCPMNEDSSPPDTKKYSRARHPLRKDPSLDYEVSSDEEWEEEEPGESLSDCDKDEEECQEECTKSDEESEDGFFVPDGYLSEDEGAQVDRMQIDDDIEGADSSPSCKNDIEIEEFCALLRQQKYLNNLTEHALRKNQPLIISNLINDKDLSSDHNISGTPKLEQMCLQVLSMYVIPGISCIEISEDKMQDEDQEVCLSTGKGVASLISGVAVIPDSDLPII

SEQ ID NO: 217733 - protein, 145 aa, Glycine max
  Coding DNA Sequence Number=SeqID_100955
MFWRNTQLKDWKIIVSKVLRKEMVLSMESIAQVIGCIREKITYQHDWEKPYESHVPKALYGKNIKEIDRKKKVWLNITQKCFMPKVGPKDYVSDLHKFMLFHLMDDIPFHLPHTIYINILRNMNTLGEEDDIYYVALINKLILEY

SEQ ID NO: 217734 - protein, 253 aa, Glycine max
  Coding DNA Sequence Number=SeqID_100956
MAMIILCPLRWSHYLMLLWDGFQMWALDDLTLLVVVMLISCKEGNRKLAVEPSIGNLDVLIGERDFLDCTSGRLDGCEVRVGVISLSGEVESSEDGILMGSFGVMYLCPAHIFLFFGKEEGMIVDQASISSGQHGSRPLFHLNPSASKPWRLAQRSIFDFSCWSGLYMSLLRFDWTRGSRLFMLFLHPLLLGDNLFFLLLLLSLLPSLDLALLLLENPFYLFSKAKGFLSLVLVSNSLGHLLLVFLLDVILVH

SEQ ID NO: 217735 - protein, 372 aa, Glycine max
  Coding DNA Sequence Number=SeqID_100957
  Homolog annotation: Hit_ID=Q1RY14; Match level="QueryCoverage=49%, HitCoverage=59%, E-value=2e-34, Identity=45%"; Hit description=Heat shock protein DnaJ
  Pfam annotation: Domain name=DnaJ_C; Domain location=253-368; Score= -41.3; E_value=0.0042; Accession=PF01556.9; Description=DnaJ C terminal region
  Subcellular localization annotation: CTP_CleavageSite=32; ConfidenceScore=5.09e-01
MATITMGGNHNSSITPRHYNTHKVFLFCNYILLGAASSCIFLTLSLRLIPSLCGFFFILLQVFTIAGAVSGCAAVGTNRWYSAHMVATVLTAIFQGSVSVLVFTRTGDFLGQLKSYVREEDGAVILKLAGGLTILIFCLEWVVLTLAFFLKYYACVEGNSGAVVPVRSGKVQQDEDLKDWPWPFQRAIYDYDHFGEEDPKKGTHEVPFSADDDMGRGTEYKFSCTLEELYTGKTKNIKITREIADAKGMQVEETLRINVKPGWKKGMKFVFQEKEPHSVFIRDGNDLIVVQEISLDGRYVIVSHVTGSWIIALYINEVIRPDYEQVFPTLGMPFWEDPTKNGMLRIKFNIIFPIHPTADQKAQINKVLSLPS

SEQ ID NO: 217736 - protein, 345 aa, Glycine max
  Coding DNA Sequence Number=SeqID_100958
  Gene Ontology: Mol. function=phosphoric monoester hydrolase activity; Biological process=metabolic process
  Homolog annotation: Hit_ID=Q1S694; Match level="QueryCoverage=74%, HitCoverage=62%, E-value=8e-75, Identity=64%"; Hit description=HAD -superfamily hydrolase, subfamily IIA
MEWWFVAMRVRRVRDEGYVKARIGANEAKGMILVDEAFSIDDSLTYYGSKKWGRKGNKWVKSSTLTQSVTVTCVRHSHRQWFQSIPVNYRFFDAARNSLSSPNSAIFKWKRKANYNRHSSGMGTFTTRALAQPLQNADELIDSVETFIFDCDVVMAKPAPLVSRPKAVSPVCMASHVFHRFAWRNTCDKLIDGVPETLDMLRSKGKRLVFVTNNSTKSRKQYGKKFETLGLNVSEEEIFASSFAAAAYLKSIDFPKDKKVYVIGEDGILKELELAGYQYLGGPEDGGKKIELKPGFLMEHDEDQLLLGLIATSTTIKSSKISNTDTETFYGHVYAPKLETYQPFD

SEQ ID NO: 217737 - protein, 53 aa, Glycine max
  Coding DNA Sequence Number=SeqID_100959
MGGAVTLLDVPGGGNRVFLVRRNTCTRGHATRFGTPLRLRLITVGEGGVVYAR

SEQ ID NO: 217738 - protein, 1064 aa, Glycine max
  Coding DNA Sequence Number=SeqID_100960
  Gene Ontology: Cellular component=nuclear chromosome; Biological process=chromosome organization and biogenesis (sensu Eukaryota)
  Homolog annotation: Hit_ID=UPI0000E48D64; Match level="QueryCoverage =19%, HitCoverage=31%, E-value=1e-22, Identity=36%"; Hit description =PREDICTED: similar to RAD21 homolog
  Pfam annotation: Domain name=Rad21_Rec8_N; Domain location=1-76; Score=91.9; E_value=1.9e-24; Accession=PF04825.4; Description=N terminus of Rad21  Rec8 like protein
QLYECADSILFPEIPIALRLSSHLLLGVVRIYSRKVNYLFDDCSEALLKIKQAFRSTAVDLPPEESTAPYHSITLPETFDLDDFELPDNDILQGNYVDHHVSTREQITLQDSMEGVIYTTSQFGLDERFGDGDASQIGLDLDEVLLNDKAATSEHDGFGANIQMSHQNDEKKQEIDDLPTAAELSEYAEGPSTPGLEEPNLFGTQMDQGNNEVDYHNSADLISLEAAPKESSDHQRENDVINCSLQNNGNHISFDLHHEDNACDLVEMNSKKEEQEHLACQVVMKDQENLIPNDHCLTLLPLVDSSNKDYTECEGGMINASDVAEKEDLQDGVLMNNDPVSAALDQTITNCVVSAPLMNNENVASSGCSHVTSDQEDLSCKPLSNMDGSWGPGFDGRLEDGNTLSKHEVLNGIEISKSEGQFCPFDDARVSNVISPLRSPGRPEVVDEEAQASQELKEAETLNHVSLEAVQPAESILQPCTSHLGQPSRSFIEDFSISFRLNTPRNCSLRTPPKPFGIFPITKSSEHAGSSKGEKCHVTDVSNPALSYQGTIEPSVFKETPDSGKTDMQLESQIFSDKVESINKSAAADMPEPEKLLSAYQHDGEANHLLMASTPDNQGATEGHTGAAGVKCISGKKRSYTESTLTVQSMDLIESYGGAQSKRTAESVPDDDDLLSSILVGRKSSVLKMKPSPAAPEIASMKCVRSASAPRTSALKRKVHMDDMMVLHGETDTEIDGVEGNNEPMAVQLQENAEVQPTEVVEGNNEPMAVQPQEDAEVQPTEVPVLSESHQSEVNLGSRDIDAHGHMDIISHVEELDSSQNVELNNVRANIEVSEAGNCSVGPGHESSSLTEVFKNDFAASLSRVDKTNDLVDSIHTNILSIPNAENLNTIPILEDDFVEDQSDKNGVGAIECSMETGTQVQTDGLEANDLYASLAIGSKETDEFTDIQASFNGDLPLEENRNNLLGQLNEDQIVASGMECDGKDARSDCIFIENAKVDCLQSEALGLDEKESSLKDAEIPVCQEAGLQITMCPEIRSPFVDQNDESKLNFESGVLHTSFFALS

SEQ ID NO: 217739 - protein, 385 aa, Glycine max
  Coding DNA Sequence Number=SeqID_100961
  Gene Ontology: Mol. function=RNA binding; Cellular component =ribonucleoprotein complex; Biological process=regulation of translation
  Homolog annotation: Hit_ID=Q8S7G1; Match level="QueryCoverage=69%, HitCoverage=79%, E-value=6e-24, Identity=28%"; Hit description =Putative nucleic acid binding protein
  Pfam annotation: Domain name=KH_1; Domain location=103-164; Score =50.0; E_value=8e-12; Accession=PF00013.19; Description=KH domain
  Pfam annotation: Domain name=KH_1; Domain location=196-265; Score =60.4; E_value=5.7e-15; Accession=PF00013.19; Description=KH domain
  Pfam annotation: Domain name=KH_1; Domain location=305-367; Score =59.2; E_value=1.3e-14; Accession=PF00013.19; Description=KH domain
  Pfam module annotation: Pfam domain module=KH_1::KH_1::KH_1; Domain location=103-164::196-265::305-367
  Subcellular localization annotation: CTP_CleavageSite=67; ConfidenceScore=5.39e-01
MSQQGQIPINPMVPPQNPMATMQVPMPMHMQMQMQMQMPMPMHMPLPMQMQMQMPLPMPLQIPFSVQDTAPSSGKRRRDDENSGTASAPEQSAAKRAKGQDVIFRIVVPSRQIGKVIGKEGHRIQKIREDTKATIKIADAIARHEERVIIISSKDNDEKVTDAEKALEQIAHLILKEDDSSLDASKVTAGHVAANTIRLLIAGSQAGGLIGMSGQNIEKLRDSSGASITVLAPNQLPLCASAHESDRVVQLSGDVPAVMKALEEIGCQLRENPPRQVISISPTYNYAAIRPSQPYLDPTSVDYVTFEMLISETMVGGLIGRCGSNISRIRNESGAMIKVYGGKGEQKHRQIQFGGSAQQVALAKQRVDEYIYSQLIQQTGTQQSV

SEQ ID NO: 217740 - protein, 33 aa, Glycine max
  Coding DNA Sequence Number=SeqID_100962
MGAKWVFRNMLDEAGKVVRNKARLVARCNSQQE

SEQ ID NO: 217741 - protein, 396 aa, Glycine max
  Coding DNA Sequence Number=SeqID_100963
  Gene Ontology: Cellular component=membrane
  Homolog annotation: Hit_ID=Q6ZGZ0; Match level="QueryCoverage=88%, HitCoverage=92%, E-value=1e-111, Identity=58%"; Hit description =Putative purine permease
  Pfam annotation: Domain name=TPT; Domain location=223-372; Score =194.4; E_value=2.7e-55; Accession=PF03151.7; Description=Triose -phosphate Transporter family
  Pfam annotation: Domain name=UAA; Domain location=64-381; Score= -174.0; E_value=0.1; Accession=PF08449.2; Description=UAA transporter family
  Pfam module annotation: Pfam domain module=TPT::UAA; Domain location =223-372::64-381
MYPILASGIRLVPVLLKTNCMFIYYHENLKRMLQISDNEEPMIVPGSMSELAFNKYKRWQWWCLVTLSIAFLIVGQSAAVILGRFYYDQGGNSKWMATLVQTAAFPILFIPLFTIPSPPEASTSASPPIKIILLIYFGLGVLIAADNMMYSTGLLYLSASTYSLICASQLAFNAVFSYFINSQKFTALIINSTVVLTLSAALLAVNEDTDEPSGFSKGKYIIGFLCTLGASAVYSLLLSLMQLTFEKVLKKETFSVVLEMQIYTSFVASGASVIGLFASGEWRTLHGEMEGFQKGYVAYVMTLVWTSIAWQVCSVGVVGLIFLVSSLYSNVISTVSLAVTPIAAVIVFHDKMNGVKIISMLLALWGFASYIYQNYLDDSKTRHAQAATKSQNDSSC

SEQ ID NO: 217742 - protein, 66 aa, Glycine max
  Coding DNA Sequence Number=SeqID_100964
  Gene Ontology: Mol. function=phosphopantetheine binding; Cellular component=mitochondrion; Biological process=fatty acid biosynthetic process
  Homolog annotation: Hit_ID=P53665; Match level="QueryCoverage=89%, HitCoverage=54%, E-value=2e-10, Identity=58%"; Hit description=Acyl carrier protein, mitochondrial precursor
MALRAAVLRHVRVPLQAAPKLQPWRAMSSHGDDHLSKEEVVERVLAVVKDFPKVDPSRCTKGLLKI

SEQ ID NO: 217743 - protein, 445 aa, Glycine max
  Coding DNA Sequence Number=SeqID_100965
  Gene Ontology: Mol. function=structural molecule activity; Cellular component=cytoskeleton; Biological process=signal transduction
  Homolog annotation: Hit_ID=Q6AT64; Match level="QueryCoverage=100%, HitCoverage=90%, E-value=1e-112, Identity=40%"; Hit description =Putative ankyrin
  Pfam annotation: Domain name=Ank; Domain location=172-204; Score =34.1; E_value=4.9e-07; Accession=PF00023.20; Description=Ankyrin repeat
  Pfam annotation: Domain name=Ank; Domain location=205-237; Score =18.7; E_value=0.021; Accession=PF00023.20; Description=Ankyrin repeat
  Pfam annotation: Domain name=Ank; Domain location=238-270; Score =17.6; E_value=0.045; Accession=PF00023.20; Description=Ankyrin repeat
  Pfam annotation: Domain name=Ank; Domain location=271-303; Score =38.9; E_value=1.7e-08; Accession=PF00023.20; Description=Ankyrin repeat
  Pfam annotation: Domain name=Ank; Domain location=305-337; Score =39.8; E_value=9.4e-09; Accession=PF00023.20; Description=Ankyrin repeat
  Pfam annotation: Domain name=Ank; Domain location=338-391; Score=6.0; E_value=4.3; Accession=PF00023.20; Description=Ankyrin repeat
  Pfam annotation: Domain name=Ank; Domain location=392-424; Score =41.0; E_value=4.2e-09; Accession=PF00023.20; Description=Ankyrin repeat
  Pfam annotation: Domain name=Motile_Sperm; Domain location=4-114; Score=16.5; E_value=0.00049; Accession=PF00635.16; Description=MSP (Major sperm protein) domain
  Pfam module annotation: Pfam domain module=Ank::Ank::Ank::Ank::Ank::An k::Ank::Motile_Sperm; Domain location=172-204::205-237::238-270::271 -303::305-337::338-391::392-424::4-114
MDRLIKVDPTNTVPIRIEPGQKCHGQITLRNVMYTMPVAFRLQSLIKTRYTLKPQSGIISPLSTVTIEILYNLPLGSTLPHSFPHSEDSFLLHSVVVPGATVKEPSSMFESVPSDWFTAKKKQVFIDSGIKIIFVGSLILAQLVHNGSIDEIREVLEHSEHTWKAVDSVDQNGDTLLHVAISKSRPDIVQLLLEFNADVESKNRTGETPLESACASGEELIVELLLAHKANTERTESSSLGAIHLSAREGRREVLRLLLLKGASVDSLTKDGYTALHLAVREGSRDCARLLLANNARTDIRDSRDGDTCLHVAAGVGDESMVKLLLNKGANKDVRNFNGKTAYDVAAEKGHARVFDALRLGDGLCVAARKGEVRSIQRLIEGGAVVDGRDQHGWTALHRACFKGRVEAVRALLERGIDVEARDEDGYTALHCAVEAGHADVAEVL

SEQ ID NO: 217744 - protein, 63 aa, Glycine max
  Coding DNA Sequence Number=SeqID_100966
  Gene Ontology: Mol. function=phosphopantetheine binding; Cellular component=mitochondrion; Biological process=fatty acid biosynthetic process
  Homolog annotation: Hit_ID=P53665; Match level="QueryCoverage=89%, HitCoverage=46%, E-value=2e-21, Identity=84%"; Hit description=Acyl carrier protein, mitochondrial precursor
  Pfam annotation: Domain name=PP-binding; Domain location=1-56; Score =26.1; E_value=0.00013; Accession=PF00550.15; Description =Phosphopantetheine attachment site
MQHVVVSPDVHFQKDLGLDSLDNVEIVMALEEEFKLEIPDKEADKIDSCHLAIEYISNHPMAG

SEQ ID NO: 217745 - protein, 403 aa, Glycine max
  Coding DNA Sequence Number=SeqID_100967
  Subcellular localization annotation: CTP_CleavageSite=63; ConfidenceScore=5.66e-01
MKLLTSSSSSYSSTPSSSSSLSLDPSLCNSKSVTAGCLTAILRRILCSGGLPTHPSDQIRELDSMSKMSGKVQELKTKQNTESTTTVTFSTTTTTTITRGIVERLMGLESMVERDTNTTNEATSSSSLPRSKSMNSMDYLGEYKRMEGLHKRAKSSSFREVPTFHLHENENFLVLSFESGCDGGEFRSQKGIKKEKASKERSELKKNKREKVHDEKEKGNLSDMSSANVGKHGLEFANTSALFMACSEKEYVGSETERFSHPVKRKEVTNDEKVKRKKKGTTCYAEEKVDTECSSEDSSPVSIFDFERQAPGTEVDSFGVDTSWRRKLSPELENEQLDNLMIEEMKVNTIEDNKHEGSKKNEKQSQECVDIWGEICRLVEGELGSNKLEEGLWKQDDIESVCA

SEQ ID NO: 217746 - protein, 407 aa, Glycine max
  Coding DNA Sequence Number=SeqID_100968
  Gene Ontology: Mol. function=protein binding; Cellular component =integral to membrane; Biological process=xylan catabolic process
  Homolog annotation: Hit_ID=Q949G7; Match level="QueryCoverage=99%, HitCoverage=79%, E-value=2e-97, Identity=31%"; Hit description =HcrVf3 protein
  Pfam annotation: Domain name=LRR_1; Domain location=104-126; Score =3.5; E_value=62; Accession=PF00560.23; Description=Leucine Rich Repeat
  Pfam annotation: Domain name=LRR_1; Domain location=128-150; Score =11.6; E_value=1.9; Accession=PF00560.23; Description=Leucine Rich Repeat
  Pfam annotation: Domain name=LRR_1; Domain location=152-175; Score =13.3; E_value=0.88; Accession=PF00560.23; Description=Leucine Rich Repeat
  Pfam annotation: Domain name=LRR_1; Domain location=177-199; Score =10.8; E_value=2.7; Accession=PF00560.23; Description=Leucine Rich Repeat
  Pfam annotation: Domain name=LRR_1; Domain location=201-223; Score =13.7; E_value=0.68; Accession=PF00560.23; Description=Leucine Rich Repeat
  Pfam annotation: Domain name=LRR_1; Domain location=273-295; Score =7.2; E_value=13; Accession=PF00560.23; Description=Leucine Rich Repeat
  Pfam annotation: Domain name=LRR_1; Domain location=297-319; Score =14.9; E_value=0.28; Accession=PF00560.23; Description=Leucine Rich Repeat
  Pfam annotation: Domain name=LRR_1; Domain location=31-50; Score=5.8; E_value=24; Accession=PF00560.23; Description=Leucine Rich Repeat
  Pfam annotation: Domain name=LRR_1; Domain location=321-343; Score =18.0; E_value=0.035; Accession=PF00560.23; Description=Leucine Rich Repeat
  Pfam annotation: Domain name=LRR_1; Domain location=345-366; Score =8.5; E_value=7.5; Accession=PF00560.23; Description=Leucine Rich Repeat
  Pfam annotation: Domain name=LRR_1; Domain location=52-73; Score=4.5; E_value=42; Accession=PF00560.23; Description=Leucine Rich Repeat
  Pfam annotation: Domain name=LRR_1; Domain location=7-29; Score=8.1; E_value=8.7; Accession=PF00560.23; Description=Leucine Rich Repeat
  Pfam annotation: Domain name=LRR_1; Domain location=80-101; Score =12.2; E_value=1.5; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR_1; Domain location=104-126::128-150::152-175::177-199::201-223::273 -295::297-319::31-50::...
  Pfam module annotation: Domain location=321-343::345-366::52-73::7 -29::80-101
MWEALSQVSYLNLSRNHIHGEIGTTLKNPISIHVIDLSSNHLCGKLPYLSRDVIWLDLSSNSFSESMNDFLCNDQDEPMQLELLNLASNNLSGEIPDCWMNWTSLGDVNLQSNHFVGNLPQSMGSLADLQSLQISNNTLSGIFPTSLKKNNQLISLDLGENNLSGTIPTWVGENLLNVKILRLRSNSFAGHIPKEICQMSLLQVLDLAQNNLSGNIPSCFSNLSSMTLMNQSTDPRISSVALLSPYYSSRVSIVSVLLWLKGRGDEYRNILGLVTSIDLSSNKLLGEIPREITYLNGLNFLNLSHNQLIGHIPRGIGNMRSLQSIDFSRNQLSGEIPPSIANLSFLSMLDLSYNHLKGNIPTGTQLETFDASSFIGNNLCGPPLPINCSSNGKTHSYEGSDGHGVIW

SEQ ID NO: 217747 - protein, 442 aa, Glycine max
  Coding DNA Sequence Number=SeqID_100969
  Gene Ontology: Mol. function=protein binding; Cellular component =integral to membrane; Biological process=protein amino acid phosphorylation
  Homolog annotation: Hit_ID=Q949G9; Match level="QueryCoverage=96%, HitCoverage=87%, E-value=2e-55, Identity=30%"; Hit description =HcrVf1 protein
  Pfam annotation: Domain name=LRRNT_2; Domain location=17-57; Score =45.9; E_value=1.4e-10; Accession=PF08263.3; Description=Leucine rich repeat N-terminal domain
  Pfam annotation: Domain name=LRR_1; Domain location=110-135; Score =9.8; E_value=4.2; Accession=PF00560.23; Description=Leucine Rich Repeat
  Pfam annotation: Domain name=LRR_1; Domain location=137-159; Score =15.0; E_value=0.27; Accession=PF00560.23; Description=Leucine Rich Repeat
  Pfam annotation: Domain name=LRR_1; Domain location=161-184; Score =13.2; E_value=0.92; Accession=PF00560.23; Description=Leucine Rich Repeat
  Pfam annotation: Domain name=LRR_1; Domain location=186-208; Score =14.3; E_value=0.46; Accession=PF00560.23; Description=Leucine Rich Repeat
  Pfam annotation: Domain name=LRR_1; Domain location=235-256; Score =11.7; E_value=1.8; Accession=PF00560.23; Description=Leucine Rich Repeat
  Pfam annotation: Domain name=LRR_1; Domain location=261-283; Score =7.2; E_value=13; Accession=PF00560.23; Description=Leucine Rich Repeat
  Pfam annotation: Domain name=LRR_1; Domain location=285-306; Score =13.1; E_value=1; Accession=PF00560.23; Description=Leucine Rich Repeat
  Pfam annotation: Domain name=LRR_1; Domain location=308-330; Score =14.8; E_value=0.32; Accession=PF00560.23; Description=Leucine Rich Repeat
  Pfam annotation: Domain name=LRR_1; Domain location=332-354; Score =7.1; E_value=13; Accession=PF00560.23; Description=Leucine Rich Repeat
  Pfam annotation: Domain name=LRR_1; Domain location=356-378; Score =12.8; E_value=1.1; Accession=PF00560.23; Description=Leucine Rich Repeat
  Pfam annotation: Domain name=LRR_1; Domain location=380-402; Score =14.4; E_value=0.42; Accession=PF00560.23; Description=Leucine Rich Repeat
  Pfam annotation: Domain name=LRR_1; Domain location=404-426; Score =17.9; E_value=0.037; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1; Domain location=17-57::110-135::137-159::161-184::186-208::235 -256::261-283::...
  Pfam module annotation: Domain location=285-306::308-330::332 -354::356-378::380-402::404-426
MKSEREKQAGQQESVCIPSERETLMKIKNNLIDPSNRLWSWNHNHTNCCHWYGVLCHNLTSHVLQLHLNTSYYAFKYDYYNGFYHRFDEEAYRRWSFGGEISPCLADLKHLNYLDLSGNYFLGEGMSIPSFLGTMTSLTHLNLSQTAFSGKIPPQIGNLSKLRYLDLSYNDFEGMAIPSFLCAMTSLTHLDLSYTPFMGKIPSQIGNLSNLVYLGLGGSYDLLAENVGWVSSMWKLEYLYLSNANLSKAFHWLHTLQSLPSLTHLSLSGCTLPHYNEPSLLNFSSLQTLDLSDTAISFVPKWIFKLKKLVSLQLQGNEIQGPIPGGIRNLSLLLILDLSFNSFSSSIPDCLYGLHRLKSLDLSSSNLHGTISDALGNLTSLVELDLSINQLEGNIPTCLGNLTSLVELHLSRNQLEGNIPTSLGNLCNLRVIDLSYLKLNQQ

SEQ ID NO: 217748 - protein, 107 aa, Glycine max
  Coding DNA Sequence Number=SeqID_100970
  Gene Ontology: Mol. function=lipid binding; Cellular component =anchored to membrane; Biological process=lipid transport
  Homolog annotation: Hit_ID=Q6Z387; Match level="QueryCoverage=99%, HitCoverage=63%, E-value=1e-07, Identity=34%"; Hit description=Lipid transfer protein-like
MKTNKKCVCLILKDRDDPDLGLKINMTIAVALLHLDPKSPEAKAFNQIGQKSNGGSISPSPTTSAEGSSQNGRNQGTDETATAKKNSASYIWKRLLESLVAVAGLLI

SEQ ID NO: 217749 - protein, 111 aa, Glycine max
  Coding DNA Sequence Number=SeqID_100971
MGWYKGPCGSHHAQQCKFPDLVKKARKEFVITTESKSSVTFGNIGQRHSPMHTRDMADHLFSQQETGTCNIIPTMKAQTTTPRSVTHGTRNSQSHTLSAAIKTIIPLERST

SEQ ID NO: 217750 - protein, 152 aa, Glycine max
  Coding DNA Sequence Number=SeqID_100972
  Homolog annotation: Hit_ID=Q2HRE1; Match level="QueryCoverage=65%, HitCoverage=26%, E-value=1e-18, Identity=38%"; Hit description =Lipopolysaccharide-modifying protein
  Pfam annotation: Domain name=DUF821; Domain location=1-152; Score= -138.2; E_value=4.6e-12; Accession=PF05686.3; Description=Arabidopsis thaliana protein of unknown function (DUF821)
MAYFVGRVERRHYEDTMAEQRALCLLERGLIPVHHYWPIKDDDKCRSIKFAVDWGNNHKQRAQQIGKVASDFNSFKKRYKPSISANATELCVESMVCGAEGSVKKFMMESLVKVPANTDLCTMPVPFDPPTLYATLQRKESSIQQVESWEKS

SEQ ID NO: 217751 - protein, 87 aa, Glycine max
  Coding DNA Sequence Number=SeqID_100973
  Gene Ontology: Mol. function=protein binding
  Homolog annotation: Hit_ID=Q6JN46; Match level="QueryCoverage=95%, HitCoverage=10%, E-value=2e-07, Identity=36%"; Hit description=EIX receptor 2
MNPLKLRSKYLRLSNEPRKLGIGGTPGHVQQSDLSDHDESLFEGSASPCLKLWSAFLSFSLQVILSLAALLALKWRVVAVDNIKRRT

SEQ ID NO: 217752 - protein, 81 aa, Glycine max
  Coding DNA Sequence Number=SeqID_100974
MWFFWVSANGNYISKRPVRVEFQATIFCPAFFPFVKAYDIVKEKEENASGTSSVSGVGGLAIESAVDAIKAVILGAAHDGE

SEQ ID NO: 217753 - protein, 972 aa, Glycine max
  Coding DNA Sequence Number=SeqID_100975
  Gene Ontology: Mol. function=calcium ion binding; Cellular component =intracellular; Biological process=protein amino acid phosphorylation
  Homolog annotation: Hit_ID=Q10BR5; Match level="QueryCoverage=78%, HitCoverage=63%, E-value=1e-160, Identity=35%"; Hit description =Calreticulin family protein, expressed
  Pfam annotation: Domain name=PPR; Domain location=150-184; Score =42.1; E_value=1.9e-09; Accession=PF01535.11; Description=PPR repeat
  Pfam annotation: Domain name=PPR; Domain location=251-285; Score =44.0; E_value=5.1e-10; Accession=PF01535.11; Description=PPR repeat
  Pfam annotation: Domain name=PPR; Domain location=286-320; Score =46.1; E_value=1.2e-10; Accession=PF01535.11; Description=PPR repeat
  Pfam annotation: Domain name=PPR; Domain location=321-355; Score =46.5; E_value=9e-11; Accession=PF01535.11; Description=PPR repeat
  Pfam annotation: Domain name=PPR; Domain location=422-456; Score =43.9; E_value=5.5e-10; Accession=PF01535.11; Description=PPR repeat
  Pfam annotation: Domain name=PPR; Domain location=457-491; Score =29.7; E_value=1e-05; Accession=PF01535.11; Description=PPR repeat
  Pfam annotation: Domain name=PPR; Domain location=493-527; Score =36.7; E_value=8.1e-08; Accession=PF01535.11; Description=PPR repeat
  Pfam annotation: Domain name=PPR; Domain location=594-628; Score =45.2; E_value=2.3e-10; Accession=PF01535.11; Description=PPR repeat
  Pfam annotation: Domain name=PPR; Domain location=629-663; Score=7.3; E_value=1; Accession=PF01535.11; Description=PPR repeat
  Pfam annotation: Domain name=PPR; Domain location=665-699; Score=6.3; E_value=1.4; Accession=PF01535.11; Description=PPR repeat
  Pfam module annotation: Pfam domain module=PPR::PPR::PPR::PPR::PPR::PP R::PPR::PPR::PPR::PPR; Domain location=150-184::251-285::286-320::321- 355::422-456::457-491::493-527::594-628::629-663::665-699
  Subcellular localization annotation: CTP_CleavageSite=75; ConfidenceScore=5.18e-01
MEKNLIILPSKPWHPLLIPSHSSTQLEWHGSTRALANSNSVSMTQRSHPKLVDTQLNQLCANGSLSEAVAILDSLAQQGSKVRPITFMNLLQACIDKDCILVGRELHTRIGLVRKVNPFVETKLVSMYAKCGHLDEARKVFDEMRERNLFTWSAMIGACSRDLKWEEVVELFYDMMQHGVLPDDFLLPKVLKACGKFRDIETGRLIHSLVIRGGMCSSLHVNNSILAVYAKCGEMSCAEKIFRRMDERNCVSWNVIITGYCQRGEIEQAQKYFDAMQEEGMEPGLVTWNILIASYSQLGHCDIAMDLMRKMESFGITPDVYTWTSMISGFTQKGRINEAFDLLRDMLIVGVEPNSITIASAASACASVKSLSMGSEIHSIAVKTSMVDDILIGNSLIDMYAKGGDLEAAQSIFDVMLERDVYSWNSIIGGYCQAGFCGKAHELFMKMQESDSPPNVVTWNVMITGFMQNGDEDEALNLFLRIEKDGKIKPNVASWNSLISGFLQNRQKDKALQIFRQMQFSNMAPNLVTVLTILPACTNLVAAKKVKEIHCCATRRNLVSELSVSNTFIDSYAKSGNIMYSRKVFDGLSPKDIISWNSLLSGYVLHGCSESALDLFDQMRKDGLHPSRVTLTSIISAYSHAEMVDEGKHAFSNISEEYQIRLDLEHYSAMVYLLGRSGKLAKALEFIQNMPVEPNSSVWAALLTACRIHKNFGMAIFAGEHMLELDPENIITQHLLSQAYSVCGKSWEAQKMTKLEKEKFVKMPVGQSWIEMNNMVHTFVVGDDQSIPYLDKIHSWLKRVGENVKAHISDNGLRIEEEEKENIGSVHSEKLAFAFGLIDFHHTPQILRIVKNLRMCRDCHDTAKYISLAYGHDGEVEESSPLCACVRWQLLSVTVGGSARKSFEDSTKKHQSVGPWGGNEGSRWDDGIYSGVRQLVMVHGAGIDSIQIEYDKKGSSIWSERHGGSGGRKTDK

SEQ ID NO: 217754 - protein, 97 aa, Glycine max
  Coding DNA Sequence Number=SeqID_100976
  Gene Ontology: Mol. function=nucleic acid binding
  Homolog annotation: Hit_ID=Q1T6D0; Match level="QueryCoverage=71%, HitCoverage=13%, E-value=1e-09, Identity=40%"; Hit description=Zinc finger, CCHC-type; Lipocalin
MPPEFHSDDCTFNWFLRIRIQETLPPRAKVDFFKENLAKIVYEDDNPLKPMIHIDESVYEGLYAPWEVALVIKLLGKNVGFQTMCDSLRVVYRHFGT

SEQ ID NO: 217755 - protein, 254 aa, Glycine max
  Coding DNA Sequence Number=SeqID_100977
MEGNAAAVTTTNAAIEVDPTHPSGLNQVNPPVSDMVGLPPNYTPPNVAHTSDNNVNNSTLILIKSQQPQSDHAHVSQRMGETHEAPRDHTLANSKPYPGYATEGQAFGAIPMLNTLEGPQFCPQPQPLHFAVGRVHLAMVEREKFNHIEERLRAIEGGEDHAFVDMPELCLVPDMVIPLKFKVPNFDKYKETTCPKNHLKMYNRKMGAYSKYEKLLMHFFQESLTGAAITWYTNLEPSRVHSWKELMFAFIRQY

SEQ ID NO: 217756 - protein, 77 aa, Glycine max
  Coding DNA Sequence Number=SeqID_100978
MNDAMEENPEEDPDEGSCVESSQGSSYGTSLAEFSCLTPAAAQSERSFDVSEKNMENTQKGGQKGHLEAFSNPWATK

SEQ ID NO: 217757 - protein, 336 aa, Glycine max
  Coding DNA Sequence Number=SeqID_100979
  Gene Ontology: Mol. function=transferase activity
  Homolog annotation: Hit_ID=Q1S9Q3; Match level="QueryCoverage=98%, HitCoverage=69%, E-value=4e-80, Identity=47%"; Hit description =Ankyrin
MTHHRAVEILNSMAKGIMGFDETKLREASVYESLLEASKSGIAEFIIKLTQANPDLYWVFDENQRGIFSYAILYRRENIFNLINGLKGQGKVIISRTDIFGNNMLHLIGTSVPTAELDRKSGPALQMQRELQWFKAVKRILHPKFQQAINGDGMKPKELFTKKHEELLKDAEKWAKETATSFTIVGTLIITIVFAAAFTLPGGNDQNTGIPMFLHKRMFTTYMVADAISLFSSSTAVMTFIGILTSRYAERDFLKSLPLKLMFGLFTLICSILAMMVAFCSAFSLMLEDSGHSKMVKFVISIASLSVVIFLPMQLRLLLEIFNSTFRSEVLNIKKV

SEQ ID NO: 217758 - protein, 63 aa, Glycine max
  Coding DNA Sequence Number=SeqID_100980
MAVRLFPAADHPNAAVVFRPAPVWGAVLLDESSISRGPDALAGGLIEARNQSWKPQGPVGLFR

SEQ ID NO: 217759 - protein, 206 aa, Glycine max
  Coding DNA Sequence Number=SeqID_100981
  Homolog annotation: Hit_ID=UPI000016344C; Match level="QueryCoverage =97%, HitCoverage=34%, E-value=1e-19, Identity=29%"; Hit description =protein binding
  Pfam annotation: Domain name=Ank; Domain location=106-139; Score=7.4; E_value=2.7; Accession=PF00023.20; Description=Ankyrin repeat
  Pfam annotation: Domain name=Ank; Domain location=2-34; Score=1.3; E _value=20; Accession=PF00023.20; Description=Ankyrin repeat
  Pfam annotation: Domain name=Ank; Domain location=36-70; Score=6.1; E_ value=4.1; Accession=PF00023.20; Description=Ankyrin repeat
  Pfam annotation: Domain name=Ank; Domain location=71-105; Score=6.6; E_value=3.5; Accession=PF00023.20; Description=Ankyrin repeat
  Pfam module annotation: Pfam domain module=Ank::Ank::Ank::Ank; Domain location=106-139::2-34::36-70::71-105
MAGLPLLHRCVQRGDWDTARTFVNNNRKAMYETSKLGKTVVHVAVLTGQEDMVEKLVNKVPKRLLLERDTRGYTALALAAELSDTISVAKCMVDRNRDLLTIKTNEGLIPLVLAAVKGNKNMAKYLYHNTPKQVFNEDNGYTSALLLTRCITSEIFDVALNLLNRNPRIPLTMKFDGVSPLFALAQQPSAFPSVNPPKLWLQWVYK

SEQ ID NO: 217760 - protein, 506 aa, Glycine max
  Coding DNA Sequence Number=SeqID_100982
  Gene Ontology: Mol. function=RNA-directed DNA polymerase activity; Biological process=RNA-dependent DNA replication
  Homolog annotation: Hit_ID=Q1S7B8; Match level="QueryCoverage=84%, HitCoverage=57%, E-value=1e-74, Identity=36%"; Hit description=RNA -directed DNA polymerase
GKEWLIMEIVKEGNKERCAEEEEVGGLIEEGKDSKKCLQEEFWRLVMYNKSLLRQKTRSKWLRGLNVNESWVEEPIEVKEEVSKALGPNGMDFKFLKEFWHVMKGDIMTFMDNFHRFDILNKGAKASFITVTSKCNDPQGLGDFRPISLVRCMYKVITKLLASRLQKALHKVIDQRQSAFLSGRNILHSVLIANEVMDKARRKNRNCTTFKVDFEKVYDLVCWDFLLYVMGQLGFDAQWIKWIHGCLISSSVSILVNGSPTKEFMLERWLRQGDPLTPFLFLIVVEGLSGLMRETTLRNMFLGYKVGASDVEVNLLQYTIWRFGVVEEGNIERFARPKDHRELGIKDLGFFNVAPLAKWRWNIFHQSGALWVRILEAKYNGFKGLVDGVEKMSNSIWWRDLKIICGDEQETWFDNLVEWSIDDGSSIRFWDDREWFEWERNDVEEFYKLLENINTKGYGKDFSIWNMDPSNNFTVRSTYLALFNLRGRSQLEDTFKLPWSIKIPGK

SEQ ID NO: 217761 - protein, 50 aa, Glycine max
  Coding DNA Sequence Number=SeqID_100983
MDAPNKDFKGDMDLDVRKRDENFYKGVNRTGGKNVDIWDMCGLLDYDSGA

SEQ ID NO: 217762 - protein, 148 aa, Glycine max
  Coding DNA Sequence Number=SeqID_100984
  Gene Ontology: Mol. function=transcription regulator activity; Cellular component=nucleus; Biological process=regulation of transcription
  Homolog annotation: Hit_ID=Q8S3F0; Match level="QueryCoverage=93%, HitCoverage=47%, E-value=2e-22, Identity=41%"; Hit description =Putative bHLH transcription factor
TDKVNVVREAVSYVKQLQERVKELENQKRKESMNSIILNKHRPLSINDQATHGFVDVNEELLEVKVTVLDKEVLIGIYCEKQRQRLLKILSLLDNLHLSITHTSVLPFGTSTLKITIIAQMNNEYNMTIDDLVKTLRQRILKSQDMQK

SEQ ID NO: 217763 - protein, 48 aa, Glycine max
  Coding DNA Sequence Number=SeqID_100985
MSQPHRPPLATDYPFNNSLGRTCPNPLYANNGGFKDGLAFSMGKDTHD

SEQ ID NO: 217764 - protein, 112 aa, Glycine max
  Coding DNA Sequence Number=SeqID_100986
  Homolog annotation: Hit_ID=O22490; Match level="QueryCoverage=32%, HitCoverage=34%, E-value=3e-13, Identity=91%"; Hit description =Cytochrome C
MASFDEAPPGNSKNGEKIFKTKCAQCHTVDKGAGHKQDLRFRCYFYISFYLNLDTSCSKVRELLCIDVEGNIMLVEEKKIGKKNEISFSRVRVDKRKDMGVKIWVCKWTLTN

SEQ ID NO: 217765 - protein, 55 aa, Glycine max
  Coding DNA Sequence Number=SeqID_100987
MKSGYHHYINYLDLWLLFWVGYGGGDGVGVAWVVARRCDGGTLFGERVDVPKSGR

SEQ ID NO: 217766 - protein, 62 aa, Glycine max
  Coding DNA Sequence Number=SeqID_100988
MPCFASMSSSFSGGAGGGDGDSSMSTIGDSVSEGIGSPMTRSKIKRKRIYKTINIHRSLILD

SEQ ID NO: 217767 - protein, 83 aa, Glycine max
  Coding DNA Sequence Number=SeqID_100989
  Homolog annotation: Hit_ID=Q9LV73; Match level="QueryCoverage=51%, HitCoverage=3%, E-value=3e-09, Identity=64%"; Hit description =Arabidopsis thaliana genomic DNA, chromosome 5, P1 clone:MJE7
GGADGGGVRDIDARVPEAVAELPNLKLQQVRKRNELTQLSQALPEIGGSSLRRGFVGGASFELFNDCFNFREATVVSHRVSVE

SEQ ID NO: 217768 - protein, 271 aa, Glycine max
  Coding DNA Sequence Number=SeqID_100990
  Gene Ontology: Mol. function=RNA binding; Biological process =transcription
  Homolog annotation: Hit_ID=Q5VRF7; Match level="QueryCoverage=56%, HitCoverage=63%, E-value=4e-34, Identity=50%"; Hit description=RNA polymerase Rpa43 subunit-like
  Pfam annotation: Domain name=RNA_pol_Rpb7_N; Domain location=10-79; Score=16.8; E_value=0.015; Accession=PF03876.7; Description=RNA polymerase Rpb7, N-terminal domain
MEGLKVSKANLTAYIHPSKTNQVSQPILRQLSSLLFKFSEIFHGVVLAYDLNSLHTCAKILPGVHPYFGVKLKVNLLLFSPKPNMLLEGKVVKVTQESIHVVVLGFSSAIITEKDIREEFVCKTKRGQEVYASRSHKQHVIKVGTMIRFLVKSFDEEILHVYGSLVPDHTGSIYWLDKNLEADSHEQKEEKNCARTNNARARCCGWGTVNLGHCPKEQKIKEAKAPGGILNGMLQHLDVERILHVALEIGCFSGWRGKAKMPWCIFSLGIT

SEQ ID NO: 217769 - protein, 722 aa, Glycine max
  Coding DNA Sequence Number=SeqID_100991
  Gene Ontology: Mol. function=actin binding; Biological process=actin cytoskeleton organization and biogenesis
  Homolog annotation: Hit_ID=Q9SE97; Match level="QueryCoverage=13%, HitCoverage=9%, E-value=5e-31, Identity=69%"; Hit description=Formin- like protein AHF1
MQTFFLYLFLFFLLCALQQLASSQPFFLNRRILHEPFVPLTSTLPPSEAPKPQPLHASPSSQKQKPNPKYPSSTIPTTSTTATAVPTPTTATTTTQSPFFPLYPSSPPPPSPITFASFPANISSLILPHSPKPNSSSNKLLPVALSAVAAAVLAIIISAVVCYRRRRNHPLAAEGKLIRSDTDLRLLRHNAETAVETRKLRHTSSASSEFLYLGTVVNSHVTDDSADVSDARGDRKMKSPELRPLPPLARQASLPPPPPCEEAGFTTAEEEGEDDEEFYSPRGSSLGGSGGTGSGSRRIFAAGGRSVISSSCSSSSSASPERSHSIANSPSASSSSRRTQPKSPENYNHQHVQSSSSPSLGSTPERVFTEHNSNEALSACTHAHASSSSSSLHEGTLEKNENALSSSLPPPPPPPRLSNASSSSSAFSLPSSPEKVTRNNTFDQSPRMSSVSDGLMLPGLSSVPLSPALLSSPETERGTFNGWRTSSFGAAAPQRKQWNLPVLSLTPPFDEIGTVPAPPPLPQRKHWEIPGSGPPPPPPLPRQRKQWGVPALALGSSTPISRPPELLPPSRPFVLQNQGSNVELPASLGEIEETSKPKLKPLHWDKVRTTSDRQMVWDQMKSRSFKLNEKMIETLFVVNTPNPNSVFHQPNQEERVLDPKKSQNISILLKALNVTIEEVCEALLEVIDWYIGPVIKLPLVHIGTLFKEKEKYFSSQFIIKNF

SEQ ID NO: 217770 - protein, 170 aa, Glycine max
  Coding DNA Sequence Number=SeqID_100992
MFEKEVAQVEFAEDGNEDEFVNKVLGRFKDAPNTVICVLDSNSLKVAELLFKNGFTETYAIRGGVRGQQGWMAIQDSLLPPSVHIRKRVKASKKLDTNGNGAIQQNDSNNKSSLSQDISSVENQTTDFGHVKSSVESIPEVKTGSVASSSPYPNYPDLKPPSSPTPSKPQ

SEQ ID NO: 217771 - protein, 668 aa, Glycine max
  Coding DNA Sequence Number=SeqID_100993
  Gene Ontology: Mol. function=binding; Cellular component=membrane
  Homolog annotation: Hit_ID=Q9LV73; Match level="QueryCoverage=99%, HitCoverage=50%, E-value=1e-174, Identity=48%"; Hit description =Arabidopsis thaliana genomic DNA, chromosome 5, P1 clone:MJE7
MAFGKRALSSDGGGEDANGEALESCEKGFGVARTREEKVEIRGLSWKVLRFIAVIHLQKEEFESVIKCVKVLRESADDGDEHPSLSVLAMKAWLGLGRHGEAEKELRGMVIDKGIPEGVWVSAVEAYFAAAGTAGVETVKGVFLGLLGRCHGGWVRGKVVAEFVSDERVVALFAGQEAAKDRLQKLLLINVKSQIQTYSSRTGVFIVESEAVLTEPWTISSRTEYFEPRALVLCLCHLGLLQLDRAQEYINGAEKFKIYLQKNDHQGAINQIEAMTTCLDFQPDFLSLSAHEAVTCHALPVAVASLSSLLNFYASGKSMPTAEVTVVRTLLIVLSQEPGNEQQVVKFLKHALTRASEIGPDCFFGKEEVGRREWNWFAVTLWNFGTKTGQDKNYELSAEFFRLASDFYALVEGSDNENNSMVCKSLVLSVSPMICLEFERKTSMSETEVKQALHLLDRAGQMLKSISARNSVNSDQINTIEPERFFIYTFCAYDIQGRLNNLGSQLLNVKSFASSKACKPHLLLQIGLAASQGPRLNHEVASFALNECLSSFLSSAAPDYQNVALVMRKLISIASIHKGDTDDDLVYSMYKQAYRIMVSLKEDEYPIEEGKWLGMSAWNRAAVPVRLGQIEVGKKWMTVGLDIAKLVPGMEAYKACMEEVLGNLKKEL

SEQ ID NO: 217772 - protein, 90 aa, Glycine max
  Coding DNA Sequence Number=SeqID_100994
MENAAYTHHPFGLEKNDTKTKESNETATIRYFDHLFHLYSHMKLAAANYNPLFPGLSESFALIGPRWYFVRNIPRGTRAWFWEGGSVRRL

SEQ ID NO: 217773 - protein, 266 aa, Glycine max
  Coding DNA Sequence Number=SeqID_100995
  Gene Ontology: Cellular component=membrane; Biological process =hypersensitive response
  Homolog annotation: Hit_ID=Q8GYN5; Match level="QueryCoverage=90%, HitCoverage=100%, E-value=2e-35, Identity=39%"; Hit description=RPM1- interacting protein 4
  Pfam annotation: Domain name=NOI; Domain location=190-263; Score =41.4; E_value=3.1e-09; Accession=PF05627.2; Description=Nitrate -induced NOI protein
MAIHEIHNYIHIPSWLEEHLMQRSHVPKFGNWDSGENVPYTAYFDKARKGRTGARIINPNDPEENADLSLDNPSSDHLPPTRPRANSEDQSGKGSLPLEDDPKHFVDSPARHDNVSSRSGSRSHGVGSAENRRRHSTQSTGSEYSIERSPLHRQARAPGRDSPQWEPKNSYDNSQGTPGRSRLRPVNRGDETPDKGAAVPKFGDWDVNNPSSADGFTHIFNKVREERQGVPGQVPGTPNERPQAIRGQSNDDKVQALSPSGKTSMK

SEQ ID NO: 217774 - protein, 325 aa, Glycine max
  Coding DNA Sequence Number=SeqID_100996
  Gene Ontology: Mol. function=ribonuclease H activity; Biological process=RNA-dependent DNA replication
  Homolog annotation: Hit_ID=Q1SZM6; Match level="QueryCoverage=63%, HitCoverage=82%, E-value=1e-18, Identity=31%"; Hit description =Ribonuclease H
  Subcellular localization annotation: CTP_CleavageSite=55; ConfidenceScore=5.40e-01
MLGTSAMLLDASSNTPLVQKKGIPWSLLFVGFNKTINWSKTSLNRLLDRLLGQARLLLKFAFGWLTKARLPTAGLRGRGSWVWSQKIPENIKCNSSEESIVHMLRIVLKWWEFGVPCGWTNKEVIQNASTNTWVVLHQIHNLFDDVSRAFKYNTMTRTTSQIRWTPPPEGTSKLNADGSSLGTLGSWVSVELSKIIGVDGRLFSKAIFNGLNITWLEEITSLICESDSLSTINMIHDDVGIYHPLYPLVNKIRSFRHLHWSLTFRHLQWSLTFRHYPKEGNQVADGLAKKGSSDGVPFKVWHQCPAGLSPKLMAVPLCISVSFIF

SEQ ID NO: 217775 - protein, 85 aa, Glycine max
  Coding DNA Sequence Number=SeqID_100997
  Gene Ontology: Mol. function=asparagine synthase (glutamine -hydrolyzing) activity; Cellular component=cytosol; Biological process=amino acid biosynthetic process
  Homolog annotation: Hit_ID=P49092; Match level="QueryCoverage=91%, HitCoverage=13%, E-value=2e-40, Identity=96%"; Hit description =Asparagine synthetase [glutamine-hydrolyzing] 1
  Pfam annotation: Domain name=GATase_2; Domain location=6-85; Score= -101.1; E_value=0.0024; Accession=PF00310.11; Description=Glutamine amidotransferases class-II
MVRVNGILKHRGPDWSGLHQHGDCFLAHQRLAIVDPASGDQPLFNEDKSVIVTVNGEIYNHEELRKQLPNHNFRTGSDCDVIAHL

SEQ ID NO: 217776 - protein, 136 aa, Glycine max
  Coding DNA Sequence Number=SeqID_100998
  Homolog annotation: Hit_ID=Q8GSF4; Match level="QueryCoverage=42%, HitCoverage=6%, E-value=2e-09, Identity=56%"; Hit description=SNF2P
MNLSYEQRLQVVARLILDEDSRPGDAPLYQEELGLRVTLKPHQVEGVSWLIRRYKLGVNVVLVFGEEELFIVQCHILMLEYNKAMLLFSCFAFLCNNGSGLGHEVLTWWGLGRVYIRCLTLVMRYTLQFCDRAYVN

SEQ ID NO: 217777 - protein, 453 aa, Glycine max
  Coding DNA Sequence Number=SeqID_100999
  Gene Ontology: Mol. function=transferase activity, transferring glycosyl groups; Cellular component=cytoplasm; Biological process =metabolic process
  Homolog annotation: Hit_ID=Q9M6E7; Match level="QueryCoverage=98%, HitCoverage=97%, E-value=1e-132, Identity=51%"; Hit description=UDP -glucose:salicylic acid glucosyltransferase
  Pfam annotation: Domain name=Glyco_tran_28_C; Domain location=265 -419; Score=-29.1; E_value=0.1; Accession=PF04101.6; Description =Glycosyltransferase family 28 C-terminal domain
  Pfam annotation: Domain name=UDPGT; Domain location=4-448; Score= -48.9; E_value=3.7e-08; Accession=PF00201.9; Description=UDP -glucoronosyl and UDP-glucosyl transferase
  Pfam module annotation: Pfam domain module=Glyco_tran_28_C::UDPGT; Domain location=265-419::4-448
MVHCVILPYPAQGHINPIHQFSKLLQREGVRITLVTTLSYCKNLQNAPASIALETISDGFDNGGVAEAGNWKVYMERFWQVGPKTLAELLEKLDRSGDPVDCVIYDSFFPWVLEVAKGFGIVGVVFLTQNMSVNSIYYHVQQGKLRVPLTENEISLPFLPKLHHKDMPSFFFPTDVDNSVLLDLVVGQFSNIDKADWIMCNSFYELEKEVTDWTEMIWPKFRAIGPCITSMILNKGLTDDEDDGVTQFKSEECMKWLDDKPKQSVVYVSFGSMAILNEEQIKELAYGLSDSEIYFLWVLRASEETKLPKDFEKKSEKGLVVGWCSQLKVLAHEAIGCFVTHCGWNSTLEAMSLGVPMVAMPYWSDQSTNAKQIVDVLKIGIRTTVDEKKIVRGEVLKCCIMEIMKSERGKEVKSNMERWKALAARAVSEEGSSRKNIAEFVNSLFNLQQGIAN

SEQ ID NO: 217778 - protein, 374 aa, Glycine max
  Coding DNA Sequence Number=SeqID_101000
  Gene Ontology: Mol. function=transferase activity, transferring glycosyl groups; Cellular component=cytoplasm; Biological process =metabolic process
  Homolog annotation: Hit_ID=Q8S9A2; Match level="QueryCoverage=60%, HitCoverage=81%, E-value=6e-74, Identity=60%"; Hit description =Glucosyltransferase-7
  Pfam annotation: Domain name=UDPGT; Domain location=4-363; Score= -129.4; E_value=0.00042; Accession=PF00201.9; Description=UDP -glucoronosyl and UDP-glucosyl transferase
  Subcellular localization annotation: CTP_CleavageSite=31; ConfidenceScore=5.06e-01
MVHCVVLAYPAQGHINPMHHFSKLLQQQGVKVTLVTTFSYCKSLQNIPSSIALKSISDGFDNSGLAEAGNWKVYLERFWQVGPKTLAELLEKHDRSGNPVHCVVYNSFFPWVLEVAKRFAIAGASFLTQNMSVNIGPCITSMILNTRLADDDDEEDDGLTQFNNEECMKWLDDKPKQSVVYVSFGSMAVLDEEQIREIAYVLRDSDQSYFLWVVKASEETKLPKDFEKKSEKGLVVGWCSQLKVLAHEAVGCFVTHWGWNSTLEALSLGVPMVAMPYWFDQSINAKLIVDVWKMGIRATVDEQKIVRGEVLKYCIMEKMNSEKGKEVKGNMVQWKALAARFVSKEGSSHKNIAEFVNSLFNLQAACRELQNNSC

SEQ ID NO: 217779 - protein, 404 aa, Glycine max
  Coding DNA Sequence Number=SeqID_101001
  Gene Ontology: Mol. function=nucleic acid binding; Cellular component= mitochondrion; Biological process=DNA integration
MQQPPGFSSQDKSLVCKLDKALYGLKQAPRQWFERLQSTLLHYGFHTSKCDPSLFILKKDRNVVYLLVYVDDINIIGSSNYLIKSLVSHLNSTFALKQLGQLDYFLGIEVHHTPTGSVLLTQSKYIHDLLHKTDMAEAKPISSPMVTNLKLSKTGNDLPPRSTMYRSVVGALQYATITRPEISFSVNKVCQFMSKPLESHWTAVKQILKYLKGTLHVGHRFVPASLHQPLSLHAFCDADWAADLDGQRSTSDDIVITGDDHRGVRDLKNHLSQHFQTKDLGQLKYLLGIEPVDTPMDPNTKLIPDQGEPFSDPGRYRRLVGKLIYLTMIRPDNLCSQCWSPGKWIVYENRGHLDIVAYTDADWAGSPSGRRSTSGYCVLIGGNLISWKSKKQNNVARFCAEAEY

SEQ ID NO: 217780 - protein, 128 aa, Glycine max
  Coding DNA Sequence Number=SeqID_101002
  Subcellular localization annotation: CTP_CleavageSite=37; ConfidenceScore=5.01e-01
MALESKLNNISPYQQCVGGSHNRGSGSRVEGRHEKCRSQTRPNNTKWGRTTPNCGQTTPNGAKQKKLSLSVKHEPNGSKQACEFQVLECDDVWGLNINKVDDVGFIGGRRFTILLSKITLRLQAYLTL

SEQ ID NO: 217781 - protein, 435 aa, Glycine max
  Coding DNA Sequence Number=SeqID_101003
  Gene Ontology: Mol. function=nucleic acid binding; Cellular component= mating-type region heterochromatin; Biological process=chromatin silencing at silent mating-type cassette
  Homolog annotation: Hit_ID=Q8GZN6; Match level="QueryCoverage=80%, HitCoverage=39%, E-value=2e-79, Identity=48%"; Hit description=SNF2P
  Pfam annotation: Domain name=Helicase_C; Domain location=109-199; Score=76.7; E_value=7.5e-20; Accession=PF00271.21; Description =Helicase conserved C-terminal domain
MKLGGELLNQNIGGTSNNIVIYINKNVDDMSFVFINKQRRVTLAKRDEREGKREKQGVGEREIPSKLRKEWASGKLLILDQLLQKLHYSGHRVLLFAQMTHTLDILQDFLELRKYSYERLDGSIRAEERFAAIRSFSSSSANMGLNSEADQNEAFVFIISTRAGGVGLNLVAADTVIFYEQDWNPQVDKQALQRAHRIGQMNHVLCINLVTERTVEEVIMRRAERKLLLSLNVIGDNILKDDNKEPSEVGSGDLKSIIFGLHMFDPTEINDGNHRNMNIPEICAMADRVLAMRDEQILDNDERKFEVNPTNILKGDAVKERDSASLSCDLGLDEASYLSWVKKFEEVSKSSCDSITDLRSRRNVDEEKSLKIESARKKAEEKKLARWEALGYQSLNVKDAISPTGNDIASASGSVHFVYGDSFALMHQAFAHLNQ

SEQ ID NO: 217782 - protein, 412 aa, Glycine max
  Coding DNA Sequence Number=SeqID_101004
  Gene Ontology: Mol. function=nucleic acid binding; Biological process= DNA integration
  Homolog annotation: Hit_ID=Q0KIN0; Match level="QueryCoverage=51%, HitCoverage=25%, E-value=1e-19, Identity=47%"; Hit description =Integrase core domain containing protein
MASAYPSATHVNIDTSVVPTDEAPTGKIPANIRARHESRELYQLSPPVTCVSTISPELAHQHLNHPSLDKLRPLTPNFAHEIHDQFGVSIETLRTDNAHEYLSSHVFGSTCYVHDLTPSKDKLPTRSLKCLFLGYSRLQKASSVAPNIPPPALLVPNLPIAYRKEDTLRFLVLTTRTPFPRWPKSLLCVSFLLWLPFNIDLFTSWTSKMPYMSCKKFIWINIQILQFKFGMTHCEPDLSVFFIHFPFGHCIYLVVYIDDIVIARNDSKAILCLKSHLHSQFQTTKDMGMHDCRPSDTPMELIQPMLKLFVTLMLIGGNLISWRSKKQKTVARSNVEAEYHAMAAAPSERSHGLGCSPHCFKPGRSFMSEQNTKIDYHFVQDNIFSREITIEFVNSKRSTSRHAHKIPQGLSC

SEQ ID NO: 217783 - protein, 238 aa, Glycine max
  Coding DNA Sequence Number=SeqID_101005
  Gene Ontology: Mol. function=intracellular transporter activity; Cellular component=intracellular; Biological process=ER to Golgi vesicle-mediated transport
  Homolog annotation: Hit_ID=Q9SKS7; Match level="QueryCoverage=72%, HitCoverage=100%, E-value=8e-58, Identity=75%"; Hit description =Expressed protein
  Pfam annotation: Domain name=Sedlin_N; Domain location=91-231; Score =160.9; E_value=3.4e-45; Accession=PF04628.3; Description=Sedlin, N -terminal conserved region
MKILLVWIICILDPCTPEHFLLRRVASSSYEPFHSLHRFGGCGCCETELDPDRCRHTAGEQDDRLRRRRRSPGESPSLPAPDFNVRRKSPNNPLYIQSFTEADDALKLHHIVHCSLDVVDERVNNPKKSGPMLNETFLGLLYPIENYKVYGYLTNTKVKFILVTTDLDVKDADVRNNYAFFLRPVPLSSWVQFFRRFHSAYVDAVSNPFHVPGKKITSRTFAERVSTIVKSFGLSSAG

SEQ ID NO: 217784 - protein, 131 aa, Glycine max
  Coding DNA Sequence Number=SeqID_101006
  Homolog annotation: Hit_ID=Q5XM22; Match level="QueryCoverage=41%, HitCoverage=31%, E-value=1e-11, Identity=54%"; Hit description =Resistance-like protein HAAS-2
MLLQRGSIRTLAVYIFPSLLHLSIIGTFHTFDALHVDQVEELLVDLLEVSSQEARDETFQCHGTYVQLSWLRDIYRNKCDVGQWVVATQAYLLHLVGCALFANKSAIHMHVCWIYEHFPIVASVIVVEDYH

SEQ ID NO: 217785 - protein, 276 aa, Glycine max
  Coding DNA Sequence Number=SeqID_101007
  Homolog annotation: Hit_ID=Q6YTS9; Match level="QueryCoverage=37%, HitCoverage=28%, E-value=4e-14, Identity=40%"; Hit description =Proline-rich protein family-like
MVLLLWHAGRDPDPKSGSGARTSRIESVVVLVELVEAPGVGSGGVFEFLVQIVVVDVVIVEIVVDVKVVVGVRFVVGAFFHGVHGFEVEPGGRGIGAGVVEAGKGEVAEALDFGAVPFAELLHLVAALHGGFGRGGGVGALRRDGVGHLLPMGGLEVGAAEGVPFVAVGVDEGGGFLGGPAGRRETAGGGGGRGRDREGEGRGRVGVGGGRRGGHGWREKRKVTHRQGWVTEFANNNIFNGVVARRRGTKGAAIISGGQTQRDPIKQGQWARNISS

SEQ ID NO: 217786 - protein, 85 aa, Glycine max
  Coding DNA Sequence Number=SeqID_101008
  Gene Ontology: Mol. function=zinc ion binding; Cellular component =nucleus; Biological process=ubiquitin cycle
  Homolog annotation: Hit_ID=A0ELV2; Match level="QueryCoverage=70%, HitCoverage=52%, E-value=1e-23, Identity=80%"; Hit description=RBX1 -like protein
MATLDFDVPMVPTGEPSSNVGPSSKKPKHFEIKKWNVVTLWAWDIVVDNCAICWNHIMDLCCYWAMVAAIVSVILLSKANGVIHY

SEQ ID NO: 217787 - protein, 104 aa, Glycine max
  Coding DNA Sequence Number=SeqID_101009
  Subcellular localization annotation: CTP_CleavageSite=46; ConfidenceScore=5.04e-01
MGSFLNNFCHGAVFYVVCMQNACKTQAPLATSWALDTWKANPPLLLATSRGSASRQGYEARVQDARKPFSRELQTEVAEQGIANSTCDFGEVLKPPTAPAIWFR

SEQ ID NO: 217788 - protein, 128 aa, Glycine max
  Coding DNA Sequence Number=SeqID_101010
  Gene Ontology: Biological process=protein folding
  Homolog annotation: Hit_ID=Q10T60; Match level="QueryCoverage=93%, HitCoverage=35%, E-value=2e-22, Identity=43%"; Hit description =Expressed protein
MGRRQNDSDFGRFAILVLFLIGAISCSVIYLFLTVVFSPSPESLPSVDDHVVGVAEEEQCCRGIEHLELWGDAVKWGSEFRLNSSEECCMACKRMCSGDGGPCMCNSWVYCGDREACGPRFGEDIQQC

SEQ ID NO: 217789 - protein, 705 aa, Glycine max
  Coding DNA Sequence Number=SeqID_101011
  Gene Ontology: Mol. function=nucleic acid binding
  Homolog annotation: Hit_ID=Q6YH14; Match level="QueryCoverage=41%, HitCoverage=85%, E-value=1e-123, Identity=75%"; Hit description =Putative heterogeneous nuclear ribonucleoprotein
  Pfam annotation: Domain name=RRM_1; Domain location=121-192; Score =94.0; E_value=4.6e-25; Accession=PF00076.12; Description=RNA recognition motif. (a.k.a. RRM, R
  Pfam annotation: Domain name=RRM_1; Domain location=201-278; Score =24.4; E_value=0.0004; Accession=PF00076.12; Description=RNA recognition motif. (a.k.a. RRM, R
  Pfam annotation: Domain name=RRM_1; Domain location=298-371; Score =36.5; E_value=9.5e-08; Accession=PF00076.12; Description=RNA recognition motif. (a.k.a. RRM, R
  Pfam module annotation: Pfam domain module=RRM_1::RRM_1::RRM_1; Domain location=121-192::201-278::298-371
NEEEIKESIDEYEKDEHLDFEDNYPEYEAEEYGGVDYDEKEIEQDEGQEEGDEVEEDPEEIVGEEEGDTGDEEVEYVYEEVEDDDDEHAGEEHEHAQMPDVEQEEHREVVKERRKRKEFEVFVGGLDKDATEHDLKKVFGKVGVVTEVRLMINPQTKRNKGFAFLRFETVEQARRAVVELKNPVINGKRCGVTPSQDSDTLYLGNICKTWKKEALKEKLKHYGVEDVEDLTLIEDDTNEGMNRGFAFLEFSSRSDAKEAYKRLQKRDVAFGVDKPAKVSFADSFIDLGDEIMAQVKTVFIDSLPPSWNEDYVRDLLKKYGEIEKVELAKDMPAARRKNYGFVTFSTHVAAVECADSITSAGLGEGDKKAKVRARLSRPLSKPLQRGRGKYVNHGDFRSGRNSGRLVRSSRSQPAPRSLPAHVVRGVGSRVPPVRPISVRNRRPVTPMLVRARPVAPPARSYDRRLAAPAYPKSGMKRDYSRRVDLPPPRSRVATDYGSRVASQRHSSYRDYPARGSDYPELHRRSTSRGAPKRGYVDDGYGQRFERAPPSPPPPHLSYHEGRPRDYDSLSGSKRPYTAIDDVPPRYDTGARQSRSRLDYDYGGSASQYGDAYGDRLGRSSLGYSGSRNSISNQDLHGTYGSRQGMSYGGGSFGGSDGGMYSSSYGGDYASRGSDVGGRSYSSMYSGRGVGGSSNYMGSGGSGSYY

SEQ ID NO: 217790 - protein, 236 aa, Glycine max
  Coding DNA Sequence Number=SeqID_101012
  Gene Ontology: Cellular component=extracellular region; Biological process=sexual reproduction
  Homolog annotation: Hit_ID=Q850K7; Match level="QueryCoverage=90%, HitCoverage=83%, E-value=4e-84, Identity=69%"; Hit description =Expansin-like B1 precursor
  Pfam annotation: Domain name=DPBB_1; Domain location=44-122; Score =82.2; E_value=1.6e-21; Accession=PF03330.8; Description=Rare lipoprotein A (RlpA)-like double
  Pfam annotation: Domain name=Pollen_allerg_1; Domain location=134 -214; Score=35.3; E_value=2.2e-07; Accession=PF01357.11; Description =Pollen allergen
  Pfam module annotation: Pfam domain module=DPBB_1::Pollen_allerg_1; Domain location=44-122::134-214
MALYLFCLLLAITFIFMQTLADTSCTDFGACGFGSFGATVNGGDVSAASSLYRNGVGCGACYQVRCTNSVYCSENGVTAVITDQGSSDNTDFILSKHAFSRMAQTTDAAASLLALGVVDIEYRRVACSYPDKNITIKIDESSNNPYYLAFVIWYQQGRRDITAVQLCETQNFVCQLLDRSHGAVWTTTSPPSGPLSLRMLFSDEEEGEETWVVPVNNIPGDWKAGETYDSGVQVNQ

SEQ ID NO: 217791 - protein, 113 aa, Glycine max
  Coding DNA Sequence Number=SeqID_101013
  Gene Ontology: Mol. function=nucleotide binding; Cellular component =membrane; Biological process=small GTPase mediated signal transduction
  Homolog annotation: Hit_ID=Q40525; Match level="QueryCoverage=84%, HitCoverage=46%, E-value=1e-41, Identity=89%"; Hit description=Nt -rab6 protein
  Pfam annotation: Domain name=Ras; Domain location=1-79; Score=-13.6; E_value=3e-08; Accession=PF00071.12; Description=Ras family
RQTFLNTSKWIEEVRSERGSDVIIVLVGNKTDLVDKRQVSTEEGEAKSRELNVMFIEASAKAGFNIKALFRKIAAALPGMETLSSTKQEDMVDVNLRSSGGYQSQPQSGGCAC

SEQ ID NO: 217792 - protein, 369 aa, Glycine max
  Coding DNA Sequence Number=SeqID_101014
  Gene Ontology: Mol. function=GTP binding; Cellular component =intracellular; Biological process=sporulation
  Homolog annotation: Hit_ID=UPI0000162CAC; Match level="QueryCoverage =92%, HitCoverage=45%, E-value=2e-81, Identity=51%"; Hit description =GTP binding
  Pfam annotation: Domain name=Arf; Domain location=177-349; Score= -94.8; E_value=0.019; Accession=PF00025.11; Description=ADP -ribosylation factor family
  Pfam annotation: Domain name=GTP1_OBG; Domain location=38-189; Score=- 109.3; E_value=0.098; Accession=PF01018.12; Description=GTP1OBG family
  Pfam annotation: Domain name=MMR_HSR1; Domain location=191-320; Score= 132.2; E_value=1.4e-36; Accession=PF01926.13; Description=GTPase of unknown function
  Pfam module annotation: Pfam domain module=Arf::GTP1_OBG::MMR_HSR1; Domain location=177-349::38-189::191-320
MEAFTQRFISRWSVTLYARYSDTPQKKSKLAPLQERRMMDQCKIFAKAGDGGNGCSSLRKGRPYDPWDIPGALVDDFPNPGNGSTSGVTSGEVKAMHSTGCSSSQDEETDVKKSEKSRQVALTNVFSQLSTSNGAPEFGTEDIGGKQEILYNVAELTEEGQQIVIARGGEGGLGNMLVSKIQGSLTQKSIADVSFVGMPNAGKSTLLGAISRAKPAVGDYAFTTLRPNLGNLNYDDLSITVADIPGLIKGAHQNRGLGHAFLRHIERTKVLAYVVDLAATLNGRKGIPPWEQLRDLILELEYHQDGLSKRPSLIVANKTDEEGAEEVYKELKRRVQGVPIFPVCFSLYLSFVVHKETVKPVVFQSNKGS

SEQ ID NO: 217793 - protein, 36 aa, Glycine max
  Coding DNA Sequence Number=SeqID_101015
MAPLGKVQAGVLGRSVMTNLTTLIRAKKMTTNAAPH

SEQ ID NO: 217794 - protein, 214 aa, Glycine max
  Coding DNA Sequence Number=SeqID_101016
  Gene Ontology: Mol. function=DNA binding; Cellular component=nucleus; Biological process=regulation of transcription
  Homolog annotation: Hit_ID=Q2HTW0; Match level="QueryCoverage=97%, HitCoverage=38%, E-value=1e-72, Identity=76%"; Hit description=Myb, DNA-binding
  Pfam annotation: Domain name=Myb_DNA-binding; Domain location=20-66; Score=49.6; E_value=1.1e-11; Accession=PF00249.21; Description=Myb -like DNA-binding domain
  Pfam annotation: Domain name=Myb_DNA-binding; Domain location=72-117; Score=44.6; E_value=3.5e-10; Accession=PF00249.21; Description=Myb -like DNA-binding domain
  Pfam module annotation: Pfam domain module=Myb_DNA-binding::Myb_DNA -binding; Domain location=20-66::72-117
MVQDMKQQDNGESKKKERHIVTWTQEEDDILREQIGIHGTENWAIIASKFKDKTTRQCRRRWYTYLNSDFKKGGWSAEEDMLLCEAQKVFGNRWTEIAKVVSGRTDNAVKNRFSTLCRKKQKYAALAKENSTSYINSNNKRMMLQHCNNMDTTSESGVPIKNLRYCILYVSKYTNSTKRSANILSYWNIGGPILLMMQKRSNLRTDHIYEMELQ

SEQ ID NO: 217795 - protein, 196 aa, Glycine max
  Coding DNA Sequence Number=SeqID_101017
  Gene Ontology: Mol. function=DNA binding; Cellular component=nucleus; Biological process=regulation of transcription
  Homolog annotation: Hit_ID=Q2HTW0; Match level="QueryCoverage=99%, HitCoverage=18%, E-value=1e-21, Identity=56%"; Hit description=Myb, DNA-binding
VLQEFLNRSKESDIPGQKVPDVRLVDLKDMIEELKSGNEEGRVLQELLNRTKESDSTGHKIPDLRPADFKDMVEDSKSGNEEGQVLQEFLNRTNKSDIPEHKIPNLQLVDLKDMIEDLKSGNEEGQACWRYFKFFKAITSLVASVKCLIISEYVLGKWTVMKTLQAVLDTVQDQFSSVSQLVIIWSTHCIRILEPK

SEQ ID NO: 217796 - protein, 56 aa, Glycine max
  Coding DNA Sequence Number=SeqID_101018
  Gene Ontology: Mol. function=nucleotide binding; Cellular component =membrane; Biological process=small GTPase mediated signal transduction
  Homolog annotation: Hit_ID=Q40525; Match level="QueryCoverage=68%, HitCoverage=18%, E-value=9e-14, Identity=97%"; Hit description=Nt -rab6 protein
MASVSALAKYKLVFLGDQSVGKTSIITRFMYDKFDNTYQGNKMTTNAALLTIMNHD

SEQ ID NO: 217797 - protein, 247 aa, Glycine max
  Coding DNA Sequence Number=SeqID_101019
MEFRARKSTQNQLSSFFLTKSIGEENELWLNLINPTLSVSSTWWRKKSRGLENGRILLEERSDGRDRVSEGRSNRGASSTLVGASALSAIEAEGVGPNEMLVKEWEVWDGCLRPPQSTRRYAPYNGGGLANMRDGGGGNISRAGDGIWCGVGTLDGSSDDGLRVYPPSCPGRKEVAPEHPLELAQHRTIHVEQCDGDGYGDYGRVWVVVVMVESIEAEGSGVALVKVTWFWVSRSTSSSSQSVTIFE

SEQ ID NO: 217798 - protein, 73 aa, Glycine max
  Coding DNA Sequence Number=SeqID_101020
MSLLQVAVSNDTILPCPIVTYYNALTMQFRHLGTSIALKADAPTSPEDAFPHQVKSLLLTQFASTFYHIVINP

SEQ ID NO: 217799 - protein, 79 aa, Glycine max
  Coding DNA Sequence Number=SeqID_101021
  Gene Ontology: Mol. function=DNA binding; Cellular component=nucleus; Biological process=regulation of transcription
  Homolog annotation: Hit_ID=Q2HTW0; Match level="QueryCoverage=96%, HitCoverage=15%, E-value=1e-10, Identity=74%"; Hit description=Myb, DNA-binding
MTGLFLPHQDWSSAPLFKQSLPNIDDAPKKEVNEEEDEPVCNQERNFLRKTLGMESPSINPSANSSQPPPCKRALLPSL

SEQ ID NO: 217800 - protein, 86 aa, Glycine max
  Coding DNA Sequence Number=SeqID_101022
  Gene Ontology: Mol. function=RNA-directed DNA polymerase activity; Cellular component=mitochondrion; Biological process=RNA-dependent DNA replication
MMIGQFFLNESKCLFTQRCLEYLGHIVSGNGVAPEPSKIQAMVDWPMPTTIKSLHGFLGLTGFYRKLIRVTLEGQLPLEQCNSTSI

SEQ ID NO: 217801 - protein, 196 aa, Glycine max
  Coding DNA Sequence Number=SeqID_101023
  Homolog annotation: Hit_ID=Q1SAV4; Match level="QueryCoverage=28%, HitCoverage=14%, E-value=6e-13, Identity=62%"; Hit description =Integrase, catalytic region
  Subcellular localization annotation: CTP_CleavageSite=26; ConfidenceScore=5.01e-01
MSLFQGFFKGNVKTSNNGSQQAKATRGGHRWSVVVEEEPPTHAQAKFGSLGRVDPTQILLLRLKTHISFSRCYIENPNGQNVKSGVASRKALHPPPLLDLSSPTRSRPSLLSSTNIPPFSRPLPFLLHPETSHIKYTYSSKVASLFMEMVCKLDDFPCSLVSNHDPIFISRFWQEVCKMNGTKLRMSTSYHLKTDG

SEQ ID NO: 217802 - protein, 99 aa, Glycine max
  Coding DNA Sequence Number=SeqID_101024
MKGLMVEERRAYPYNQQLLGTDAKDTKPFADLAFLVERVNMVVHNNADYVIHLSYSSLPCASRNSKLSARYHRPPLTCYVPWRFTSHSVVMRTFMRILD

SEQ ID NO: 217803 - protein, 125 aa, Glycine max
  Coding DNA Sequence Number=SeqID_101025
MGPAHEFGTVSPPPPPSSTHNIDTKRNKKDEKASIAENGAELANDAFNTQQKGEKAPECEKLGTHFRSFCPTEWLRVLSNKLEIAEWDKLKKEKRGYSLQSIVMHNNSIVMHPPRTSYNLCFDPR

SEQ ID NO: 217804 - protein, 385 aa, Glycine max
  Coding DNA Sequence Number=SeqID_101026
MDERFPMLGVAASVKLFGMDMSLILQAKSDMSSVCGACIVLLHTCHSLSGYVLETWFVCKWGCIAVQNFRAQLQLPPVTEESFPLVVSSSKDTHRGASDNKSSSSEKEPALVIVIFPPYTSRGVRRGSGGGDVKASHPRRRSHCAGSPSSALMKLTSLEDSYKIVIQACGSDGFPFLRAAPGSPPFFFMYRCLFEVLGLALPLTIFQCALVEHLNCVGLLVFLPNEIDGKDWLDLLERVSNKFFDFDSNVFFHFKDGFFKVLDMGVVVDCLPLMLNKDGEPRFSFYWQADPIKFKCFDEDLLTFMERVNKAIMEQLSTSLDARAILSLSSMSDPLAAFDNKCSAMSCFLMPLMKKVGPTSGTIPPFATALVEGRHPVIEVGPIVV

SEQ ID NO: 217805 - protein, 58 aa, Glycine max
  Coding DNA Sequence Number=SeqID_101027
MFNNCSTALKLRDIEEPNEEQDQISKEKEKLTFTNTFTNTCKSRQLKGTRPRSRWCES

SEQ ID NO: 217806 - protein, 187 aa, Glycine max
  Coding DNA Sequence Number=SeqID_101028
HELLEDSLCSMLPAHRRMTVADILLIENFRKVGIRPPPILGAFANSSGGYDKIGCNDELLEELLADYDVPKFEELWMHMLNQFELQENKWMKELYEKKKMEIEADFDSDYGVVTLQSGLHSLERSASKVFTKTIFHMFRCMLIRAPTVMRLAEVAHRHDDDYNHIVDLLAAELKKLRVKHGNQSVAE

SEQ ID NO: 217807 - protein, 63 aa, Glycine max
  Coding DNA Sequence Number=SeqID_101029
MIPLTKTLKILVLLEQRVVVQQAMVDQAEARETTVVANLQVETVHGSANGAVEDNVQATSLGQ

SEQ ID NO: 217808 - protein, 487 aa, Glycine max
  Coding DNA Sequence Number=SeqID_101030
  Gene Ontology: Mol. function=histone-lysine N-methyltransferase activity; Cellular component=nucleus; Biological process=chromatin modification
  Homolog annotation: Hit_ID=Q8VZ17; Match level="QueryCoverage=53%, HitCoverage=32%, E-value=1e-63, Identity=53%"; Hit description =Histone-lysine N-methyltransferase, H3 lysine-9 specific SUVH6 (EC 2.1.1.43) (Histone ...
  Homolog annotation: Hit description=H3-K9 methyltransferase 6) (H3-K9- HMTase 6) (Suppressor of variegation 3-9 homolog protein 6) (Su(var)3- 9 homolog protein 6)
  Pfam annotation: Domain name=YDG_SRA; Domain location=310-462; Score =272.5; E_value=8.2e-79; Accession=PF02182.8; Description=YDGSRA domain
MTILLAVRDFPDGCGGFPKCVGTIVELEDTNKNAQHLARRYLPPRKASAVRDFLPLFGGCNDNGKKVGLQNPSVDDNPLKNVAAAADDVKEVKSNIQDDYGRKRKLVDIYQTDSEKNVAERVKKLHAFEEPSSSQMKIVLGLMAKSACPWSSGKGSSNLKLGDAKNGDESKKVFSFALPDRSRRAIKTKGLLGQKPLKKKGNASASQGTGELEIWEKEDRLDPGEISEDLQIFLKSHKFGVNVTPSSHSNFIGNENDRKKVRETLQLFQVVSRKLLEEGESKSNELGKRKRVDLIAARILKDNGNHVNSGKKILGPVPGVEVGDEFQYRVELNIIGLHRQIQGGIDYVKHNGKILATSIVASGGYADYLVNSDILVYTGQGGNVMSNDRKPEDQKLERGNLALKNSSEEKNPVRVIRGSEAMDDKYKTYVYDGLYVVETYWQDRGSHGKLVYRFRLQRIPGQKLALKEVKKSKYFKTNFHMCCEHHR

SEQ ID NO: 217809 - protein, 210 aa, Glycine max
  Coding DNA Sequence Number=SeqID_101031
MSPYYLGGSGLLIKGVFGITITNLACYLGCRSSEDTNKCHAKAKFDVVVANGADRIKIPRDFFRKWGKKLHKKVIIDDGCGNFSSADIVVENHKAKKAAFFVNGVKDIVQIYYKHGSCLVYSQRQNSAKGPSTTHPLPGPLKGATTIIGWEKLMTYAIVNSSQALHIPADRRNEEFYPHPRKVEVQKLVEGDVVQFMKARNEDEICVSVT

SEQ ID NO: 217810 - protein, 82 aa, Glycine max
  Coding DNA Sequence Number=SeqID_101032
MVQAIEESFEPESKVEVGEVVVVRGSSGGLVEAKAKLLGFGRGVVFFDNCLRLVVATLTQVERVVVILDCEIAFMAPIVKAW

SEQ ID NO: 217811 - protein, 273 aa, Glycine max
  Coding DNA Sequence Number=SeqID_101033
  Homolog annotation: Hit_ID=Q1SPJ4; Match level="QueryCoverage=64%, HitCoverage=12%, E-value=3e-20, Identity=34%"; Hit description =Thiolase
MEVVMQFVVMHWNLWCCILLGYLQISCISLSSGHHLNRSTGLENWLGYSGSLVGDDSLLYDSAFVETSTSSFPLNESVSCEDLEGVGSFNTTCLLSSTHYLKSDIYIYGVGNLEILSDVSLLCPMEGCMITVNVSGNVKLGQDASIVSGSVVLSAANLTMGYNSYIDSSSLGGSPPSLTSGTPGATMELVEGMTNWGGDVYAWSTLSEPWSYGSKGGGKSTKKQYGGNGGGRVKLLVKDTLYVNGSITAKGGDGGSDGGGGSGGSILVHAVKL

SEQ ID NO: 217812 - protein, 88 aa, Glycine max
  Coding DNA Sequence Number=SeqID_101034
MDIPQHIVPYLKKAYDDLQEPLTKFLRDANLIGSYATLHHMFRYVETLKGAQVFAPKSCMEIECESLKLLESICGKLVISVGLLPPSL

SEQ ID NO: 217813 - protein, 382 aa, Glycine max
  Coding DNA Sequence Number=SeqID_101035
  Gene Ontology: Mol. function=RNA-directed DNA polymerase activity; Cellular component=chromatin; Biological process=chromatin assembly or disassembly
MEVNMSALENEVATLKLTLAEMKAQEATDQERLVSLLTQTKNDTHSEKLVKKDGAEDDTGSSDSIVVKQLLQKLQGNTLDEFRQLVKKVELPMFNGDNPTGWIARAEVYFRVQGTQEELKVSLAQLCMDGPTIYFFKGFTDDDENMPWEKLKDALLERYGGLGDVSVFEQLSVLHQEGSVEEYIQEFERLVAQVPWLPDEQYLGHFIHGLREGIRGRVLGYLGVMGQETRAFTTGLVRLQVMGHTTRVTPTIVIGSMSGALEKVRIREFRAKGRWRQAPLLPATYGETKEGPVLLFALSTSVPICTSSIKRARRDNILAGQAGCVLGEHISGLSSSRVSDVSSIGACRPRIFFIKGLLCFLEDEWQRNGEGRERGNATSRRR

SEQ ID NO: 217814 - protein, 77 aa, Glycine max
  Coding DNA Sequence Number=SeqID_101036
MSEEVDMNEQNKNEAGVNEKHVDYSDAFNTSQVLAARDDVLYWVRSVAYEIGFVAAIMRSDKNSGIRGRTSFVLTGY

SEQ ID NO: 217815 - protein, 46 aa, Glycine max
  Coding DNA Sequence Number=SeqID_101037
MKEGHIPFELGAMFGHNTSNAVDEGSRQDGPTPRGESSLDSNFLAT

SEQ ID NO: 217816 - protein, 74 aa, Glycine max
  Coding DNA Sequence Number=SeqID_101038
MACDILLQETMEHFATIDLIEQCKEAKVDIISNDFSAELPFRLKQPMVKAAVQVTDLPNDNTIVVEEHYNEIAC

SEQ ID NO: 217817 - protein, 59 aa, Glycine max
  Coding DNA Sequence Number=SeqID_101039
FLEILQAFPLVALLGFSSIREKKNGLVPQFQCLCARNISLAIDIISKILTVGMCGTEFR

SEQ ID NO: 217818 - protein, 281 aa, Glycine max
  Coding DNA Sequence Number=SeqID_101040
  Gene Ontology: Mol. function=nucleoside-triphosphatase activity; Cellular component=mitochondrion; Biological process=ATP-dependent proteolysis
  Homolog annotation: Hit_ID=P93647; Match level="QueryCoverage=95%, HitCoverage=31%, E-value=1e-112, Identity=76%"; Hit description=Lon protease homolog 1, mitochondrial precursor
MAESFELPNRLAILPFRNKVLLPGAIIRIRCTSPISVKLVEQELWQREEKGLIGILPVRDAAAEIQPAGPVISHGKGTDSLDQNSKVQGGSSDSQKLDVKNQHDVVHWHNRGVAARALHLSRGVEKPSGRVTYIVVLEGLCRFSVQELSTRGTYHTARISSLEMTKTEMEQVEQDPDFITLSRQFKATAMELISVLEQTVPVHKLADIFVASFEISFEEQLSMLDSVDPKVRLSKATELVDRHLQSILVAEKITQKVEGQLSKSQKEFLLRQQVSFLAPSF

SEQ ID NO: 217819 - protein, 120 aa, Glycine max
  Coding DNA Sequence Number=SeqID_101041
MKWGREDLCSCNSGKWWGPVWTEQHMSLSCLSNCGVKGKSWDPNSRSARKSNGQSHRLIYSSFPGASSLSGGPGGKDYDSSPSTIINVTMTLDTNYLRDTMDAEEDVDLVLNSEGAEEEE

SEQ ID NO: 217820 - protein, 149 aa, Glycine max
  Coding DNA Sequence Number=SeqID_101042
  Homolog annotation: Hit_ID=Q9FGQ9; Match level="QueryCoverage=92%, HitCoverage=88%, E-value=8e-31, Identity=50%"; Hit description =Arabidopsis thaliana genomic DNA, chromosome 5, TAC clone:K14A3
  Pfam annotation: Domain name=DUF581; Domain location=59-110; Score =70.7; E_value=4.7e-18; Accession=PF04570.5; Description=Protein of unknown function (DUF581)
MAGGSIKRHCFSEEDDVEPGYSGHNHFHHYQHGFISRTLGYGTFYNRRVRSHSIFSPRSGRFYDARFEDHQPHFLQACSLCKKPLGDNRDIFMYSEECRQEQIERDEAKEKNKNLSSSMKALRKKEQRNSVSPNKTQDYSFRAGTVAAA

SEQ ID NO: 217821 - protein, 168 aa, Glycine max
  Coding DNA Sequence Number=SeqID_101043
MGFGRLGDGKLHTRPHPAAMSKLDKIIHMLEIDEVETSKRENQIGTLKPVRDTFGGSHFSFIRNLKNMYGTTSKPIDDKLSDEEQLLLLLASLARSFKALVQTLLIGRSTLNLDEVNVILREKERMMRTENVDDEHHVIIVVESERERNHSRRHDGPRGRSKSQSRPQ

SEQ ID NO: 217822 - protein, 93 aa, Glycine max
  Coding DNA Sequence Number=SeqID_101044
  Subcellular localization annotation: CTP_CleavageSite=31; ConfidenceScore=5.02e-01
MSEQANKSYICPLKPRARKSTVTSASIVSPRVATVAADEGPKCWWGQRASRLAKRDPFGFVEENDERIWEKVKGIGDVGELELEARFREKAEP

SEQ ID NO: 217823 - protein, 185 aa, Glycine max
  Coding DNA Sequence Number=SeqID_101045
ISAYHGCRMTKLGLCVLSDTTVSEWQRGADNRKVSPRIMGISAYHGCRMTKLGLCVPSDTTVSEWQRGADNRKVSPRIMGISAYHGCRMTKLGLCVPSDTTVSEWQRGADNRKVSPRIMGISAYHGCRMTKLGLCVPSDTTVSEWQRGADNRKGQYDKDYGAADKSKALAPTYPPMRNSDLRSSG

SEQ ID NO: 217824 - protein, 184 aa, Glycine max
  Coding DNA Sequence Number=SeqID_101046
  Homolog annotation: Hit_ID=Q47522; Match level="QueryCoverage=35%, HitCoverage=86%, E-value=2e-22, Identity=72%"; Hit description=LacZ protein
LLTGWCVTAKAPPDISAGKCSGHAARRVPFAIQAAQLLGRAIGAGLFAITPAGERGMCCKAIKLGNARVFPVTTLSYDVIAKEYLAARLEATKAKEKRDKNRQEQAGHIIRKLKQELSALGLSDDSLALEHEIKLIDTVDLEGGPVGKPVVPAALMNRPTRGERRFAYWALAECILAYYVGTDE

SEQ ID NO: 217825 - protein, 258 aa, Glycine max
  Coding DNA Sequence Number=SeqID_101047
  Homolog annotation: Hit_ID=Q64EX4; Match level="QueryCoverage=52%, HitCoverage=31%, E-value=4e-56, Identity=69%"; Hit description=MtN19- like protein
  Pfam annotation: Domain name=SURNod19; Domain location=5-246; Score =65.0; E_value=2.5e-16; Accession=PF07712.3; Description=Stress up -regulated Nod 19
MKHFTDTLISANIGTKAGTGPPLEVDGIDKLDSDHIFVRNSGLCQRDTLGQYYGLGSETRGTATDVPDPFGIVVGDPAEIPEGYEEKWMVNIHAIDTRGVVDRMGCTECRCDLYNVTKKEHGEPLSSDYKGGYYCCYDQTQCRLREGFEGPKRSLYLRYTVKWVEWNKFIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 217826 - protein, 95 aa, Glycine max
  Coding DNA Sequence Number=SeqID_101048
MSSSLHAFKGDNVSHISKKTMSSVIACLQKVTMTLIYILKITMSSVIACLQRRQCPHLHFKDNNAFSHCMPSKGDNVFIYISKMTMSSVIACLER

SEQ ID NO: 217827 - protein, 79 aa, Glycine max
  Coding DNA Sequence Number=SeqID_101049
MADPDALVSTMKGKKKSRDVNTGAFVIACFKLSNIQQRLKHHFEVGDMCRSKLHDDEPSNFNDAKSPSDGFKIDSRLQD

SEQ ID NO: 217828 - protein, 368 aa, Glycine max
  Coding DNA Sequence Number=SeqID_101050
  Gene Ontology: Mol. function=protein binding; Cellular component =cellulose and pectin-containing cell wall; Biological process=xylan catabolic process
  Homolog annotation: Hit_ID=Q949G7; Match level="QueryCoverage=96%, HitCoverage=75%, E-value=2e-84, Identity=32%"; Hit description =HcrVf3 protein
  Pfam annotation: Domain name=LRR_1; Domain location=116-139; Score =11.5; E_value=2; Accession=PF00560.23; Description=Leucine Rich Repeat
  Pfam annotation: Domain name=LRR_1; Domain location=14-36; Score=5.8; E_value=24; Accession=PF00560.23; Description=Leucine Rich Repeat
  Pfam annotation: Domain name=LRR_1; Domain location=141-163; Score =11.2; E_value=2.2; Accession=PF00560.23; Description=Leucine Rich Repeat
  Pfam annotation: Domain name=LRR_1; Domain location=165-187; Score =12.8; E_value=1.2; Accession=PF00560.23; Description=Leucine Rich Repeat
  Pfam annotation: Domain name=LRR_1; Domain location=237-259; Score =7.9; E_value=9.6; Accession=PF00560.23; Description=Leucine Rich Repeat
  Pfam annotation: Domain name=LRR_1; Domain location=261-283; Score =15.1; E_value=0.25; Accession=PF00560.23; Description=Leucine Rich Repeat
  Pfam annotation: Domain name=LRR_1; Domain location=285-307; Score =17.0; E_value=0.068; Accession=PF00560.23; Description=Leucine Rich Repeat
  Pfam annotation: Domain name=LRR_1; Domain location=309-330; Score =6.8; E_value=15; Accession=PF00560.23; Description=Leucine Rich Repeat
  Pfam annotation: Domain name=LRR_1; Domain location=44-63; Score =11.6; E_value=1.9; Accession=PF00560.23; Description=Leucine Rich Repeat
  Pfam annotation: Domain name=LRR_1; Domain location=68-90; Score=5.7; E_value=24; Accession=PF00560.23; Description=Leucine Rich Repeat
  Pfam annotation: Domain name=LRR_1; Domain location=92-114; Score =10.5; E_value=3.1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =116-139::14-36::141-163::165-187::237-259::261-283::285-307::309 -330::44-63::68-90::92-114
IGPNFPSWIQSQNKLRYVGLSNTGILDSIPTWFWEAHSQDKPMQLEFLNLASNNLSGEIPDCWINWPFLVDVNLQSNHFVGNFPPSMGSLAELQSLEIRNNLLSGIFPTSLKKTSQLISLDLGENNLSGCIPTWVGEKLSNMKILRLRSNSFSGHIPNEICQMSLLQVLDLAKNNLSGNIPSCFRNLSAMTLVNRSTDPQIYSQAPNNTRYSSVSGIVSVLLWLKGRGDEYGNILGLVTSIDLSSNKLLGEIPREITDLNGLNFLNLSHNQLIGPIPEGIGNMGSLQTIDFSRNQISGEIPPTISNLSFLSMLDVSYNHLKGKIPTGTQLQTFDASRFIGNNLCGPPLPINCSSNGKLIVMKEVMGME

SEQ ID NO: 217829 - protein, 265 aa, Glycine max
  Coding DNA Sequence Number=SeqID_101051
MEVTKTFINGWKLLKLPSMVGSYMEVTKTSINRQKSPDKVKIIWKPTAEKEPTPQANPKFNPADEESSLSSTEDEHEVQGNKGLNSSTHALSKKTPPKEASKDQNSTESSLEKDHINVESNKINNIKGVSKYTPKDIDDCLKNLDDDPFALLGFMSRDVSMSSKQSETSVQQSSTTETLASALDELRKLAFSQSMLENIGKVEYREGGGFGEVAKPKIEDIEKRQKEGKEAIKKLQEVKPKHDADFEALKEPYKKMKPNPPFSIF

SEQ ID NO: 217830 - protein, 161 aa, Glycine max
  Coding DNA Sequence Number=SeqID_101052
METVWLAKENGDDLTSFPSSSSGTINIIAFPLKETCVMSPIFDGRFLVGGVGKKIRGTFTMTISMRGIASQVTRGGKSLSRYIEDLKRSVGSTRRTSIKEGEARFHTVEAADCGDFDIQLHFSGVFLELVGSRATVGVPLVVDMNTAAIDGDGGSTGEDEK

SEQ ID NO: 217831 - protein, 140 aa, Glycine max
  Coding DNA Sequence Number=SeqID_101053
MPLFRLTERENEASLAVLPDLLMELDSMDEVDDFDAFKQRMLGIGDKKPPPYRRDLLFVDNAGYVSTSLLRSTTSLNVIYFYVVSSKPDLNSIRFNITVDVDNVFKGEASTTAMTAAPSQESCPSKTVISDRHRLVGGLQ

SEQ ID NO: 217832 - protein, 43 aa, Glycine max
  Coding DNA Sequence Number=SeqID_101054
MCRGKDNAKCSEGVPKIGKHQYSRQYGHEGNVVGGIPHSVLPK

SEQ ID NO: 217833 - protein, 91 aa, Glycine max
  Coding DNA Sequence Number=SeqID_101055
MSPSTRDESGWMYSCNAFNYALREQSEINNKLEKQDNTTGPIKEGLALLLIGYFTTIHQENELKNDIHTLVGCQLPSVSVTIRLVATVPTL

SEQ ID NO: 217834 - protein, 83 aa, Glycine max
  Coding DNA Sequence Number=SeqID_101056
  Subcellular localization annotation: CTP_CleavageSite=55; ConfidenceScore=5.12e-01
MEANTFLPPATKSQAKYSDDKEIKNGKTNTKWLSVPSQEASFGKGSSFAGASMVLSSAAAALIILENLRGFEREKERRGVTRD

SEQ ID NO: 217835 - protein, 58 aa, Glycine max
  Coding DNA Sequence Number=SeqID_101057
  Gene Ontology: Mol. function=protein serine/threonine kinase activity; Biological process=protein amino acid phosphorylation
  Homolog annotation: Hit_ID=Q1SMH9; Match level="QueryCoverage=98%, HitCoverage=9%, E-value=2e-15, Identity=70%"; Hit description =Protein kinase
MEQYEILEHIGRGSFASALLVRHRHENKRYVLKKIRLARQTNITHRFAYQEAPMYEYV

SEQ ID NO: 217836 - protein, 212 aa, Glycine max
  Coding DNA Sequence Number=SeqID_101058
MESTGKTTLVKEVGKELKKSKKFDQVIDTSVSYTPDRKKIQDDIAGPLGLTSLKDCTESERPTRLWRRLTNDYQPMIPYYSQNIEPRPHTRTQNTEEDGKLTRGTHTRKNSPKGLSKWEEYHIRCSSDENNVEDGKEEEIGAGGALVAPRCGVPIAAAEVDEPLRFLDDSSIWRYGKLKIGEENALSREKIAKMKLLKILIYRKGRLVIDYK

SEQ ID NO: 217837 - protein, 44 aa, Glycine max
  Coding DNA Sequence Number=SeqID_101059
MTNHQKSASNNLIRGANILVDPNGEIKLTDFGMAKHVSLFAFRE

SEQ ID NO: 217838 - protein, 206 aa, Glycine max
  Coding DNA Sequence Number=SeqID_101060
  Homolog annotation: Hit_ID=Q5ZC01; Match level="QueryCoverage=36%, HitCoverage=8%, E-value=6e-18, Identity=57%"; Hit description=IFA -binding protein-like
  Pfam annotation: Domain name=DUF593; Domain location=49-142; Score =127.0; E_value=5.1e-35; Accession=PF04576.6; Description=Protein of unknown function, DUF593
MVYEMNGEVLQKIGTNETASTDTHSVVCDSARINPKEENSSNINKSSITTKEREETGFIKEKPTTKEKEVEEERNASGVATNEAMSMITRLQEEKATLQMEALQYFRMMEKQPEYDTDELEKVNGLLIEKEKEIQDLEVELEFYRSNMADDEPMGSGPYSNGLKPIVCPFYCSYSGYQATKNPMYLNCIKVNGQTLGAANYNNTFG

SEQ ID NO: 217839 - protein, 225 aa, Glycine max
  Coding DNA Sequence Number=SeqID_101061
  Gene Ontology: Mol. function=helicase activity; Biological process =viral genome replication
  Homolog annotation: Hit_ID=Q9LTU4; Match level="QueryCoverage=96%, HitCoverage=18%, E-value=2e-46, Identity=39%"; Hit description =Helicase-like protein
MRMHDMLDEQIIIAIKDMLDHHNHYAQKFRMARDKLHSAAVPDLKMKLISQRQTDGRLYNLPTTTEVAALIVGGEDGYRLNIPHKDHANIHAAKRKQVTLREYFSYRLQSRTDEAQTILHSRRLFQQWIVDGYCMIESQKLNYVRQYQQQLRVDKYINLIGSNDHPQTLGRDRGKRIILPSSFVGGQRYIEQLYFDGMAICGHLGFPDLFLTMTCNPTWPEIRRK

SEQ ID NO: 217840 - protein, 153 aa, Glycine max
  Coding DNA Sequence Number=SeqID_101062
TWFPALITALGQSRGVASDSLVFERLSLGLGERGQGQLRPLPHLQLLLQHMVEPPDSIPSVEQFNEWMEDESSETTTPEPLVRRKKTDQTQEAAATSEKSLEATYEPSEPVADTASVQQTVDPFTPEDHTRPVLSLSTSHTATLVLHLTDEED

SEQ ID NO: 217841 - protein, 56 aa, Glycine max
  Coding DNA Sequence Number=SeqID_101063
MAVVVATTTTTIVEALAEKFEKGSISMKAPFNRLKETILPPTPKFYNSSYKEESMK

SEQ ID NO: 217842 - protein, 124 aa, Glycine max
  Coding DNA Sequence Number=SeqID_101064
  Gene Ontology: Mol. function=identical protein binding; Biological process=negative regulation of enzyme activity
  Homolog annotation: Hit_ID=Q2HV71; Match level="QueryCoverage=68%, HitCoverage=11%, E-value=5e-25, Identity=63%"; Hit description =Protease-associated PA; Proteinase inhibitor I9, subtilisin propeptide
MWDNVGVDGVVSDRFQTGGEREERFQAGGEREERVQDSSSGLWHASNFGEGVIVGVIDIGVWLESEGFKDHGMTKKIPNKWKGSCEEVQDFNTSMCNFKLIGTTYFNKGVIAANSKVTYYMLRN

SEQ ID NO: 217843 - protein, 150 aa, Glycine max
  Coding DNA Sequence Number=SeqID_101065
  Gene Ontology: Mol. function=metal ion binding
MTNANCLEESLHSVSNGNLRVIQSKTDGKLVELNTQCAHADNGCGSCSSEDNAMNEAILNSKLEAVICSEGYILKHQKIQSKIDRWCVSAKTSKFESMNKLQNQLEKVESLTQDLEEGLEFLFRHLINTRGIVRSCGCPINSSVDPVATT

SEQ ID NO: 217844 - protein, 119 aa, Glycine max
  Coding DNA Sequence Number=SeqID_101066
MKARRSLSSVRTSFSKEDNESYCDGGKGVRSSRIGGGRSCLCTHWPSTSFRYPKEATTPTPIANERLTLTKIYNLLRNAKSLMYLINKSKVESMPLQWNSRSRSALLALIRTWHNAFMP

SEQ ID NO: 217845 - protein, 89 aa, Glycine max
  Coding DNA Sequence Number=SeqID_101067
  Gene Ontology: Mol. function=GTP cyclohydrolase I activity; Cellular component=cytoplasm; Biological process=aromatic compound biosynthetic process
  Homolog annotation: Hit_ID=Q8VYU3; Match level="QueryCoverage=54%, HitCoverage=10%, E-value=2e-07, Identity=63%"; Hit description=GTP cyclohydrolase I
MEHLGQYDLNCDLKNGVNMCCDEESFVKEINTTSIEYAVKVLLMDLGEDINREGIIKTPHRVAKALFEGTREVITPHGISNYYQSSWYN

SEQ ID NO: 217846 - protein, 208 aa, Glycine max
  Coding DNA Sequence Number=SeqID_101068
MRENMAEILVSKTTWRMVWWRPHLDVLFLLFVLLGLNLLIMVLLLEMPFGAKFEAQEGLPSEMSSLVEEICCCEGSEKGSDTGSEALARERERERKREEGENKVSCFWWISICHRGTFSSSTVTRRPRPRSANKRKRRSKEVNTTPFSTPSRSSEIFVIISLIASFFYLLDFFGINFFSKAGFGGLLWFGVFYDSHYCCSKVEGGQEK

SEQ ID NO: 217847 - protein, 403 aa, Glycine max
  Coding DNA Sequence Number=SeqID_101069
  Gene Ontology: Mol. function=GTP cyclohydrolase I activity; Cellular component=cytoplasm; Biological process=aromatic compound biosynthetic process
  Homolog annotation: Hit_ID=Q8VYU3; Match level="QueryCoverage=95%, HitCoverage=84%, E-value=1e-132, Identity=62%"; Hit description=GTP cyclohydrolase I
  Pfam annotation: Domain name=GTP_cyclohydroI; Domain location=277 -381; Score=76.7; E_value=7.4e-20; Accession=PF01227.12; Description =GTP cyclohydrolase I
  Pfam annotation: Domain name=GTP_cyclohydroI; Domain location=45-145; Score=54.5; E_value=3.6e-13; Accession=PF01227.12; Description=GTP cyclohydrolase I
  Pfam module annotation: Pfam domain module=GTP_cyclohydroI::GTP _cyclohydroI; Domain location=277-381::45-145
MAIHIKKMEKPCTFTCYKQSAKEIVEGALFPEAGVDSTKVGHAGELVIVRDLEFYSYCESCMLPFYFKCHVGYVPSGQRVLGLSKLSRVTNVFAKRFQEPQRLANEVCSALHQGIEPAGVAVVLQCTHINIPDTESNFFDSNHKGLVETLVSSGSGVFENNDADTWGDVFGLLKVRGIDKDKVHVKRSLDQHWCPSLSSKIGEINPIMITAVSSILKSLGEDPIRKELVGTPSRYAKWLMNFQYCNDIYVKLNGSLRSGVDDSLHTNGEVSFDDKELHSDLNLPFWSQCEHHLLPFHGVVHIGYFIPKGFHPVEKSLLQSIVHFYGFKLQVQERLTKQIAETVSPLLGGNVIVVVEASHTCMISRGIEKFGSNTSTIAVLGRFSTDLAARTSFLESIPNATSL

SEQ ID NO: 217848 - protein, 82 aa, Glycine max
  Coding DNA Sequence Number=SeqID_101070
MVTITTSMRVMEVRMSGFQKKILLTRKTKAKDNNHFGVLNSSYFSNINCDHPDQEINFLGLDVPSSWKIDREFYIGLHFHSE

SEQ ID NO: 217849 - protein, 525 aa, Glycine max
  Coding DNA Sequence Number=SeqID_101071
  Homolog annotation: Hit_ID=Q10NR6; Match level="QueryCoverage=12%, HitCoverage=16%, E-value=1e-08, Identity=52%"; Hit description =Expressed protein
  Subcellular localization annotation: CTP_CleavageSite=64; ConfidenceScore=5.40e-01
MSSAPMTDNNKVQNKGLLSSSSSSSSVRIEEEIMKQGIITILNSNTNTNTPSSSSSSSLRRTLSADMSSKNYLHAKTIADSEKEEEDDEDEAERERLEIWSSIQRNKKEEQEKSGAFDMWSSIVSLKGKDEISKSMPITPYVHPLVKRSKSCLSGKSLEICTESLGSETGSDALLLSSHSSSSETGDATEQEQDKEQVNEEEEEELCNYASVVATKKASASASASASPPRAFPPPLPSLSHHQASSSVTHMRSHRDNGRLVLQAVSVPSHNNFSIQRQDGRLVLTFSNHQEEEEEEEEEEEENGDHVEELGEECFGGFEFGEEEDYYDEGEDEEEEEYFLGTKPQVSSIEPNSVLMGYESVIEKAPLLPSGVTSSVHELALMMNIKNKPIGVVNRNPKWSEKFNEMTNFDDVNVAAQSLPPRPRVARLIPSAPAASFNFNAYEYYWRTKSASSKGTSVNLNQLDQEKLKSKVVVSGDMNKVVSREQQQLLVLRGKNGDYLVHNLKSCKDSRRSFLFWEPYCIATS

SEQ ID NO: 217850 - protein, 85 aa, Glycine max
  Coding DNA Sequence Number=SeqID_101072
MTAVTQPNNIILGVYGSSNVRKDNVVEQITRKVERDMFDVIVMASVMKKNNTWCLRWNKSPDVRRIRNLGTSWDKDGGEDPYHLA

SEQ ID NO: 217851 - protein, 107 aa, Glycine max; identical to SEQ ID NO: 167898
  Coding DNA Sequence Number=SeqID_101073
  Homolog annotation: Hit_ID=Q1SP03; Match level="QueryCoverage=84%, HitCoverage=16%, E-value=2e-10, Identity=38%"; Hit description=IMP dehydrogenase/GMP reductase

SEQ ID NO: 217852 - protein, 129 aa, Glycine max
  Coding DNA Sequence Number=SeqID_101074
  Homolog annotation: Hit_ID=Q86AI8; Match level="QueryCoverage=62%, HitCoverage=27%, E-value=3e-11, Identity=42%"; Hit description =Similar to Homo sapiens (Human). Mucin 2
MAIMMEAMMSMKKIMEANAVVVAATSAVAKVNPTPPSGLNQMNHPRGLHTLTFRGLHILSFRGLHALTFRGLDILAFKGLDALAFRGLHVLANRGLHTLTLRGLHVLAIRALHVLAIRGLHALAFRGLH

SEQ ID NO: 217853 - protein, 65 aa, Glycine max
  Coding DNA Sequence Number=SeqID_101075
MEDQIEKMRETITKLNSKLLEKTNKERILESIMSAPSPLTTTVDETDHHVDDAQVDRSHYMSKDH

SEQ ID NO: 217854 - protein, 162 aa, Glycine max
  Coding DNA Sequence Number=SeqID_101076
  Homolog annotation: Hit_ID=UPI00006A2900; Match level="QueryCoverage =96%, HitCoverage=54%, E-value=2e-28, Identity=88%"; Hit description =UPI00006A2900 related cluster
  Subcellular localization annotation: CTP_CleavageSite=38; ConfidenceScore=5.52e-01
MNAWAAHKPVIPVVTFLTPLASNFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 217855 - protein, 296 aa, Glycine max
  Coding DNA Sequence Number=SeqID_101077
  Homolog annotation: Hit_ID=Q47522; Match level="QueryCoverage=14%, HitCoverage=53%, E-value=9e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDQTLGHSYVVSRHFHSLIPLVKKFVVRVISDDNSSSSFATSDKSRSPFWNLLRLQKLTIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 217856 - protein, 218 aa, Glycine max
  Coding DNA Sequence Number=SeqID_101078
  Homolog annotation: Hit_ID=Q10NC3; Match level="QueryCoverage=85%, HitCoverage=43%, E-value=5e-11, Identity=41%"; Hit description =Expressed protein
MTSMEIFVSKLEVSFQTPKLRGAISCSSVGQGVDASKSYFQGPSRNNSDSRSQAHGEDMDVGYEGNHLSQSFEGLEQNFHDDIIKLTKEQNDAEDAEYARHREKGAKRKKCIYAQFCSLVSSVRVKLASLRKNWVSLWHKTLWDLFNSLFVFEDVKDTFEAVKLFIAVTKINAINAQYEEKLAALRAQHSSRRAEFLQRESHARQQQYQQIIRDPYPS

SEQ ID NO: 217857 - protein, 54 aa, Glycine max
  Coding DNA Sequence Number=SeqID_101079
MSMVKLEWVLGCVLLLNANYRGFNITIPILHKGLWDQICIPHGGTLLSEDDTEE

SEQ ID NO: 217858 - protein, 80 aa, Glycine max
  Coding DNA Sequence Number=SeqID_101080
  Homolog annotation: Hit_ID=Q59296; Match level="QueryCoverage=32%, HitCoverage=5%, E-value=3e-08, Identity=96%"; Hit description =Catalase
  Subcellular localization annotation: CTP_CleavageSite=40; ConfidenceScore=5.74e-01
MTVSPTHSNTASAKGTSPSFASLHAKTPSPLLSNPVSITSTALITSIAGYRARIRNHGHSCFLCEIVIRSQFHTTYEPEA

SEQ ID NO: 217859 - protein, 195 aa, Glycine max
  Coding DNA Sequence Number=SeqID_101081
  Homolog annotation: Hit_ID=Q93X76; Match level="QueryCoverage=29%, HitCoverage=12%, E-value=7e-24, Identity=91%"; Hit description =Putative carboxyl-terminal proteinase
  Pfam annotation: Domain name=DUF239; Domain location=141-195; Score= -84.3; E_value=0.053; Accession=PF03080.5; Description=Arabidopsis proteins of unknown function
MEILSTFRHNHGFVIDPYVSTCSPLGLEDIIDQILNEDDKQVVISHALFQVSENDEDKLVRHLTSSGEYTVKFYTSRSMLENPNQPTPHTPKHAPNWREPQIDFWKCNVNATIFTSRTTLVLAYACVITMHAVGYVSGEQYYGAKASINVWAPRVENQDEFSLSQMWVISGSFGDDLNTIEAGWQASFNSAIAVS

SEQ ID NO: 217860 - protein, 66 aa, Glycine max
  Coding DNA Sequence Number=SeqID_101082
MKMCKAAKRTPKAHPSELELAQVSSCFNLSNLAHPRKLVTSPLSYLGAQASQRLAWVSQGSEKALK

SEQ ID NO: 217861 - protein, 141 aa, Glycine max
  Coding DNA Sequence Number=SeqID_101083
  Gene Ontology: Mol. function=structural constituent of ribosome; Cellular component=ribonucleoprotein complex; Biological process =translation
  Homolog annotation: Hit_ID=Q2MI98; Match level="QueryCoverage=99%, HitCoverage=81%, E-value=2e-53, Identity=72%"; Hit description =Chloroplast 30S ribosomal protein S4
  Pfam annotation: Domain name=Ribosomal_S4; Domain location=2-65; Score=43.2; E_value=8.8e-10; Accession=PF00163.9; Description =Ribosomal protein S4S9 N-terminal domain
  Pfam annotation: Domain name=S4; Domain location=66-113; Score=91.3; E_value=2.9e-24; Accession=PF01479.15; Description=S4 domain
  Pfam module annotation: Pfam domain module=Ribosomal_S4::S4; Domain location=2-65::66-113
  Subcellular localization annotation: CTP_CleavageSite=47; ConfidenceScore=5.01e-01
MSRYRGPRFKKIRRLGSLPGLTSKRPTVKSELRNQSRSKRQLLKYVRIAGKAKGSTGQVLLQLLEMRLDNILFRLGMAATIPQARQLINHRHVLVNGHIVDIPSYRCKPQDIITAKDEQKSKDSGFKIILIQPPVRNCQII

SEQ ID NO: 217862 - protein, 82 aa, Glycine max
  Coding DNA Sequence Number=SeqID_101084
MAFFLSYLDYKAQNAQVSNALRNGNVTHTPDIFSKIPTLQTNLREDPTVNEVWAAFLPRQLHVASLRSFIKRLPQEASSWLL

SEQ ID NO: 217863 - protein, 231 aa, Glycine max
  Coding DNA Sequence Number=SeqID_101085
MGSSQKPSLKKRFYQVKIKSLEVTSLRKLGQLMGQLQRQAFRKAYGKIWDLARVEVSMEPIASLAQYYDQPLRCFIFGDFQLSPMGSTPHWPNLGAGIRPPKASRKWGGRNTEKIFGAIDVFLAYHDHKESPVVAMLADLYDTFDRRCEESNARIVCCTPALYVGLVSHLFLQEGRPVYPLQGYCSCVEKGKANWDQLLASMGGRLLIGSLARRKEESRFYLHAKDVQMFP

SEQ ID NO: 217864 - protein, 140 aa, Glycine max
  Coding DNA Sequence Number=SeqID_101086
MVEPSKKRKGSSSRSQRHSEAQDTPIPSSISSSSLFSSEEQHIQYTNLFSSRSIIDPKFIDMDFFSDESFECIQEFQNSNPIPFMSLKLPVYSELVKAFYSNLEIQESTLISEFYGIKIVIDQSLFYDLTQLSSEGVPFE

SEQ ID NO: 217865 - protein, 69 aa, Glycine max
  Coding DNA Sequence Number=SeqID_101087
MCRRQYSNLSVDELRGSGAIPRLLWCLTLCLPGGAILLDESSVSRRPDDLAGGDGHSVELTKARNPGIL

SEQ ID NO: 217866 - protein, 55 aa, Glycine max
  Coding DNA Sequence Number=SeqID_101088
MTNFCLLAKPIYRLSEPSTERTTLAAELTTPAVERKEESGRRMIWTHALSEGSSR

SEQ ID NO: 217867 - protein, 98 aa, Glycine max
  Coding DNA Sequence Number=SeqID_101089
MSLSSAVHVSSTYEFGAMGSDSLVQFSNLAFFSEPHECHCLALFMHPPPTSLEPHEGIAYNCSPILHFHFFSEPHECHCLALFVCPPPMSLEPRKFIA

SEQ ID NO: 217868 - protein, 256 aa, Glycine max
  Coding DNA Sequence Number=SeqID_101090
GHRNQLPVHPASQSAYQKWPLGALDSMARLNRAAAPSYLFKGNFGGNQLLDGSISLSPLYPSQTNDLHVCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNFRPIGAAFPNKPTRRQRLVVRQ

SEQ ID NO: 217869 - protein, 253 aa, Glycine max
  Coding DNA Sequence Number=SeqID_101091
  Gene Ontology: Mol. function=helicase activity; Biological process =protein amino acid phosphorylation
  Homolog annotation: Hit_ID=Q1SN45; Match level="QueryCoverage=94%, HitCoverage=14%, E-value=3e-55, Identity=44%"; Hit description=AAA ATPase
MSKPEQVWDQTWHWMADDMVYNHKKSSTSPALQLDDRTFQNLVLLQIEELLQANQRSLRDYHSMPYLENVNCPAYLDNSLILAELNYNNEELRSEFEHLFSYMTDEQASIYNQIVEVVNKDEGGMFFLYGYGGTRKTYIWKTLASSLRADNKIIIMVSSSGIASLLLPGGRTTHSKFKIPVPVFEDLTCNIHQGTQLAELLNQTSLIIWDEAPMAHKFFFEALDHSLRDIIKHNSKDNKIFGDPASHSKRQPL

SEQ ID NO: 217870 - protein, 164 aa, Glycine max
  Coding DNA Sequence Number=SeqID_101092
  Gene Ontology: Mol. function=hydrolase activity; Biological process =intracellular signaling cascade
MASTSTLLLWKQHLHRFGEVTNDVIQSYAQTMPSPDPKIEHLLVQAGFLDVAKLRQVKIDGALVTALVERPVTGPTYYDWKQTCVEYISVVPPENALVGSTLKLKWLKEHMLTLPVELTPQQLADYCRAYILGQIGGVSVPDKSGNKVHLMYLPLLAYFDKAGK

SEQ ID NO: 217871 - protein, 165 aa, Glycine max
  Coding DNA Sequence Number=SeqID_101093
MGELEEVQEQMKADMEAMKEKMTTMMEAMMSMKKIMEANAVAIAATSAVAKVKPMPPFGLNQMNNPTSDMVGKDLGSTGGPHYAQIQNKHAFPPYEVPTIHHPMWHTLLVRMSITPLPYSLRADNPKLIMHMSLKPWGRHMKFPTTILPTSSLASDMPLKGKQVV

SEQ ID NO: 217872 - protein, 76 aa, Glycine max
  Coding DNA Sequence Number=SeqID_101094
MPPRIVKRGAAAKRASRGSSKAAPENQPEPETAEVVVKNNEENPVVDAVVEEKPVDVEQEHEEVPNGSAKVERCYL

SEQ ID NO: 217873 - protein, 106 aa, Glycine max
  Coding DNA Sequence Number=SeqID_101095
  Gene Ontology: Mol. function=3-deoxy-8-phosphooctulonate synthase activity; Cellular component=cytoplasm; Biological process =biosynthetic process
  Homolog annotation: Hit_ID=O50044; Match level="QueryCoverage=99%, HitCoverage=36%, E-value=4e-47, Identity=84%"; Hit description=2 -dehydro-3-deoxyphosphooctonate aldolase
MADTHLLMVADITHSLQQPAGKKLDGGGVASGGLRELIPCIARTAVAVGVDGIFMEVHDDPLKAPVDGPTQWPLRHFKELLEELVAIARISKGKQRFNIDLTPFRE

SEQ ID NO: 217874 - protein, 155 aa, Glycine max
  Coding DNA Sequence Number=SeqID_101096
  Gene Ontology: Mol. function=3-deoxy-8-phosphooctulonate synthase activity; Cellular component=cytoplasm; Biological process =biosynthetic process
  Homolog annotation: Hit_ID=O50044; Match level="QueryCoverage=74%, HitCoverage=39%, E-value=1e-58, Identity=95%"; Hit description=2 -dehydro-3-deoxyphosphooctonate aldolase
  Pfam annotation: Domain name=DAHP_synth_1; Domain location=4-155; Score=1.2; E_value=2.2e-11; Accession=PF00793.10; Description=DAHP synthetase I family
MSSELEVASVYLTAGPRKILSMGQMSPLAVPKEKDTILILILEKVKIAYDIPIVTDVHESIQCEAVGRVADIIQIPAFLCRQTDLLVAAAKTGKIINIKKGQFCAPSVMTNSAEKVRLAGNPNVMVCERGTMFGYNDLIVDPRNLEWMREANCPI

SEQ ID NO: 217875 - protein, 288 aa, Glycine max
  Coding DNA Sequence Number=SeqID_101097
  Gene Ontology: Mol. function=nucleic acid binding
MENERVLGGEKRKRNREKEKPQRLLLDERLNLPSEVRSDAHFRGKQVATRGNNGTGGGNKPGGRGKRVEHNFLNVSGSFLVSLSLPKDDIEDEYVSEQLSNYDSDEDVFKKKYERFNNELLCKEFKWRLGLEFASLITSKSKGIIKDVLPRFGNFYICLEGPKTAFKKDCRPLINVDGCHLKSKFGGQLLIVVDKDPNDQYMPIAFAVVETETQETWRWFLNLLFEDIGSVETNKWVFISDQQKGLQQVFLKFLTSIEHGFYLQHLYNNFKKKNWWWDNDERSDDGGC

SEQ ID NO: 217876 - protein, 95 aa, Glycine max
  Coding DNA Sequence Number=SeqID_101098
  Subcellular localization annotation: CTP_CleavageSite=17; ConfidenceScore=5.08e-01
MSSSSTVVAQGPAVVVRVSNGGGSRGDDSCTKKWVVVTQGSNVGGSTGDGEGCGRETKKKENEKEEEAKGIKNDSRGQNGKRRRSNEKMKVVGGE

SEQ ID NO: 217877 - protein, 91 aa, Glycine max
  Coding DNA Sequence Number=SeqID_101099
MEKGVYSNQSFLLPPKETHRPIMQCELVYKPVKLGEENSEVVTTTTVMTVVAATVDEGGGNDNENYGSSCNDSHGGGSDDDEGHDNNGGDN

SEQ ID NO: 217878 - protein, 101 aa, Glycine max
  Coding DNA Sequence Number=SeqID_101100
  Subcellular localization annotation: CTP_CleavageSite=50; ConfidenceScore=5.16e-01
MHLGFWNPKAKFQTLTEAIRLMGERMNGKGGSSSLSSSSLAMVKFKCDLSAIMFTSRSVNHPRKRNPVLAYFFHGLMILRLLIMCPQKGVSWSDMFMKMKS

SEQ ID NO: 217879 - protein, 308 aa, Glycine max
  Coding DNA Sequence Number=SeqID_101101
  Gene Ontology: Mol. function=protein binding; Cellular component =microtubule associated complex; Biological process=carbohydrate metabolic process
  Homolog annotation: Hit_ID=Q2XPP4; Match level="QueryCoverage=98%, HitCoverage=63%, E-value=5e-98, Identity=57%"; Hit description =Autophagy 4
  Pfam annotation: Domain name=Peptidase_C54; Domain location=1-248; Score=298.8; E_value=1e-86; Accession=PF03416.9; Description =Peptidase family C54
MWLSCAQALLFHKLGRSWRKPIDKPPDKEYIDVLQLFGDSEASAFSIHNLLQAGKGYGLAVGSWVGPYAMCRTWEVLARKKNDLGELPLPMAIYVVSGDEDGERGGAPVVCIEDASKRCFEFSSGLAAWTPLLLLVPLVLGLDKVNPRYIPLLRSTFKFPQSLGIMGGKPGASTYIIGAQNEKAFYLDPHDVQQVVNISGDTQEPTSTSSYHCNIMRHIPLDSIDPSLAIGFYCRDKDDFDDFCSQASKLAEESNGAPLFTVTQSRSFSKQVTSNDVSGDNTGFQEEDFPGMDRGNDTGTNEDDWQLL

SEQ ID NO: 217880 - protein, 435 aa, Glycine max
  Coding DNA Sequence Number=SeqID_101102
  Gene Ontology: Mol. function=protein dimerization activity; Cellular component=cytoplasm; Biological process=regulation of transcription, DNA-dependent
  Homolog annotation: Hit_ID=Q9LT11; Match level="QueryCoverage=91%, HitCoverage=96%, E-value=2e-63, Identity=37%"; Hit description =Arabidopsis thaliana genomic DNA, chromosome 5, P1 clone:MQM1
  Pfam annotation: Domain name=DUF1771; Domain location=242-307; Score =21.4; E_value=0.00015; Accession=PF08590.1; Description=Domain of unknown function (DUF1771)
MTASARSSLKKMSWARGQSSGWTAFDLKQRKNNNFESEDDKDPFPAIGTTDPMVGKNHVPAKPFSSVLLPTRNFPPFKEGGNSKKAMVGSDSDGKYCGATAQEDVNLAIKKLREQHLWAEHSLIDDIFSAVNNNIDKATALLETMDPAANFEESKVSSNPRSTTSDDTPCKDKTDDSLTSEKVEDDIPFDSNLVDNLQDNDKDLEDRNAPSGQKLSDVDYLRCKMKLLNSIPVEPEWEDDDIYISNRKDALRTMRSASRHSRAASSAFLRGDHFSAQHHSMKARAERHTAEELNSDAAKKILSVRNNENDIWKLDLHGLHATEAIQALQEHLYRIESQGFSKSSATSNGVKENGLGHSTLGSLNFMDREAPLRLRPLALHVITGVGNHSRGQAALPTAVRSFLNENRSKISQCSMSSILLPSLPPITFVEDIQNE

SEQ ID NO: 217881 - protein, 327 aa, Glycine max
  Coding DNA Sequence Number=SeqID_101103
  Pfam annotation: Domain name=PRA1; Domain location=58-202; Score= -22.6; E_value=0.00038; Accession=PF03208.9; Description=PRA1 family protein
  Subcellular localization annotation: CTP_CleavageSite=45; ConfidenceScore=5.58e-01
MYPSYYYPSSFCGAYATNFSNLWFNRRGTSIEPFSDPPKSTSSVMANFGTTHRTPTTTTTPSPPSLDPYEPKAPHEKLYTDFKIYWPFTTPLTSEAAAIRVIRNLENLGLYYTLFVWIILFIVLIPHLLRAHPKSVFLHRTIDKKFVLALLVFATFVQLILTEAGIQLAVTLACAVPFLLVHAVFWVSHHGFEIEDDSDTKEMAPLVGHNRCTCGAKETKASILPPRTHQTRRATTTRPKVELEQQQQQQPIPEPTLTLKDPNIMVVEEPKHEQEEEPQNAESEEEEEEEDLTLEEEPVEKLLEMFTKEQLHSLAVGRGYVPLIYLF

SEQ ID NO: 217882 - protein, 196 aa, Glycine max
  Coding DNA Sequence Number=SeqID_101104
  Pfam annotation: Domain name=PRA1; Domain location=19-178; Score =22.2; E_value=1.3e-07; Accession=PF03208.9; Description=PRA1 family protein
MANYGTTQRIPSSSTPPSTADNYEPEPKAPQEKFYSDFRIYCPINIPSTSEAAGVRIMRNMCNFGLYYTLFVWIILFITLIPQRKVSLILFVTMTYVTTLYILLLRVFPNSVVLHRIIDKRVVLALLAIATAVQLILTEAGIHLAVTLASSVPVLLVHAVLWASYDAFEVEDASAKGELAPLAGHSENVDDNTDAA

SEQ ID NO: 217883 - protein, 228 aa, Glycine max
  Coding DNA Sequence Number=SeqID_101105
  Homolog annotation: Hit_ID=Q93WY4; Match level="QueryCoverage=38%, HitCoverage=42%, E-value=2e-25, Identity=62%"; Hit description =Probable WRKY transcription factor 12
  Pfam annotation: Domain name=WRKY; Domain location=155-202; Score =28.1; E_value=2.6e-07; Accession=PF03106.6; Description=WRKY DNA -binding domain
MEGERGGAPNYELQVSFTNTPQAIHELGFVQYEENQVLGFLSPSSQSQSSPLSQSLKSDTLVVATATTAIAAAATIGFVSHSELAIKTWNNDQEVVGTLDPKPVEEENCTGNGSDQGNNNAWWRSAATEKNKLKIRRKLREPRFCFQTRSDVDVLDDGYKWRKYGQKVVKNSLHPRKCSWLSTLAIPEALYPGGMKLHYHERFYISFILNKKRGKSYCHVPQCYYGKS

SEQ ID NO: 217884 - protein, 124 aa, Glycine max
  Coding DNA Sequence Number=SeqID_101106
MPDKILSYNKAYIDEEDEEEWSSQSDEEKGKQGICYIFFLFPCDRYQDTFKTLERGSQGLRKNDSHIEHRAALAVKLYGVQAALLSALGNPFENLSQSKSSSLWQASGGFLPAMIWTGMFPVSL

SEQ ID NO: 217885 - protein, 819 aa, Glycine max
  Coding DNA Sequence Number=SeqID_101107
  Gene Ontology: Mol. function=hydrolase activity; Cellular component =nucleus; Biological process=metabolic process
  Homolog annotation: Hit_ID=Q1SZI6; Match level="QueryCoverage=70%, HitCoverage=58%, E-value=2e-85, Identity=28%"; Hit description =Tetratricopeptide-like helical
  Pfam annotation: Domain name=PPR; Domain location=114-148; Score=2.5; E_value=3.8; Accession=PF01535.11; Description=PPR repeat
  Pfam annotation: Domain name=PPR; Domain location=149-183; Score=3.2; E_value=3.1; Accession=PF01535.11; Description=PPR repeat
  Pfam annotation: Domain name=PPR; Domain location=217-250; Score=1.1; E_value=5.5; Accession=PF01535.11; Description=PPR repeat
  Pfam annotation: Domain name=PPR; Domain location=283-317; Score =21.6; E_value=0.0028; Accession=PF01535.11; Description=PPR repeat
  Pfam annotation: Domain name=PPR; Domain location=385-419; Score =30.0; E_value=8.6e-06; Accession=PF01535.11; Description=PPR repeat
  Pfam annotation: Domain name=PPR; Domain location=486-520; Score =34.3; E_value=4.2e-07; Accession=PF01535.11; Description=PPR repeat
  Pfam annotation: Domain name=PPR; Domain location=587-621; Score =22.5; E_value=0.0015; Accession=PF01535.11; Description=PPR repeat
  Pfam module annotation: Pfam domain module=PPR::PPR::PPR::PPR::PPR::PP R::PPR; Domain location=114-148::149-183::217-250::283-317::385 -419::486-520::587-621
  Subcellular localization annotation: CTP_CleavageSite=46; ConfidenceScore=5.60e-01
MENSVSSLSLCFPPNPKTHIFQAFSFRPSPRSPPPTSKTHHTKPPRFTTPRKHRTKKPKPFTEKDAFPSSLPLHNKNPIFIFKDIKRFARQNKLKEALTILDYVDQRGIPVDATTFSSVVAACIRAKSLPQGREVHTHIRINGLENNSFLRTKLVHMYTACGSLEDAQKLFDGLPCESVYPWNALLRGTVVSGKRQYIDVLKTYTEMRALGVELNVYSFSNVIKSFAGARAFSQGLKTHGLLIKNGLVDNYILRTSLIDMYFKCGKVRLACRVFEEIPERDVVVWGAMLAGFAHNRLQREVLEYVRWMVEEGVKPNSVVMTIVIPVIGEVCARRLGQEFHAYVVKTKSYSKLVPVQSSLIDMYCKCGDMISARRVFYGSKERNVVCWTALMSGYAANGKLEQALRSTIWMQQEGFRPDVVTLATVLPVCAQLRALEQGKQIHAYALKHWFLPNVSVASSLMTMYSKCGVVEYSRRLFDNMEQRNVISWTAMIDSYIENGYLCEALGVIRSMQLSKHRPDSVAIGRMLSVCGERKLVKLGKEIHGQILKRDFTSVHFVSAELINMYGFFGDINKANLVFNAVPVKGSMTWTALIRAYGYNELYQDAVNLFDQMRYSPNHFTFEAILSICDKAGFVDDACRIFNSMPRYKIEASKEHFAIMVTLIPIRRRFSVSTLKPYLPQRDATSSDDASRVARRLSRLFRHSGFTPEPFNNGHHQMQKLQQCRGIRVKVIGGNLEAALGLMQRKMQSSGIERMIKQEQRFHIKNSEKRVLAQKNLERKIRSEDLARKLKAIMIKKVSQDVECSLVVMEAVFKQQLDAG

SEQ ID NO: 217886 - protein, 185 aa, Glycine max
  Coding DNA Sequence Number=SeqID_101108
  Gene Ontology: Mol. function=protein binding; Biological process =carbohydrate metabolic process
  Homolog annotation: Hit_ID=Q8S929; Match level="QueryCoverage=98%, HitCoverage=38%, E-value=1e-44, Identity=51%"; Hit description =Autophagy 4a
  Subcellular localization annotation: CTP_CleavageSite=66; ConfidenceScore=5.31e-01
MVLKGLCERIVSSKCSSKSSTETVDNTQVPVYSKAGSSNSKFPKASLWSNIFTSGFSVVETYSESSASEKKAVHSRSSGWAAAVRKVVTGGSMRRFQERVLGSSRTDISSSDGDIWLLGVCHKISQQESSGGVDNSNGLASFEQDFSSKILVTYRKGFDAIGDTKYTSDVHWGCMLRSSQMLVAQ

SEQ ID NO: 217887 - protein, 268 aa, Glycine max
  Coding DNA Sequence Number=SeqID_101109
  Gene Ontology: Mol. function=protein binding; Cellular component =cytoskeleton; Biological process=phagocytosis
  Homolog annotation: Hit_ID=O80516; Match level="QueryCoverage=88%, HitCoverage=89%, E-value=1e-117, Identity=83%"; Hit description =Expressed protein
  Pfam annotation: Domain name=ELMO_CED12; Domain location=87-248; Score=335.6; E_value=8.4e-98; Accession=PF04727.4; Description =ELMOCED-12 family
MNKASLVGDTMIETEQVATIMIKAKTTLPSAEFVTGSTAWLGRGLSCVCAQRRESDARPSFDLTPAQEECLQRLQSRIDIPYDGSVPEHQDALRDLWNAAFPEEELHGLISEQWKDMGWQGKDPSTDFRGGGFISLENLLFFARNFPKSFQDLLRKQEGDRSVWEYPFAVAGVNITFMLIQMLDLEAVKPRTLVGATFLKFLAENDSAFDLLYCITFKMMDQQWLSMRASYMDFNTVMKSTRRQLEKELLLEDIMRLEDVPSYKLLTR

SEQ ID NO: 217888 - protein, 135 aa, Glycine max
  Coding DNA Sequence Number=SeqID_101110
  Homolog annotation: Hit_ID=O80618; Match level="QueryCoverage=88%, HitCoverage=42%, E-value=3e-19, Identity=41%"; Hit description =Predicted by genefinder and genscan
MEMEWNVFQRVGIQGLKLPTTRNAHMLNTRVDKLHTKVLFMQELGFLYEKALRACARLPAIFGYDVENNLWPKFVYLVKEMERDLEELNRFPQYFGFSLKERIVPRHLHLKERGVRIPLNRMLMWGNEKFYAKWK

SEQ ID NO: 217889 - protein, 138 aa, Glycine max
  Coding DNA Sequence Number=SeqID_101111
  Gene Ontology: Mol. function=helicase activity; Biological process =protein amino acid phosphorylation
  Homolog annotation: Hit_ID=Q9LTU4; Match level="QueryCoverage=92%, HitCoverage=10%, E-value=3e-22, Identity=39%"; Hit description =Helicase-like protein
  Pfam annotation: Domain name=DUF889; Domain location=8-137; Score= -11.7; E_value=1e-10; Accession=PF05970.5; Description=Eukaryotic protein of unknown function (DUF889)
MTRGCHKFCQISPVIPKGKRQEVVHATINSSYLWNFCEVMTFTKNMRLQIGNSDSNVSERKEFSDWILGIGIGTIGHSNDVDINVPIPDDLVLQSKDNMNVGAFFQDSVILTPRNDIVDLINQYMLSLLPRDEKSYRG

SEQ ID NO: 217890 - protein, 623 aa, Glycine max
  Coding DNA Sequence Number=SeqID_101112
  Gene Ontology: Mol. function=unfolded protein binding; Cellular component=chloroplast; Biological process=cellular protein metabolic process
  Homolog annotation: Hit_ID=Q9C667; Match level="QueryCoverage=90%, HitCoverage=92%, E-value=0.0, Identity=69%"; Hit description =Chaperonin, putative
  Pfam annotation: Domain name=Cpn60_TCP1; Domain location=72-569; Score=571.8; E_value=6.8e-169; Accession=PF00118.14; Description=TCP- 1cpn60 chaperonin family
  Subcellular localization annotation: CTP_CleavageSite=47; ConfidenceScore=5.69e-01
LLLVPPNQHVTNSKKLKAMACSSFTFANPSSIPRLRNSLSSSSISPRAMAKELYFNHDGSATKKLLAGVDMVAELLGVTLGPKGRNVVLPNKYGPPKIVNDGETVLKEIELEDPLENVGVKLVRQAGAKTNDQAGDGSTTSVVLARGLIREGTKVIAAGMNPVQIARGIEKTAAALVSELRLMSREVEDHELADVAAVSAGNDYSVGNMISEALHKVGRMGVVTIETGRSTENCLEIVEGMQFDRGYLSPYFVNNRRKMTVELHNCKLLLVDKKITKTKELINILNNSAKEKYPVLIVAEGIEQEALAPVIKNKLRGALKVAAIKAPAFGERKTHYLEDIAILTGGTVIREDMGFTLEKAHKNDLGSATKVVITKNSTLIVTDGSTREAVEKRVHQLRRLVENTVENFQKNILNERIARLSGGIAILQVGAQTQVELKDKQLRVEDALNATKAAIEEGVVVGGGCSLLRLSQKVDGIKKLLDNEEQQIGAEIFRRALSYPTRMIAKNAGLNGNVIIDKVLSDNNMNFGYNAARDSYEDLMKAGIMDPTKHSASVAKAFLTSNAVVVERKELEPIPMPRRKSMPMPTSGNELEPMSIPRRKPMSMPMATPGNEILLGQTVNSFI

SEQ ID NO: 217891 - protein, 73 aa, Glycine max
  Coding DNA Sequence Number=SeqID_101113
MEAMKIRRKRTKKECKNQKRTWMSLNGGDRTETEETRGDIDRDIGVYRLCFVGPPSLTSSQRVNVNSRVKISK

SEQ ID NO: 217892 - protein, 92 aa, Glycine max
  Coding DNA Sequence Number=SeqID_101114
LLEALDVDVMHEGVQNLVIPIQNQFESVNSNNVHHNDNTTYCWLTQEDVFRYLLNSIGVFSPTSGNPINTLGVIDTQNLLKREKERESQERE

SEQ ID NO: 217893 - protein, 131 aa, Glycine max
  Coding DNA Sequence Number=SeqID_101115
MKFQFLVENTMNNTLGTVSKFCPSVSMYFCIVAKISRYCAYRIVINMVVGGKVVTLKSIEESSHIVMQETPMQRASTTKRIFSALSMTRESERAQESRPCAKCEIKSLSETFVICQAQCTTGAKSKSTYSH

SEQ ID NO: 217894 - protein, 65 aa, Glycine max
  Coding DNA Sequence Number=SeqID_101116
MGGALTLLDVPVTLLDVPSEGNRVVKEFQASLDGDGLESIIIHGQRIDGAHVSYVVCCVCTWGVK

SEQ ID NO: 217895 - protein, 52 aa, Glycine max
  Coding DNA Sequence Number=SeqID_101117
IYPEVHENPKAFFNSSSSILLEPLARGSSDWSLPREDCINPDAKIHEGRKLP

SEQ ID NO: 217896 - protein, 139 aa, Glycine max
  Coding DNA Sequence Number=SeqID_101118
MVQPTNPRSSQDSPLSVLRLHEACSYLAHEPKIYPKAHENPRAFSCISIPIFLESSIHCPCGVGLHHIPLELEFIPQDQGVPTDSKRIKVIPEWPTPPSVEGRSPEFQEPMDLRSNHFQGGGDDATYPPRALDRRVQED

SEQ ID NO: 217897 - protein, 389 aa, Glycine max
  Coding DNA Sequence Number=SeqID_101119
  Homolog annotation: Hit_ID=Q1RUD8; Match level="QueryCoverage=36%, HitCoverage=31%, E-value=2e-19, Identity=35%"; Hit description=IMP dehydrogenase/GMP reductase
LLVFGVVLFPNVDGLVDLAAIDVFLPYHNSKESPVVAMLVDAYDTFDQRCEKRGARIVCCTPALYVWLVSHIFRHESRLTCPLQGHCMCAEKGKANWEQLLAGFLNVPLMGTRGCINYNLILVIRQLGYPMRGAPSEESIAPFITRGFGDPNSRMLQSAEVPEESKEVQPLMELERTQIVKEKFKMAAIKVRKECDELRDVNTATAAALERETKTARKEERGRNKFRGALWGSNNKLKFRRAKRDQPRIEGMILEDKLKAYQRSKRILSKQLSRTEENMWAIIEQYKEKLNLAATHEQRLEDKYAKVSVLQAEREARERVIDSLHREAMMWMDRFTFTLNRSQELPRLLAKAKAMADLYSAPEEIEDVQEQMKADIEALKDRMASMMED

SEQ ID NO: 217898 - protein, 97 aa, Glycine max
  Coding DNA Sequence Number=SeqID_101120
PSFHGLFPSGWCLPSPLLLGLPLHLHGEKSPLKDLIEAQNPASIEVPQASFHHEGFTNIPLMGTRGCINYNPVLAIRQLGYPMRGAPSEESIAPFIA

SEQ ID NO: 217899 - protein, 120 aa, Glycine max
  Coding DNA Sequence Number=SeqID_101121
  Gene Ontology: Mol. function=tetracycline:hydrogen antiporter activity; Cellular component=integral to membrane; Biological process=tetracycline transport
  Homolog annotation: Hit_ID=UPI00005F95E1; Match level="QueryCoverage =80%, HitCoverage=23%, E-value=6e-14, Identity=42%"; Hit description =COG0477: Permeases of the major facilitator superfamily
MRAAVLSRHGVCHHAARCAAAGGGDDAVSCGLAKPLVAVRDSGGDLGGRPGLHRRAGHQLCAGAVSAAGGCGGGAAGIYSDGGRCGWQPGDGGAAGGREISVSADDAGGCSAGADRLALQ

SEQ ID NO: 217900 - protein, 194 aa, Glycine max
  Coding DNA Sequence Number=SeqID_101122
  Gene Ontology: Mol. function=D-amino-acid dehydrogenase activity; Cellular component=membrane; Biological process=electron transport
  Homolog annotation: Hit_ID=P0A6J5; Match level="QueryCoverage=92%, HitCoverage=41%, E-value=2e-84, Identity=82%"; Hit description=D -amino acid dehydrogenase small subunit
  Pfam annotation: Domain name=DAO; Domain location=16-193; Score=16.4; E_value=3.5e-07; Accession=PF01266.14; Description=FAD dependent oxidoreductase
MVIPVNYAFRDEGLMRVVILGSGVVGVASAWYLAQAGHDVTVIDRQPGAALETSAGNAGQISPGYAAPWAAPGVPLKAVKWMFQKHAPLAVRLDGSKFQLEWMWNMLRNCDMRHYQENKGRMVRIAEYSRDCLKALRSSTGIAYEGRQGGTLQLFRTQQQFDSASKDIAVLREAGVPYELLEAHQLHSVEPALA

SEQ ID NO: 217901 - protein, 105 aa, Glycine max
  Coding DNA Sequence Number=SeqID_101123
  Subcellular localization annotation: CTP_CleavageSite=74; ConfidenceScore=5.55e-01
MLSLKKIFLSLAHFEPILSLSLKTPSSPSSTPFVLSVLPSHITPLPQKKQPPPTSPSTTGKSSSHKYSFSRSFVAYLVQSYPRRALDRRLQEDWARDTGEALGFS

SEQ ID NO: 217902 - protein, 1047 aa, Glycine max
  Coding DNA Sequence Number=SeqID_101124
  Gene Ontology: Mol. function=RNA-directed DNA polymerase activity; Cellular component=chromatin; Biological process=chromatin assembly or disassembly
  Pfam annotation: Domain name=Chromo; Domain location=962-1007; Score =30.5; E_value=5.9e-06; Accession=PF00385.14; Description='chromo' (CHRromatin Organisation MOdifier
  Pfam annotation: Domain name=RVP_2; Domain location=18-130; Score= -56.2; E_value=0.024; Accession=PF08284.2; Description=Retroviral aspartyl protease
  Pfam annotation: Domain name=RnaseH; Domain location=457-574; Score= -26.7; E_value=0.018; Accession=PF00075.14; Description=RNase H
  Pfam annotation: Domain name=rve; Domain location=679-810; Score =40.8; E_value=4.6e-09; Accession=PF00665.16; Description=Integrase core domain
  Pfam annotation: Domain name=zf-H2C2; Domain location=620-661; Score =33.3; E_value=8.6e-07; Accession=PF09337.1; Description=His(2) -Cys(2) zinc finger
  Pfam module annotation: Pfam domain module=Chromo::RVP_2::RVT _1::RnaseH::rve::zf-H2C2; Domain location=962-1007::18-130::255 -519::457-574::679-810::620-661
AQLNLHSLTGPLAPETLRFSGLIVDHQVLILVDGGSTHNFIQDSMVAELGLTPCPTTPLKVMVGNGQFLNCQQVCQAVTLTIQNIAFIIDLHVLPLCGAHVVLGVQWLRSLGPVLTDYTSLSMQFLHNGRIISFKGEDTSTLQPLTSTQLRRLVRTTGDTAYFHLSVTPLDSSPPDTHSPSYPSDIQSLLTKFASLFHPPTALPPSRPTDHHIHLNPNSQTVNVRPYRYPHYQKAEIESQVASMLQRGLIRPSTSPFSSPVLLVRKHDGTWRFCIDYRALNALTIKDRFPIPTIDESLDKLGGASWFSKLDLLQGYHQILMSEEDIYKTAFRTHHGHFEFREQFVLKLSKCTFAQPQVEYLGHLVSAQGVEPVLAKVQVIQQWPEPQSGRALKSFLGLAGFYRCFIRGYATIAAPLTKLVTADPFQWTEEARAAFVHLKEMLTSTPVLRLPDFSLTFTVETDASGTGMGAVLTQRGHPIAYFSKVFPPKLMGASTYVRELFAITAAVKKWRQYLLGRRFHILTDHRSLKELLTQVIQTPEQQMYLARLMGYDYTIMYRSGSSNKVADALSRTLNLFNSVNPSWITDHREFSVTNDLILHKGRIWLPQALPFTSTLLSEYHSTPTGGHMGITKTLARLTENFYWKGIRQDVERFIASCVDCQHTKYETRKPAGLLSPLPVPSRPWEDLSLDFITGLPAFHGHTVILVIVDRFSKGIHLEMLPTQHTAYTVAVLFMDLVGKLHGMPRSLVSDRDPLFLSKFWQELFRVIEQYLRAFVHKKPSSWGKLLRWVEWSYNTSWNSSSGLTPYEITFGKKPVNFPRYLEGDSTIVAVEDLLSERQATFEAIKKKLEKAQSRMKHFADARRRDAHFNVGDLVLVKLRPHRQKSATGQPGGFSKLDKRFYGPFRVTERIGPAAYKLKLPDNSRIHPVFHISLLKLFRSPEPVNDQYCSTLPPHYEHDQLVITPLAILSTRYSADSKLEVLVQWQGLSPDDTTWEDWDKLREAYHLEDKVIPEGVKDDSNIAATRNNIAETRPRRKKKIPAYLRDCV

SEQ ID NO: 217903 - protein, 202 aa, Glycine max
  Coding DNA Sequence Number=SeqID_101125
  Gene Ontology: Mol. function=structural constituent of ribosome; Cellular component=intracellular; Biological process=translation
  Homolog annotation: Hit_ID=Q9AVH1; Match level="QueryCoverage=66%, HitCoverage=63%, E-value=8e-42, Identity=52%"; Hit description =Putative senescence-associated protein
  Pfam annotation: Domain name=Ribosomal_L18p; Domain location=1-116; Score=-26.2; E_value=0.0016; Accession=PF00861.12; Description =Ribosomal L18pL5e family
MKMDFPMGLHFMHHWPLAYAAAKFAGACLCGLKGEVGVTEGSNRSSSIPKVLFQMYRRFEKFYLLLVLATGEDYSMEPAESRRPFCALLDVGLIRTTTGNHVFGALKGALDGGLDIPHSDKRFVGFYKEKKELDAENGIEALYKKVHAAIQADPTLKKSDKQPPKEHKRYNLKKLTYEDRKAKFISRVATLNSTADNNEDDE

SEQ ID NO: 217904 - protein, 61 aa, Glycine max
  Coding DNA Sequence Number=SeqID_101126
MVNNIFTPSRYKEIIMVQPKPSAGLKGKPHQHALIFMPSCIQQSKAWVPRPKSYFGIYPNP

SEQ ID NO: 217905 - protein, 44 aa, Glycine max
  Coding DNA Sequence Number=SeqID_101127
MGSHTWCDITLNMNDFIFEGGTYSGTHVLPMLRCYGRFFKPIFP

SEQ ID NO: 217906 - protein, 380 aa, Glycine max
  Coding DNA Sequence Number=SeqID_101128
  Gene Ontology: Mol. function=hydrolase activity, acting on glycosyl bonds; Biological process=polysaccharide catabolic process
  Homolog annotation: Hit_ID=Q94EU9; Match level="QueryCoverage=99%, HitCoverage=77%, E-value=1e-167, Identity=76%"; Hit description=Beta- amylase PCT-BMYI
  Pfam annotation: Domain name=Glyco_hydro_14; Domain location=91-380; Score=377.5; E_value=2.1e-110; Accession=PF01373.8; Description =Glycosyl hydrolase family 14
  Subcellular localization annotation: CTP_CleavageSite=43; ConfidenceScore=5.00e-01
MALTLRSSISLVNQKETKLPKAKDEVPTKVFYFGKTNPSFRLRAKSSMQQTHVTPNNSFNSEVTMINEKREKVHAPSVAHSHNDSMRVPVFVMLPLDTVTMGGTLNKPRAMNASLMALKSAGVEGVMVDAWWGLVEKEGPLKYNWEAYAELVQMVQRHGLKLQVVMSFHQCGGNVGDSCSIPLPPWVLEEISKNPELVYTDRSGRRNPEYISLGCDSMPVLRGRTPLQVYSDYMRSFRYRFRDYLGSVIIEIQVGMGPCGELRYPSYPESNGTWRFPGIGEFQCYDKYMRASLEASTEAIGKKEWGKNGPHDSGQYNQFPEDTGFFQREGTWNTEYGRFFLDWLLQHAVSRWIPTNSTNAGKTWSCAQFHLHGNEGQRAT

SEQ ID NO: 217907 - protein, 63 aa, Glycine max
  Coding DNA Sequence Number=SeqID_101129
MSEGGKRQRLPESDSCGTHLYVGHITGIQKQQEQAQEVALWHFSIQFLAKQSLSKKQGQYITY

SEQ ID NO: 217908 - protein, 939 aa, Glycine max
  Coding DNA Sequence Number=SeqID_101130
  Gene Ontology: Mol. function=transcription factor activity; Cellular component=nucleus; Biological process=regulation of transcription, DNA-dependent
  Homolog annotation: Hit_ID=Q1SIZ0; Match level="QueryCoverage=99%, HitCoverage=86%, E-value=0.0, Identity=50%"; Hit description=Zinc finger, NF-X1-type; Single-stranded nucleic acid binding R3H; Zinc finger, RING-type; Zinc finger, PHD-type
  Pfam annotation: Domain name=C1_1; Domain location=295-347; Score= -4.8; E_value=0.096; Accession=PF00130.12; Description=Phorbol estersdiacylglycerol binding
  Pfam annotation: Domain name=C1_3; Domain location=304-334; Score =12.9; E_value=0.016; Accession=PF07649.3; Description=C1-like domain
  Pfam annotation: Domain name=zf-NF-X1; Domain location=419-437; Score= 20.0; E_value=0.0086; Accession=PF01422.8; Description=NF-X1 type zinc finger
  Pfam annotation: Domain name=zf-NF-X1; Domain location=474-491; Score= 18.5; E_value=0.024; Accession=PF01422.8; Description=NF-X1 type zinc finger
  Pfam annotation: Domain name=zf-NF-X1; Domain location=561-579; Score= 14.2; E_value=0.17; Accession=PF01422.8; Description=NF-X1 type zinc finger
  Pfam annotation: Domain name=zf-NF-X1; Domain location=614-644; Score= 13.3; E_value=0.22; Accession=PF01422.8; Description=NF-X1 type zinc finger
  Pfam annotation: Domain name=zf-NF-X1; Domain location=653-674; Score= 15.7; E_value=0.12; Accession=PF01422.8; Description=NF-X1 type zinc finger
  Pfam module annotation: Pfam domain module=C1_1::C1_3::zf-NF-X1::zf -NF-X1::zf-NF-X1::zf-NF-X1::zf-NF-X1; Domain location=295-347::304 -334::419-437::474-491::561-579::614-644::653-674
MSSQLRRERRDWSRVPPQGATRQEWVPRGAAAASSNVAQPSNLHSNNNADAGSSNQGVAVAAPSSVSRARSNNHGNDSGSSNQGVAVAVVSVSHGRSNNHGTDAAGSSNQGVAIAALSVSRGRSNIHGNDAGSSNQGVAVAALPASRGRSNNHGTDAAGSSNQGVAIAALSVSCGRSNIHGHDAGSSNQGVAVAAPPASRGRSNNPRNDAGSSNQGLAVAPPVNRGRSNNQGKDSGPSSQGVAVAALASRGRSNNHGTHRMEKEKDKGNKSGSQVEKGLGVGVRYSSLPQLVQEIQEKLMKGTVECMICYEMVQRSAAVWSCSSCYSIFHLNCIKKWARAPISSDLSLSVEKNHELNWRCPGCQSVKFTSSKEIRYVCFCGKRIDPPSDLYLTPHSCGEPCGKPLQKVLVAGGNRDDLCPHACVLQCHPGPCPPCKAFAPPRLCPCGKKNITTRCSDRQSVLTCGQCCDKLLECGRHRCEHICHVGPCNPLRFAIQEAVGNVNFYLAGLRHAVVGKQGWRMNARVVWIRYLPALKTSIPPPLPCGTPPPSCQLPCSVPQPCGHSVSHSCHFGDCPPCSVPVAKECIGGHVVLRNIPCGSKDIRCNHPCGKTRQCGLHACGRTCHPPPCDSQSGVVQGFKAPCGQTCGAPRRSCRHTCMAPCHPSSPCPDIRCEFPVTITCSCGRVTANVPCDGGGSSSNYNADAIHEASIIQTLPAPLQPVDANGKKVPLGQRKLICDDECAKLERKRVLADAFDITAPNLDSLHFSDNSLSSELLSDFFRREPKWVLAVEERCKILVLGKSRGIGTAHGLKVHIFCPMLKEKRDAVRLIADRWKLAVNAAGWEPKRFIVISVTPKSKAPARVIGVKGTTTLNVPLPPAFDPLVDMDPRLVVSFPDLPRDTEINSLVLRFGGECELVWLNDKNALAVFHDPARAATAMR

SEQ ID NO: 217909 - protein, 86 aa, Glycine max
  Coding DNA Sequence Number=SeqID_101131
MENMKMNNDERFAQKGVPVHSQVMKIKQESEKIVDWSPGKPEIRSVLREISRQISRSPLGISGQPISVALVFWFDMFYQVGWGLGN

SEQ ID NO: 217910 - protein, 65 aa, Glycine max
  Coding DNA Sequence Number=SeqID_101132
MEFDVGKGLSKFTNITILFFEPEVRNIITLKSILKVFELASSLKAKFFNNEFGGFAWEDHSHDFC

SEQ ID NO: 217911 - protein, 79 aa, Glycine max
  Coding DNA Sequence Number=SeqID_101133
MEAAKEAKTKAGQGDHKQLRQLSNTPSHVVGLWVRSGNAVGVGLDTLCIMKPEAAMKMMERDIEEEVTVQAFCSNEIMN

SEQ ID NO: 217912 - protein, 70 aa, Glycine max
  Coding DNA Sequence Number=SeqID_101134
MHIKPTANLLQAPISYSNIFLIPAQCQIQAEIRPQCCLAWAKLLVETRPHIEMKDASDILVAKLNKWLIL

SEQ ID NO: 217913 - protein, 330 aa, Glycine max
  Coding DNA Sequence Number=SeqID_101135
  Gene Ontology: Mol. function=protein serine/threonine kinase activity; Cellular component=cytoplasm; Biological process=protein amino acid phosphorylation
  Homolog annotation: Hit_ID=Q1SJ01; Match level="QueryCoverage=82%, HitCoverage=84%, E-value=1e-123, Identity=76%"; Hit description =Serine/threonine protein kinase, active site
  Pfam annotation: Domain name=APH; Domain location=17-208; Score=0.3; E_value=0.0053; Accession=PF01636.13; Description=Phosphotransferase enzyme family
  Pfam annotation: Domain name=Kdo; Domain location=11-179; Score= -86.6; E_value=0.08; Accession=PF06293.4; Description=Lipopolysacchari de kinase (Kdo)
  Pfam annotation: Domain name=Pkinase; Domain location=15-277; Score =252.2; E_value=1.1e-72; Accession=PF00069.15; Description=Protein kinase domain
  Pfam annotation: Domain name=Pkinase_Tyr; Domain location=15-275; Score=49.6; E_value=1.6e-15; Accession=PF07714.7; Description =Protein tyrosine kinase
  Pfam module annotation: Pfam domain module=APH::Kdo::Pkinase::Pkinase_ Tyr; Domain location=17-208::11-179::15-277::15-275
IAKPSAGDTIASADLEKLAVLGHGNGGTVYKVRHKTTSATYALKIIHSDADATTRRRAFSETSILRRATDCPHVVRFHGSFENPSGDVAILMEYMDGGTLETALATGGTFSEERLAKVARDVLEGLAYLHARNIAHRDIKPANILVNSEGEVKIADFGVSKLMCRTLEACNSYVGTCAYMSPDRFDPEAYGGNYNGFAADIWSLGLTLFELYVGHFPFLQAGQRPDWATLMCAICFSDPPSLPETASPEFHDFVECCLKKESGERWTAAQLLTHPFKLFGLMMKATGNGFAGMNGVGDENDEVGEWKVEAWKECMNVEQSILVLRQVDEQ

SEQ ID NO: 217914 - protein, 379 aa, Glycine max
  Coding DNA Sequence Number=SeqID_101136
  Gene Ontology: Mol. function=structural constituent of ribosome; Cellular component=small ribosomal subunit; Biological process =translation
  Homolog annotation: Hit_ID=Q1SHZ2; Match level="QueryCoverage=70%, HitCoverage=87%, E-value=1e-122, Identity=81%"; Hit description =Ribosomal protein S2, eukaryotic and archaeal form
  Pfam annotation: Domain name=Ribosomal_S2; Domain location=90-258; Score=332.3; E_value=8.5e-97; Accession=PF00318.10; Description =Ribosomal protein S2
  Subcellular localization annotation: CTP_CleavageSite=67; ConfidenceScore=5.03e-01
MTWPRGPNVNAERALTSFLNVRVLSLSLARPFLHNSREPSETLISQTFRGHPATPKPPPPLLPPGAMAATDSSAASSRQLSQRETDIQMMLAADVHLGTKNCDFQMERYVFKRRTDGIYIINLGKTWEKLQLAARIIVAIENPQDIIVQSARPYGQRAVLKFAQYTGAHAIAGRHTPGTFTNQMQQSYNEPRLLILTDPRTDHQPIKEGALGNIPTIAFCDTDSPMRYVDVGIPANNKGKHSIGCLFWLLARMVLQMRGTIRPGHKWDVMVDLFFYREPEEAKQQEEDEAPPAQDYAISDFNAAGIGSFPATDGQWPAAVEQPWTEEAPQPISAAPTNWTPEAAAAGDWGEAVPAPAPAPVPQAGAPPAQAFPPATGWD

SEQ ID NO: 217915 - protein, 173 aa, Glycine max
  Coding DNA Sequence Number=SeqID_101137
  Gene Ontology: Mol. function=transferase activity, transferring glycosyl groups; Cellular component=endoplasmic reticulum; Biological process=GPI anchor biosynthetic process
  Homolog annotation: Hit_ID=Q500W7; Match level="QueryCoverage=85%, HitCoverage=32%, E-value=3e-68, Identity=81%"; Hit description=GPI mannosyltransferase 1
MASLDIHSLLLFSAIFRVILIVYGEWQDAHMEVRYTDVDYLVFSDAAALMAVGDSPYKRTTYRYSPLLAFLLIPNSFIHRSWGKFLFSASDLLVGYFIYYILKLRKVPENLCNYSVMTWLFNPFTFTIGTRGNCEPIVCAVVLWIIICLMKDKVESTFGKKFYNLYCSVLERI

SEQ ID NO: 217916 - protein, 153 aa, Glycine max
  Coding DNA Sequence Number=SeqID_101138
  Gene Ontology: Mol. function=protein serine/threonine kinase activity; Cellular component=cellular bud neck; Biological process =protein amino acid phosphorylation
  Homolog annotation: Hit_ID=Q1SJ01; Match level="QueryCoverage=100%, HitCoverage=50%, E-value=6e-38, Identity=54%"; Hit description =Serine/threonine protein kinase, active site
MALIRRRHPNLRLPILEPTERKPHFSLPLVPPTTKPTTNDDITIDDLEKLVVLGHGNGGTIYKVYHKTTSTTCALKIIHGGTDVTTHRRALVEASILRRATNCPHVVNFYSSFEMPTGDVAILMEYMDGGSLETALAVNGTFSEERLVTVARD

SEQ ID NO: 217917 - protein, 161 aa, Glycine max
  Coding DNA Sequence Number=SeqID_101139
  Homolog annotation: Hit_ID=O64527; Match level="QueryCoverage=98%, HitCoverage=65%, E-value=5e-31, Identity=49%"; Hit description =Uncharacterized protein At1g79260
  Pfam annotation: Domain name=DUF1794; Domain location=2-161; Score =29.0; E_value=2.3e-09; Accession=PF08768.1; Description=Domain of unknown function (DUF1794)
MPVIGYTQKTWKLSSGEPMHAESGYWRPKPDGTIEVVIAQSNGLVEVQKGTYSAEEKVIQLQSEIVGNASKEIISLPYLSLYPMVKQFRYPLQIKETTLLPTLQPYYQLYYNIEISFLALSVVKEIRRCFQLVDGNLCYDVQMATNKITLQPHLKASLKKL

SEQ ID NO: 217918 - protein, 642 aa, Glycine max
  Coding DNA Sequence Number=SeqID_101140
  Gene Ontology: Mol. function=catalytic activity; Cellular component =intracellular; Biological process=metabolic process
  Homolog annotation: Hit_ID=Q9FK33; Match level="QueryCoverage=99%, HitCoverage=91%, E-value=0.0, Identity=63%"; Hit description =Selenium-binding protein-like
  Pfam annotation: Domain name=PPR; Domain location=105-138; Score =12.6; E_value=0.24; Accession=PF01535.11; Description=PPR repeat
  Pfam annotation: Domain name=PPR; Domain location=237-271; Score =35.0; E_value=2.6e-07; Accession=PF01535.11; Description=PPR repeat
  Pfam annotation: Domain name=PPR; Domain location=272-306; Score=3.8; E_value=2.7; Accession=PF01535.11; Description=PPR repeat
  Pfam annotation: Domain name=PPR; Domain location=338-372; Score =48.2; E_value=2.7e-11; Accession=PF01535.11; Description=PPR repeat
  Pfam annotation: Domain name=PPR; Domain location=373-407; Score =10.5; E_value=0.43; Accession=PF01535.11; Description=PPR repeat
  Pfam annotation: Domain name=PPR; Domain location=475-509; Score=9.7; E_value=0.53; Accession=PF01535.11; Description=PPR repeat
  Pfam annotation: Domain name=PPR; Domain location=70-104; Score=25.2; E_value=0.00023; Accession=PF01535.11; Description=PPR repeat
  Pfam module annotation: Pfam domain module=PPR::PPR::PPR::PPR::PPR::PP R::PPR; Domain location=105-138::237-271::272-306::338-372::373 -407::475-509::70-104
MDQKLKPKPKKVEYMERNVPVLEDTQIRKTSPSGLCSQIEKLVVCNRHREAMELFEILELEHDGYGVGASTYDALVSACVGLRSIRGVKRVFNYMINSGFEPDLYVMNRVLFMHVKCGLMLDARKLFDEMPEKDVASWMTMVGGLVDTGNFSEAFRLFLCMWKEFNDGRSRTFATMIRASAGLGLVQVGKQIHSCALKRGVGDDHFVSCALIDMYSKCGSIEDAHCVFDQMPEKTTVGWNSIIASYALHGYSEEALSLYFEMRDSGTTVDHFTISIVIRICARLASLEHAKQAHAALVRHGFATDIVANTALVDFYSKWGRMEDARHVFNRMRHKNVISWNALIAGYGNHGQGQEAVEMFEQMLQEGVTPTHVTFLAVLSACSYSGLSQRGWEIFYSMKRDHKVKPRAMHYACMIELLGRESLLDEAYALIRTAPFKPTANMWAALLTACRMHKNLELGKLAAEKLYGMEPEKLCNYIVLLNLYNSSGKLKEAAGILQTLKKKGLRMLPACSWVEVKKQPYAFLCGDKSHSQTKEIYQKVDNLMVEICKHGYAEENETLLPDVDEEEQRILKYHSEKLAIAFGLINTPHWTPLQITQGHRVCGDCHSAIKLIAMVTGREIVVRDASRFHHFRNGSCSCGDYW

SEQ ID NO: 217919 - protein, 223 aa, Glycine max
  Coding DNA Sequence Number=SeqID_101141
  Gene Ontology: Mol. function=RNA-directed DNA polymerase activity; Biological process=RNA-dependent DNA replication
MGCTKISSLTQNNTPKRKDSRERKNPEERSSANLSTQSSQWWKDLQKAINPPNALSGFEDCITRKLGNGQNTLFGEHSWCDRQPLYRQYQRLYQVANNKEAKVAEVIQPNINRISCRWVWRLQLFLWEEELLLQPESELRSTLQFSIDEDGWVWKPSGNQSTVASAFNHLQATVLEEEHQEICHILKKFWVCETPTKVLTFSWRLLWNKLPTCDQLQRRNIHI

SEQ ID NO: 217920 - protein, 77 aa, Glycine max
  Coding DNA Sequence Number=SeqID_101142
MLWKPVRVPKIELVIISTVEDEEILKVEVEEILIKEEIVILNHPTKEKVKILLVRLIEEEVEELTWVKGSHLLQLPN

SEQ ID NO: 217921 - protein, 104 aa, Glycine max
  Coding DNA Sequence Number=SeqID_101143
  Homolog annotation: Hit_ID=Q9SWB2; Match level="QueryCoverage=74%, HitCoverage=100%, E-value=6e-39, Identity=100%"; Hit description =Seed maturation protein PM41
MKHKNKHRSKEIVEFVITQHKHIYRKMSGAQGAQPKESKTATTYESVEGGENRTRTDLLSREDQGCIQVEKLQEKVHDPAGKGGPVFGAGKDEDKQDLGVTGTG

SEQ ID NO: 217922 - protein, 571 aa, Glycine max
  Coding DNA Sequence Number=SeqID_101144
  Gene Ontology: Mol. function=protein serine/threonine kinase activity; Cellular component=cytoplasm; Biological process=protein amino acid phosphorylation
  Homolog annotation: Hit_ID=Q1SXL1; Match level="QueryCoverage=99%, HitCoverage=98%, E-value=0.0, Identity=73%"; Hit description =Serine/threonine protein kinase, active site
  Pfam annotation: Domain name=Pkinase; Domain location=176-511; Score =245.6; E_value=1.1e-70; Accession=PF00069.15; Description=Protein kinase domain
  Pfam annotation: Domain name=Pkinase_Tyr; Domain location=176-505; Score=-36.4; E_value=3.1e-10; Accession=PF07714.7; Description =Protein tyrosine kinase
  Pfam module annotation: Pfam domain module=Pkinase::Pkinase_Tyr; Domain location=176-511::176-505
  Subcellular localization annotation: CTP_CleavageSite=58; ConfidenceScore=5.17e-01
MEHKLSEGAHPSAHSSCSNSGNNSPTHPKNVNQEPKDTSTTTTTTNVHNSGNETGHVDQASKTDQAKLEGKSRPQKLIPPSRNISDFNPQQHQSPSTNKPNSNSDHPPHAKAMSVSTPQTKTSSTNNLQGQGSGASSRSDSLESTSAPIRPHTGGDVRWEAINMISRVGPLNLSHFRLLKRIGYGDIGSVYLVELKGTRTYFAMKVMDKAALISRNKLLRAQTEREILGLLDHPFLPTLYSYFETRKFYCLVMEFCSGGDLHSLRQKQPNKCFTEEAARFYASEVLLALEYLHMLGIVYRDLKPENLLVRDEGHIMLSDFDLSLRCSVNPTLVKSSSAHASNSSSGSNNDVGSILTDDQAVQSTTQVSSFFPRILPSKKNRKAKSDFGILVGGGRLPELMAEPTNVRSMSFVGTHEYLAPEIIKGEGHGSAVDWWTFGIFLYELLHGTTPFKGSGYKATLFNVVGQPLRFPETPQVSAVARDLIRGLLVKEPQKRIAYKRGATEIKQHPFFEGMNWALVRSATPPHIPEVIDFSKYASKDTAPPPDKKMADIANDKHSNSATDSYIEFEYF

SEQ ID NO: 217923 - protein, 160 aa, Glycine max
  Coding DNA Sequence Number=SeqID_101145
  Subcellular localization annotation: CTP_CleavageSite=64; ConfidenceScore=5.64e-01
MILLTQQVHPLLTFSSTYKSNSPLHPHVQLKVGVGVVTPFSQVPIMPFCKGRPYRRRRKGSRCSSSAAAQAPLPPDPDKENREDSDGVVVAQGESPDLQTLFRRFWKVAAPYWTSDDKGPARLQLAAAFVNIRINQSSSLTSDEAKIVYINEGSPHPTSR

SEQ ID NO: 217924 - protein, 60 aa, Glycine max
  Coding DNA Sequence Number=SeqID_101146
  Pfam annotation: Domain name=PPR; Domain location=6-40; Score=27.7; E_ value=4.2e-05; Accession=PF01535.11; Description=PPR repeat
MVLDTVTYNSLVDGLCKSGRIPYVWNLIDEMQRSTNKCVEVADIFLEAIETIKPYLVIAC

SEQ ID NO: 217925 - protein, 393 aa, Glycine max
  Coding DNA Sequence Number=SeqID_101147
  Gene Ontology: Mol. function=oxidoreductase activity, acting on the CH-OH group of donors, NAD or NADP as acceptor; Cellular component =mitochondrion; Biological process=isocitrate metabolic process
  Homolog annotation: Hit_ID=O82585; Match level="QueryCoverage=99%, HitCoverage=100%, E-value=0.0, Identity=94%"; Hit description=NADP -dependent isocitrate dehydrogenase
  Pfam annotation: Domain name=Iso_dh; Domain location=7-379; Score =315.4; E_value=9.9e-92; Accession=PF00180.10; Description =Isocitrateisopropylmalate dehydrogenase
MGFQKIRVGNPIVEMDGDEMTRVIWKLIKDKLIFPYLELDIKYFDLGLPHRDATNDRVTIESAEATLKYNVAIKCATITPDEARVKEFNLKQMWRSPNGTIRNILNGTVFREPIICKNIPRLVSGWTKPICIGRHAFGDQYRATDTVIKGPGKLKLVFAPSGNEGIKELEVYNFTGAGGIALSMYNTDESIRAFAEASMNFAYQKKWPLYLSTKNTILKKYDGRYEHRLIDDMVAYALKSDGGYVWACKNYDGDVQSDFLAQGFGSLGLMTSVLVCPDGKTIEAEAAHGTVTRHYRVHQKGGETSTNSIASIFAWSRGLAHRAKLDGNARLLDFTEKLEAACIGTVELGKMTKDLALLVHGPKVSRSQYLNTEEFIDAVAEELRTRLSSQSKL

SEQ ID NO: 217926 - protein, 582 aa, Glycine max
  Coding DNA Sequence Number=SeqID_101148
  Gene Ontology: Mol. function=ATPase activity, coupled to transmembrane movement of substances; Cellular component=integral to membrane; Biological process=transport
  Homolog annotation: Hit_ID=Q5QNE1; Match level="QueryCoverage=99%, HitCoverage=75%, E-value=0.0, Identity=66%"; Hit description =Putative ABC transporter Nda
  Pfam annotation: Domain name=ABC_membrane_2; Domain location=1-199; Score=55.7; E_value=1.6e-13; Accession=PF06472.5; Description=ABC transporter transmembrane region
  Pfam annotation: Domain name=ABC_tran; Domain location=318-554; Score= 92.5; E_value=1.3e-24; Accession=PF00005.17; Description=ABC transporter
  Pfam annotation: Domain name=NACHT; Domain location=319-501; Score= -41.7; E_value=0.1; Accession=PF05729.3; Description=NACHT domain
  Pfam annotation: Domain name=SbmA_BacA; Domain location=1-250; Score=- 134.5; E_value=0.00091; Accession=PF05992.3; Description=SbmABacA -like family
  Pfam module annotation: Pfam domain module=ABC_membrane_2::ABC _tran::NACHT::SbmA_BacA; Domain location=1-199::318-554::319-501::1 -250
MLIFVLRDYARETLSLRWRSWMTRYYIDRYLKNQTFYKIQSQSIIDNPDQRIVDDLSSFTGTSLAFSLTLFNAAVDLISFSNILYGIYPPLFVVLIVYSIGGTAISVFLGRGLVNLNFLQEKKEADFRYGLVRVRENAESIAFYSGEESEMQLLLQRFKSAFENLTQLLIASRNLDFFTSGYRYLIQVLPAAVVAPLYFSGKIEFGVINQSLSAFNHILGDFSLIVYQFQAISAFSAVINRLGEFDDVLDRSSSNSLTDTVEDIQITYKDFSSSSALESNGSTPPEKYATLLEIEDLILKTPSESTLIRDLSLTIKEKDSLLVMGPSGSGKTSLLRAMAGLWKTGTGKITYYVKGGEYPEQSICSDVNTPVNNANDTYEARGKCLSRKSGIFFLPQRPYMVLGTLREQLMYPTWTDDVVPMSDSTKEKNALPFLTNLPNLDNANDKPMKPTTDELIKVLEDVRLGYLLARFSLDSIHEWSSVLSLGEQQRLAFARLLLSKPQLALLDESTSALDEVNEVHLYQKIGAANITYVSIGHRSSLCAYHDKILSISTFNSDSEQLNWCIEPIEPTRPESSLKFTNL

SEQ ID NO: 217927 - protein, 128 aa, Glycine max
  Coding DNA Sequence Number=SeqID_101149
  Gene Ontology: Mol. function=solute:hydrogen antiporter activity; Cellular component=integral to membrane; Biological process =regulation of pH
  Homolog annotation: Hit_ID=Q1S134; Match level="QueryCoverage=99%, HitCoverage=18%, E-value=2e-21, Identity=44%"; Hit description =Probable Na/H antiporter [imported]-Arabidopsis thaliana, putative
MAEDRAIWPSSVATRLSSIKVSDTTAKLLKKEAKKGNTPNRQQRFADFNVVTTSIFKQVRNTQYVVPILDNVFRNRDCLTGKRAPNISSWRPKNVGPNRMPALNAYDDAADEFGCIDRPEDIMKGFRE

SEQ ID NO: 217928 - protein, 374 aa, Glycine max
  Coding DNA Sequence Number=SeqID_101150
  Gene Ontology: Mol. function=DNA binding; Cellular component=beta -galactosidase complex; Biological process=DNA integration
  Homolog annotation: Hit_ID=Q1SDN3; Match level="QueryCoverage=99%, HitCoverage=28%, E-value=1e-119, Identity=57%"; Hit description =Polynucleotidyl transferase, Ribonuclease H fold
MTTVRLVLSLAASQGWHLHQLDVNIAFLHGDLHEEVYMKVSPGLIVANPALVCKLQRSLYGLKQASRQWNAKLTSTLLDSGFQQSKADYFLFTKRSPTGLTIVLVYVDDLVLIGTDLVEIQQLKQSLDAKFGIKDLGILKYFLGFEVARSTLGIVLHQRKYCLDLLQDIGLLAAKPCSLPMDPTLKLHKASGVTLSDSIVYRRLIGCLLYLTHTRPDICYVVGKLSQYLQSPTNIHMQAAHHVLRYLKGTAGRSLFFSSSASTSLIGFSDSDWGACLDTRRSISGMCFFLGTSLISWKSKKQSIVSRYSSEAEYRTLAQASCEAQWLLFLLKDLHIDHPKPVVLYCDNQAALHIVANPVFHERTKHIEIDCHVV

SEQ ID NO: 217929 - protein, 205 aa, Glycine max
  Coding DNA Sequence Number=SeqID_101151
  Gene Ontology: Mol. function=nucleic acid binding; Biological process= DNA integration
  Pfam annotation: Domain name=zf-CCHC; Domain location=156-173; Score =14.6; E_value=0.0038; Accession=PF00098.13; Description=Zinc knuckle
MWMENALNIWNTLKKRYYQGDVFRISDLQEELYLLKQRDATITSYFTKLKGLIQELDNFRPIPSYTCVVVCDLIPVIKSYREGDYVVRFLRGLNEQYSTVRSNIMMMDPLPDLDKVFSILIQQERCQMDTSQASYGRGRGRGSHSLGGRGRGRGSKICSYCNKTGHMVDTCYKKHGYSPHLQRGGAINQYSLDDQEIEDDLQSLG

SEQ ID NO: 217930 - protein, 294 aa, Glycine max
  Coding DNA Sequence Number=SeqID_101152
MVIDQSLFHDLTQLSSDGVPFEGTLNDDWKFDFSAHDARQLVCTNNADMTECLLAGSLAFESRILHYLIVRILLPRSSNLAQVSEEDLVIMWAFHTGRQLEWAHLVRYRMHKALRLNAPLPYPHLVTLFFRHFQIPLDSEPYVPIKRSFLIGAAVIASFGYRKEHDGSWVKKGAQSADEEGNLPVEDNSTLLRRLMDKFDGLQTFVGDKFDAMELQVDMRFDAMESRITKVEEDVSFIRTCFDPPPPPPSLMQAPLELVGLGSSSSMDSFASWKMNGSGMEKGRERGDATSRRR

SEQ ID NO: 217931 - protein, 216 aa, Glycine max
  Coding DNA Sequence Number=SeqID_101153
  Homolog annotation: Hit_ID=Q6Z2N3; Match level="QueryCoverage=79%, HitCoverage=70%, E-value=1e-67, Identity=69%"; Hit description =Putative Lil3 protein
  Subcellular localization annotation: CTP_CleavageSite=45; ConfidenceScore=5.71e-01
MASFSPLTNFSTAPSPYSKIGFFHNPFITLRSSNALLRLSPLKVSADNEVATSASAFEEPRWIGGTWDLKQFQINGNTDWDAVIDAGQVKRRKWLGDNPESSTNDNPVVFNTAIIPWWAWIKRFHLPEAELLNGRAAMIGFFMAYVVDSLTGVGVVDQMSNFFCKTLLFTAVSGILLVRKNEDIETLKKLWEEITFYDKQWQATWQDENSSTPKKD

SEQ ID NO: 217932 - protein, 71 aa, Glycine max
  Coding DNA Sequence Number=SeqID_101154
  Homolog annotation: Hit_ID=Q1S125; Match level="QueryCoverage=73%, HitCoverage=20%, E-value=1e-11, Identity=65%"; Hit description =Single hybrid motif
  Pfam annotation: Domain name=Biotin_lipoyl; Domain location=8-66; Score=-17.2; E_value=0.061; Accession=PF00364.12; Description=Biotin- requiring enzyme
MEERVCILLGSSWVRKGDVIKEGQVIGYLDQFGTGLPIRSDVAGEVLKLLVEDGGLLGTERVMIAVLFIQN

SEQ ID NO: 217933 - protein, 146 aa, Glycine max
  Coding DNA Sequence Number=SeqID_101155
  Subcellular localization annotation: CTP_CleavageSite=20; ConfidenceScore=5.07e-01
ARRARARPSDLPSTSVAHTPASTSVVAPAGSIPSIEQFLERDASSEATIPEPFIVKEETSETRVRQEATATLERSREVTSNPPTSVVDLSSPQHATDPSTPILEIPEDPTTPVLTLNTSSPATLVLHLTDEEDVKTQDTQDQSQEF

SEQ ID NO: 217934 - protein, 84 aa, Glycine max
  Coding DNA Sequence Number=SeqID_101156
MEKKGIVEKGHVEEYLTKIVAWLLGPYVVTWLIDSEHVVESMRGRETYWNYEACTKDGSLDSNNDHVSFALSNFKCFVTHWCGE

SEQ ID NO: 217935 - protein, 1081 aa, Glycine max
  Coding DNA Sequence Number=SeqID_101157
  Gene Ontology: Mol. function=histone-lysine N-methyltransferase activity; Cellular component=nucleus; Biological process=chromatin modification
  Homolog annotation: Hit_ID=Q8VZ17; Match level="QueryCoverage=75%, HitCoverage=95%, E-value=1e-176, Identity=44%"; Hit description =Histone-lysine N-methyltransferase, H3 lysine-9 specific SUVH6 (EC 2.1.1.43) (Histone ...
  Homolog annotation: Hit description=H3-K9 methyltransferase 6) (H3-K9- HMTase 6) (Suppressor of variegation 3-9 homolog protein 6) (Su(var)3- 9 homolog protein 6)
  Pfam annotation: Domain name=Pre-SET; Domain location=801-897; Score =129.0; E_value=1.3e-35; Accession=PF05033.6; Description=Pre-SET motif
  Pfam annotation: Domain name=SET; Domain location=899-1058; Score =178.8; E_value=1.4e-50; Accession=PF00856.18; Description=SET domain
  Pfam annotation: Domain name=YDG_SRA; Domain location=625-777; Score =269.4; E_value=7.2e-78; Accession=PF02182.8; Description=YDGSRA domain
  Pfam module annotation: Pfam domain module=Pre-SET::SET::YDG_SRA; Domain location=801-897::899-1058::625-777
MAAPVSNGHSEEGRNEKSLMENGEYTFFARSMYKRRKVSAVRDFPDGCGPFALRIDPVLNVNIVGCGSTNGTIIEDKNGEHLGDDTVKTSNCENDGSHSEVKDSLLTETLGQTTDSGLNMENPVVSSPQVNGSTAEHEPAKVTIGQTIESGLNKENPVVSSHKMDGLTAEEEAAKVTVEQTIDRVLNKENPVVSSHQVDGPTAEDESVKVPLVDIEILNAEFARTANTVKCDSSYMLKSSSQVGEVVMSGGLKPLLPNVNISGSSACMVEPVTRRYLPRRKVSALRDFPALCGRNAPHLSKDKDVCLEGISSLNNKKACQQNLALDDNNPLKEVGAMAVDPLKEVGPADVKEIKSNIQDEYGYKRKLVDIVQTDSESNAAKRVKKPLEIKRDKHFTLPEESNHHVKINSKAEVKEQNREETKPLDLSHSKHKLKGNFNGSRVSSERKVVLGLMAESECPWRSDKGSSKFKFGDAKNEGKKKKVTVALPDRSKTAIKSKGAQNYSRQKPFKKKKGNATSEGMSELVICEKKDSLDSYENNEDLQIVLKSHEFNVNVTPSHSNFTGDEDDSNVTRKKVRKTLRLFQVVFRKLLQEVESKLSERANSKRVDLIAAKILKENGHYVNSGKQILGDVPGVEVGDEFQYRVELNIVGLHRQIQGGIDYVKQNGKILATSIVASGAYADDLDNSDGLIYTGQGGNVMNTDKEPEDQKLERGNLALKNSIEEKNSVRVIRGSESMDGKCRIYVYDGLYVVESCWQDVGPHGKLVYKFRLRRILGQPELALKEVKKSKKFKTREGVCVDDISYGKERIPICAVNTIDDENPPPFNYITSMIYPNCHVLPAEGCDCTNGCSDLEKCSCVVKNGGEIPFNHNEAIVQAKPLVYECGPTCKCPSTCHNRVSQLGIKFQLEIFKTDTRGWGVRSLNSIPSGSFICEYIGELLEDKEAEQRTGNDEYLFDIGNNYSNSTLWDDLSTLTTLMPDAHSASCEVVKDGGFTIDAAQFGNLGRFINHSCSPNLIAQNVLYDHHDTRMPHIMFFAADNIPPLQELTYDYNYEIDQVRDSDGNIKKKYCYCGSVDCTGRMY

SEQ ID NO: 217936 - protein, 244 aa, Glycine max
  Coding DNA Sequence Number=SeqID_101158
  Gene Ontology: Cellular component=extracellular region; Biological process=sexual reproduction
  Homolog annotation: Hit_ID=O23547; Match level="QueryCoverage=58%, HitCoverage=56%, E-value=2e-50, Identity=62%"; Hit description =Expansin-like B1 precursor
  Pfam annotation: Domain name=Pollen_allerg_1; Domain location=79-159; Score=23.9; E_value=2.1e-05; Accession=PF01357.11; Description=Pollen allergen
MMMMMMNQVRCKIPQFCDENGAYVVVTDYGEGDRTDFIMSPRAYSRLGRNADASAELFKYGVMDVEYRRVPCRYGGYNLLVKVHEHSRNPHYLAIVILYLGGTYDVTAVELWQEDCQEWRRMRRAFGTVFDAENPPRGDIKLRFQLSGNAENDSRNINSDYGGSGDDSESDISGSGNDFDSNGGGAISGDDDNNVNDNSNDSDNDEIVMLLVDASNDGVIMVVTMSVVMLVATIVILSGDDCNK

SEQ ID NO: 217937 - protein, 112 aa, Glycine max
  Coding DNA Sequence Number=SeqID_101159
MDAFRAMLLHIHISTFSYFTPPPCTPMALFLSHGATWHCRIPSKPSRTVKSHAGSENYNLVLKKDKCLGDEECVSEVGSGTTIAAVVTSMGGPPAAVGIVRLSRPGAVSIVG

SEQ ID NO: 217938 - protein, 269 aa, Glycine max
  Coding DNA Sequence Number=SeqID_101160
  Gene Ontology: Mol. function=endopeptidase inhibitor activity
  Homolog annotation: Hit_ID=Q1SV12; Match level="QueryCoverage=68%, HitCoverage=95%, E-value=4e-52, Identity=53%"; Hit description =Kunitz inhibitor ST1-like
  Pfam annotation: Domain name=Kunitz_legume; Domain location=30-190; Score=28.9; E_value=3.1e-07; Accession=PF00197.9; Description =Trypsin and protease inhibitor
MSMKLLLASLSISVWLFMATLSLAQSNNRYVFDTHGDPLETDDEYYIRPAITDNGGRFTLINRNRSCPLYVGLENTDTPQGYPMKFTPFANKDDDDNLRVNTDLKVTLVQVSTTCVQSTEWKLGENDTRSGRRLIVTGRDNGIQKSVGIYNIRWCPTEACPTCRFICGTGGILRENGRILFALDGNKVEEVPGGGEEEEEEEGEGVAEEGEEEDEEEEEGVVEEEVGQVVGEARGGFRDGGWEAEGGGVKEHAPGAPRRHHALTCFLYV

SEQ ID NO: 217939 - protein, 467 aa, Glycine max
  Coding DNA Sequence Number=SeqID_101161
  Gene Ontology: Mol. function=sequence-specific DNA binding; Cellular component=nucleus; Biological process=regulation of transcription, DNA-dependent
  Homolog annotation: Hit_ID=Q8W4H1; Match level="QueryCoverage=94%, HitCoverage=95%, E-value=5e-71, Identity=47%"; Hit description=GATA transcription factor 28
MDHQRSQYYAMHVGLDGGQRELLRNIPLYMLEQKLMIMMIKGFPGLVNLGPAQSVVWDAMVPSRKRTCVGRPKPSSVEKLTKDLCTILHEQQSYFSVSSEEDLLFESDTPMVSVEIGHGSILIRHPSYIAREEESEASSLSVDNKQCPMSEAYSFSGAIAMHNDSSRLKSSSLEVEKIGNSTGQGMQQEQLKRHAFVHCDKSQLERVQILGNHESPLCSIDLNDVVNYEEFLRILTNEEQQQLLKLLPVVDTAKLPDSLEVMFSSSQFKENLTYFQQLLAEGVFDISLLGAKSEDCKILKRLALSNLSKSKWVAHHNFLKKCKNKAGKSNTMGSTGTTSTNVLNNRASTDVANIKRMRDSRNQNLPEIKTIMRSPKRTIAKASCEGKEAVEDGACYSPKHLFALPPDASFLLLDSLNFVQESSDQDLLLEVSSNTSFPQAELLQPTLSLGAQASTSSSSIYSNLVHH

SEQ ID NO: 217940 - protein, 128 aa, Glycine max
  Coding DNA Sequence Number=SeqID_101162
  Gene Ontology: Mol. function=dihydroorotate dehydrogenase activity; Cellular component=cytoplasm; Biological process='de novo' pyrimidine base biosynthetic process
  Homolog annotation: Hit_ID=Q1SIZ4; Match level="QueryCoverage=70%, HitCoverage=21%, E-value=2e-33, Identity=78%"; Hit description =Dihydroorotate dehydrogenase 1
  Subcellular localization annotation: CTP_CleavageSite=38; ConfidenceScore=5.40e-01
MASLSMTQIRTGNCASGFGLNCAGKVKVGPSRVGFKVFASETQATEPDLSVTVNGLHMPNPFVIGSGPPGTNYTVMKRAFDEGWGAVIAKTEWVCVIVNTDTWSCVVIWELRLKTEEFGVLWSKMPIF

SEQ ID NO: 217941 - protein, 191 aa, Glycine max
  Coding DNA Sequence Number=SeqID_101163
  Gene Ontology: Mol. function=dihydroorotate dehydrogenase activity; Cellular component=cytoplasm; Biological process='de novo' pyrimidine base biosynthetic process
  Homolog annotation: Hit_ID=Q1SIZ4; Match level="QueryCoverage=83%, HitCoverage=44%, E-value=4e-76, Identity=92%"; Hit description =Dihydroorotate dehydrogenase 1
MGAAVGQDVLFWKSLSFTITMLITLLMRLLIASKGCSKFRMYSTPGGYSAKAVHPIALGKVMSIAKMMKSEFDSENYTLSAIGGVETGGDAAEFILLGANTVQVCTGVMMHGYGLVKKLCLELQDFMKKHNFTSIEDFRGVSLEYFTTHTDLVRRQKEAVQKRKAIKKGLQSDKDWTGDGFVQETESMVSN

SEQ ID NO: 217942 - protein, 51 aa, Glycine max
  Coding DNA Sequence Number=SeqID_101164
YEALKMHGVSTCSFQVGDISNLERELKIDQMQATEKQNLGMFSQSELDLFM

SEQ ID NO: 217943 - protein, 118 aa, Glycine max
  Coding DNA Sequence Number=SeqID_101165
MVVLETCMALAVVVVPFLTGVLDAMAVALAEAVVVADLLTSSAKFFLNMGTLLMFVISRLITSNTWVNPNSKSTGLGHSQPSALLTNSSSYGTGLANSTWILDSGASFHVTGDSQNIK

SEQ ID NO: 217944 - protein, 657 aa, Glycine max
  Coding DNA Sequence Number=SeqID_101166
  Gene Ontology: Mol. function=CTP synthase activity; Cellular component=cellular_component; Biological process=pyrimidine nucleotide biosynthetic process
  Homolog annotation: Hit_ID=Q9LTW8; Match level="QueryCoverage=89%, HitCoverage=99%, E-value=0.0, Identity=74%"; Hit description=CTP synthase
  Pfam annotation: Domain name=CTP_synth_N; Domain location=1-284; Score=687.9; E_value=7.5e-204; Accession=PF06418.4; Description=CTP synthase N-terminus
  Pfam annotation: Domain name=GATase; Domain location=308-545; Score =279.9; E_value=4.9e-81; Accession=PF00117.18; Description=Glutamine amidotransferase class-I
  Pfam annotation: Domain name=Peptidase_C26; Domain location=301-527; Score=-97.9; E_value=0.006; Accession=PF07722.3; Description =Peptidase C26
  Pfam module annotation: Pfam domain module=CTP_synth_N::GATase::Peptid ase_C26; Domain location=1-284::308-545::301-527
MKYVLVTGGVVSGLGKGVTASSIGLILKACGLRVTSIKIDPYLNTDAGTMSPFEHGEVFVLDDGGEVDLDLGNYERFLDIKLTRDNNITTGKIYQSVIEKERRGDYLGKTVQVVPHITDAIQEWIERVAKIPVDGKEGPADVCVIELGGTIGDIESMPFIEALGQFSYRVGPGNFCLVHVSLVPILHVVGEPKTKPTQHSVRQLRGLGLTPNLLACRSSKELDDNVKAKLGQFCHVPLSNILTLHDVPNIWHIPLLLKDQKAHEAILKALNLLGVAAEPNLKEWTARTKVYDRCHEIVRIAMVGKYTGLSDAYLSVLKALLHASVARNRKLIVDWVPAGDLEEATYNEDPEAHKAAWSLLKGANGVLVPGGFGDRGVQGKILAAKYAREHNVPFLGICLGMQIAVIEFARSVLGLHDATSTEFNPETKTPCVIFMPEGSKTHMGGTMRLGSRRTYFEVADCKSAKLYGNASFVDERHRHRYEVNPDMISQLENAGLSFVGKDETGRRMEIVELPSHPFFIGVQFHPEFKSRPGKPSPLFSGLIAAASEQRSTIMVPSSNGHAKLTNGNGMYNGHSPKLKAHQKGNGFKASNGSLNVVSPHIKCLVHANNRGITISKGILLVLGCLYSYCSHHWFHSLVKYWPKLHLIMPNIWALVAF

SEQ ID NO: 217945 - protein, 66 aa, Glycine max
  Coding DNA Sequence Number=SeqID_101167
MESERPSSTINETYKQQQEPEEEDDDDYHNEEEEEEEEENNEILKRRISNHPLYGLLVEAHLDCLK

SEQ ID NO: 217946 - protein, 108 aa, Glycine max
  Coding DNA Sequence Number=SeqID_101168
MEMPMTFSSTFEIIYFILTGLGWNRVRATQPNPQVKEWVENPGCISNTFTTQQRSGISMEEAWPLTPLGTGPSGAGLPQGHNDGSGGTIVRRDFTGVGQKKTWQEEGR

SEQ ID NO: 217947 - protein, 106 aa, Glycine max
  Coding DNA Sequence Number=SeqID_101169
MSYPIPLHHQSPQKCRSQDPDPKNSVASHDCERLKFGLLWDSFRRCLFVAHGLSVEDLDGAGANLEGDGDPARSEKSATTRKQKSYSVCGSGKRGRTPWRSKALHQ

SEQ ID NO: 217948 - protein, 87 aa, Glycine max
  Coding DNA Sequence Number=SeqID_101170
  Gene Ontology: Mol. function=hydrolase activity; Biological process =metabolic process
  Homolog annotation: Hit_ID=Q0ZPW7; Match level="QueryCoverage=84%, HitCoverage=30%, E-value=9e-14, Identity=48%"; Hit description=CXE carboxylesterase
MPDQARRRYTICGGLPAPVRVDPMTQLLTRDLVRDRGLYCKELLEKNGWSGVAEVVETKDEDHVFHLFKPNCENAQVLIDQIVSFLK

SEQ ID NO: 217949 - protein, 149 aa, Glycine max
  Coding DNA Sequence Number=SeqID_101171
  Homolog annotation: Hit_ID=Q1S4H8; Match level="QueryCoverage=40%, HitCoverage=16%, E-value=1e-08, Identity=44%"; Hit description=Zinc finger, CCHC-type; Zinc finger, SWIM-type
  Pfam annotation: Domain name=zf-CCHC; Domain location=49-66; Score =10.7; E_value=0.017; Accession=PF00098.13; Description=Zinc knuckle
MAKTDDQKDIADLIPPLIYKVGPRRPNKLRRESDEETIPTKLRRENTKNKCTRCLQYGHNTRTCKERPVATSGFEAQVVGFEIPTIGNTAQAVGSKIPTIENNVGDAGSMMGGLGYVIPIENTLATTFEFDIPTQASQVGTSNPSGSKV

SEQ ID NO: 217950 - protein, 437 aa, Glycine max
  Coding DNA Sequence Number=SeqID_101172
  Gene Ontology: Mol. function=nucleic acid binding; Cellular component= nucleus; Biological process=mRNA polyadenylation
  Homolog annotation: Hit_ID=Q00M91; Match level="QueryCoverage=100%, HitCoverage=69%, E-value=0.0, Identity=100%"; Hit description =Poly(A)-binding protein
  Pfam annotation: Domain name=RRM_1; Domain location=114-184; Score =97.6; E_value=3.7e-26; Accession=PF00076.12; Description=RNA recognition motif. (a.k.a. RRM, R
  Pfam annotation: Domain name=RRM_1; Domain location=205-275; Score =106.7; E_value=6.6e-29; Accession=PF00076.12; Description=RNA recognition motif. (a.k.a. RRM, R
  Pfam annotation: Domain name=RRM_1; Domain location=26-97; Score =87.2; E_value=5e-23; Accession=PF00076.12; Description=RNA recognition motif. (a.k.a. RRM, R
  Pfam annotation: Domain name=RRM_1; Domain location=308-378; Score =82.2; E_value=1.6e-21; Accession=PF00076.12; Description=RNA recognition motif. (a.k.a. RRM, R
  Pfam module annotation: Pfam domain module=RRM_1::RRM_1::RRM_1::RRM _1; Domain location=114-184::205-275::26-97::308-378
MAQVLENPTIDAAASGANPSLTTISLYVGDLHHDVNDPQLYDLFNQVAQVVSVRICRDVATQQSLGYGYVNFSNAHDAAKAIDVLNFTPLNGKIIRIMYSIRDPSARKSGAANVFIKNLDKAIDHKALYDTFSAFGNILSCKVATDASGQSKGHGFVQFESEESAQNAIDKLNGMLINDKQVFVGPFLRKQDRESALSGTKFNNVFVKNLLDSMTEADLERIFGEYGAITSAVVMRDVDGKSKGFGFVNFANVDDAAKAVEALNGKNFDGKEWYVGKAQKKSERELELKGQHEQITKETVDKYHGTNLYIKNLDDSVGDEELMELFSEFGTITSCKVMRDPNGISRGSGFVSFSIAEGATRALGEMNGKMVAGKPLYVALAQRKEDRRARLQAQFSQSRPAAITPNVSPRMPLYPLGAPAIGQQFLYGQAAPATIPQ

SEQ ID NO: 217951 - protein, 445 aa, Glycine max
  Coding DNA Sequence Number=SeqID_101173
  Gene Ontology: Mol. function=nucleic acid binding; Cellular component= nucleus; Biological process=DNA integration
MDFARYALSHKCAVDIYVAFGVSDYEEVTEDKVRGELTRGKELFNDQQIVVFDDVKSKVSNKGKQKASGYEDPFVENPGQCDEDPNRMDDDNMSNPPHEEPYTNFKEMHDLEIGYETEELYSDVEYEDDITKPGKKFWMFRKETMSKAFKRTLGMQFTCLQDFKEGMMECPVLNAYVSKVGETTTFQLKTLELITHVPKFFTIKMSIPKWVAKVLLDKFRTSKRFTLPQIVQEMKSTYVVGITRSCAIFARKLALHKIEGDAIKQYTLLRCYNSELISINANNTFKIHVNRHVPTLPPRFGSFYMCMDACKSDFVDSCKPFIGVDDCHLKTRYGGQSLVVVIRDANDQYYPLAFVVVETENKESWKWFLNGLLTNIGDPETYKWVLISDRQKGLVISFHELDDRIEHRFMDLVIAASKATYLEAYKEKMNQIKEINNKAYDNKRK

SEQ ID NO: 217952 - protein, 207 aa, Glycine max
  Coding DNA Sequence Number=SeqID_101174
MGAWGANTFRMRKLPNPSLQVVTIMSTQLSKKENEVVTVIGLDVEKDNSSYVSDVGLALGFVVSECNEDEYHDLVLDEEVEGVCVVGFVNDGIEGQIREGSMGRGRAKHLDFGQIQVARWRMFLDDDDAILPRRGSITRAMARRLQEDWTKDAGKDPRVLMSLRWRLQSSFFILHSAAIDLQEAKDSIDEEDPRPTSSTWSYIRWDE

SEQ ID NO: 217953 - protein, 239 aa, Glycine max
  Coding DNA Sequence Number=SeqID_101175
  Gene Ontology: Mol. function=ATP-dependent peptidase activity; Cellular component=integral to membrane; Biological process=ATP -dependent proteolysis
  Homolog annotation: Hit_ID=Q00M73; Match level="QueryCoverage=99%, HitCoverage=49%, E-value=1e-77, Identity=65%"; Hit description =Membrane protein-like protein
  Pfam annotation: Domain name=DUF81; Domain location=21-210; Score= -49.2; E_value=0.0047; Accession=PF01925.9; Description=Domain of unknown function DUF81
VSEEDYKSLPAGSADPRDEEVIPMAIQGIPYSNFIEVFLALHVVTYTKTCSILYWVLNSLQVPIAISVTLYEAICLCNGTRVIASKGKENTDWMKLHKICLYCSCGIIAGIVSGLLGLGGGFILGPLFLELGIPPQVASATSTFAMVFSSSMSVVQYYLLERFPVPYASYFILVATIAALTGQHVVRKIIAIFGRASIIIFVLAFTIFLSAISLGGVGIENMVEKMENNEYMGFANICH

SEQ ID NO: 217954 - protein, 414 aa, Glycine max
  Coding DNA Sequence Number=SeqID_101176
  Gene Ontology: Mol. function=RNA-directed DNA polymerase activity; Cellular component=mitochondrion; Biological process=RNA-dependent DNA replication
MKLFLSRFVFALSYPVSDDETSQKHQSNIKERWRRPSDNGASDGVDGRYEEANSTDGGHKEGEHDKGKDKLKKRDPSPPPTSKTTTPTHQHPSPNITFTDADFNGVSPHDNNPVVIFVILMGFNVQFILVDKDNSMNMMYWDAFIGLKVPKDSMLPRPKVLVGFAEAEAEVRGQEGALRTNKTIWSPLHGTRSLKEIHGSMSDAGGGGSDHTTFDILCEPVLVSIDPSSKVETLLPKLPDHCLNGPTYSSHPGSQRESPHRFHGGTYIVVSLSLWILFVNNTMNSASNGAGIVFEGLDVVIIEKSLKFNFSLTHNQAKYKALHASMWLTRETRVKDLVAKGDSKVVMLQAKGEYQVEELQLAKYLKKVKELAQSFTRFKLGHLLGDGNDRGDILSKLGSAKKHGNQAIILETLD

SEQ ID NO: 217955 - protein, 195 aa, Glycine max
  Coding DNA Sequence Number=SeqID_101177
  Gene Ontology: Mol. function=nucleic acid binding; Cellular component= chromatin; Biological process=DNA integration
  Homolog annotation: Hit_ID=Q1S7C5; Match level="QueryCoverage=88%, HitCoverage=15%, E-value=4e-36, Identity=39%"; Hit description =Integrase, catalytic region
MFQLTTNTYPFNSIMQQLYVPAEKLDDSNHLHWKQKIEPVIKSHKLQRFVENPTIPPCFLSDEDRDVRNVNPAYEAWEVQDQMLLTWLQLTLLKSILSCVLVSIHSYQVWDKIHKHFFTQTKARARKTLCEFLSQIKNIADELANIGSPIQHEEYVDAILVGLPQDYAPVVSVIESKFETPTIVEVEVLLLAHES

SEQ ID NO: 217956 - protein, 662 aa, Glycine max
  Coding DNA Sequence Number=SeqID_101178
  Gene Ontology: Mol. function=nucleic acid binding; Cellular component= nucleus
  Homolog annotation: Hit_ID=Q941Q3; Match level="QueryCoverage=81%, HitCoverage=71%, E-value=1e-57, Identity=48%"; Hit description =Floral homeotic protein HUA1
  Pfam annotation: Domain name=zf-CCCH; Domain location=146-172; Score =41.7; E_value=2.5e-09; Accession=PF00642.15; Description=Zinc finger C-x8-C-x5-C-x3-H type (and similar)
  Pfam annotation: Domain name=zf-CCCH; Domain location=463-489; Score =42.6; E_value=1.4e-09; Accession=PF00642.15; Description=Zinc finger C-x8-C-x5-C-x3-H type (and similar)
  Pfam annotation: Domain name=zf-CCCH; Domain location=505-531; Score =43.3; E_value=8e-10; Accession=PF00642.15; Description=Zinc finger C- x8-C-x5-C-x3-H type (and similar)
  Pfam annotation: Domain name=zf-CCCH; Domain location=579-605; Score =48.0; E_value=3.2e-11; Accession=PF00642.15; Description=Zinc finger C-x8-C-x5-C-x3-H type (and similar)
  Pfam module annotation: Pfam domain module=zf-CCCH::zf-CCCH::zf -CCCH::zf-CCCH; Domain location=146-172::463-489::505-531::579-605
MENHIYAASYSPSTNYRSFRDPPADTMFLSHHLHHHRTDASSAAALRFPSSALSAVEAADIAPPGVTSRIASSSAAAAAANFLSTWPPAAAAAPSALDLKRSSEALYHPTILGTIGQSEAWYSTNPLAKRPRYESASNMTIYPQRPGEKDCAHYMLTRTCKFGDSCKFDHPVWVPEGGIPDWKESLDLEGRPKVWRVYVRRERGENSKGEVAKAVAKLPNVMCAVVTGSADATKEDGSQGPGDSFRCEGEFGLGVNGCWVDCTHKGIFLGPGDSFRCEGEFGSVLNEWRVLWLFCAWIEGREVGLGFGHQQSVEAMDWVRQTGSEYGMTPSNRDINARNGFKPEPNVDPSNGDLGIWCASSFIHLADRTEEKGFVLQVWRSFPHQSPPMSQPPVEGDVGRGTRRREWRGELRGECRMLFLGSTVNDQKPHTMDQWCSVRLLASVPMSSQVPNVVTSETPPERPGEPDCPYFLKTQRCKFGSKCKFNHPKVSSENADVSSGLPERPSEPPCAFYMKTGKCRYGTACKFHHPKDIQIQLSDDLSQNVAQTQTNSMMGGATGDTQPIKSLISPSLQNSKGLPGEVDCPFYMKTGSCKYGVSCRYNHPDRNAINPPIAGLGASILPSSAANLNIGLLNPAVSAYQAFEPRLSNPMVMWKLLLYLFS

SEQ ID NO: 217957 - protein, 144 aa, Glycine max
  Coding DNA Sequence Number=SeqID_101179
  Gene Ontology: Mol. function=transferase activity; Cellular component= nucleus; Biological process=regulation of transcription, DNA-dependent
  Homolog annotation: Hit_ID=Q00M89; Match level="QueryCoverage=99%, HitCoverage=53%, E-value=5e-81, Identity=100%"; Hit description=N -hydroxycinnamoyl/benzoyltransferase 1
MEPPLPQEYFGNSVHAVSGEATARELLENDLGWAAWKLPLAVQTITTEWCNTCSKSGYSVLSSFKLFPWFNMNGSEFGMGKAVAVRSGYANKFDGKVKYHTQAVEALICKKLKKGLREESAPIDDGKIDELNRGEVSLPNYYSD

SEQ ID NO: 217958 - protein, 237 aa, Glycine max
  Coding DNA Sequence Number=SeqID_101180
  Gene Ontology: Cellular component=integral to membrane
  Homolog annotation: Hit_ID=Q00M73; Match level="QueryCoverage=99%, HitCoverage=48%, E-value=1e-106, Identity=85%"; Hit description =Membrane protein-like protein
MATEVRKKTSRGATTVIWLASWSLIMAYNVCLAERVLKDQKPESFVVKERQGVMNSIIDFFWNDGEPTNDRVWPEMKFGWRIVVGSIVGFFGAALGSVGGVGGGGIFIPMLTLVIGFDAKSSTALSKCMIMGAAVSTVYYNLRFRHPTLDLPVIDYDLALLFQPMLMLGISIGVAFNVMFADWMVTVLLIILFIATSTKALFKGIDTWKKETIMKKEAAKMLESDSSPGCKSLQTFL

SEQ ID NO: 217959 - protein, 148 aa, Glycine max
  Coding DNA Sequence Number=SeqID_101181
MYSYWPTLVLTIDELFFMANENDENIIVELCMTREHACAGWQGTKERFIFFYETIFSKLERTTKKSMAPSNHDMARLVAEKKKVDQVVNVVVVNTIAARNVIDAGEKSITLTVKLLNIVNVESLPRGRGNERKATDKSTLRWTLKIAS

SEQ ID NO: 217960 - protein, 286 aa, Glycine max
  Coding DNA Sequence Number=SeqID_101182
  Gene Ontology: Mol. function=RNA-directed DNA polymerase activity; Biological process=RNA-dependent DNA replication
MAHEHSLYFGHGLLLKIVVDDWGPRPFRVMDWWHQEKNFRRVVKSEWSSMNIQGWAAFVLKEKLKGLKEALGCWSKENEGDLKRRPQDIMKKINEMDIKEEESRKDMIQGLHTDGLWVEEPRRVKGVLEFFQQRFIEGEGLLKGDIIFFMEEFNENGVFPKGSNSSFIALILKLSEPHGIGYYRPISLKGCMHKVVAKVLARRPPTMGDLASHCLERPYKMEKYKSGRRKNGPCLVTPENIVLAGRVLCEFQKLQLIFALRESFAHWASCTCWVSFEDDLDPLPPF

SEQ ID NO: 217961 - protein, 398 aa, Glycine max
  Coding DNA Sequence Number=SeqID_101183
  Gene Ontology: Mol. function=DNA-3-methyladenine glycosylase I activity; Biological process=base-excision repair
  Homolog annotation: Hit_ID=Q1SSK0; Match level="QueryCoverage=97%, HitCoverage=99%, E-value=1e-140, Identity=68%"; Hit description =Methyladenine glycosylase
  Pfam annotation: Domain name=Adenine_glyco; Domain location=204-382; Score=264.7; E_value=1.9e-76; Accession=PF03352.4; Description =Methyladenine glycosylase
  Subcellular localization annotation: CTP_CleavageSite=32; ConfidenceScore=5.27e-01
MCGSKTKVTVGIEATATSLVARINGRPVLQPTCNRVPNLERRNSIKKLSPKSRSPPSPPLLSKTSLTPPVSPKSKSPRPPPIKRGNESNGLNSSSEKIVTPRNTIKTPTLERKKSKSFKEGSCGALGLSASTEASLSYSSTLITESPGSIAAVRREQMALQHAQRKMKIAHYGRSKSAKFARVIPLEPSTNLTSKTSEEKRCSFITANSDPIYIAYHDEEWGVPVHDDKMLFELLVLSGAQVGSDWTSILKKRQDFRTAFSEFDAATLANLTDKQMVSISMEYDIDISRVRGVVDNANRILAINKDFGSFDKYIWDFVNHKPISTQYKFGHKIPVKTSKSESISKDMIRRGFRCVGPTVLHSFMQAAGLTNDHLITCHRHLQCTLLASTPHCTTEHFL

SEQ ID NO: 217962 - protein, 196 aa, Glycine max
  Coding DNA Sequence Number=SeqID_101184
  Homolog annotation: Hit_ID=Q1T1Y0; Match level="QueryCoverage=41%, HitCoverage=21%, E-value=2e-10, Identity=44%"; Hit description =Ankyrin
  Pfam annotation: Domain name=DUF1723; Domain location=97-146; Score =37.4; E_value=4.9e-08; Accession=PF08330.1; Description=Protein of unknown function (DUF1723)
MEFMELGQRMEVGHKNKQISVRWQFKHIKMRRWHAHKRPSFDGDDHGLKRGDKCDHAKLKLVSHERKLKKEIALHEQIEELVKESCLFFMTTYYYEKADKGLLSTFSERWHMETDMFHLPMGKMTITLDDVSSLLHIPFIRCFCSFQHMEKDVASPLLEELLRVGKKRMQLKRQTKQEMYMSILVGHEISMPRGVI

SEQ ID NO: 217963 - protein, 254 aa, Glycine max
  Coding DNA Sequence Number=SeqID_101185
MSMLGKGSPIDEFDIQKDLRKRNMLVPFLFKIMVKGLSGVMKEACNKNLVSSYMVGKVASEERNVSSDLAMYERSVTWDSRWAVGCRGSFTIGARLKGYGAREFGACCSGGKKRRCDGIWGLSMVVMVLRKMVEVLRRTAMVFATTIRGSPMSEVLSAMTKCINARNSNKEDYNAREFEACCGGDRRRMMWWRLGIISGSGGVMKNNGGVEEDDRGAYRDNEGFTGVESVINDEKSIDIKTKRTETIYGGEGLS

SEQ ID NO: 217964 - protein, 67 aa, Glycine max
  Coding DNA Sequence Number=SeqID_101186
MARGGHWWSWMVEEKVLGFGWAFGEGENLTQRAHLSKRKSTFGAKCDNSHSVQFPLGLELCFAHCLC

SEQ ID NO: 217965 - protein, 906 aa, Glycine max
  Coding DNA Sequence Number=SeqID_101187
  Gene Ontology: Mol. function=transferase activity; Cellular component= nucleus; Biological process=regulation of transcription, DNA-dependent
  Homolog annotation: Hit_ID=Q00M87; Match level="QueryCoverage=98%, HitCoverage=100%, E-value=0.0, Identity=90%"; Hit description=N -hydroxycinnamoyl/benzoyltransferase 3
  Pfam annotation: Domain name=Transferase; Domain location=31-476; Score=257.8; E_value=2.3e-74; Accession=PF02458.6; Description =Transferase family
  Pfam annotation: Domain name=Transferase; Domain location=480-884; Score=199.9; E_value=5.9e-57; Accession=PF02458.6; Description =Transferase family
  Pfam module annotation: Pfam domain module=Transferase::Transferase; Domain location=31-476::480-884
MTCFSVHKINTTPLQHKSNLCVTSICIMSTPVVRRISECFIKPHRPIEESNQICYLAPWDIILLSYHYIQKGLLFKKPPTLVDQQNFIENLLEKLKHSLSFTLSHFYPLAGRLVTHTTQDPPSYAFFVDCKNSDGARFIYASLDMTISDILTPVDVPPILHSFFDHHKAVNHDGHTMPLLSIQVTELVDAVFIGCSMNHTLGDGTSYWNFFNTWSQIFQSQAQGHEYNVPISHPPILNRWFPSDCDPSVNLPFKHHDEFICNFEAPFLRERVFHFSAESIAKLKAKANSESNTTKISSFQSLSALVWRSITLARSVPYEQKTSCKMAINNRSRMEPPMPEEYFGNLVQVVSAETTTRELLENDLGWAAWLLHVAVTNHNDKVVLQSLQGWLQSPFIPQIGRLFDPYSVLMGSSPRFNKYGCEFGMGKAVAIRSGYANKFDGKVTSYPGREGGGSIDLEVCLLPHIMRALESDKEFMNAVSKGLLFKKPATTLVDQHHFMENLLEKLKHSLSLTLFHFYPLAGRLVTHQTHDPPSYSVSVDCKNSDGARFIYATSDITISDILAPIDVPPILHSFFDHHKAVNHDGHTMSLLSIQVTELVDAVFIGCSMNHVVGDGTSYWNFFNTWSQIFQSQSHALGHEYDVPIHNRWFPKDCAPPINLPFIHHDEIISRYEAPKLRERIFHFSAESIAKLKAKANSESNTTKISSFQSLSALVWRSVTRARSPPNDQRTTCRLAANNRSRMEPPLPQEYFGNSVHVVSAETTTGELLENGIGWAAWKLHMAVANYNNGVVLQSLKVWLESPFVIQMGRFFDPYCVMMGSSPRFNVYGNEFGMGKAVAARSGYANKFEGKVTSYPGREGGGSIDLEVCLSPENMTALESDEEFMNAVSKSNPLYELTNVACPGPSF

SEQ ID NO: 217966 - protein, 393 aa, Glycine max
  Coding DNA Sequence Number=SeqID_101188
  Gene Ontology: Mol. function=RNA-directed DNA polymerase activity; Cellular component=chromatin; Biological process=chromatin assembly or disassembly
  Pfam annotation: Domain name=rve; Domain location=111-255; Score =28.6; E_value=2.2e-05; Accession=PF00665.16; Description=Integrase core domain
MANPMDIQGPAGIFGPHRFLPSFYQRVCITGDPFDSFVNNSSIVPFMAESDASGTWMGVVLSQLGHPIAFFSRQFCPRLRLAFSYVRKLESHLVAQWPQPYPIIVDEVPYFTNGRAHDLSLDFIVDLPPYHGNTTILLMVDRFSKAIHLGMLTSNFTTQTVALLFMDMVGKIHGMPRSLVSDRDPLFVSKFWQELFRLRGTKLQMSSAYHPQSDGQIKPGQWVMVKLRLYRQLSATRTPYSKLAKRFYGPFKILSRNGKVAYKLQHPEDSRIHPIFHCSMLKPFYQTPLSKDKPIALPPQVCKHQPVISPLAIIDTHWEIREGEPCLMVLVQWEEEFHLKDKVLSNDVGIDKPADKQQALILDQQTSSTNNVRKGGVSEYHLKVENLGSLSLR

SEQ ID NO: 217967 - protein, 82 aa, Glycine max
  Coding DNA Sequence Number=SeqID_101189
  Gene Ontology: Mol. function=oxidoreductase activity; Cellular component=cytoplasm; Biological process=leukotriene metabolic process
  Homolog annotation: Hit_ID=Q9SLN8; Match level="QueryCoverage=80%, HitCoverage=19%, E-value=2e-21, Identity=71%"; Hit description=Allyl alcohol dehydrogenase
MSTLEDGNGVGQLVGQLAKLMGYYVVGSAGSKDKVEILKNKFGFDGAFNYKEEQDLDATLKRYFPEGTDVRSSGLGIIKKGD

SEQ ID NO: 217968 - protein, 354 aa, Glycine max
  Coding DNA Sequence Number=SeqID_101190
  Homolog annotation: Hit_ID=P82413; Match level="QueryCoverage=46%, HitCoverage=69%, E-value=2e-28, Identity=45%"; Hit description=50S ribosomal protein L19, chloroplast precursor
  Pfam annotation: Domain name=Ribosomal_L19; Domain location=284-354; Score=-18.4; E_value=8.1e-06; Accession=PF01245.10; Description =Ribosomal protein L19
MSEVAFLSKTLKLNATVQYKSPNEISIIDKKYCSSRKEWHEEDAAGEGADGEGGDEVLAGLGLGLGLGLGLGLGLGLGLGLGLGLGLSVGGREGDICGGRVEGAGEGACAVVIATRDNKMASPSQIKEKRRVVVDTCGTDRETDKGALRTIFLILLTFAVFPCLLPTEVEPLFFLSLMASQVLLQALFAPKLSFPSSSRNVALISRVPSTPISWRCTPLIAKPSFVVRADTNLDGGGEATEDVPSDNAEKVSEGEAEQVSDSEAPKSPRKPRVKLGDIMGILNQRAIEASEKQRPTPDIRTGDIVEIKLEVPENKRRLSIYKGIVISKQNAGIHTTIRIRRIIAGTGVEIVFPV

SEQ ID NO: 217969 - protein, 277 aa, Glycine max
  Coding DNA Sequence Number=SeqID_101191
  Gene Ontology: Cellular component=integral to membrane; Biological process=negative regulation of apoptosis
  Homolog annotation: Hit_ID=Q6U1L7; Match level="QueryCoverage=87%, HitCoverage=98%, E-value=4e-89, Identity=67%"; Hit description=Bax inhibitor
  Pfam annotation: Domain name=UPF0005; Domain location=23-234; Score =45.5; E_value=1.8e-10; Accession=PF01027.11; Description =Uncharacterised protein family UPF0005
MDSFNSFFDSTNRWNYDTLKNFRQISPVVQNHLKQVYFTLCFAVVAAAVGAYLHVLLNIGGFLTTVACVGSSVWLLSTPPFEEACRKRVTLLMAASLFQGASIGPLIDLAIQIDPSLIFSAFVGTSLAFACFSGAALVARRREYLYLGGLVSSGLSILLWLHFASSIFGGSTALFKFELYFGLLVFVGYIVVDTQEIVERAHLGDLDYVKHALTLFTDLVAVFVRILVIMMKREPRKGVGKKSMVKVPNKFLLHDYVRIFVGEEVEFSNTLFFHTSG

SEQ ID NO: 217970 - protein, 283 aa, Glycine max
  Coding DNA Sequence Number=SeqID_101192
MESGRISSEKNAIRIENPFSLKVGQVFTGAIPMLNQVMSATRGATDAFSGVSRHVNTSLRKLGAKNIEVGIGCGVGFGHGFGVGLAVKPVVLNQIQSSLVDVMTKVMTKIGLSPNLPFSQGAFPPSLQSAASTVNTNQSSAGSMMQLATKSVDQVSQGLPGSRPVQIGSDFENNPLRVTAVDSAFGSRTEKVISNFLQNPLLKGEGGGLDEASVERRDVDYRSHFHLGIIISLEFVSFFLCVNTRKVQDIVWRWGRQAKMEVKQPWWNLVASELLELWLLGGM

SEQ ID NO: 217971 - protein, 81 aa, Glycine max
  Coding DNA Sequence Number=SeqID_101193
  Subcellular localization annotation: CTP_CleavageSite=35; ConfidenceScore=5.01e-01
MEVAKFKGLIPKPQTKHHFLLSQNFPPFSTDDAVGVSRVTSDDCDVSNNNRDISSSGNDGRVDNIGGGSNNIGDEMMTVAR

SEQ ID NO: 217972 - protein, 116 aa, Glycine max
  Coding DNA Sequence Number=SeqID_101194
  Subcellular localization annotation: CTP_CleavageSite=16; ConfidenceScore=5.55e-01
MALTLAILLSLVAITTAQAPSPAPSTLPPQMSPSLPPTESPSPSPSPSPSPSPSPSPSPSPSPSPSPASTSSPPSPSAPSPAASDSTVPSSPSNAFIHGTTFFMPFLAAAAILLAA

SEQ ID NO: 217973 - protein, 139 aa, Glycine max
  Coding DNA Sequence Number=SeqID_101195
  Subcellular localization annotation: CTP_CleavageSite=32; ConfidenceScore=5.41e-01
MAATPWFLPPHVFTFARSFFFVKFNLFNDGLSSSQVEPPFVKLNVDRSWVWDTNSAGFGGLISDPLLVLEHGLSNTWNQRFQSAEAMNAILCKNVNQTYMHLHAFKVYEIQLIVNRAWELSSSSNTFDRVWTTPLEAIL

SEQ ID NO: 217974 - protein, 557 aa, Glycine max
  Coding DNA Sequence Number=SeqID_101196
  Gene Ontology: Mol. function=triacylglycerol lipase activity; Biological process=lipid metabolic process
  Homolog annotation: Hit_ID=O23522; Match level="QueryCoverage=87%, HitCoverage=82%, E-value=1e-160, Identity=58%"; Hit description =Triacylglycerol lipase like protein
  Pfam annotation: Domain name=Lipase_3; Domain location=286-437; Score= 157.3; E_value=4e-44; Accession=PF01764.16; Description=Lipase (class 3)
  Subcellular localization annotation: CTP_CleavageSite=60; ConfidenceScore=5.17e-01
IHSIRNISSNSLTLSAAESFINSFIRQNLEQLTMMQISSTVPAHNLHKFQAIRCPSFSFRCQQASSSTFQKPFISTESTRLHLANLHKLLETQKPEVPPPTQIQHHQPIINDPKEKKGRSFLEGLNLARLWPEMKATDEMSPRHLKRLQRLLSMTAEYSPRNILGGRWREYHGSNDWKGMLDPLDENLRREVVRYGEFVQAAYQAFHSDPAMSTEEPPHTQHVALPDRSYRMTKSLYATSSIGLPKWVDDVAPDLGWMTQRSSWVGYVAVCEDRREITRMGRRDIVISLRGTSTCLEWAENLRAHMIDMPDNDSSEEAQGKPKVECGFMSLYKTKGAQVPSLAESVVEEVRRLIDLYKGEELSISVIGHSLGATLALLVAEEISTCCPQVPPVAVFSFGGPRVGNKAFGDRLAAKNVKVLRIVNSQDVITRVPGIFVSEELEQKIRNVGGGVLEENTPLAYSHVGTELRVHTKMSPYLKPDADMACCHDLEAYLHLVDGFLASNCPFRSNAKRSLARLMQDQSANVKKLYTSKAKSLTVNLSRQGSMSMSNCLPSPS

SEQ ID NO: 217975 - protein, 145 aa, Glycine max
  Coding DNA Sequence Number=SeqID_101197
MRPTTVDSSEILEVCRKEVMEWDKEVVHVAHVLYGLLSEGLGLGAERLTEMGLLEKHCEIGEIKSVSSGRYVVMVEDSERKQCSNSNEKKKREKMRSKHGEGKSVEEKSEERWLQMFGKQSHQHVEAKAEAEAQCGLGESQIQVL

SEQ ID NO: 217976 - protein, 164 aa, Glycine max
  Coding DNA Sequence Number=SeqID_101198
  Homolog annotation: Hit_ID=Q28MA5; Match level="QueryCoverage=48%, HitCoverage=27%, E-value=1e-07, Identity=39%"; Hit description =Inosine/uridine-preferring nucleoside hydrolase
MFGVENHFRYTTENSVKFGAHRDTDHRELKQPLAMEVWNSVLQRLKPRSKITVLANGPLTNLAKELYVVGGHISNNVNDKGDIFSVRSNQYAEFNMFLDPLVAKIVFESEVNITLIPLNIHRRVRSFLTIIGELHRTHEAVFSKHLLSRLYRLKQTHNRYQNMA

SEQ ID NO: 217977 - protein, 109 aa, Glycine max
  Coding DNA Sequence Number=SeqID_101199
KQQGGEKKTNGHIKKKAYIAWKENSSNTSSDSRNEEEANLCLMTDGEVDNLVSSSDSETEIDDNYEQLLDAFNEMHEKDKNLSQAKKFHKEKLRWHVDKMVDLDWYKCC

SEQ ID NO: 217978 - protein, 129 aa, Glycine max
  Coding DNA Sequence Number=SeqID_101200
  Gene Ontology: Mol. function=nucleic acid binding; Cellular component= intracellular; Biological process=regulation of transcription, DNA -dependent
  Homolog annotation: Hit_ID=Q8W5B1; Match level="QueryCoverage=88%, HitCoverage=30%, E-value=1e-31, Identity=53%"; Hit description =Polycomb group protein VERNALIZATION 2
MCRQNSPVHHAGEEEIAADESLLIYCKPVELYNILYRRALQNPSFLRRCLRYKIRASRKRRLRAGIVIFNYRDRYNILRKTEVTEDFSCPFCLMQCGNFKVTEDYQAVNVSVKIDILRSEVRTLFNFDL

SEQ ID NO: 217979 - protein, 327 aa, Glycine max
  Coding DNA Sequence Number=SeqID_101201
  Gene Ontology: Mol. function=protein serine/threonine kinase activity; Cellular component=intracellular; Biological process =protein amino acid phosphorylation
  Homolog annotation: Hit_ID=Q05006; Match level="QueryCoverage=92%, HitCoverage=98%, E-value=7e-68, Identity=47%"; Hit description=Cell division control protein 2 homolog 2
  Pfam annotation: Domain name=Pkinase; Domain location=17-316; Score =254.1; E_value=2.9e-73; Accession=PF00069.15; Description=Protein kinase domain
  Pfam annotation: Domain name=Pkinase_Tyr; Domain location=17-265; Score=-19.3; E_value=2.7e-11; Accession=PF07714.7; Description =Protein tyrosine kinase
  Pfam module annotation: Pfam domain module=Pkinase::Pkinase_Tyr; Domain location=17-316::17-265
MCSRDRGERPDATGMDLEVLEVAEEGSYGRVFRCLDIHTGALVTMKQITMVRLSQGVPAPIIREVSLLKELHHANIVKLLRVGLTENRYVNLVFEHLDYDLHHFIVNRGYPKDALTVKSFMYQILSAVAYCHSLKVLHRDLKPSNVLIDHSKRLIKLADFRLAGEFADDLLYTEKLGTSWYRAPEILCDSRQYSTQIDLWSVGCIFAEMVIGQPLVQAINCRDELEGIFKLLGTPTEETWPGITKLMPNLHIYYPKFDALNHEKLREFTCLSASMQGLETFVTDLEPSGLNLLSMMLCLDPSRRISAEAALKHAYFIDVNYVSLLLL

SEQ ID NO: 217980 - protein, 172 aa, Glycine max
  Coding DNA Sequence Number=SeqID_101202
MQKQRRRRNEILSIVIEAHRYQEAAPMKEAIASSKSPGMMDSTLGSSRISEILSKVTCTRFYLSISLIGYMYKVLARLLPNRLLKVMEVSLGEGEGVGGHCCGGWSVVVGIRGKIKGRLVRVTLFCENAPTIWDQHRFKGALKLGVFTPKAYTPKSLSGSLPPDSGPTQKTF

SEQ ID NO: 217981 - protein, 191 aa, Glycine max
  Coding DNA Sequence Number=SeqID_101203
  Gene Ontology: Mol. function=protein dimerization activity
  Homolog annotation: Hit_ID=Q2QPA8; Match level="QueryCoverage=61%, HitCoverage=14%, E-value=7e-16, Identity=42%"; Hit description=HAT family dimerisation domain containing protein
MFHFIKLDEGFKYNTIMYSAKKPKIQLKRKEKKVAQEKSVQEEKTTKERDCGRTVILQLHCPLHAAGHFLNPEFFYDNSQMEFDGEVIRGLYAAINKLVGDLDMEKIIMRELLSYKMGAGMFGTPIAVSTRKEIAPAQWCRMYGPDAPHLQQLAIRILSLTRGKGGASSTREKKWFKLRKHWKIILVRRRN

SEQ ID NO: 217982 - protein, 801 aa, Glycine max
  Coding DNA Sequence Number=SeqID_101204
  Gene Ontology: Mol. function=protein serine/threonine kinase activity; Cellular component=cell surface; Biological process =protein amino acid phosphorylation
  Homolog annotation: Hit_ID=Q0ZCC5; Match level="QueryCoverage=91%, HitCoverage=35%, E-value=1e-172, Identity=45%"; Hit description=CCHC- type integrase
  Pfam annotation: Domain name=B_lectin; Domain location=70-179; Score =47.3; E_value=5.1e-11; Accession=PF01453.15; Description=D-mannose binding lectin
  Pfam annotation: Domain name=Pkinase; Domain location=513-785; Score =139.3; E_value=1e-38; Accession=PF00069.15; Description=Protein kinase domain
  Pfam annotation: Domain name=Pkinase_Tyr; Domain location=514-785; Score=90.0; E_value=7.2e-24; Accession=PF07714.7; Description =Protein tyrosine kinase
  Pfam annotation: Domain name=S_locus_glycop; Domain location=226-332; Score=-46.7; E_value=0.099; Accession=PF00954.11; Description=S-locus glycoprotein family
  Pfam module annotation: Pfam domain module=B_lectin::Pkinase::Pkinase_ Tyr::S_locus_glycop; Domain location=70-179::513-785::514-785::226-332
MAVLTFLIRTLVFLRVSLVFANVNLDSRLSTDGNDAWRSPSGEFAFGFRQLSNFGTKLFMVAIWYDKIPDKTVVWSAKTEYKLATAPTGSHVQITKEGLSLTSPEGDSIWRAKPEATVSEGAMLNNGNFVLLNGGSEYENMWQSFDNPTDTLLPNQSLQLGLGGVLTSRFTDTNYTTGRFQLYFQDFNVMLSPLAFPSQLRYNPYYHAINDASVGNASRLVFDKSGEIYVETTGGTRNRILPQVDNTLDTEVNYYRATLDFSGVFTLYAHPRNTSGQPRWRIMNYVPDNICDAIFNDYGSGSCGYNSYCSMENDRPTCNCPYGYSLVDPSNESGGCQPNFTLACGADVQQPPEELYEMHVAKNFNFPLGDYEKVEPYSQQECQQACLHDCMCAVAILEVDTCWMKRLPLGNGRQLPIRDQHFVYIKTRLSPDFYPGLANRELPAAPDSKKENRAKSIILGSLIASLVVNSILLAAVALFFLLKPKLKKVIQASALLETNLHSFSFEALKEATEDFCKELGRGSCGIVYKGKLETADSCNVIAVKRLDRLAQEREKEFRTELSAIGKTSHKNLVRLIGFCDQGINRLLVYEFMSNGTLADILFGHSKPIWNLRVGFVLGIARGLVYLHEECDSAIIHCDIKPQNILIDEHFNAKISDFGLAKLLLFDQSRTNTMIRGTRGYVAPEWFKNVAVTVKVDVYSFGVMLLENICCRRSVMTMEPEEEEKAILTDWAYDCCVEGRLHALVENDREALSDIGRLQRWVKIAIWCIQEDPEMRPTMGKVNQMLEGLVEVANPPSPNPDI

SEQ ID NO: 217983 - protein, 260 aa, Glycine max
  Coding DNA Sequence Number=SeqID_101205
  Gene Ontology: Mol. function=ubiquitin thiolesterase activity; Cellular component=intracellular; Biological process=ubiquitin -dependent protein catabolic process
  Homolog annotation: Hit_ID=Q8GWE1; Match level="QueryCoverage=86%, HitCoverage=97%, E-value=2e-91, Identity=70%"; Hit description =Putative carboxyl-terminal proteinase
  Pfam annotation: Domain name=Peptidase_C12; Domain location=39-244; Score=312.7; E_value=6.7e-91; Accession=PF01088.11; Description =Ubiquitin carboxyl-terminal hydrolase, family 1
MAYKPGQWAHKGPRQEYKMRAVTSAKVLWKNKAMASAKRWLPLEANPDVMNQFLWGLGLREDEAECCDVYGLDEELLEMVPKPVLAVLFLYPITTQSEEERLQQENEKKEYNSRVYFMKQTVGNACGTIGLLHALGNLTSEVKLVEGSFFDNFFKSTASLDPLQRATFLENDKEMEVAHLVAATAGDTEASDNATAHFICFACVDDELYELDGRKSVPISHGPSSPSTLLRDAAKAIQSMIQKNPDSFNFNVIALCKKSG

SEQ ID NO: 217984 - protein, 323 aa, Glycine max
  Coding DNA Sequence Number=SeqID_101206
  Gene Ontology: Mol. function=protein serine/threonine kinase activity; Biological process=protein amino acid phosphorylation
  Homolog annotation: Hit_ID=Q0ZCC5; Match level="QueryCoverage=96%, HitCoverage=23%, E-value=3e-29, Identity=36%"; Hit description=CCHC -type integrase
  Pfam annotation: Domain name=Pkinase; Domain location=158-313; Score=- 113.8; E_value=0.088; Accession=PF00069.15; Description=Protein kinase domain
  Pfam annotation: Domain name=Pkinase_Tyr; Domain location=160-295; Score=-171.9; E_value=0.063; Accession=PF07714.7; Description =Protein tyrosine kinase
  Pfam module annotation: Pfam domain module=Pkinase::Pkinase_Tyr; Domain location=158-313::160-295
MRYVPDDICTTIFNENGSGSCGYNSYCSMKHDRPTCKCPYGYSMVDPSNEFGGCQPNFTLACGADKQPYSQQECRQSCLHSGNTCWMKRLPLGNGRQVAGASPAPDSKKEDRAKPILLRSLYPLSLSPKLTRLVPATPSLLETNLHSFTYETLEKATRGFSEEIGRGSSGVVYKGQLEAASCNLMIAIKRLDRLAQERDKEFRTELSAIGKTSHKNLLLADQSKTDTMIRRGYVPPEWFKNVPVMVKVDVYSFGVMLEIIWCRSVLMMDSGEEEKAILTDWAYDCYIEGRNVDALVKNDEEAFSDSCRLHKWIKIALMRDSYL

SEQ ID NO: 217985 - protein, 361 aa, Glycine max
  Coding DNA Sequence Number=SeqID_101207
PPDIGNWFSSYEYRSPGPDSNFSVEDSAFSEEETQRDGEEEEEENVRVQGEGVAGENVVQCIRTCVKEDNHSEDQCLNTPPDIRNWFSSYVYESPESDTSSLFRDEVSEENECGKERFDFEVVKEDESRFENVHSKGRVDHNSSSNKNTKGDDSAEMKTNSTTVDTSHLEKILQPCLQDKTLQQHNLGPTKYKEALGLNHKSPGCDPEGHLMSLDTDRSVMKPPKLLQKNDTGESKTKGEIQHDKKLDLSARVAKNFSARSSTCTSNKENDGFVTTRRNSYTGGNDESSCKKAEKIILAGAVPLACEKQGVTKRKALTEATNVKQYNVMGITGKWQCPQKRKPDVGPAMKQLRLDRWVRRV

SEQ ID NO: 217986 - protein, 809 aa, Glycine max
  Coding DNA Sequence Number=SeqID_101208
  Gene Ontology: Mol. function=protein serine/threonine kinase activity; Cellular component=cell surface; Biological process =protein amino acid phosphorylation
  Homolog annotation: Hit_ID=Q0ZCC5; Match level="QueryCoverage=90%, HitCoverage=35%, E-value=0.0, Identity=46%"; Hit description=CCHC -type integrase
  Pfam annotation: Domain name=B_lectin; Domain location=74-179; Score =74.8; E_value=2.7e-19; Accession=PF01453.15; Description=D-mannose binding lectin
  Pfam annotation: Domain name=Pkinase; Domain location=518-790; Score =156.2; E_value=8.4e-44; Accession=PF00069.15; Description=Protein kinase domain
  Pfam annotation: Domain name=Pkinase_Tyr; Domain location=520-790; Score=107.8; E_value=3.2e-29; Accession=PF07714.7; Description =Protein tyrosine kinase
  Pfam annotation: Domain name=S_locus_glycop; Domain location=223-337; Score=-44.7; E_value=0.071; Accession=PF00954.11; Description=S-locus glycoprotein family
  Pfam module annotation: Pfam domain module=B_lectin::Pkinase::Pkinase_ Tyr::S_locus_glycop; Domain location=74-179::518-790::520-790::223-337
MAALNLNLLIVTLIYIHHVSLAFAKVTLNSPLFTDTDDAWLSPSGEFAFGFRQLNDNDTKLFMVAIWYNMIPDDQTVVWSARKDNKLATAPAGSKLQITQEGLSLTNPKGDFIWTASSKDFVSEGAMLDSGNFVLLNGSSANVWQSFEHPTDTLLPNQSLQLGGMLTSRLTDTNYTTGRFQLYFDGGNLLLSPLAWPSQLRYKSYPVIDASGNASRLLFNISGDIYVETTNGNRIQPQGQKWVSNSSSSLDLNPEMNFYRATLDPSGVFTQYAHPRNNTARQGWIIMRYVPDDICNIIFDRFGSGSCGYNSYCDMENERPTCNCLDGYSLVDPSNQFGGCQPNFTLACGADVQAPPEQLYHMLQSSRYNFPEADYEKIQPYTQQECLQFCLHDCMCAVAIFGLDTCWMKRLPLSNGRVTDVNDHHFVYIKIRNSRDFYPGVNEELPPGADSNKEDGAKPILMGSLIGSLVVNGILLATVALLVLLKPKLKVAVPVAAASLLETNLHSFSYEALKEATWGFSEELGRGSCGIVYKGKLEAEDSCNVIAVKRLDRLAQEREKEFRTELSAIGKTSHKNLVRLIGFCDQGINRLLVYEFMSNGTLADILFGHSKPNWNTRVGFALGIARGLVYLHEECDTPIIHCDIKPQNILIDEHFNTKISDFGLAKLLLSDQSRTNTMIRGTRGYVAPEWFKNVAVTVKVDVYSFGIMLLEIICCRRSVVMEEPGEEEKAVLADWACDCYMEGRIDALVENEEEALSDKERLQKWIKIAIWCIHENPEMRPTIGMVVQMLEGFVQVSNPPPTFTMHSVS

SEQ ID NO: 217987 - protein, 78 aa, Glycine max
  Coding DNA Sequence Number=SeqID_101209
MVVMFVHGNITLSSTLSTNDYDAWLSPSAKTIAWNTKANEILATATTGSQVQLTSEGLTLTSPKGKSIWKAQPDAALS

SEQ ID NO: 217988 - protein, 54 aa, Glycine max
  Coding DNA Sequence Number=SeqID_101210
  Gene Ontology: Mol. function=structural molecule activity; Cellular component=coated vesicle membrane; Biological process=intracellular protein transport
  Homolog annotation: Hit_ID=Q9MAZ1; Match level="QueryCoverage=63%, HitCoverage=19%, E-value=7e-09, Identity=85%"; Hit description =Nonclathrin coat protein zeta2-COP
MYIFMTLFVDVQFLIIILETDPNVIVGKIANNSIDYGAPLSEQTLSQALSRSVK

SEQ ID NO: 217989 - protein, 445 aa, Glycine max
  Coding DNA Sequence Number=SeqID_101211
  Gene Ontology: Mol. function=transferase activity; Cellular component= nucleus; Biological process=regulation of transcription, DNA-dependent
  Homolog annotation: Hit_ID=Q00M84; Match level="QueryCoverage=96%, HitCoverage=100%, E-value=0.0, Identity=93%"; Hit description=N -hydroxycinnamoyl/benzoyltransferase 6
  Pfam annotation: Domain name=Transferase; Domain location=21-434; Score=219.2; E_value=9.2e-63; Accession=PF02458.6; Description =Transferase family
MAIAYWSLTSSTLCRTMSTPPVVERVSECFIKPQHSNHESNQICYLTPWDIAMLSAHYIQKGLLFKKPSSPLVSHNNFIENLLQKLKHSLSLTLFHFYPLAGRLVTHQTHDPPFYAVFVDCNNSDGARFIHATLDMTISDILSPVDVPPIVQSLFDHHKAVNHDGHTMPLLSVQVTEFVDGVFIGCSMNHTLGDGTSYWNFFNTWSQIFQVQGHEHDVPISHPPIHNRWFPEGCESIAKLKAKANSECNTTKISSFQSLSALVWRCITRARRLPYDQRTSCKLSANNRTRMEPPLPQEYFGNSIYTLNAGTATSGKLLENGIGWAAWKLHKSVVNHNDRAVLETLKEWLESPLIYDLGRYFDPYCVMMGSSPRFNMYGNEFGMGKAVALRSGYANKFDGKVTSYPGHEGGGSVDLEVCLSPAVMSALESDEEFMNIALVSVYNPL

SEQ ID NO: 217990 - protein, 105 aa, Glycine max
  Coding DNA Sequence Number=SeqID_101212
MEMEKGRSNRRITVCVTQNKQGKKAPILDMGCFLFDLLFPFFPPGDKGKNKANGAARLTCEVGADQCILNSCKSAKQVGLVRCQCRLTQVDLNARRDNLLTHLYQ

SEQ ID NO: 217991 - protein, 148 aa, Glycine max
  Coding DNA Sequence Number=SeqID_101213
METQNVILKTSRSKKDACILEKSLSHRYPDLVFHEALKEEKEKLHVEIRRSRTNNDPEQCRVIEHLIEVTKNVVNMSPNKKVTKIVFNEPTDLIARHITDNAIGSEDLELESAYKSQSEWKTDLFGFCRDPCLCKFNPILYRFYFKKW

SEQ ID NO: 217992 - protein, 325 aa, Glycine max
  Coding DNA Sequence Number=SeqID_101214
  Gene Ontology: Mol. function=caspase activity; Biological process =proteolysis
  Homolog annotation: Hit_ID=Q9ZSP8; Match level="QueryCoverage=97%, HitCoverage=99%, E-value=2e-77, Identity=44%"; Hit description=Latex- abundant protein
  Pfam annotation: Domain name=Peptidase_C14; Domain location=10-323; Score=59.9; E_value=8.5e-15; Accession=PF00656.12; Description =Caspase domain
EECEIGTTAKKAILVGINYPRTKAKLRGCINDVWRIHRCLIEKYDFYEHDITVLIDTDESYMEPNGKNIRSVLTRLVQSAEPGDVLFMHYSGHGTRLLAKTREDGDTSYDECIVPSDMNLIIGCAFSVNVSQGCFWSISVLTVTGFWSTLVRICLANIDKVFHSTTDDDRDIELPHKQCGYVKNRLSLYDIFGEDASPKVNKFLKVILNKLEHGNGRILGLVGSLAQEFLKQKLDSNDGGGYAKPAMETKVERKYEAYVGSSSMKPRLSKWRNFDEWLLDRPNSDGSVTNQEIILKAREKLKRVGFKQRPGLYYSDDHVDGPFVC

SEQ ID NO: 217993 - protein, 200 aa, Glycine max
  Coding DNA Sequence Number=SeqID_101215
  Gene Ontology: Mol. function=zinc ion binding; Cellular component =nucleus; Biological process=regulation of transcription, DNA -dependent
  Homolog annotation: Hit_ID=Q00M83; Match level="QueryCoverage=63%, HitCoverage=18%, E-value=1e-69, Identity=98%"; Hit description=Zinc finger protein 1
  Pfam annotation: Domain name=zf-C3HC4; Domain location=153-193; Score= 42.7; E_value=1.3e-09; Accession=PF00097.15; Description=Zinc finger, C3HC4 type (RING finger)
MCLISLNRLVSFDEPVDLKAQGLGRCWEEKRNRPRLASTECLCLGVCRTVMLCFVRNGMRKLFTLCSLLFVVCLKEDVVILEHQSFLSRIADVHDRHRDMRLDVDNMSYEELLALEERIGNVSTGLSEETLSKLLKQRKHSVEKGSETDAEPCCVCQEDYGDGNDIGTLDCGHDFHSSCIKQWLMHKNLCPICKTTGLAT

SEQ ID NO: 217994 - protein, 112 aa, Glycine max
  Coding DNA Sequence Number=SeqID_101216
MHAHHHHSDPPLCTCNNSELATTNHRIVMHSSTLITPPSRSPKHILKQHPMTKKHYHRRSFSRIPIFSNVNDVVSGEELGWEEGLDGVVVVVNDCGGGGFRWRKGIRRKGKK

SEQ ID NO: 217995 - protein, 468 aa, Glycine max
  Coding DNA Sequence Number=SeqID_101217
  Gene Ontology: Mol. function=zinc ion binding
  Homolog annotation: Hit_ID=Q00M83; Match level="QueryCoverage=90%, HitCoverage=61%, E-value=0.0, Identity=86%"; Hit description=Zinc finger protein 1
NLNLNAGLADSGSDDSQHLELPNLNKSSGSANECIPPNVGSGSFLLPSGNNAFLVEDTDGRPSCSLDTRRVSCKRKAVEGNNGQSSDAGSSSYSQHTDGSAWHTIPTQDNAGSSSRRSIPSEEVNARLGLGIGDEASENVSDSKTAGSSESFHRNFRLRLNPSNPANSVPPTAFSTGSMIRHSGVSPSSQVSQRLHSVNNSLNSRSAPPIDNVVPQSQPHVIHVPALPRNRQSFRWSGGSSSRNIHSSNSIISPARDQEDASSRRMSRNMLEHPVFQPATDLRNLVQNPTVRASSSSSVNLSIPGNVASSRTGSNPATNPSSAPTWVSPPNPPQHPRRLSEYVRRSLFSPSSDAIGSPSNNYSSLRSGFSTSEPRALSSGSGANPRSSSWLERQGGSEFGIPYSLRTLAVASEGSSRLVSEPIPNLNRLTSSACGAGSPTSTGGGRRDNQVDSDLLGQQKRFYQAHRM

SEQ ID NO: 217996 - protein, 206 aa, Glycine max
  Coding DNA Sequence Number=SeqID_101218
MLQPYEISIGLKEHSNPVTPKAYTPKSPSGPLPPDSDSSGFLRERKRLQCEGCFSQFRRDIKIPNGENSRNCVANMILKFHDDPTVNGGGCGWCVMAWPGVEVEAAMNGRWVIENRGISNLATLRGWSWADDGFFKAIGGRLSGSVVSHGDGDGGGRNSCYVTEGGVVPLFEARLLLRNGMDIIGEQTRANSRHNRISEKQVMELT

SEQ ID NO: 217997 - protein, 631 aa, Glycine max
  Coding DNA Sequence Number=SeqID_101219
  Gene Ontology: Mol. function=protein serine/threonine kinase activity; Cellular component=integral to membrane; Biological process=protein amino acid phosphorylation
  Homolog annotation: Hit_ID=Q9LFS4; Match level="QueryCoverage=98%, HitCoverage=97%, E-value=0.0, Identity=74%"; Hit description =Receptor protein kinase-like protein
  Pfam annotation: Domain name=LRRNT_2; Domain location=31-71; Score =56.9; E_value=6.6e-14; Accession=PF08263.3; Description=Leucine rich repeat N-terminal domain
  Pfam annotation: Domain name=LRR_1; Domain location=123-145; Score =19.1; E_value=0.016; Accession=PF00560.23; Description=Leucine Rich Repeat
  Pfam annotation: Domain name=LRR_1; Domain location=147-169; Score =10.2; E_value=3.5; Accession=PF00560.23; Description=Leucine Rich Repeat
  Pfam annotation: Domain name=LRR_1; Domain location=171-190; Score =13.5; E_value=0.79; Accession=PF00560.23; Description=Leucine Rich Repeat
  Pfam annotation: Domain name=LRR_1; Domain location=300-325; Score =6.1; E_value=21; Accession=PF00560.23; Description=Leucine Rich Repeat
  Pfam annotation: Domain name=LRR_1; Domain location=99-121; Score =16.3; E_value=0.11; Accession=PF00560.23; Description=Leucine Rich Repeat
  Pfam annotation: Domain name=Pkinase; Domain location=311-580; Score =117.1; E_value=5e-32; Accession=PF00069.15; Description=Protein kinase domain
  Pfam annotation: Domain name=Pkinase_Tyr; Domain location=311-580; Score=128.5; E_value=1.9e-35; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=31-71::123 -145::147-169::171-190::300-325::99-121::311-580::311-580
MGKPRREDVLCFVLFFWFCSFSNALLSPKGVNFEVLALMGIKASLVDPHGILDNWDEDAVDPCSWNMVTCSPENLVISLGIPSQNLSGTLSPSIGNLTNLQTVVLQNNNITGPIPSEIGKLSKLQTLDLSDNFFSGEIPPSMGHLRSLQYLRLNNNSFDGQCPESLANMAQLAFLDLSYNNLSGPIPKMLAKSFSIVGNPLVCATEKEKNCHGMTLMPMSMNLNDTEQNLFASLDALPSGRKKAHKMAIAFGLILGCLSLIVLGVGLVLWRRHKHKQQAFFDVKDRHHEEVYLGNLKRFHLRELQIATNNFSNKNILGKGGFGNVYKGILPDGTLVAVKRLKDGNAIGGDIQFQTEVEMISLAVHRNLLKLYGFCMTPTERLLVYPYMSNGSVASRLKGKPVLDWGTRKQIALGAARGLLYLHEQCDPKIIHRDVKAANILLDDYCEAVVGDFGLAKLLDHQDSHVTTAVRGTVGHIAPEYLSTGQSSEKTDVFGFGILLLELITGQRALEFGKAANQKGAMLDWVRKLHQEKKLELLVDKDLKTNYDRIELEEIVQVALLCTQYLPGHRPKMSEVVRMLEGDGLAEKWEASQSADTTKCKPQELSSSDRYSDLTDDSSLLVQAMELSGPR

SEQ ID NO: 217998 - protein, 95 aa, Glycine max
  Coding DNA Sequence Number=SeqID_101220
MPLQDKNHQRLKDFLFLMLQRGFMGMHCNHLCWADELDKDIDEAVAKAIEEQRKRILRPDVCVEFRMCLIWRLVVAILGWFSLVVAIEVVVCGTF

SEQ ID NO: 217999 - protein, 276 aa, Glycine max
  Coding DNA Sequence Number=SeqID_101221
  Gene Ontology: Mol. function=transporter activity; Cellular component= membrane; Biological process=oligopeptide transport
  Homolog annotation: Hit_ID=Q1SIG4; Match level="QueryCoverage=97%, HitCoverage=45%, E-value=1e-57, Identity=64%"; Hit description=TGF -beta receptor, type I/II extracellular region
GFILGSTVIVYVQDHVNWGVADIILSVVMAVSLLIFLIGRKGPITRTMSKRLQEDWARAAEECPRVLMNLRTHLLLEVASPLSLPFSIPLSFIFQEAKESFDEEDPRPTSSNGACIIVAAISKRKLPYPSDPTQLYEVSKSKGNRERFLPQTMKLKFLEKAAILENEGNLAEKQNPWKLTTVTKVEELKLTINMFPIWVFTLPFGICTAQTATFFIKQSAIMNRKIGNKRLTGNERGISILQRIGIGMFFSIITMIVAALVEKKRLEAVEINGPLK

SEQ ID NO: 218000 - protein, 66 aa, Glycine max
  Coding DNA Sequence Number=SeqID_101222
MAVMVTVASIQHRRFLKPNPRILDPIQPLRWWSFFSFPYLAIAISKLFSVIQERCCFGVRTRMTFL

SEQ ID NO: 218001 - protein, 106 aa, Glycine max
  Coding DNA Sequence Number=SeqID_101223
  Subcellular localization annotation: CTP_CleavageSite=34; ConfidenceScore=5.35e-01
MPHPIRALCFDVLQHKVPYINSPSHLLPRTQSSRSSQDPNTNNTRGGDQSGSRCFARMLQPYGISIGLKEHSNPVTPKAYTPKSPSGPLPPDSGSTPKIILAHRHC

SEQ ID NO: 218002 - protein, 179 aa, Glycine max
  Coding DNA Sequence Number=SeqID_101224
MGSLLLMRRETKLICNQNHQNNYMVTKTRHKEEKGMLRGLAWYKDKFNKHDWWWFTPIYASHIENVRNKLWNKISAFNANIPNQRLIAGDYNDIVSQLVSGPRTWSFFKKFPKWMEEGLKEWKANIFGNIKVAKRKIEAKLGGIQRMIHDGRGNPFLYKLEKDLHHQLETLLYLEELSW

SEQ ID NO: 218003 - protein, 93 aa, Glycine max
  Coding DNA Sequence Number=SeqID_101225
  Homolog annotation: Hit_ID=Q2A9R3; Match level="QueryCoverage=52%, HitCoverage=15%, E-value=4e-07, Identity=57%"; Hit description =Ethylene responsive element binding factor
QQKPEGKNVSKVKENVVDVDKFAGQVWDHIQQNMIQRGMIIGKDSKKPQSSRKPSLQISLPKKTEWIQFGDPEVTETVSQSNPNAEEKKHYRG

SEQ ID NO: 218004 - protein, 168 aa, Glycine max
  Coding DNA Sequence Number=SeqID_101226
  Gene Ontology: Mol. function=nucleic acid binding
  Homolog annotation: Hit_ID=Q1SLA4; Match level="QueryCoverage=48%, HitCoverage=15%, E-value=2e-10, Identity=39%"; Hit description=Zinc finger, CCHC-type; Lipocalin
MEEDLDNEEEEEDLEWCPNFHPNSQPIEFVAIQVRFFGLPIHYYDGNILCALGNHIRRTVRVDRSTWTNEKGKYTKLCVEVDLTKPLLALFKINQRFGHYVEGCPDKGKETWNGNQNTVVNRAQVEKEGRVSTSKANGPWAAVKKCRDLGEEKKKRRIRMEEGMRIPT

SEQ ID NO: 218005 - protein, 739 aa, Glycine max
  Coding DNA Sequence Number=SeqID_101227
  Gene Ontology: Mol. function=nucleic acid binding; Cellular component= intracellular; Biological process=DNA integration
  Homolog annotation: Hit_ID=Q1RXN8; Match level="QueryCoverage=97%, HitCoverage=62%, E-value=0.0, Identity=48%"; Hit description =Peptidase S8 and S53, subtilisin, kexin, sedolisin; Integrase, catalytic region; Zinc finger, CCHC-type
  Pfam annotation: Domain name=rve; Domain location=2-161; Score=157.2; E_value=4.4e-44; Accession=PF00665.16; Description=Integrase core domain
  Pfam module annotation: Pfam domain module=RVT_2::rve; Domain location=309-530::2-161
MKGTRQNGLYKLQARVPSLGGEKYFITFIDDWSRKVWTYLLKHKNQAFKCFKQWKLLVENQTGRHVKLLRTNNGLEYLSEEFNEFCKDNGIRRHKTVRLTPQQNGLAERMNKTILERVRCMLSNAKLANSFWGEAVNTACYLINRCPSSAIEFKTPEERWTGKAPSYENLTIFGCIVYVHSNEGKLEPRAKKGIFLGYPKGVKGYKFWLLDPAVQKGVQAEKNRHSDQGIRLEVEKLAQTLGLVEDRNEASHDEPMISLIPEPADTSYILVKDKEGRLKLLIEIDDQGSEPISYKDAISRTDSDQWRSAMQDEFDSLMKNDTWKLVEKPAKQKVVGCKWIFKRKPEETGMDSYRYKARLVARGFTQRERIDYNEIFSPVVKHTSIRIILALIAVHNLELEQMDVKTSFLHGNLEETIYMSQPEGYGVKGKKEMVCLLKKSLYGLKQSLRQWYSQMVSTEVPMTVVSTSEDDMLIASTDMKAIKELKNLLQSEFEMKDLRAARRILGMDIIRKRNEEDEIKDMSRIPYSNAIGSLMYDMVCTRPDLAYSASIVSRFMANPGKQHWSVVKWILRYLKGSKSVGLVYEESQKESMVCDIDKRRSLTGYLFTLYGSVISWKANLQSFVALSTTKAEYIALTEAIKEAIWLKGLVHELEGKTGPVEVWCDSQSAIDLSKNQVFHERTKHIDIRMHYIRDIIAQGEVEVRKVARANNPADMLTKVVPCSKFTHCLNLVNIGTCDT

SEQ ID NO: 218006 - protein, 68 aa, Glycine max
  Coding DNA Sequence Number=SeqID_101228
MEAISVIAKGSAVPAEISSIVLEFRSQREHNSIGVALAKFGLSLDCDCVLFDYPPPCVEGMLIGNSFR

SEQ ID NO: 218007 - protein, 86 aa, Glycine max
  Coding DNA Sequence Number=SeqID_101229
  Gene Ontology: Mol. function=ATP binding; Cellular component =chloroplast; Biological process=protein folding
  Homolog annotation: Hit_ID=Q1SGV8; Match level="QueryCoverage=55%, HitCoverage=21%, E-value=2e-13, Identity=74%"; Hit description=GroES- like
  Pfam annotation: Domain name=Cpn10; Domain location=39-86; Score= -3.2; E_value=0.0017; Accession=PF00166.12; Description=Chaperonin 10 Kd subunit
MAPTNICVQVRINGQRSTHSNSVIDLYGNTLRLSLWEIRLLIKIKEAEEKTEGGILLPSTAQTKPQGGEVVAVGKNNVEISVKTGA

SEQ ID NO: 218008 - protein, 115 aa, Glycine max
  Coding DNA Sequence Number=SeqID_101230
MEICSDLRIAAESTHWLEDNSRSLCFNGIKVCARLARGCARRAHALGEPQWLGPSGMKMTWMALLVPSWQRRGKNHEKMREKERERESCRSLIREQVEGEERDVDRPITKDLSGG

SEQ ID NO: 218009 - protein, 80 aa, Glycine max
  Coding DNA Sequence Number=SeqID_101231
MAIYNTFLLASGISRNFTNFLTMGAKYLEVVKRGSHPNNGWSSDEIRNDPNKSFPYGILLVLKTWSVTRDPITLNGVFKL

SEQ ID NO: 218010 - protein, 240 aa, Glycine max
  Coding DNA Sequence Number=SeqID_101232
  Gene Ontology: Mol. function=manganese ion binding; Cellular component=cytosol; Biological process=carbohydrate biosynthetic process
  Homolog annotation: Hit_ID=Q8L7W2; Match level="QueryCoverage=78%, HitCoverage=52%, E-value=2e-63, Identity=63%"; Hit description=Nudix hydrolase 8
  Subcellular localization annotation: CTP_CleavageSite=44; ConfidenceScore=5.48e-01
MELKSFSFNSEMVLVGRTRTCPALLSNSSSVRFCSQLNCFGAVTSSVGPDNLAAETSFHHINGTNGSISSLCSRNLRVLDASDDVYEGVVIDSDRLPDNPSTFAANLRFSLHHWKKVGKKGIWLRLPSEQSDFVPIAIKEGFRYHHAEPGYVMLTYWIPEGPFMLPANASHQVGVGGFVISGSNEVLVVQEKQCAPANCGLWKIPTRFVLQSEELYAGAIREVKEETGIDTEFVEVIAFR

SEQ ID NO: 218011 - protein, 113 aa, Glycine max
  Coding DNA Sequence Number=SeqID_101233
  Subcellular localization annotation: CTP_CleavageSite=61; ConfidenceScore=5.04e-01
MKEVKMKRKDSEGRAITKPLPATVNLSGSGWWRAPLTRYSVSPSNDSRNGLNHLVMTTPPSASSLLVTIEGLGSDKEGTSVLELVVWRVGRRLELEKRRTRKWGALREEEKNE

SEQ ID NO: 218012 - protein, 365 aa, Glycine max
  Coding DNA Sequence Number=SeqID_101234
  Homolog annotation: Hit_ID=Q9LVS8; Match level="QueryCoverage=34%, HitCoverage=64%, E-value=6e-32, Identity=55%"; Hit description =Similarity to EREBP-4
  Pfam annotation: Domain name=DUF862; Domain location=1-73; Score= -10.9; E_value=0.0021; Accession=PF05903.5; Description=Eukaryotic protein of unknown function (DUF862)
MALGHMNIQVVRLSAKYHGDTYHLIAKNCNHFTDEVCQHLTGSPIPGWVNRMARVVWFKLLGSFCNCLLPESLQVAAVRHLPERVAFDDDDGSGSDGLSASIESEEDEPNHHFLTSPNGDVAFLKEKPSQVMGAFIFLFLLCVFCFQSKVTYATRCGDAGPEIHYPYQIKGQQQQHKSLPGFELLCKDNLTTIHFPSYGDLVVKSISYDTKNIHLLDPKNCAHHVFLNLNLSLTPFHYFYVLKNYTYLNCSTTLPHPLVEVPCLSASSYHVYTVDPAVPVPGSCDGVKTVAIPFAYSPYLSDKSLGLRLTWHLREPLDNEAAVNRTRVIGSSICVFVMAMLLLISMKVRGATRNLHQKEGQLLQS

SEQ ID NO: 218013 - protein, 123 aa, Glycine max
  Coding DNA Sequence Number=SeqID_101235
MCPVVGFGPWLGLGKPLVEILPPGQLRGFCPLLAWLGSAVLGYGPVLSFGLVGPLLPPVISFVARILQLCLAPRWLSLCLGGGSSCHNMARHKGRDESKRQGLNLSGSWQQGHSATYNTPSRI

SEQ ID NO: 218014 - protein, 105 aa, Glycine max
  Coding DNA Sequence Number=SeqID_101236
MGETHEMPHHNLADFESRLGYAAKGQTVGDILLQNTLEGPQYHPQPHLLHSTAGKNPHAMAEMGKLDHLEKRINEALGLNPELGLGLNPELGLDLKRADYFILQN

SEQ ID NO: 218015 - protein, 543 aa, Glycine max
  Coding DNA Sequence Number=SeqID_101237
  Gene Ontology: Mol. function=metal ion binding; Cellular component =nucleus; Biological process=response to stimulus
  Homolog annotation: Hit_ID=Q84JU6; Match level="QueryCoverage=95%, HitCoverage=64%, E-value=1e-158, Identity=49%"; Hit description=E3 ubiquitin-protein ligase HOS1
  Subcellular localization annotation: CTP_CleavageSite=52; ConfidenceScore=5.18e-01
MDKRLNGPTVSSSSNGGSAVGRSSPTLQPNYSSRLVQEALEHLASIDLIELCKEAKVERCRATRDLRSCGRYVHHVLNSCGHASLCEECSQRCDICPICRIPISKSGAKVHLRLYYECIEAGLISKRCDERFQEIEDGDKQLTADVQRLYSLFDVALENNLGISNVLDILESSFKGTLSAQLHDLQNLQESIMKTKQHMDVIIWCTRHQFLEDVRSRFTDSSSWSSVVRTRKSEAIRRAWPDPINQSVESSGHDGSLFIEDAMNNLDLEEGFRNEIVEGLEIASLQKDSESFLGSNTDQILGYYPFKNLRSAVDLLFLRGGSDMFLYYLYDRHWTIPEEEWRYILEDFAATFSISRHSLLESLTFYLLDDHTEEALQEACRLLPEITGSTSHPKIAEVLLERGSPDTALMVLRWAGRDGGPHVTSLRDAVTAVRVRVECGLLTEAFMHQRMLCTKVKEKNFNKTASGNTSEKQKGQCNKWVEWMEVLVTEICCLCIRRNLVDRMLELPWNSEEEKYIHKCLLDYAIEDPLRTTGNLLVVYYFQ

SEQ ID NO: 218016 - protein, 337 aa, Glycine max
  Coding DNA Sequence Number=SeqID_101238
  Gene Ontology: Mol. function=metal ion binding; Cellular component =nucleus; Biological process=response to stimulus
  Homolog annotation: Hit_ID=Q84JU6; Match level="QueryCoverage=88%, HitCoverage=30%, E-value=7e-13, Identity=28%"; Hit description=E3 ubiquitin-protein ligase HOS1
RHRYSEAYQVHIKLEKAEQDCISKGSVSQQNLPVLEKAIHFRANLINRCLELLPEVEQQQLRSGNLTEGVVTSCEEVEIPDKFDVPQIQDFLSTSLLIPSSVNSSLMLHKDHPTGLLSSLTLGTSAKIGMSFPTTGTELGNFGSLSYHHDGLFTNNERVPSHQRKIGKNLRNDNSPTPRNHRIRFMNGSPLKGFTRTSPSNSQENRPDKISPGVEQNNQTTSPMESWKATVNPVTRSTLSYPKEFANDLSNVSSKNVQSHKDERSWNMGSTNDPMDVSRSLVDNKLNTEENIKGAPRWRSDDASDEEDDRDVGRAMDIAYYSTPPTQMTRRSRVSRR

SEQ ID NO: 218017 - protein, 584 aa, Glycine max
  Coding DNA Sequence Number=SeqID_101239
  Gene Ontology: Mol. function=oxidoreductase activity, acting on the CH-CH group of donors; Cellular component=peroxisome; Biological process=fatty acid metabolic process
  Homolog annotation: Hit_ID=Q945U4; Match level="QueryCoverage=84%, HitCoverage=74%, E-value=0.0, Identity=95%"; Hit description=Acyl -CoA oxidase
  Pfam annotation: Domain name=Acyl-CoA_dh_1; Domain location=365-530; Score=-24.6; E_value=0.037; Accession=PF00441.14; Description=Acyl -CoA dehydrogenase, C-terminal doma
  Pfam annotation: Domain name=Acyl-CoA_dh_M; Domain location=225-285; Score=64.9; E_value=2.6e-16; Accession=PF02770.9; Description=Acyl -CoA dehydrogenase, middle domain
  Pfam module annotation: Pfam domain module=Acyl-CoA_dh_1::Acyl-CoA_dh_ M; Domain location=365-530::225-285
MNVKGKVVRNESRVEDERRKRKEERNMKYEIFSSDSNVITFSSFGTLKTQLNHIKHPLFYSNCCYCNTTQSSFITETKATSCDIRKTLARMEDSIDHLAFERNKAQFDVDEMKIVWAGSRQDFELSDRISRLVASDPAFRKDDRTTLGRKELFKNTLRKAAYAWKRINELRLNEQEAYKLRSFVDQPAFTDLHWGMFVPAIQGQGTDEQQQKWLPLAYRMQIIGCYAQTELGHGSNVQGLETTATFDPKTDEFVIHNPTLTSSKWWPGGLGKISTHAVVYARLIIGGEDHGVHGFIVQLRSLDDHLPLSGITIGDIGMKFGNAAYNTMDNGVLRFDHVRIPRNQMLMRVSQVTREGKYVHSNVPRQLVYGTMVNVRQKIVADASVALSRAVCIATRYSAVRRQFGSHNGGLETQVIDYKTQQARLFPLLASAYAFRFVGEWLKWLYMDVTKRLQANDFSTLPEAHACTAGLKSLTTTATADGIEECRKLCGGHGYLCSSGLPELFAVYVPACTYEGDNIVLLLQVARYLMKTVSQLGSGNKPVGTTAYMARVEQLMQYHSDVKKAEDWLKPNVVLEAFEARAAR

SEQ ID NO: 218018 - protein, 182 aa, Glycine max
  Coding DNA Sequence Number=SeqID_101240
  Gene Ontology: Mol. function=DNA binding; Cellular component=nucleus; Biological process=regulation of transcription, DNA-dependent
  Homolog annotation: Hit_ID=Q52MQ4; Match level="QueryCoverage=97%, HitCoverage=90%, E-value=6e-53, Identity=58%"; Hit description=Myb family transcription factor 2
  Pfam annotation: Domain name=Myb_DNA-binding; Domain location=16-63; Score=59.7; E_value=9.4e-15; Accession=PF00249.21; Description=Myb -like DNA-binding domain
  Pfam annotation: Domain name=Myb_DNA-binding; Domain location=69-114; Score=47.8; E_value=3.6e-11; Accession=PF00249.21; Description=Myb -like DNA-binding domain
  Pfam module annotation: Pfam domain module=Myb_DNA-binding::Myb_DNA -binding; Domain location=16-63::69-114
MAPPKNDETAKKTNNRGAWTAEEDQKLAQCIEIHGAKRWKTVAIKSGLNRCGKSCRLRWLNYLRPNIKRGNISVEEEDLIIRLHKLLGNRWSLIAKRLPGRTDNEIKNYWNTCLCKKLNRTKVKPETSTAQATHTTRSTEERAAVENKERIDDGSGDSEVNFDVNEFFNFSIEGPFALDWMI

SEQ ID NO: 218019 - protein, 398 aa, Glycine max
  Coding DNA Sequence Number=SeqID_101241
  Gene Ontology: Mol. function=phosphatidylserine decarboxylase activity; Cellular component=mitochondrion; Biological process =phospholipid biosynthetic process
  Homolog annotation: Hit_ID=Q1SSC6; Match level="QueryCoverage=99%, HitCoverage=98%, E-value=1e-156, Identity=67%"; Hit description =Phosphatidylserine decarboxylase
  Pfam annotation: Domain name=PS_Dcarbxylase; Domain location=155-398; Score=-3.4; E_value=7.6e-07; Accession=PF02666.6; Description =Phosphatidylserine decarboxylase
  Subcellular localization annotation: CTP_CleavageSite=38; ConfidenceScore=5.64e-01
MKYRVSHKFPVLPRHTRPFNHTRYFTSFAKKFQTPQPRASINAGGSGNSQGNSFVVPGATVATILMLGVLHARRLYEDKKTEQMKEKGIEIEFQPDAKATFLRLLPLRSISRCWGYLTSMEIPVWLRPHIYKAWARAFHSNLEEAALPLDKYASLRDFFVRTLKEGSRPIDVDPQCLVSPVDGTVLRFGELKGAGAMIEQIKGFSYSVFSLLGASPFLPTTDVQEEHSESITTTVKSKKSWWRVSLASPKVWNPTSSRASQYKRSNMGRSGTTLNGCLTCRTSRVILEGLWQEGFMALAAIGATNIGSIELFIEPELHTNRPRKKFLHSEPPEERIYGCEGVGRMLKKGDELGAFNMGSTVVLVFQAPISKLPEGDSSQEFRFCVGRGDRIRVGEALG

SEQ ID NO: 218020 - protein, 137 aa, Glycine max
  Coding DNA Sequence Number=SeqID_101242
MDEEAKVEAPQEPTHQWSPFESLMIQKMNVMLHLHQKHLADIHSTIENITTQLENIETRVTLSTLLNPDEMKLSVATCPSRASEGEAHGCAFQRRKDARSRHQRLFVGNVGKTEGNRRQKRGSCSYVPSIKEEIRPT

SEQ ID NO: 218021 - protein, 100 aa, Glycine max
  Coding DNA Sequence Number=SeqID_101243
MYPLSAFNQKVDYRGDLRRLLILSQYQYQLMDPSSPAPEVDLPSTPILISDDPTMRTPEWIPTPLTTPKLQFSDKEEGRLTTPPGTPVLHLDDEKQDRDE

SEQ ID NO: 218022 - protein, 110 aa, Glycine max
  Coding DNA Sequence Number=SeqID_101244
MEEFFILVCLCFDHVDVCSVRVIQHWEMKYQRNEAEILEQEMELTASAMILQTPGEKEYELLENNRPKEKPKVELKILPTHLKYVFLEDNETKPIIISSSLQKKEEDQLV

SEQ ID NO: 218023 - protein, 52 aa, Glycine max
  Coding DNA Sequence Number=SeqID_101245
MSSTFSARLSQHPWNFRIKDYQQGFRSNVSNKDIGLTSKKAEGGFLWWSFKG

SEQ ID NO: 218024 - protein, 382 aa, Glycine max
  Coding DNA Sequence Number=SeqID_101246
  Gene Ontology: Mol. function=hydroxymethyl-, formyl- and related transferase activity; Biological process='de novo' IMP biosynthetic process
  Homolog annotation: Hit_ID=Q1SSC9; Match level="QueryCoverage=95%, HitCoverage=92%, E-value=1e-134, Identity=72%"; Hit description =Formyl transferase, N-terminal
  Pfam annotation: Domain name=Formyl_trans_N; Domain location=132-316; Score=72.7; E_value=1.2e-18; Accession=PF00551.9; Description=Formyl transferase
  Subcellular localization annotation: CTP_CleavageSite=66; ConfidenceScore=5.48e-01
MGIVQRLCSSWSNVFRLGNRNSYSSFNKSVDPTNPSCSSSSFLTHGIHVFQCPDAVGIVANLSDCIASRGGNILSADVFVPQNKRVFYSRNVFVFDPVMWPRMQMEEDFLRISKTFNAMRSVIRVPALDPKYKIAILVAKQDHCLIDLLHGWQDGRLSVDITCVISNHYRSPENEVIRFLDMHGVPYHYLRTTAENKREEEILELVQNTDFLVLARSMRILSSFFLRSYGKDIINIHHGLLPSFSGSNPSKQAVDAGVKLIGATSHFVTEGLDAGPIIEQMLNLILAHYDYESPFTWPNLKADFSFNLMQILTYALWGLKEFPIEITCRAMCRNQRTLRNNASQALSGLIVSFECCHMKKRILSYFEDKQQLYTLPNGGISL

SEQ ID NO: 218025 - protein, 114 aa, Glycine max
  Coding DNA Sequence Number=SeqID_101247
  Gene Ontology: Mol. function=kinase activity
  Homolog annotation: Hit_ID=Q1SSD6; Match level="QueryCoverage=88%, HitCoverage=16%, E-value=3e-32, Identity=75%"; Hit description =Protein kinase PKN/PRK1, effector
MTWHVVFFYCALPSASDRNLKFSRGGVLRPIEKDEHESLASPPSVRASRLSSPLHDNLTSNKKTFSKPRASLEKDVEQLQLRLQQEKSMRILLERAMGRASSTLSPGHRHFAAQ

SEQ ID NO: 218026 - protein, 167 aa, Glycine max
  Coding DNA Sequence Number=SeqID_101248
  Gene Ontology: Mol. function=RNA-directed DNA polymerase activity; Biological process=RNA-dependent DNA replication
  Pfam annotation: Domain name=AT_hook; Domain location=119-131; Score =14.9; E_value=0.061; Accession=PF02178.9; Description=AT hook motif
MKWRKASGVLCDANVPIKLKGKFYRTAVRPAILYGTECWAVKSQHEIKLGVAEMRMLRWMCGKTRQDKIRNEAIRERVGVVPIVEKMVENRLRWFGHVERRPVDSVVRRVDQMGRRQTIRGRGRPKKTIREVIKKDLELNDLDRSMICHIKQQSFSGKGACHVCLHL

SEQ ID NO: 218027 - protein, 227 aa, Glycine max
  Coding DNA Sequence Number=SeqID_101249
  Gene Ontology: Mol. function=hormone activity; Cellular component=cis- Golgi network; Biological process=ER to Golgi vesicle-mediated transport
  Homolog annotation: Hit_ID=Q1SIY3; Match level="QueryCoverage=67%, HitCoverage=99%, E-value=2e-72, Identity=87%"; Hit description =Sybindin-like protein
  Pfam annotation: Domain name=Sedlin_N; Domain location=28-167; Score=- 54.6; E_value=0.082; Accession=PF04628.3; Description=Sedlin, N -terminal conserved region
  Pfam annotation: Domain name=Sybindin; Domain location=24-159; Score =198.2; E_value=1.9e-56; Accession=PF04099.3; Description=Sybindin -like family
  Pfam module annotation: Pfam domain module=Sedlin_N::Sybindin; Domain location=28-167::24-159
MQFFGVSEISPSPPAPTASGNNGHMMYVFNRNGVCLLYREWNRPLRTLDAQQDHKLMFGLLFSLKSLTAKMDPTSAVEKGNLGMLQLPGQGCSFHSFCTNTYKLSFMESPSGIKIILVTHPRTGDLRESLKYIYNLYVEYVVKNPLYTPGSPISVIHGHSHHQLASFYVLNAYDNCFNHEEVRAVQYNVGPVCERHCIDAELFPINTVDDLCGFNALFCMVYVRGIA

SEQ ID NO: 218028 - protein, 177 aa, Glycine max
  Coding DNA Sequence Number=SeqID_101250
  Gene Ontology: Mol. function=catalytic activity; Biological process =metabolic process
  Homolog annotation: Hit_ID=P93837; Match level="QueryCoverage=63%, HitCoverage=21%, E-value=2e-18, Identity=49%"; Hit description=Amp -binding protein
  Subcellular localization annotation: CTP_CleavageSite=44; ConfidenceScore=5.29e-01
MVCFHPIMFYGQMNNCHCLPWSSLSSHAFAFGNSPSPSPTRRPKASLKLHEHRYFCKVDSRVLTFAFSSLGIRRGSVVFVLALNVPVMYELHFAGAILNNINTRLYARTVSVILRHVKSALVFVDCASCHLVLEALSLFPENQNQHPTLILITDKIVEKEKALPAVDNFLDIDEGLE

SEQ ID NO: 218029 - protein, 111 aa, Glycine max
  Coding DNA Sequence Number=SeqID_101251
  Gene Ontology: Mol. function=catalytic activity; Biological process =metabolic process
  Homolog annotation: Hit_ID=Q9FFE6; Match level="QueryCoverage=61%, HitCoverage=12%, E-value=3e-10, Identity=53%"; Hit description=AMP -binding protein
MSRKLSTAGKAFSFSTILSVMRIRDDGDGAGVEAGVDVVENCAGEVELVHDGDVQGQDEDNTATTDAEGGEGEGQLKASMAREGGVIVGQHPIEALGTDIVEFYKTGGPNL

SEQ ID NO: 218030 - protein, 315 aa, Glycine max
  Coding DNA Sequence Number=SeqID_101252
  Gene Ontology: Mol. function=kinase activity; Cellular component =cytoplasm; Biological process=regulation of transcription, DNA -dependent
  Homolog annotation: Hit_ID=Q1SSD6; Match level="QueryCoverage=95%, HitCoverage=54%, E-value=1e-120, Identity=68%"; Hit description =Protein kinase PKN/PRK1, effector
  Pfam annotation: Domain name=DUF547; Domain location=81-227; Score =138.6; E_value=1.7e-38; Accession=PF04784.5; Description=Protein of unknown function, DUF547
VNEKFSTKEKTPALRTLKDHLNQCPNRLSEEMVKSSTHAVQPRHGFGNDRDCSCKSVVEISWIATRKRHSSHASYAIDNYRVLVEQLERVNISQMESDGQIAFWINVHNALVMHAYLAYGIPQGSLKRLALFHKGYGDGGNQGRGGSCGRRGKVVVVTEWLESFLSAALRKKNGEEKQLISSKLCITDFQPLVCFALCTGALSDPVLKVYTASNIREQLNIAKREFLQANVVVKKSSKVFLPKLVERFSREASISLDDLLGWVMESVDKKLHDSIQKCLDRKSNKKSSQIIEWLPYSSRFRYMFSKDLIDKPWWV

SEQ ID NO: 218031 - protein, 235 aa, Glycine max
  Coding DNA Sequence Number=SeqID_101253
  Gene Ontology: Mol. function=nucleotide binding
  Homolog annotation: Hit_ID=Q1SSD9; Match level="QueryCoverage=79%, HitCoverage=47%, E-value=5e-98, Identity=88%"; Hit description =Hypothetical plant protein
  Pfam annotation: Domain name=DUF246; Domain location=1-145; Score =25.7; E_value=3.8e-16; Accession=PF03138.5; Description=Plant protein family
MKKQDLSPDGERKRGKCPLTPHEVGLMLQALGFSKDTYLYVASGEVYGGEETMQPLRDLFPNIYTKEMLAEEELKPFLPFSSRLAAIDYIVCDESDVFVTNNNGNMAKILAGRRRYMGHKRTIRPNAKKLSTILAGRHQMDWDTFAKKVKSCQRGFMGEPDEMRPGRGEFHEFPSSCVCKRPYVDEELSKELIPPRMELEEAGHEVNLNHEVIGRGGIKSYLALLMPTERQLKIE

SEQ ID NO: 218032 - protein, 1356 aa, Glycine max
  Coding DNA Sequence Number=SeqID_101254
  Gene Ontology: Mol. function=RNA binding
  Homolog annotation: Hit_ID=Q108Y7; Match level="QueryCoverage=94%, HitCoverage=60%, E-value=1e-115, Identity=29%"; Hit description =Agenet domain containing protein, expressed
  Pfam annotation: Domain name=Agenet; Domain location=881-953; Score =57.8; E_value=3.6e-14; Accession=PF05641.3; Description=Agenet domain
  Pfam annotation: Domain name=QLQ; Domain location=248-284; Score=9.7; E_value=0.022; Accession=PF08880.1; Description=QLQ
  Pfam module annotation: Pfam domain module=Agenet::QLQ; Domain location=881-953::248-284
MNFAGKILCGNQISISSAFVLDSYIELCETGGGSLSQTEKDKNQVEASANQNTQVSEVINGGPKNTLSTAEDLKENNASKDERRSTPEVNSVIDLSKKDVADDVGKMQPIPVTETVKTSSAMEGSPSTFGRGPSKTKSVGEVATNGASKATAERKTRRASNKSAGKESSRRGSHAKDTKLARQTDRGDKSTKVSLSPSPGFQMMQSNEVQQFGHIDSNSTKSFAVVNTSTYSIPDLNTSASPPVLFHQPFTDQQQVQLRAQIFVYGALIQGMVPDEAYMISAFGGSDGGRSLWDNAWRACMERQHGQKSHPANPETPLQSRSVARTSDLPHKQSAAQAKGISSPLGRTSSKATPPIVNPLIPLSSPLWSLSTLGLGSDSLQSSAIARGSVMDYPQAITPLHPYQTTPVRNFLGHNTPWMSQTPLRGPWIGSPTPAPDNSTHISASPASDTIKLGSVKGSLPPSSVIKNITSSLPTSSTGLQSIFAGTASLLDANNVTVSPAQHSSDPKPRKRKKVVVSEDLGQRAFQSLAPAVGSHTSTPVAVVVPVGNVPITTIEKSVVSVSPLADQSKNDQNVEKRIMSDESLLKVKEARVHAEEASALSAAAVNHSLELWNQLDKHKNSGLMPDIEAKLASAAVAVAAAAAIAKAAAAAANVASNAALQAKLMADEALLSSGYNNSSQSNQICLSEGTNNLGKATPASILKGANGTNSPGSIIVAAKEAVKRRVEAASAATKRAENMDAIVKAAELAAEAVSQAGKIVTMGDPLPISQLVEAGPEGCLKATRESSQQVGLFKDITRDMVNINVRDIPETSYTHNRDILSGGISASIKINEKNSRGPKGRKVVSNLVKPIHVVPGSEPEIQAPFTVNNGSENLVESSIIKEGLLVEVFKDEEGFKAAWFSANILTLRDDKAYVGYTSLVAAEGAGPLKEWVSLVCDGDKHPRIRTARPLNTLQYEGTRKRRRAAMGDYAWSVGDRVDAWIQESWWEGVITAKNKKDETTFTVHFPASGETLVVRAWHLRPSLIWKDGKWIESSKVGANDSSTHEGDTPIEKRPKLGSHAVDVKGKDKMSKGSDAVESAKPDEMKLLNLAENDKVFNIGKSSKNENKFDAHRMVRTGLQKEGSKVIFGVPKPGKKRKFMEVSKHYVAHENSKISDRNDSVKLANFLMPPSSGPRGWKNSSKNDAKEKHGADSKPKTSHTERIKDSSNQFKNASQSESKVERAPHSASDGATGSILFSTLATSVDAHPTKRASSSRASKGKLAPAHIKSGKGEMEKALNDNPMKSASDVVEPRRSNRRIQPTSRLLEGLQSSLIISKIPSVSHNRNTKSCAVYRYSPCYLGGRVAKDVEWESFIYS

SEQ ID NO: 218033 - protein, 558 aa, Glycine max
  Coding DNA Sequence Number=SeqID_101255
  Gene Ontology: Mol. function=transferase activity; Cellular component= nucleus; Biological process=regulation of transcription
  Homolog annotation: Hit_ID=Q1SSE5; Match level="QueryCoverage=81%, HitCoverage=94%, E-value=1e-167, Identity=63%"; Hit description =Tetratricopeptide-like helical
  Pfam annotation: Domain name=PPR; Domain location=174-208; Score =16.0; E_value=0.096; Accession=PF01535.11; Description=PPR repeat
  Pfam annotation: Domain name=PPR; Domain location=267-301; Score =33.1; E_value=9.9e-07; Accession=PF01535.11; Description=PPR repeat
  Pfam annotation: Domain name=PPR; Domain location=369-403; Score =20.2; E_value=0.0074; Accession=PF01535.11; Description=PPR repeat
  Pfam annotation: Domain name=PPR; Domain location=444-478; Score=2.6; E_value=3.7; Accession=PF01535.11; Description=PPR repeat
  Pfam annotation: Domain name=PPR; Domain location=510-544; Score=4.8; E_value=2; Accession=PF01535.11; Description=PPR repeat
  Pfam module annotation: Pfam domain module=PPR::PPR::PPR::PPR::PPR; Domain location=174-208::267-301::369-403::444-478::510-544
MRRFLFLYNEARKFRKPHIPLAFPSPLAYSTSLNHTHNIGDSKFNLVDVSAQGGTKAEFALFEASRGIKPNSFALVNLLGLVSNLNCASFGHKLHSYVIRSGYFSHIHVSTSLTKFYPVSKRFVVLHAPRQVLRLCRRSLVHICFVCLFPTESLQLGSSIHCKIVKLGMDDGTVVANCLIDMYGKCGFVERAVQVFSQTIEKDVISWNSVIAASANNGHIELAYKFLHLMPNTDTVSYNGLINGIAQFGNVEVAVQVLSSLPSPNSSSWNSVITGFLDTNRAREALDMFRKMHLRKVEMDEFTFSIILNGIACLSALTWGMLIHCCTIKCGLDASVVVGSALIDMYSKCGQVKNAESIFLHALPNKNLVSWNAIMSGYARNGDSAGVIHLFKLLKMERDVKPDCITFLNLNLISVCSHSEIPFEVAIRYFESMIDEYKIAPSIEHCCSMIRLMGQKGELWRAERLILELGFESCGVVWRALLGACGTQADLQVAEIAAAKVIEMDRDEDYVYVMMSNMYASCGRWEDVNVIRGLMSRKEVRKEAGSSWIEIDSSVSSL

SEQ ID NO: 218034 - protein, 338 aa, Glycine max
  Coding DNA Sequence Number=SeqID_101256
  Gene Ontology: Mol. function=molecular_function; Cellular component =membrane; Biological process=auxin mediated signaling pathway
  Homolog annotation: Hit_ID=Q9FGL0; Match level="QueryCoverage=99%, HitCoverage=94%, E-value=1e-102, Identity=54%"; Hit description =Nodulin-like protein
  Pfam annotation: Domain name=DUF6; Domain location=183-313; Score =33.2; E_value=9.3e-07; Accession=PF00892.11; Description=Integral membrane protein DUF6
  Pfam annotation: Domain name=DUF6; Domain location=20-141; Score =13.5; E_value=0.011; Accession=PF00892.11; Description=Integral membrane protein DUF6
  Pfam annotation: Domain name=TPT; Domain location=174-313; Score= -32.2; E_value=0.043; Accession=PF03151.7; Description=Triose -phosphate Transporter family
  Pfam module annotation: Pfam domain module=DUF6::DUF6::TPT; Domain location=183-313::20-141::174-313
MSRGAMEDVAIIGGLIGVQFIYAGNAVLMSYSMSLGFSSLTIIILTSLATFLILFPIAFFVERSRWPKHCSFRLVFQYLFLKGINLTSPAMGTAMPNIAPGLIFIIAWISGLEKVNLSNKYSQVKILGTLLCVLGALTMSIMQSISAPATVKNDTVELTPPPSAFTFDIQKIIGCLYLVVAVFILSSNVVLQAFALGDFPAPMSLGAITSLIGAFMTAIFQFLEDHEVKTSWLLVRSGDLIGFFILAGAVSGICLSFNGWALKKKGPVFVSMFSPIGTVCSVIFSVVTLEDTINIGSLEGMFLMFTGLYLVLWAKGKEGHPDGDGLESECDAETPLLS

SEQ ID NO: 218035 - protein, 296 aa, Glycine max
  Coding DNA Sequence Number=SeqID_101257
  Gene Ontology: Mol. function=metalloendopeptidase activity; Cellular component=proteinaceous extracellular matrix; Biological process =peptidoglycan metabolic process
  Homolog annotation: Hit_ID=Q1SSE4; Match level="QueryCoverage=94%, HitCoverage=94%, E-value=1e-123, Identity=77%"; Hit description =Peptidase M10A and M12B, matrixin and adamalysin; Peptidase, metallopeptidases
  Pfam annotation: Domain name=PG_binding_1; Domain location=2-62; Score=41.1; E_value=3.7e-09; Accession=PF01471.9; Description =Putative peptidoglycan binding domain
  Pfam annotation: Domain name=Peptidase_M10; Domain location=87-250; Score=284.9; E_value=1.6e-82; Accession=PF00413.14; Description =Matrixin
  Pfam module annotation: Pfam domain module=PG_binding_1::Peptidase _M10; Domain location=2-62::87-250
MSELKKYFHRFGYLSLPETTPNFTDTFDSQFESALVRYQKRLGLPVTGKLDSGTISAIVAPRCGVSDAAPHGFRATRRYAYFNGKPRWTRGTPMTLTYAFSPYNMIDRVSVPEIRAVFERAFARWASVIPVSFQETPEYDRADITIGFYLGDHGDGEPFDGVLGVLGHAFSPQNGRFHLDAAETWSVDFEREASRVAVDLESVATHEIGHVLGLGHSSVKEAVMYPSLSPRRKKVDLKIDDVAGVQALYGSNPNFTFSSLLQSQNSLNAAVGLETGFYKWTLSLPLLALFALFLSA

SEQ ID NO: 218036 - protein, 384 aa, Glycine max
  Coding DNA Sequence Number=SeqID_101258
  Gene Ontology: Mol. function=catalytic activity; Cellular component =nucleus; Biological process=metabolic process
  Homolog annotation: Hit_ID=Q9FFE6; Match level="QueryCoverage=99%, HitCoverage=69%, E-value=1e-153, Identity=65%"; Hit description=AMP -binding protein
  Pfam annotation: Domain name=AMP-binding; Domain location=1-300; Score=138.5; E_value=1.8e-38; Accession=PF00501.18; Description=AMP -binding enzyme
MSKGDPNFKWVLPNSDWDPMILNYTSGTTSSPKGVVHCHRGAFISALDTLIDWAVPKNPIYLWTLPMFHANGWNLTWGIAALGGTNICVRKFDAGVVYSLIRNHHVTHMCGAPVVLNMLTNSDKRPLEKPVQFITAGAPPPAAVLLRAEEFGFVVGHGYGLTETGGIVVSCAWKGKWNRLPATERARLKARQGVRTVGVTEVDVVGPTGESVKRDGVSVGEIVVKGGCVMLGYLKDPSGTARCFKNGRFYTGDVAVMHEDGYLEIKDRSKEVIISGGENLSSVELESVLYGHPAVNEAAVVARPDEYWGETPCAFVSLKAAIKEKEKLTEKDMIQYCKDNMPHYMVPKTVVFKDELPKTSTGKIQKFVLKQIANNMGSLKHSRI

SEQ ID NO: 218037 - protein, 100 aa, Glycine max
  Coding DNA Sequence Number=SeqID_101259
MVKVVVASLQTPMGGKDIFLLLNLISLQLGPSKLDVLAASFDPQVAFTVKNSSLTIPKLAKNIDYGLLSHRYSLGCKKCKPTSQDFDPPYSINQVFCWCF

SEQ ID NO: 218038 - protein, 553 aa, Glycine max
  Coding DNA Sequence Number=SeqID_101260
  Gene Ontology: Mol. function=catalytic activity; Cellular component =nucleus; Biological process=metabolic process
  Homolog annotation: Hit_ID=Q9FFE6; Match level="QueryCoverage=97%, HitCoverage=98%, E-value=0.0, Identity=62%"; Hit description=AMP -binding protein
  Pfam annotation: Domain name=AMP-binding; Domain location=41-465; Score=345.7; E_value=7.7e-101; Accession=PF00501.18; Description=AMP- binding enzyme
MDDLTPNPANSPPLTPLTFLERAAIVYGDSHSILYNRTSFTWSQTHRRCLQLASSLTSLGLGRGHVISVLSPNTPSMYELHFAVPMCGAILNNLNLRLNPHILSVLLRHSESKLVFVHSHSLPLILRALSNFPKTTPRPSLVLITDDADAVTVSLAHVIDTYEGLIKKGNPNFHWARPNSEWDPITLNYTSGTTSSPKGVVHSHRATFIMALDSLIDWCVPKQPVYLWTLPMFHSNGWTFPWGIAAAGGTNVCPRKIDAPMIYHLIQSHNVTHMCAAPVVLNLLLTRTEPVKNPVHVLTGGSPPPAAILTRAEKLGFRVRHGYGMTETLGVVVSCAWKKEWDKFPATERARFKARQGVRTVAMTEVDVVDPATGVSVKRDGVTSGEIVFRGACVMLGYLKDSDGTKRCIRNNWLYTGDVGVMHGDGYLEIKDRSKDVILSGGENLSSVQVEAVLYDHPAVNEVAVVARPDEFWGETPCAFVMLKEGLVAPPSEKEVVEFCRERLPHFMVPKTVVFKEALPKTSTGKIQKHVLRMDAQAMGSLAAPQPTIPSRM

SEQ ID NO: 218039 - protein, 673 aa, Glycine max
  Coding DNA Sequence Number=SeqID_101261
  Gene Ontology: Mol. function=methyltransferase activity
  Homolog annotation: Hit_ID=Q1SSE9; Match level="QueryCoverage=100%, HitCoverage=53%, E-value=0.0, Identity=53%"; Hit description=N-6 Adenine-specific DNA methylase
MASNPPLHMEDQTDEDFFDKLVEDDMEPVKFGHDEGDDSDEAKAFANLGINDVDAAAFENSAAAESGVKVKGELGNVESDVGLEQKGNSVPAMSSVGFDSKVDPGEDGSGVGSEVTSALAVGTSDTVGNSGIKEVGWNSFHADLNGVGGLGSYSDFFSELGDQSGDFTGNVYDNLSTEVKPGSEVQNNGLNASGNYVQYQEGQGYDGSLENHSNRQGNGLNESVNHVQYPEDQAYVASSEEHAYGQDLSSSQYWEDLYPGWKYDHQTGQWYQIDGYSATATTQQSSEVNTAADWTAASDRETEISYMQQTAQSVAGTLAETGTTENVSSWSQVSEGNNGYPEHMVFDPQYPGWYYDTIAQEWRSLETYNSTIQSSGLGLENGHASASTFLPKDNSLYSEYSQADNYGSQGIDSQTVDGSWSGLYGTNHQQGFDLYTTGSATTRGDNITSGGNQQINHSYGSSISANKNQQSTSSSFGSVALYNRVNHDRGLANGTFEPPSFGPTGDTVQQFNYSTTKFGEQNVFSNDFTEIQKPFSYSSQSIQGGHQYSHNPHVGRSSAGRPSHALDSVQGSISVLNLIEVVTGNMDSLSIGNNTSNYFRALSQQSLPGPLVGGSVGNKELYKWLDERIAHCESPDMDYKKGERLRLLLSLLKIGCQHYGKLRSPFGTDTILK

SEQ ID NO: 218040 - protein, 92 aa, Glycine max
  Coding DNA Sequence Number=SeqID_101262
MESHFEIKTSVKERVLPMLEEQPPHFLLCKKTLVSIVEAMSSKVILMMPKNQSRVKQSFKFQDSRFKNQDSRKVKIKIQDSRFMNHEKTQSR

SEQ ID NO: 218041 - protein, 776 aa, Glycine max
  Coding DNA Sequence Number=SeqID_101263
  Gene Ontology: Cellular component=ribonucleoprotein complex; Biological process=mRNA metabolic process
  Subcellular localization annotation: CTP_CleavageSite=48; ConfidenceScore=5.17e-01
MGTCLSKKNGSSTSPNKSVSQHRNSENSVIVTLSKPTEPELSLKNKTPQDEVKKEIFIIKPRNSHDDREKTTTTSKTQPFIAQSPAPKQGDGVFMTNEETMVVNKTIAPSTPSIGIVGVRTSSCTKEEVDEILIQCGRLSRSSSGRKYSGSKRSFDFDHCDNDTTSAEDDQRKSKGNGNGREENDVAGESCRHRQSPRRSSQGRRRTPSRERDQSNGRERKVSRSPGRRSSDTTNTTNASNNNNNTSSRPGKMVSVPATVSSLVMDKSNSCGGDSGTKKITTVKRNVGDAGSKGAASPRAQSPARVNGNVGRDKMLNENLQQQHQQQPSLSRNNSSRKVEQSPYRRNPQSEVDHNSSRKAEQSPYSNSKVQQNKPKIEAEAIQKPNGRVALEKGVSVNCKTKEQHEEEESSVPISAVVKTTAVSSGVDNLKPQGLTRSRSSRRSRDLDTNATNSYASLLLEDIQNFHQKNTQQQQQQPSSVSLPACLNKVCSILEAVADLNSTTSSNFTEDKRSPSTQQSNIRNDEYYGKKVAGSNKDPFVESEVAVSDDVMEPSLHKYVTVKRGGGVVVEDMEDQESSGSNSFTVSSSSGQHHWGNNISCSSSWEPNSADSTDCWTSSRLSSREEEAQKTPLGLGCSLSSEAKKKKKGLNSKRRECDHEHSGGIGRGRLGSNKGMFNEVLTFLLFGVAYLQLFLVSARPIQVDLSHLCHVTCAVYEQFVILPKVVVSPQGKTSDFTYSTYINLNQYFSTQKVTPQGKTRDCSNLMTTTPRPLPSY

SEQ ID NO: 218042 - protein, 255 aa, Glycine max
  Coding DNA Sequence Number=SeqID_101264
  Homolog annotation: Hit_ID=Q6H4U3; Match level="QueryCoverage=55%, HitCoverage=67%, E-value=3e-20, Identity=39%"; Hit description=HIN1 -like protein
  Pfam annotation: Domain name=Hin1; Domain location=91-229; Score =179.0; E_value=1.1e-50; Accession=PF07320.4; Description=Harpin -induced protein 1 (Hin1)
MADPQKIHPVHHDVEAQNHPSAPLVPRSMSKSDAGDPQRVVVQQQQQNIPLKQTKPPPKKRRSCCCRFFCWLISILLILIVAIGITVGILYLVFRPKLPKYSVDELRVTHFDLADNNSLSVTFNLTITARNPNKKIGIDYRGGSHISAWYMDTKLCEGSLPKFYQGHRNTTVLSIPLTGKTQDATGLQSTLQNQLQESGNVPLNLKVKQPVRIKLGKLKLFKIKFRVRCKIVVDSLSANSSIRIQSSSCKFRFRL

SEQ ID NO: 218043 - protein, 726 aa, Glycine max
  Coding DNA Sequence Number=SeqID_101265
  Gene Ontology: Mol. function=methyltransferase activity
  Homolog annotation: Hit_ID=Q1SSE9; Match level="QueryCoverage=99%, HitCoverage=46%, E-value=0.0, Identity=75%"; Hit description=N-6 Adenine-specific DNA methylase
ENDTPESAVAKHFASAKMSGTEFPQYGMPSNCLQNLPSEGQMRAMALEVQNLLVSGKKKEALQCAQEGQLWGPALVLASQLGEQFYVDTVKQMALRQLVSGSPLRTLCLLIAGQQAEIFSTDTSNSGHPGASDMSQQSPQVGSNGMLDDWEENLAVITANRTKGDELVIIHLGDCLWKERSEITAAHICYLVAEANFESYSDSARLCLIGADHWKCPRTYASPEAIQRTELYEYSKVVGNSQFTLHPFQPYKLIYAFMLAEVGKVSDSLKYCQALLKSLKTGRAPEVELWRQLAVSLEERIRIYQQGGYAANLAPAKLVGKLLNFFDSTAHRVVGGLPPPAPSSSQGTVHGSEHLYQNMAPRVSSSQSTMSLAPSASMEPISDWTADNNKMAKPNRSISEPDIGRTPRQETTSPDIQGKAQASGGTSRFSRFGFGSQLLQKTVGLVLKPRSGRQAKLGEKNKFYYDEKLKRWVEEGAELPAEEAAALPPPPTTAAFQNGSTEYNLRSALKTESSPPIEGSNIRTASPELSPGMPPIPPSSNQFSARGRLGVRSRYVDTFNQGGGTSANLFQSPSVPSVKPVLAANAKFFVPTPAPSSNERTIEAIVESKQEDNATNEYPSISTTNEWSYQSPKHVSSTTIQRFPSMGNISNQVAADGNNSHLPHSRRTASWSGSFNDSFTPQKMGNIKPLGEALGMPPSRFSPDESLMHKPVKSSSYGEDLHEVEF

SEQ ID NO: 218044 - protein, 179 aa, Glycine max
  Coding DNA Sequence Number=SeqID_101266
  Pfam annotation: Domain name=F-box; Domain location=20-70; Score =24.6; E_value=0.00036; Accession=PF00646.23; Description=F-box domain
MDDTGSTRPRICDGVIDDKPPILSLPSDLLEEIIAKAASKSSIDLVNIKLSCKDFLHASEANNVWKNVSLEDFPSGWYPHQTAIDFLQHCREKGNIDILYRDGVKEFCNYLVANVSGHEKLKYAAECDLKQAKYLYEIILLCSDDNETRQEGMQHLRDLVTNKCFLETKRSVFNFLGNF

SEQ ID NO: 218045 - protein, 383 aa, Glycine max
  Coding DNA Sequence Number=SeqID_101267
  Gene Ontology: Mol. function=transporter activity; Cellular component= membrane; Biological process=transport
  Homolog annotation: Hit_ID=Q7VW01; Match level="QueryCoverage=58%, HitCoverage=39%, E-value=6e-88, Identity=64%"; Hit description =Putative membrane transport protein
IGVLVAAVHPAAVLHGAGAGAAGEVRGLYPGGRVQLPQPAELGARLERRGQQPAGRDRCQSRRHRAIERDQHGRRRSGAGHAGNRRLALRDFGPDPVAAGGLRRRVGGGAQAGGHSVHGVGRVFVRGLVLFPGAGHGRFLAPRQQVGRYAGHGGGAGGDVRLHDPYAPVAARVGVGHFAHAACGPVVGHPADRGRRVRRTGGIPDDHRGVAADAAAGPRHVGVGRVNPAGVRNARGGSVRHGLREDVHDHHAGDDQANADQRGGVQVLPEEQRADDGDQHDAHARPDGVGDADRHLAQRQRQEIERDHVAEHRHHRWHQARKTLGAFQGAGGEDLGDDGDAQVEPLHLRGPSDCRSSTSRAPAPPSRSGASENASTSFFCTSQ

SEQ ID NO: 218046 - protein, 40 aa, Glycine max
  Coding DNA Sequence Number=SeqID_101268
LWEFYGSITGVPEVPEAHLLTKRGRWLPPSSPRRARLLPP

SEQ ID NO: 218047 - protein, 361 aa, Glycine max
  Coding DNA Sequence Number=SeqID_101269
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=95%, HitCoverage=23%, E-value=3e-85, Identity=46%"; Hit description=Chromo
MADNTRMKEVYAELKKNADAITRVSDDLQNHIERLEATNHAQMEKIEVMQSTNDSQFSQLNAVMSQVLQRLQNIPMSSHGASNSQKEQQRSSFQVRSIKLDFPRFDGKNVMDWIFKAEQFFDYYATPDADRLIIASVHLDQDVVPWYQMLQKTEPFSSWQAFTRALELDFGPSAYDCPRATLFKLNQSATVNEYYMQFTALVNRVDGLSAEAILDCFVSGLQEEISMDVKAMEPRTLTKAVALAKLFEEKYTSPPKTKTFSNLARNFTSTTSATQKYPPTNQKNDNPKPNLPPLLPTPSTKPFNLRNQNIKKISPVEIQLRREKNLCYFCDEKFSPAHKCPNRQVMLLQLEETDEDQTDEQ

SEQ ID NO: 218048 - protein, 1462 aa, Glycine max
  Coding DNA Sequence Number=SeqID_101270
  Gene Ontology: Mol. function=methyltransferase activity
  Homolog annotation: Hit_ID=Q1SSE9; Match level="QueryCoverage=94%, HitCoverage=99%, E-value=0.0, Identity=62%"; Hit description=N-6 Adenine-specific DNA methylase
MASNPPFHMEDQTDEDFFDKLVEDDMEPVKSGHDEGDDSDEAKAFANLGINDVDAAESGIEVKGEYGTVESDAGLEQEGNLLPSSSSVGFDNKVGPGEDGIGVGSEVTSASAVGTSDKVSSSEVKEVGWNSFHADLNGGGGFGSYSDFFSELGDQSGDFLGNVYDNLSSEVKPGNEVQNDGSNALSNYVQYHEGQGYDGSLESHTNRLGDGLNASANHVQYQEGETYVASSEEHPNGQDLSSSQYWEDLYPGWKYDHNTGQWYQIDGYIVTSTTQQSSEANTAADLSAASDGKTEISYMQQTAQSVAGTLAESGTTKNVSSWSQVSEGNNGYPEHMIFDPQYPGWYYDTIAQEWRSLETYNSTIQSSSLGLENGHASANTFSPNDNSLYSEYSQTDNYGIQGIDSQPVDGSWSGLYGTNHQQGFDMYTTGSVTTRGDNITSGGNQQINHSYGSSISANKDQQNTSSSFGSVALYNRVNHDLGLANGTFEPQSFGPTGDTVQQFNYSTTKFGEQKVFSNDFTENKKPFSYSPQSIHGEHQYSHAPQVGRSSAGRPSHALDSVQGSISVLNLIEVVTGNMDSLSIGNNTSNYFRALSQQSFPGPLVGGSVGNKELYKWLDERITHCESPDMDYKKGERLRLLLSLLKIGCQHYGKLRSAFGTGTILKENATPESAVAKLFASAKTSGTEFPQYGMPSHCLQNLPSEGQMRAMASEVQNLLVSGKKKEALQCAQEGQLWGPALVLASQLGEQFYVDTVKQMALRQLVAGSPLRTLCLLIAGQPAEVFSTDTSISGHPGASNMAQQSPQVGSNGMLDDWEENLAVITANRTKDDELVIIHLGDCLWKERSEITAAHICYLVAEANFESYSDSARLCLIGADHWKCPRTYASPEAIQRTELYEYSKVVGNSQFTLHPFQPYKLIYAFMLAEVGKVSDSLKYCQALLKSLKTGRAPEVESWKQLALSLEERIRIHQQGGYAANLAPAKLVGKLLNFFDSTAHRVVGSLPPPAPSSSQGTVHGSEQQFKNMAPRVSSSQSTMSLAPSASMEPISEWTADNNRMAKPNRSVSEPDFGRTPRQETMSPDAQGKAQASGGTSRFSRFGFGSQLLQKTVGLVLKPRSGRQAKLGEKNKFYYDEKLKRWVEEGAELPAEEAAALPPPPTTAAFQNGSAEYNLRSALKTESSPPIEGSNIRTSSPELSPGMPPIPPSANQFSARGRLGVRSRYVDTFNQGGGTSANLFQFPSVPSVKPAVAANAKFFVPTPAPSNEQTMEAIAESKQEDSATNECSYQSPKSSTTIQRFPSLGNISNQGATDGNNSHLPHSRRTASWSGSFNDSFTPRKMGNIKPLGESLGMPPSRFLPDESLMRTHVKSSSYGEDLQEHFFGCTEQWYTSDGVLTNRSENNNRHLSPSSLPFPSSFQYFLKSPTPTQPIDVFFFSFNAKGVDSGHHLRIMELVWYNKGQDHLLS

SEQ ID NO: 218049 - protein, 37 aa, Glycine max
  Coding DNA Sequence Number=SeqID_101271
MVDDDALVVIGHSRAVAFTLHQSDVVQEERLGDDDVR

SEQ ID NO: 218050 - protein, 213 aa, Glycine max
  Coding DNA Sequence Number=SeqID_101272
  Gene Ontology: Mol. function=transferase activity, transferring hexosyl groups; Biological process=carbohydrate biosynthetic process
  Homolog annotation: Hit_ID=Q1SPA8; Match level="QueryCoverage=99%, HitCoverage=49%, E-value=3e-88, Identity=67%"; Hit description =Glycosyl transferase, family 8
MDASYYYLKLRWSVPCGPNNVITFPGALWLKPWYGAEMAVILVQSAIYLGVIAMTRLARPSFSKLCYRRSDKSINLVHNSLKLVALWCILAAYVTPFFTIPHTVHPLLGWILYLLGTFALCSIAINVFMLPMLPVLVPWLGIIGALMVMAFPWYPDGVVRALFVFAYAFCSAPFLWASMLRIVQSLQLSLEREAFLPARLGESSPNSWFNKLY

SEQ ID NO: 218051 - protein, 322 aa, Glycine max
  Coding DNA Sequence Number=SeqID_101273
  Gene Ontology: Mol. function=heat shock protein binding; Cellular component=integral to membrane; Biological process=protein folding
  Homolog annotation: Hit_ID=Q8LN96; Match level="QueryCoverage=99%, HitCoverage=53%, E-value=3e-93, Identity=57%"; Hit description =Putative DnaJ domain containing protein
  Pfam annotation: Domain name=DnaJ; Domain location=12-77; Score =111.4; E_value=2.5e-30; Accession=PF00226.21; Description=DnaJ domain
MDEPNEAQDNRELYALLNLSPEASDEEIRRAYRQWAQAYHPDKYQAPHMKDIATENFQRICEAYEILSDPNKRQIYDIYGMEGLTSGLELGPKLNGAEEIKAELERLKRMKEREKMAAHFQPSGTIVANMSLPRYLDGNGMLRGFSSLFSRLIVYFITFMSIRMAMTSEIQSQLSKRNAVTIGGNLAVNGEEGGGAATAVFRHHLSEVSSVEVVASAGLRALIGVQTTRNLSSHSAATMGIALSLKDGSLNLSNLWTRQLSETASGHIELALGPHSSVTVGWQKKDQRRSASGEVKVLLRHQFIILIVFLLNLLAALWEELG

SEQ ID NO: 218052 - protein, 69 aa, Glycine max
  Coding DNA Sequence Number=SeqID_101274
MAKREAHVVTASAIIVLGFVMIDVTKTCEGDQLCKRKGLRLRDDQPKMRGVDCGVRGDKEIFGVECGGD

SEQ ID NO: 218053 - protein, 131 aa, Glycine max
  Coding DNA Sequence Number=SeqID_101275
  Pfam annotation: Domain name=Transposase_23; Domain location=37-107; Score=-11.0; E_value=0.018; Accession=PF03017.5; Description =TNP1ENSPM transposase
MQSQGLTVSPEPEIGSLAASVSIKKGYVDPSWNNPNTGDSEKCRLYVEENPPRLVALGRLYEGSTTVHNVFLCHDQVKVGVEEVRDVDTPIPVPTEEVQLVGQTLNTFIAWLTHLVKLLSKQLWDPTKPTR

SEQ ID NO: 218054 - protein, 125 aa, Glycine max
  Coding DNA Sequence Number=SeqID_101276
  Gene Ontology: Mol. function=heat shock protein binding; Cellular component=integral to membrane; Biological process=protein folding
  Homolog annotation: Hit_ID=Q39079; Match level="QueryCoverage=88%, HitCoverage=20%, E-value=6e-24, Identity=54%"; Hit description =Chaperone protein dnaJ 13
MSALSLLLVCQLRGKHFVMKLFIKPYYLRRNKQKALEEKEKTSAQVKEARATAEKAQNLQQNVANRKRNKQLETGGLVIMRALYGNQRILNNLKSSSETSFELTSEVIDVTIPLNFLVNDSGQLK

SEQ ID NO: 218055 - protein, 114 aa, Glycine max
  Coding DNA Sequence Number=SeqID_101277
  Homolog annotation: Hit_ID=Q1SPB9; Match level="QueryCoverage=94%, HitCoverage=18%, E-value=1e-12, Identity=38%"; Hit description =Transposase
MLMLDQFHLFIHDSIENIVDVKTDGNCGYRAIVALLDIGEDSWSLVRNNLLKELAKWSDEYINLYGGIDKFEELKRSLLVDGLSMVTMDKLMDITDMGYVIASRYNVIMVSLSL

SEQ ID NO: 218056 - protein, 331 aa, Glycine max
  Coding DNA Sequence Number=SeqID_101278
  Gene Ontology: Mol. function=transporter activity; Cellular component= intracellular; Biological process=transport
  Homolog annotation: Hit_ID=Q9FGK6; Match level="QueryCoverage=90%, HitCoverage=75%, E-value=2e-85, Identity=52%"; Hit description =Similarity to phosphatidylinositol/phosphatidylcholine transfer protein
  Pfam annotation: Domain name=CRAL_TRIO; Domain location=42-228; Score= 135.2; E_value=1.8e-37; Accession=PF00650.10; Description=CRALTRIO domain
MAQGFSSGRAFKGLEISVSFNVGLSRIEFNFTEYDEVKKCYPHGYHGVDRYGRPVYIERIGMVDLNKLGQVTTFERFIKHHVSEQEKTLKVRFPACSLAAKRHIASTTSILDVNGVGISNFSKPARYLFMEIQKIDSCYYPETLNQLFIINAGSGFRMLWKAVKTFLDVRTVAKIHVLGFNYLSVLLEAIDSSNLPTFLGGNCTCSDYGGCLMSDRGPWKNPEVLEMIQVVNLREEIDGKSEDGDVDIEDSSMPKKVDMQNKDGNSLSLLEEAACAGSDSACSCRLALQKIDCLEASLGDIKNKIKTLEDVLQDTKMALIEHAQHEERPKM

SEQ ID NO: 218057 - protein, 227 aa, Glycine max
  Coding DNA Sequence Number=SeqID_101279
MEECHYCKAPWEEDWIQGLETRLKQMWLKKGIIHIINLGDHIGRTVRVDRNTLAQERKYVRLCVEADLTKLLLALFELKQRFYKIEYKDSGIMLKAALIKGSQTVGTGNQNSAQGGIERGQGSILNGPWNVVKKPRRQRRGKENPGNGVDVVAAKKTENKFFSLGSRHELLKNSEEYFEGEASGVVPDAMNIMGKMAVKENMEVSIPTEGNHMAQNSVILEENNKET

SEQ ID NO: 218058 - protein, 127 aa, Glycine max
  Coding DNA Sequence Number=SeqID_101280
  Homolog annotation: Hit_ID=Q1T344; Match level="QueryCoverage=59%, HitCoverage=27%, E-value=8e-13, Identity=44%"; Hit description=RNA polymerase, RBP11-like
MSEEVDMNNQNEDEVGVNEEEHARSVVYEIGFVTMIKRKKDFFRRNTSSRKCGCPFKLHGKPVVGRQGWMVKLMCESHNHELAKSLVGHSYAGRLTKDEKTTIVDMTKSMVKPRNNLLTLKEHDANS

SEQ ID NO: 218059 - protein, 245 aa, Glycine max
  Coding DNA Sequence Number=SeqID_101281
  Gene Ontology: Mol. function=RNA-directed DNA polymerase activity; Cellular component=extracellular region; Biological process=RNA -dependent DNA replication
MLAQNILEEDLSSPITRGIFTRKRKFISRLGGIQRKFELNCSYPFLIHLVKKLLNELHEVLYQEELKWFQRSCSKWHQDGDRNTHYCHLKIVDKRRKSRIQMLRGVDGKWIEEENELKTLVNGFYFDLFSDDNPQGIWLQSRYGFATLSDDKIHDLNVIVHEDEMRRTIFEMGPWKALGPYGFPAGFYQNDWSITGKFVCNFIKHLWRHPGEAGSVNCTNICLIPKIDKPEFVSQFHLISLCNTS

SEQ ID NO: 218060 - protein, 76 aa, Glycine max
  Coding DNA Sequence Number=SeqID_101282
MDSKQVRRSDPLRRQWPRLKLKLVRRDLKHNHERPDLQRGGVQHGGGLSGRTFWTFRYKFNTVTDCDDSGGKRSVF

SEQ ID NO: 218061 - protein, 91 aa, Glycine max
  Coding DNA Sequence Number=SeqID_101283
TTKSKRIQEDSEEKEGSLLKDANDVLAEKGQASRKAKVSTDGNPMASKDNEMEVLTPPQATNKMKNVVAKPHLKVGKENPPRKKVISKDSG

SEQ ID NO: 218062 - protein, 156 aa, Glycine max
  Coding DNA Sequence Number=SeqID_101284
MGLLPTVAVPIYGIHYFLQMKKGSGKVTRMGNDAETTSIDHMGLSHGSVVKSVVEFVLLCFCNGGFGNRSKLHDVESRLIQGTSFVVQVEGTSTWVVVTENKRGYISYGSVQVEGTSTRLFKENKGGYIPCGSLLVKDFTRLKRNLKDRRSLGDWM

SEQ ID NO: 218063 - protein, 304 aa, Glycine max
  Coding DNA Sequence Number=SeqID_101285
MDWGVTPLVSLRWCAAMAEATGVEVATMAIDQVVEEDVGLRDDMMKIVDPMISLKKATSWYQCLGFLMKAIWFSFVYMDSDVSNPRMMLNSERVICGFGQGGKMLPCAQREALVDPLHCHHPLNWYLHQRSSTLDNDGLYHRGISPGAPDPQGIESQLEGQASRGAQVPPEDVIVVTMESKPWGLVAEYGIWIKWENKGTTVIVMLITTIVMLITTVVLCRGPQCQSTPTMMLKGRIKYSERNHDHGECDNDRGANEGWDMKGVTTKEIVTTTMVKRKEYARSRHQHLFEENVEKTGKDVIYEL

SEQ ID NO: 218064 - protein, 347 aa, Glycine max
  Coding DNA Sequence Number=SeqID_101286
MATSNSSAIEIIPALEISTIHTDNEPSIHDEHFFDIQELEKVGLKLNETLIFGGARHFFNEPQTIYPKLIRTFWRSVEFVNKKAIVSKVLRIKVLSSDSIAKETGRLREGSTYQEGCEKNYDSYVIRELYKENTEKPSSKMTLSDLHKFVLFHLMENLPFDMPHTIYINILRNLKGLYGLDDIYHATLVNKLLWDKGVYHVFNKMDNDSKHTLVAKGSVVAKQHKFSKTNLKAMKEKEEEELLAREHKTKKRHEQANKSTPVRPATKTLVLQRLKYLSKIAALEGNHQSPCMDKATAYPLGLHISRVTDVKIVADKVEVFNYPRNWISLFNRNKLVRAPDAFDAKTF

SEQ ID NO: 218065 - protein, 116 aa, Glycine max
  Coding DNA Sequence Number=SeqID_101287
  Homolog annotation: Hit_ID=Q1T493; Match level="QueryCoverage=94%, HitCoverage=23%, E-value=4e-07, Identity=28%"; Hit description =Nucleic acid-binding, OB-fold, subgroup
SYPASVSNSFKASKLMINDLVLEIQEFRESLLDLGIEVRSILMPIGQGSSLVLGKSNVSFFKQEFVCVIVAKITTIVMDNYSWCYPACGQCYKKADMQTVLFTCPSGKENDQPVLR

SEQ ID NO: 218066 - protein, 326 aa, Glycine max
  Coding DNA Sequence Number=SeqID_101288
  Gene Ontology: Mol. function=carboxylesterase activity; Cellular component=nucleus; Biological process=metabolic process
  Homolog annotation: Hit_ID=Q0ZPV4; Match level="QueryCoverage=95%, HitCoverage=95%, E-value=1e-132, Identity=74%"; Hit description=CXE carboxylesterase
  Pfam annotation: Domain name=Abhydrolase_3; Domain location=77-300; Score=264.0; E_value=3e-76; Accession=PF07859.3; Description =alphabeta hydrolase fold
MSEISNSKATVVEDCRGVLHVYNDGSIVRSSRPSFNVPINDDGTVLWKDVVFDTALDLQLRLYKPADDSAGSKLPIFIYIHGGGFCIGSRTWPNCQNYCFQLTSRLRAVVVAPDYRLAPENRLPDAIEDGFEALKWLQTQAVSDEPDPWLSHVADFSHVYISGDSAGGNIAHHLAARLGFGSPELDPVRVRGYVLLAPFFGGTIRTKSEAEGPKDAFLNLELIDRLSIPIGETTDHPLVNPFGPYSQSLEAIDFDPILVVAGGSDLLKDRAEDYAKRLKEWGNKDIEYVEFEGQQHGFFTIYPNSEPSNKLMLIIKQFIEKHLGKV

SEQ ID NO: 218067 - protein, 122 aa, Glycine max
  Coding DNA Sequence Number=SeqID_101289
  Gene Ontology: Mol. function=carboxylesterase activity; Biological process=metabolic process
  Homolog annotation: Hit_ID=Q0ZPW1; Match level="QueryCoverage=98%, HitCoverage=46%, E-value=2e-26, Identity=47%"; Hit description=CXE carboxylesterase
  Pfam annotation: Domain name=Abhydrolase_3; Domain location=1-122; Score=-62.9; E_value=0.0013; Accession=PF07859.3; Description =alphabeta hydrolase fold
MFKPIKWLQDQAVSNELDPWLSHVADFSGVFVLGDSAGGNIVHHLAARLGLDLGLPSWHRFGYWRLCLPVGETSYHPLVNPFGPNSKSLEATKLDPILVVAPGSDLLKRQDRGLCKEAQGVG

SEQ ID NO: 218068 - protein, 315 aa, Glycine max
  Coding DNA Sequence Number=SeqID_101290
  Gene Ontology: Mol. function=nucleoside-triphosphatase activity; Cellular component=intracellular; Biological process=defense response
  Homolog annotation: Hit_ID=Q9C587; Match level="QueryCoverage=88%, HitCoverage=28%, E-value=2e-77, Identity=57%"; Hit description =Replication factor C large subunit-like protein
  Pfam annotation: Domain name=AAA; Domain location=138-307; Score= -17.4; E_value=0.0044; Accession=PF00004.19; Description=ATPase family associated with various cellular activities (AAA)
MLHISRSLYRTSFLTEDGLFDMIRASKPAKASSQEDKKLVNKAVAVASQSKVSPKSQVKVPLSSRSPSKQAKPKTATTVQSSSMWTEKYRPKDPKDIIGNQSLVLQLRNWLKAWNEHFLDTGNKKQGKKQNDSGLKKAVLLSGTPGIGKTTSAKLVCQELGFQAIEVEIFLVKFICLEKVNASDSRGKADSKIEKGISGSKTNSVKELVTNEAIGVNMERSKHYKSVLIMDEVDGMSAGDRGGVADLIASIKISKIPIICICNDRYSQKLKSLVNYCLLLSFRKPTKQQVIPFYSPSPLTDGVYNLNNKFFRSRK

SEQ ID NO: 218069 - protein, 71 aa, Glycine max
  Coding DNA Sequence Number=SeqID_101291
MAVNMGASLQAFPPQDPQSQKQLLSFEEPSSCKELGSSSSKCNKIAPFHEAVEHEQPRIPPIRREPSHSIN

SEQ ID NO: 218070 - protein, 88 aa, Glycine max
  Coding DNA Sequence Number=SeqID_101292
MDSPSFLASQLYSSNKHVHLYVRHKYNFLRPEKVSAKDERRHARSMLGPAQHNDEETVVTNASDTEEDIVEMDYAQPHRKPPIHNEKP

SEQ ID NO: 218071 - protein, 352 aa, Glycine max
  Coding DNA Sequence Number=SeqID_101293
  Gene Ontology: Mol. function=L-lactate dehydrogenase activity; Cellular component=cytoplasm; Biological process=tricarboxylic acid cycle intermediate metabolic process
  Homolog annotation: Hit_ID=Q1SP88; Match level="QueryCoverage=99%, HitCoverage=100%, E-value=1e-159, Identity=82%"; Hit description=NAD- binding site; L-lactate/malate dehydrogenase
  Pfam annotation: Domain name=Ldh_1_C; Domain location=182-352; Score =147.2; E_value=4.5e-41; Accession=PF02866.8; Description =lactatemalate dehydrogenase, alphabe
  Pfam annotation: Domain name=Ldh_1_N; Domain location=40-180; Score =234.7; E_value=2.1e-67; Accession=PF00056.13; Description =lactatemalate dehydrogenase, NAD bind
  Pfam module annotation: Pfam domain module=Ldh_1_C::Ldh_1_N; Domain location=182-352::40-180
  Subcellular localization annotation: CTP_CleavageSite=29; ConfidenceScore=5.36e-01
MAMHKSSSGSALGPGGLDLTQAFFKSIMNAAASSPTKRHNKISVVGAGNVGMAIAQTILTQDLTDELVLVDAIPDKLRGEMLDLQHAAAFLPRTRIQASTDYSVTLGSDLCIVTAGARQINGESRLNLLQRNVTLFQKIIPPLARYSPDTILLIVSNPVDVLTYVAWKLSGFPSNRVIGSGTNLDSSRFRFLIADHLDVNAQDVQAFIVGEHGDSSVALWSSISVGGVPVLSFLEKQEIAYEKEMLENIHKEVIQGAYEVINLKGYTSWAIGYSVANLARTILRDQRRVHPVSVLAKGFYGIDDGEVFLSLPAQLGRGGVLGVTNVHLTEEETQRLRDSAKTILQVQNQLVI

SEQ ID NO: 218072 - protein, 377 aa, Glycine max
  Coding DNA Sequence Number=SeqID_101294
  Gene Ontology: Mol. function=ATPase activity, coupled to transmembrane movement of substances; Cellular component=integral to membrane; Biological process=transport
  Homolog annotation: Hit_ID=Q9LHD1; Match level="QueryCoverage=86%, HitCoverage=77%, E-value=2e-87, Identity=39%"; Hit description =Multidrug resistance protein 13
  Pfam annotation: Domain name=ABC_tran; Domain location=223-377; Score= -1.9; E_value=2.5e-07; Accession=PF00005.17; Description=ABC transporter
MSTFLFCHILAFVLSWRLTLAAIPLSVMFIVPALVFGKIMLDLVMKMIESYGIAGGIAEQAISSIRTVYSYVGENQTLTRFSSALQKTMEFGIKQGFAKGLMLGSMGVIYISWGFQAWVGTFLITNKGEKGGHVFVAGFNVLMGGLSILSALPNLTAITEATAAVTRLFEMIDRVPTIDSEDKKGKALSYVRGEIEFQDVYFCYPSRPDTPVLQGFNLTVPAGKSVGLVGGSGSGKSTVIQLFERFYDPVEGVILLDGHKTNRLQLKWLRSQIGLVNQEPVLFATSIKENILFGKEGASMENVISAAKAANAHDFIVKLPDGYETQPNNHNNKLHKQYNTQLRAGEHLSYDSIRDQNQVNIKMARVTLNEYLTSKMN

SEQ ID NO: 218073 - protein, 284 aa, Glycine max
  Coding DNA Sequence Number=SeqID_101295
  Gene Ontology: Mol. function=transporter activity; Cellular component= integral to membrane; Biological process=oligopeptide transport
  Homolog annotation: Hit_ID=Q7XAK5; Match level="QueryCoverage=94%, HitCoverage=44%, E-value=1e-104, Identity=66%"; Hit description =Nitrate transporter
  Pfam annotation: Domain name=PTR2; Domain location=3-200; Score= -25.0; E_value=5.3e-05; Accession=PF00854.12; Description=POT family
MDSSECGGGMKRKWYLCNLTDVEEVKMVLRMLPIWATTIMFWTIHAQMTTFSVAQATTMDRHIGKTFQIPAASMTVFLIGTILLTVPFYDRFIVPVAKKVLKNPHGFTPLQRIGVGLVLSVISMVVGALIEIKRLRYAQSHGLVDKPEAKIPMTVFWLIPQNFIVGAGEAFMYMGQLNFFLRECPKGMKTMSTGLFLSTLSLGFFFSTLLVSIVNKMTAHGRPWLADNLNQGRLYDFYWLLAILSAINVVLYLVCAKWYVYKEKRLADEGIVLEETDDAAFHGH

SEQ ID NO: 218074 - protein, 89 aa, Glycine max
  Coding DNA Sequence Number=SeqID_101296
  Gene Ontology: Biological process=steroid metabolic process
  Homolog annotation: Hit_ID=Q6ZJR8; Match level="QueryCoverage=50%, HitCoverage=6%, E-value=3e-15, Identity=66%"; Hit description =Putative oxysterol binding protein
MVLMSTFYSQGKYKKVVGSLDGSEEKVKMERFDTLVGIGRRESMEDGTGARIYLLCEDADVGILKAVMVQAFCALPVCWCYRNNEQLKG

SEQ ID NO: 218075 - protein, 34 aa, Glycine max
  Coding DNA Sequence Number=SeqID_101297
MTQKNGCQEEAILINKCRAETKKCFQQRPMAMQR

SEQ ID NO: 218076 - protein, 566 aa, Glycine max
  Coding DNA Sequence Number=SeqID_101298
VSEVGSPTLRVDENHETSTDTESMIYDGDIDKDVTSGSEDMWGASLHSREVRRVSEQDISELNSWRDISSPLSMQNIDEENAADVSSMSSRSDMPDDTPTYAMSSDHNNIFGNMKDFGAPQNSHSSVVSERWKQLMRLMDTRDSHLPHDRHSKKPGELFNLSENSCKAQVINNGNNLAASEQDNTHKSRGNEEPAASHSVMQQEVTDGVSINSSSSSSPRSVLSITQKTIANQVPSSGFNPETHQDVQQSNMQDVSQGTLNGEGPPDSIPQNIQPSMDDPNVESHNSDLSHPQGQNFPLENYIQESNMSSKMDDSGVCNKGEENKSKNDKNSGDKLAPLIIPDASAEPHRQAEMIASVDISEESRERFDDNVPLISLILESSLESQGEEEDEESSEASVRQEATTESSINAETTDTSSDEDFERNRSGNEAILSTSLSAGESDKLKETDKPKHSSEEVNYLQSESKQVVEDHMVKEKLDKGDISKESPLPIATEVTNSADTEGECNKMNKNEATDQELNKNETMVITEPAAESDQKGLQLEQVSAPKPYKPNDTSKEVGCFQQEST

SEQ ID NO: 218077 - protein, 477 aa, Glycine max
  Coding DNA Sequence Number=SeqID_101299
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q9SD73; Match level="QueryCoverage=99%, HitCoverage=86%, E-value=1e-141, Identity=59%"; Hit description=Beta- D-glucan exohydrolase-like protein
  Pfam annotation: Domain name=Glyco_hydro_3; Domain location=8-165; Score=34.1; E_value=5.1e-11; Accession=PF00933.12; Description =Glycosyl hydrolase family 3 N terminal domain
  Pfam annotation: Domain name=Glyco_hydro_3_C; Domain location=267 -477; Score=122.1; E_value=1.6e-33; Accession=PF01915.12; Description= Glycosyl hydrolase family 3 C terminal domain
  Pfam module annotation: Pfam domain module=Glyco_hydro_3::Glyco_hydro_ 3_C; Domain location=8-165::267-477
MVDGFQKLALESRLAIPIIYGVDAIHGNSSVYGATRFPHNVGLGATRLGHPPERQPRGYPFVAGRNNVVACGKHFVGDGGTEKGVNEVDCIAKGVSTIMVSYSRWNGNKLHGHHFRLNEVLKEKLGFKGFVISEWEEIDECQPYGSDYRHCISTAINAGIDMVMVPFRFEIFIEELMSLVQLGEIPIAGTDDAVERILRVKFAAELFEFPLTDRSLLDVVGGKSDQTELVSTSSWCLNNNLIQWRIQKFYLVELHRDLARKTVQKSLVLLKNGKDPSKPFLPLNRNAKRVLVAGTHAHDIGYQCGGWIGTKYESSGQITIGTTILDAVKEAVGNETEVIYEQCPSTDIIERSDVSFAIVVVREGPYAECGGDNSELVIPFNGDGIINLVADKIPTLVILISGRPFLSEQCLLEKIDALVAAWLPVTEAQRITDVIFGDHDFKGQLPMTWFRRVEQLDQPVGVSSCDPLFPLDYGLKY

SEQ ID NO: 218078 - protein, 389 aa, Glycine max
  Coding DNA Sequence Number=SeqID_101300
  Homolog annotation: Hit_ID=Q1SD81; Match level="QueryCoverage=35%, HitCoverage=11%, E-value=1e-27, Identity=53%"; Hit description=H+ -transporting two-sector ATPase, alpha/beta subunit, central region; TonB box, N-terminal
MEPTLKETKKGLNARDIQLRILKVLHVSFEISYTFMQRNPLVSGALLVFFILYIFLSFIYNVLVFLSPFFMCTAIFVRIFWSSEQNLLNIVNNEEEKGGEKRDEPKISPEMIRNERRSLLYKCPSYNATSRRRNFTGKKLDVYGGLEIKAKDLSSVFRNEFPRNNNKIGRTKFDKEEIGSLEAPIKQVLFSEPSTMNLVTHVVSSDGLEKRTENKEDEKKVQEGGNKGELTEDEQKNEMDLGTCELERHKRLESLIARRRARKQLKLQIEKGLIDMKSVTPSQIAPLFVSRLNPFDSPREIDGMQMPGSAPSALRSPFDIPYDPFEEKPILTGDSFDQELKGLLIEPRQEDFEAIGHRLAHPRVRRLQGNIDNHFLFSSSFLLLLFTPF

SEQ ID NO: 218079 - protein, 47 aa, Glycine max
  Coding DNA Sequence Number=SeqID_101301
  Homolog annotation: Hit_ID=Q1S622; Match level="QueryCoverage=56%, HitCoverage=17%, E-value=5e-07, Identity=100%"; Hit description =YABBY protein
MTVYLVEKDASIINISLKQHQRRKFKGLRLVIQISATGRLSAQQPKT

SEQ ID NO: 218080 - protein, 93 aa, Glycine max
  Coding DNA Sequence Number=SeqID_101302
  Pfam annotation: Domain name=GRP; Domain location=1-88; Score=-27.5; E_value=0.049; Accession=PF07172.2; Description=Glycine rich protein family
MVTMMLVVVATTLVTVVVVVMVTITMATTLMVVVVAVLVVVVASYGGHNDGDGGNDECGINGGGNGSGKDGGDDDGDNKKVFGYINRGMEHDE

SEQ ID NO: 218081 - protein, 90 aa, Glycine max
  Coding DNA Sequence Number=SeqID_101303
MCKFVAAVRFFAQPLMQKTIWSEELKSVIIFLRVTMPVSMCPVSPSNASSLIQDDCGLYNVTLTRKQATAARKLAVAGTLYSVGHFHWWF

SEQ ID NO: 218082 - protein, 139 aa, Glycine max
  Coding DNA Sequence Number=SeqID_101304
MESSNEKIASKRKVSGKNNEETRSYFTWNLEMERVLADVLRDQRNLGNKGDGGWEKSALNVIATMLSTSFDANVTSENAKNHIKLWRSWYGIVSEIPGHSGFDWDGTKHMITVENENAWNEYCTSHKSAKPFRFKVLQN

SEQ ID NO: 218083 - protein, 136 aa, Glycine max
  Coding DNA Sequence Number=SeqID_101305
MVIFHHGDAAEDKGEQPWKKELHHQESALDKKLREEASMEEKKEREGRSMKLKRGSLNGGKERERERGEHEIEGGKEGEKLSFEHIPRIYQRHLNIFPLDVTRMEGVTLAHGKGICHKNMQKEYSKNMLKASQHIP

SEQ ID NO: 218084 - protein, 45 aa, Glycine max
  Coding DNA Sequence Number=SeqID_101306
MKLRMRCRLSHFIVTLTAKKGMQGMSNHMAGVCMSEHNMQLMTTE

SEQ ID NO: 218085 - protein, 122 aa, Glycine max
  Coding DNA Sequence Number=SeqID_101307
YILLDGVSWDATMIGACGIRIVPSGKWRSAYDIGIGVNSTGFLSRKFLLGLVFVVDWAFSVGRALGKGENQYWPSNYIGAGDIDTWGCEGFVGVLGHVGVAVTAWASPSFFFAPPAPGLLLP

SEQ ID NO: 218086 - protein, 146 aa, Glycine max
  Coding DNA Sequence Number=SeqID_101308
  Gene Ontology: Mol. function=identical protein binding; Cellular component=cellulose and pectin-containing cell wall; Biological process=negative regulation of enzyme activity
  Homolog annotation: Hit_ID=Q1SB16; Match level="QueryCoverage=74%, HitCoverage=13%, E-value=3e-36, Identity=68%"; Hit description =Protease-associated PA; Proteinase inhibitor I9, subtilisin propeptide
MNCYWKCHSSASTTASYFVGNANYRGLASGLARGGAPLAHLAIYKACWDLPIGDCTDVDILKAFDKAIHDGVDVLSVSLGFSIPLFSYVDLCDILAIGSFHATAKGITVVCFAGNSGPSPLKPLQFYFVNQQTDLLIKWYQKYLVT

SEQ ID NO: 218087 - protein, 681 aa, Glycine max
  Coding DNA Sequence Number=SeqID_101309
  Gene Ontology: Mol. function=nucleic acid binding; Cellular component= mitochondrion; Biological process=DNA integration
MTEIEELLLVHEARLNKFHKQMLVDSPSINYTQENIKSFSSHGSDSYTVPNKNLQQSEPESFPNYPGGSSGGGSFNRGGGQSANFHCQVSKIGQTASVENYSSQPQNNFNSGYAQNNTKTNAQSQPNSANWIPDSGASFHVTGESQNIQQIEPFEGPDQFIGNGNVGPDGLYSFSNIQFQNSPSGKLFISNDVLFHESKFPYADLFESAPSLSQPSSSPTHFNFPSTPIIPPVQNNIQDNSSSDQSSPAQTSLPSDQSLSDPNNSVQSAPLAADTNVTQALTDSNWKLAMQQEYDALMKNYTWDLVPLPPDRKAIGCKWIFRDIIKLKPVTIKLILTLAVTNQWKLFQLDVNDAFVNGFLKETVYMSQPPGFKDSNSSLFCKLNMALHRLKQAPRQGFERLQSTLIQFGFVASKCDPSLFIYTVSSHAFPLKQLGQLDYFLGIEIKTLSDNSLLLTQSKYIRDLLQKTNMRQAQAISSPMTSSCKLTKTGSDLFTDPTMYSSVIGALQNLTITRPEISFAVNKVCQFMENPLDAHWAAVKRILRYLKGTVLYGLHLRPAALGQPYFIRALCDADWAFDIDDRRSTSGAAVYFGSNLISWWSGKQKVVARSSTEAEYKSLAQTTAEISRIKTLLTELGVPFRTPVIFCGKLNAMETLSKSQPLEFEGGIRVLYRPAVIQLQS

SEQ ID NO: 218088 - protein, 98 aa, Glycine max
  Coding DNA Sequence Number=SeqID_101310
MSEKPKSRSTNFENKKVRELFLHTRKLRLKRSVKTLLKQRKRIPKVDEMKMKTYKASVEAMISKIILMMPKNQELSRFQRIRNQKASRIKFQRIKIQE

SEQ ID NO: 218089 - protein, 68 aa, Glycine max
  Coding DNA Sequence Number=SeqID_101311
MESFVECQRQENKKSCLLSVAAPTHVPQPPPILASLDPPPSPPPSSPPPSQPPRLLDFRQVHRITQVV

SEQ ID NO: 218090 - protein, 43 aa, Glycine max
  Coding DNA Sequence Number=SeqID_101312
MAEPSKKRKGTSSRSQRHSGSQETPIPSSIPSGSLFSSEEQRI

SEQ ID NO: 218091 - protein, 264 aa, Glycine max
  Coding DNA Sequence Number=SeqID_101313
  Gene Ontology: Mol. function=transcription regulator activity; Cellular component=nucleus; Biological process=regulation of transcription
  Homolog annotation: Hit_ID=Q00M80; Match level="QueryCoverage=99%, HitCoverage=100%, E-value=1e-133, Identity=89%"; Hit description =BHelix-loop-helix transcription factor
  Pfam annotation: Domain name=HLH; Domain location=153-200; Score =27.8; E_value=3.7e-05; Accession=PF00010.16; Description=Helix-loop -helix DNA-binding domain
MEQLKPEEYQMDVMTMMLQQLPQLSEPYTHTMEGFHPPEDHFYGNNTMPLADLIDNNNPHSSMPWSSSYSFTHLPSSTISFSNNNPIMLQEQQQHSPSETYEDANANPYGGEKRSSMAAMREMIFRMAAMQPIHIDPESVKQPKRRNVKISKDPQSVAARHRRERISERIRILQRLVPGGTKMDTASMLDEAIHYVKFLKTQVQSLQRASSANNNIRPLGTSTVNATGIGFPVAMSTTSNSTPYFPLPKPYQARHMENMHDRYD

SEQ ID NO: 218092 - protein, 170 aa, Glycine max
  Coding DNA Sequence Number=SeqID_101314
MDVRINISNFLNTGLDMIIPERDVLDYCRTLINSSKGNQMSSLQICGASHLPLHVSSNVRWRINVPSSSSLPCARAHFVEAKLHGESKVIQRCFDDNNDHDKDDDKKLKDQSKNNSRETRTIQEFKNQEEFKTQRRKPRIKIQGSRSQESRSRFKTQDSRMKKILNLDKY

SEQ ID NO: 218093 - protein, 200 aa, Glycine max
  Coding DNA Sequence Number=SeqID_101315
  Homolog annotation: Hit_ID=Q1RZJ4; Match level="QueryCoverage=86%, HitCoverage=4%, E-value=4e-44, Identity=46%"; Hit description =Aldo/keto reductase; Sigma-54 factor, interaction region
MTWIELLERHANEPSNSLHFVGLCIKLILFNNSIHEDGIHIIEKLKEMHQILSRRFEHEKHKLQLNTGSKDLSAFAENSAAYCSFTPIMLCEKFVFEAWQDTFLTVDYTSLFWDMKLLQKLTSIHLDDLEELHQGQGGRGWCCDALNLKIESFILEMWFKWHESIWVYFPKSAKIDGSDEIELPYMLIEPFSALVVFQMT

SEQ ID NO: 218094 - protein, 69 aa, Glycine max
  Coding DNA Sequence Number=SeqID_101316
  Subcellular localization annotation: CTP_CleavageSite=42; ConfidenceScore=5.09e-01
MEDLKKVILKTIFGHKICQSAQVGVLAMFNMCMSRPQFGILLMSTVKEMMNLQREVKRRRLRRTQTGPW

SEQ ID NO: 218095 - protein, 647 aa, Glycine max
  Coding DNA Sequence Number=SeqID_101317
  Homolog annotation: Hit_ID=Q00M79; Match level="QueryCoverage=99%, HitCoverage=78%, E-value=0.0, Identity=94%"; Hit description =Expressed protein-like protein
MKVLRKELCKLHEKLEQQKKILLETIANRKKFLTSLPSHLKSLKKASLPVQNQLGLHHTKRLKQHHSAELLPPALYVIYSQLLAQKEAFGEPIDLEIIGSLKDAQAFARQQAHKDTDISTTVESSKLEDDAPDEEEDGQRRRKRPRRVQAKESLDQGGIYQVHPLKIIIHVYEDEASGPKSAKLITLRFEYLVKLNVVCVGIEGSNDAPENDLLCNLFPNDTGLELPHQSAKLFVQDAITFNTQRTSRPYRWAQHLAGIDFLPEMSPLLLTDNSGAAKNENVISGLSLYRQQNRVPTVLQRIRARRKAQLALLEQLESLTKLEWPRLPCKSVPWALHTPLCNLDSWSPVKLPPVPRESSSPAVIDKEEHIQEAMDADVIERSGATKAEPESITEDGELPTLLPKVSKLGLSAQLNLISKSIVPPLNKIRSQSFKKIDDSSDFLLDTESDLDEPAQIEQEHEKSNYHARKSVSWMNYGLKEFHLVICRKIGTDESNLNLEAKIQISMEYPLRPPLFLLSISCISSGENHDETGLEWYNELRAMEAEVNLHLLKMLTVNQKNFVLAHQVSCLAMLFDYYLDEASPSSERTNCTSVVDVGLCKPVSEGRIKLILCEDTPPNCPKQECSALEVTNGCYGIWYRKDNDVVPL

SEQ ID NO: 218096 - protein, 57 aa, Glycine max
  Coding DNA Sequence Number=SeqID_101318
  Homolog annotation: Hit_ID=Q00M76; Match level="QueryCoverage=72%, HitCoverage=16%, E-value=5e-16, Identity=97%"; Hit description =Aromatic-rich family protein
MAGNGGSDASASIEFPTALARPNQLTHATFARCQGAKGLRARTADWDPECETLGFQK

SEQ ID NO: 218097 - protein, 159 aa, Glycine max
  Coding DNA Sequence Number=SeqID_101319
  Homolog annotation: Hit_ID=Q00M77; Match level="QueryCoverage=78%, HitCoverage=62%, E-value=1e-36, Identity=66%"; Hit description =Defective chloroplast and leaves protein
  Subcellular localization annotation: CTP_CleavageSite=45; ConfidenceScore=5.34e-01
MALASLLPKTAPHVLSLTNPSASTPFILPFSFHCLPHPPLLSALKASSSGGDDLRGKPLLSQGIGKGILEEHAFEDDDDDKWVDWEDQILEDTVPLVGFVRMILHSGHDVEWPLAAREATIVEQLTVVAVVDQIAAVVHQIAAVVDEIAALCVDSKNPL

SEQ ID NO: 218098 - protein, 1003 aa, Glycine max
  Coding DNA Sequence Number=SeqID_101320
  Gene Ontology: Mol. function=DNA binding; Cellular component=beta -galactosidase complex; Biological process=DNA integration
  Homolog annotation: Hit_ID=Q1SNS9; Match level="QueryCoverage=73%, HitCoverage=85%, E-value=0.0, Identity=78%"; Hit description =Integrase, catalytic region
  Pfam annotation: Domain name=rve; Domain location=205-332; Score =30.1; E_value=7.8e-06; Accession=PF00665.16; Description=Integrase core domain
  Pfam module annotation: Pfam domain module=RVT_2::rve; Domain location=522-764::205-332
PIAFAVKSGRTSSWEKKPNTGSEKPCSHCKRDGHDIDSCFQLVGYPDWWGDRPRSVGRALGRGKHVHRPMSGALKGRGNNAKVNMTQVVDDTEVMKYEDDQVLPGLSSKQWNALLNAINTQKGGTSTRLTGENSWIIDTGASHHMTSTLACMNDVRDIEPCPIGMPNGTRTYATKEGMVTVGDKLMLKHVLFVPNLNCNLISISQLLHDADYIVHFTKTMCVIQDRTSRMMIGAGEQSEGLYVLSVVTPVRAYQANGIRFCVLHQTSIHYTPQQNGRVERKHRHILNVARALRFQANLPLKFWGECILTAAYLINRTPSALLDGKTPYEVLFDAKPAYTQIRTFGCYPYGKKGWEMYDIETEEYFVSQNVNFVEDIFPFSSNGKVSETHVDEWGWPLDPIDECEERNETRNVVTTNDLGAVVVGNDVQDIENHEEVHVMEQQTETIEDVDQGERLDSQQSIRSDELIGRGHRIKNPSTRLKDHVTHTATVSLSTSSPLHSKSSGYEPNCFAEAVKDEKWRNAMKEEIQALEDNGTWTTEDLPLGKKAIGCKWIYKIKYNSDGSIERHKARLVIHGNRQVEGVDYNETFAPTTKMVTVRTFLAIAAAKNFQLHQMDVRNAFLHGDLEEEVYMKLPPGFEKKSLGKAPRCWFAKFSDALKTYGFEQSYSDYSLFMLRRRNTELYVLVYVDDIVISGNQSDAIHKFRDYLGHCFHMKDLGKLKYFLGIEVARNATGIFLSQRKYALDLISDCRLLGAKPATIPIEQNHQLALVEGEGIKDPTGYRSLIGRLIYLTITHPELSYCVHILAQFMQASKIEHWNAALRVVRYLKGNPGQGILLRTDCDLRLYGYCDTDWAGCPLTRRSLTAYFVMLGSSPISWKTKKQTTVSRSSAEAEYRSMAAATCELKWLKGLLSSLGVEHTDPMQLYCDNQSALHIANNPVLHERTKHIEVDCHFVRDEIVKGSIQPLYVHTSKQLADILTKALGKRQFDSLLSKLGVLHLHAPT

SEQ ID NO: 218099 - protein, 36 aa, Glycine max
  Coding DNA Sequence Number=SeqID_101321
MMRQNFAGPPVSHALNQVNGKVPVAGFPRAFSLTHN

SEQ ID NO: 218100 - protein, 222 aa, Glycine max
  Coding DNA Sequence Number=SeqID_101322
  Gene Ontology: Mol. function=nucleic acid binding; Cellular component= beta-galactosidase complex; Biological process=DNA integration
MAEKKDDGNKINDESNKDESGSHLKKQISPYDLYSSDNPGNIITQHDESFDSLTDRLKKPDDAAPEIDDWWTVNSMIVSWIFNTIEPKLRSTITYRENAQELWDDIKQRFSISNGPRIQQLKSELANCKQNGDSIVTYFGRLKKLWDELNDFDQIPMCTCNGCKCGISAALNKKREEEKLHQFLMDLDDTQFRTVRSNVLSLDPLPNLNRAYQMVVQEERVG

SEQ ID NO: 218101 - protein, 212 aa, Glycine max
  Coding DNA Sequence Number=SeqID_101323
  Gene Ontology: Mol. function=protein disulfide oxidoreductase activity; Biological process=cell redox homeostasis
  Homolog annotation: Hit_ID=Q6YTI3; Match level="QueryCoverage=60%, HitCoverage=59%, E-value=2e-51, Identity=72%"; Hit description =Thioredoxin-like protein
  Pfam annotation: Domain name=Thioredoxin; Domain location=90-202; Score=40.1; E_value=7.7e-09; Accession=PF00085.10; Description =Thioredoxin
MPPVIIPGQNSKSFVSVRLDIQKQVECRISRAVFSLVPRHIHGKLCFGGTKVEPLVKIRHTFCPSRIRVAEEYQEGLSDEDDDLCPVECVREFTTDEEFSKILDKAKETGSLVVVDFFRTSCGSCKYIEQGFAKLCKKSGDHEAPVIFLKHNVMDEYDEQSEVADRLRIRAVPLFHFYKDGVLLEAFPTRDKDRILAAILKYSSLEAEDILG

SEQ ID NO: 218102 - protein, 135 aa, Glycine max
  Coding DNA Sequence Number=SeqID_101324
  Subcellular localization annotation: CTP_CleavageSite=27; ConfidenceScore=5.21e-01
PAKLLRSAVRQFSILQFFRSPMNLLPGAVHVSSTIESGAPRIWSPEKLLRSTVRQFSILHFFRSPMNLLPSAVHVSSTFESGAPRIWSPAKLLRSAVRQFSILHFFRSPMNLLPSAVHVSSTIESGAPPKLLHSA

SEQ ID NO: 218103 - protein, 148 aa, Glycine max
  Coding DNA Sequence Number=SeqID_101325
MALVEIPGVVAMVVVVVAVLVVITNGDNKDGIDSSDGSSNDGGNISGDGGDNNVGSGGWGSSGNNDDNNDSNVGYDGGDSDYGASDNDDGGDDDGSSAGIGHQRWKCGGGSYDDNDGGDIRGGDNDSATGGVGSSGEGDTGSTGDKKK

SEQ ID NO: 218104 - protein, 572 aa, Glycine max
  Coding DNA Sequence Number=SeqID_101326
  Gene Ontology: Mol. function=tRNA methyltransferase activity; Cellular component=nuclear envelope; Biological process=tRNA processing
  Homolog annotation: Hit_ID=O04394; Match level="QueryCoverage=99%, HitCoverage=87%, E-value=0.0, Identity=72%"; Hit description=Dem protein
  Pfam annotation: Domain name=VID27; Domain location=1-552; Score= -439.1; E_value=4.2e-08; Accession=PF08553.1; Description=VID27 cytoplasmic protein
STPAVNNAVKLYVHIGGNTPKAKWVTSEKLTSYSFVKTHSDTDTDDENNDSDNDNDDYVETNEKPFWVLKVGSKIRSKVGPEMGLKSFPEQRRVDFVARGVWAMKFFTDQDQIDFIDSFQKCLFENTHGVEATEANKLKVYGKDFVAWAKPEAADDSMWEDAEEVFTKSPTPVRSNQDLKEEFEEASNGGIQSLALGALDNSFLVSDNGIQVVKNFAHGIHGKGAFVNFSDGYQNGGGGSTYCTPKKTLLMRAETNMLLMSPMGGGKLHSTGLHQLDIETGKVVSEWMFGKDGTEITMRDITNDSKGAQLDPSGSTFLGLDDNRLCRWDMRDRNGMVQNLADSNAPVLNWAQGHQFSRGTNFQCFATTGDGSIVVGSLDGKIRLYSVNTMRQAKTAFPGLGSPVTHVDVTFDGKWIVGTTDSYLILICTLFTDKNGTTKTGFAGRMGNRIAAPRLLKLNPLDSHLAGANNKFRNAQFSWVTENGKQERHIVATVGKFSVIWNFQQVKDGSHECYRNQQGLKSCFCYKIVLRDDSIVESRFMHDKFAVTDSPEAPLVIATPMKVSSFSISSKR

SEQ ID NO: 218105 - protein, 599 aa, Glycine max
  Coding DNA Sequence Number=SeqID_101327
  Gene Ontology: Mol. function=transferase activity, transferring hexosyl groups; Biological process=carbohydrate biosynthetic process
  Homolog annotation: Hit_ID=Q1RYE8; Match level="QueryCoverage=93%, HitCoverage=100%, E-value=0.0, Identity=63%"; Hit description =Glycosyl transferase, family 8
  Pfam annotation: Domain name=Glyco_transf_8; Domain location=307-518; Score=217.3; E_value=3.4e-62; Accession=PF01501.10; Description =Glycosyl transferase family 8
MESTTLVSHIVPTFTWSDNRPWIHLVSPLYSGIVDNTAQGMQGSSLKKMLKTMPSKASITRINLVFLVVFLVVYATVLPHPSSDYLQDAGSIVRCSLGECHHRVRHENFKMKAALDEPQANPQRQKNKSAKKIEVPSFFSKLGERMKIGMVNMKENDVSNWSTHGERTSVYFERVSQFLNWTDLFPEWIDEEEENDVPSCPEIPMPEYAEYGSMDVIVAKLPCRYPEEGWKRDVFRVDQMLELFPCDNLVKGEGEWWYYEPEVKRLEHKCTAKITELKFAVVDEVYELSKIEKSVESRRRIKREAYATVLHSSEAYVCGAITLAQSLLQTGTKRDLILLIDKFISVRKREALSEAGWKIRIITRIRNPKAEKGSYNEYNYSKFRLWQLTDYDKVIFIDSDIIVLRNLDILFHFPQITATGNDQSIFNSGIMVIEPSKCTFRTLMRHRDDVVSYNGGDQGFLNEVFVWWHRLPRRVNFLKNFWANTTVEARAKNALFAAEPAEVYAIHYLGWKPWHCYRDYDCNWDTPEQRVYASDVAHRRWWKVHDAMEEGLQRLCRLTKRRRSELNWERRKASKMRLPDGHWKINITDPRRFASLFMD

SEQ ID NO: 218106 - protein, 973 aa, Glycine max
  Coding DNA Sequence Number=SeqID_101328
  Gene Ontology: Mol. function=actin binding; Cellular component =membrane; Biological process=signal transduction
  Homolog annotation: Hit_ID=Q1RYE3; Match level="QueryCoverage=99%, HitCoverage=100%, E-value=0.0, Identity=47%"; Hit description=IMP dehydrogenase/GMP reductase
  Pfam annotation: Domain name=DUF827; Domain location=329-856; Score =788.4; E_value=4.1e-234; Accession=PF05701.2; Description=Plant protein of unknown function (DUF827)
  Pfam annotation: Domain name=Prefoldin_2; Domain location=463-564; Score=-3.0; E_value=0.028; Accession=PF01920.10; Description =Prefoldin subunit
  Pfam annotation: Domain name=Tektin; Domain location=440-786; Score= -206.1; E_value=0.1; Accession=PF03148.5; Description=Tektin family
  Pfam module annotation: Pfam domain module=DUF827::Prefoldin _2::Tektin; Domain location=329-856::463-564::440-786
MEDVEDKIPPVTSSKITEETTLAEHVGDKLPSESSPKIAEETPLAELVGDRLPSEASPKIAEETPLAEHVGDKLPSQFSSDIVEDTPLAEHAGDKLPSEFSSEIVEETPLAEHVGDNQPSASSSKIDEETPPAEHVTDNSESSSKTAEESPLAEHVVDKLPSESTTKIADEMPLADPPEENTEVINPPGNQSSTEAPTIPLSNGKMEPGTHLPVDEFSELAVLPNASDDQTLIQDVAVDVTEKSQQVTSAEDSEPGAVENVSDRHELQDDISNITADSDADNEIRLSASSSETKDSQSDHNELTMAMGTVGSLPRAKLFDAKRGLIDTTAPFESVKEAVSKFGGIVDWKAHRIHTVERRTLVEQELEKAQEEIPEYKKQAETAEQEKGQVLKELDSTKRLIEELKLNLERAHTEERQARQDSELAKLRVEEMEQGIADESSVAAKAQLEVAKARYTAAVSDLIAVKEELEALHKEYTSLVTDRDVAIKKAEEAVTASKEVEKSVEDLTVELIAAKESLETTHAAHLEAEEQRIGTVMARDQDSLNWEKELKQAEEELQRLNQQISSAKELKSKLETASALLIDLKAELTAYMESKLKQEGGPEEPEIKTHTDIREAVASAGKELEEVNLNIEKATAEISILKVAATSLKLELEQEKATLASIRQREGMASVAVASLEAELEKTRSEIALVQMKEKEAKEKMTELPKKLQLTAEETNQANLLAQAAREELQKVKAEAEQAKAGVSTLESRLLAAQKEIEAAKASENLAIAAIKALQESESTRSKNEVDPSNGVTLSLEEYYELSKRAHEAEERANMRVAAANSEIDKVKESELKAFEKLDEVNREIAARRESLKLAMEKAEKAKEGKLGVEQELRKWRAESEQRRKAGESGQGVINQSKSPRGSFEGKANNFDRTSDAANPAHYLTSPKANEHADNDEGGSSPESKHGKKKKKSIFPRVLMFFARRKTHSTKSG

SEQ ID NO: 218107 - protein, 48 aa, Glycine max
  Coding DNA Sequence Number=SeqID_101329
MENWRTALRNNFAGLQTRREWTIGEQRYAITSRGSKLEGGGHMNSARQ

SEQ ID NO: 218108 - protein, 204 aa, Glycine max
  Coding DNA Sequence Number=SeqID_101330
  Homolog annotation: Hit_ID=Q9FGQ4; Match level="QueryCoverage=28%, HitCoverage=35%, E-value=1e-16, Identity=69%"; Hit description =Arabidopsis thaliana genomic DNA, chromosome 3, TAC clone:K5K13
MALCSVFLNLHLWLFVCLTIEALGVPKPSVASYLSQELLAEQEVDRVHGLLAQPPVKLNNMLVISLSMKLKEEICSIGFSRPPINRNKNPFSYGSMEVYWDLLYCRSKGDTLLFCNGLFSHSGVLQMTMYVSTITLSHSLEGNAGELTNFEVLDFLRAKGASKDPTRVIAKVAQSEYKVHDYLVDTATSVQTRESINEFLTSVT

SEQ ID NO: 218109 - protein, 135 aa, Glycine max
  Coding DNA Sequence Number=SeqID_101331
MRIPNDCSFDTLKCKMHKTLQLTNDQLGDEIYYRQPFIDAELLYTINRTPDAILNLLQSTITPTHDAIMYYNGKWNISRQGGILGYSFTGTNSIRFGIPSGCSMDKLMDLIKQVAPIGVPPCGIHGSQLVRRLFF

SEQ ID NO: 218110 - protein, 82 aa, Glycine max
  Coding DNA Sequence Number=SeqID_101332
HPVDPEKSNRVRGFPALITGLCQFYGVPITPNKGETPQQPGDGREQAIDTSLPPLEPLSSSTKAGALPTTRGRPAGDQVQSQ

SEQ ID NO: 218111 - protein, 39 aa, Glycine max
  Coding DNA Sequence Number=SeqID_101333
MACSKRSGTNSGPQQHGLKDEFHVTVALQDLEKKPDSGD

SEQ ID NO: 218112 - protein, 273 aa, Glycine max
  Coding DNA Sequence Number=SeqID_101334
  Gene Ontology: Mol. function=oxidoreductase activity; Cellular component=cytosol; Biological process=metabolic process
  Homolog annotation: Hit_ID=Q2HVK6; Match level="QueryCoverage=97%, HitCoverage=97%, E-value=3e-80, Identity=53%"; Hit description=Short- chain dehydrogenase/reductase SDR
  Pfam annotation: Domain name=KR; Domain location=10-157; Score=-88.7; E_value=0.032; Accession=PF08659.1; Description=KR domain
  Pfam annotation: Domain name=adh_short; Domain location=7-159; Score =10.6; E_value=1.1e-06; Accession=PF00106.15; Description=short chain dehydrogenase
  Pfam module annotation: Pfam domain module=KR::adh_short; Domain location=10-157::7-159
MGETTERYAVVTGANKGIGLEIVRQLASAGIKVVLTARNEERGIQALQTLKDSGLSHLVLFHQVDVADATSVASLADFIKSKFGKLDILAAPEDGTKAITQSYELAKECLQINYYGAKTTVESLLPLLQLSDSPRIVNVSSTMGQLESLPKGSWAREVFSDANIITEEKVDEILKKFLRDFQEGSLESNGWPRHLGAYIVSKAAMNAYTRILAKKYPSFCINSVCPGYVKTDITSNTGLLTVEEGAASPVRLALLPNGSPSGLFYYRSDVASF

SEQ ID NO: 218113 - protein, 676 aa, Glycine max
  Coding DNA Sequence Number=SeqID_101335
  Gene Ontology: Mol. function=phosphatidate phosphatase activity; Cellular component=nucleus; Biological process=lipid biosynthetic process
  Homolog annotation: Hit_ID=Q2R178; Match level="QueryCoverage=59%, HitCoverage=22%, E-value=1e-103, Identity=52%"; Hit description =Lipin, N-terminal conserved region family protein, expressed
  Pfam annotation: Domain name=LNS2; Domain location=427-661; Score =160.0; E_value=6.1e-45; Accession=PF08235.3; Description=LNS2 (LipinNed1Smp2)
DTEAEEVIENADLESHSRIQQTDSSDSDDIRYNEVVVEEQPTSPKSQTVKMGLGHYSNEKVEPNCIIKPSSYSILADQALDDNNMKDKDVSSTLSSPLDSVDDSLPRKASRRSSSPSSEDENFLFSGHDKSVINDRFERSFSPEHVDKEDHVSYGNDSEKLTAISNPIDIPMNKAAGEEVVQFSGSLPNISSGSDIMVEHNVRYPLCQSLDSKSTSLPWAFPGKDDLECLKSDEDKGNQLSHEGQGAKDYNDSGELKGTVLYLPLGMVADCTSKAFNAEYLVGMVSFESPYIFKLKGMIPADQVEKNHTGDPSTRNPSAGGSWRIWPFSLRREGSRKSMLPPSPSDSKNTTFVNSPENTISTDMNKNELKPNLMKKKVKEMTPTSEQLASLNLKDGMNTVTFTFSTAVLGKQQVDCRIYLWKWNARIVISDVDGTITRPSPGAAVKLCLGDLLVMGSNSEIASLHMQGSDVLGQFMPLVGIDWSQTGVAHLFSAIKENGYQLLFLSARSISQAYITRQFLLNLKQVMDGKVLPDGPVVISPDGLFPSLYREGSSLCEGMGEGCCTQPYPCICKEAVSGFEPMTNKSPRHNFTAAPGLALIIRRVPHEFKIACLEDIKALFPSDSSPFYAGFGNRDTDEISYLKGEVVINRRVDAKSYTSLHALVNGMFPPTSSSEQ

SEQ ID NO: 218114 - protein, 296 aa, Glycine max
  Coding DNA Sequence Number=SeqID_101336
  Gene Ontology: Mol. function=protein binding
  Homolog annotation: Hit_ID=Q9FMZ0; Match level="QueryCoverage=97%, HitCoverage=97%, E-value=2e-25, Identity=32%"; Hit description =Arabidopsis thaliana genomic DNA, chromosome 5, P1 clone:MJB21
METHHQPQKNKENDVQKITEEGVAIAKPPSPSSSPSHEFSFTISLHSSNTTIHDKSKTPPSLEVDLSPADDIFFHGHLLPLHLLSHFSSSPRFSTNSVDSFTLPIREFLEDEKRNSCNSCNSSNITIDSITNSNNIEDHNNRVTKEGSKSKPSFSLFGLSKGRKGCQVRDKEDKEDNIKHKKKLGYDVMHALKKYLRMVQPLVLFGGRREKGRFHGQAYSHSGNLIRKNKPELRGRRGEYSAPASMRTSPTNSGLLLATAALPPANDSTMEELQAAIQAAIAHCKNSIAKEEKLSC

SEQ ID NO: 218115 - protein, 177 aa, Glycine max
  Coding DNA Sequence Number=SeqID_101337
  Gene Ontology: Mol. function=DNA binding; Biological process =regulation of transcription, DNA-dependent
  Homolog annotation: Hit_ID=Q69V36; Match level="QueryCoverage=49%, HitCoverage=53%, E-value=3e-22, Identity=46%"; Hit description =Transcriptional factor B3-like
  Pfam annotation: Domain name=B3; Domain location=83-170; Score=55.1; E_value=2.3e-13; Accession=PF02362.12; Description=B3 DNA binding domain
MVSEEVTMRILRGEEGRVGKDREKEKEKEAVPDSHVTLGGLEANDRGVKGSFGCASERGLGMTDECGLETTLEKHETYDKHRDYANRVYASDEGLPVHFCNSLPKKDEVVTLVDEDGIEYSTIYLAGKTGLSGGWRGFAIAHDLTDGDALIFQLIKRTTFKVYIVRADCPPEDKQLE

SEQ ID NO: 218116 - protein, 80 aa, Glycine max
  Coding DNA Sequence Number=SeqID_101338
MSGLESEHPAFIKSMLQSHISGGFWLINEYVHTKERQKGGEFLVPKPLISENNENKLVIKILSGSIGQNTQGLGYRIRYS

SEQ ID NO: 218117 - protein, 252 aa, Glycine max
  Coding DNA Sequence Number=SeqID_101339
  Subcellular localization annotation: CTP_CleavageSite=68; ConfidenceScore=5.51e-01
MFMTEAIPSRSTSTSSDTKQRCCSDSTFSGTNLGRKLRGNMPRNQIGLQVMRLAAEHEGTPSQVMAVSQSREGEDRRKGESKSEVPQREREWMTYIPGTTTKANFYDSYSKTVTRTLSTSLKSLLLLPSRRASASLSPSAVPLAVCHTSIVPRCHRGRLPGFFGGSSSLGSSIVHLGFLQSDIDGKRDVNRLMPENFEQNGLRRNREEVHESRSGSDNMDGGSGDDFDAADNPPRKKCYHRHTHKLIQELEL

SEQ ID NO: 218118 - protein, 46 aa, Glycine max
  Coding DNA Sequence Number=SeqID_101340
  Subcellular localization annotation: CTP_CleavageSite=12; ConfidenceScore=5.06e-01
MATPRIIKWHCNCSSVVSPQSTVAFPLPNVLRHFRTRFSLILAAKN

SEQ ID NO: 218119 - protein, 104 aa, Glycine max
  Coding DNA Sequence Number=SeqID_101341
MWSAENQKVIVLMDVLCLGLQEKNERQNFYKERQKLKKNSEFEHRGSAVVMIAHFHPMKEESEKAAYYSGRITFAKIFKAYAASIITSFLNPLPQRLLLMSYDF

SEQ ID NO: 218120 - protein, 210 aa, Glycine max
  Coding DNA Sequence Number=SeqID_101342
MARGKWVCSYKKTTLLVCFFNIAVALYALHSLYSSLYIYSGNVSRNVALYSPDQIRKMELSIQIRGEFKPVELIKWALEGEFSSETVAVELPRHLKQNIIDEILQRLRSLNFSRTDIAKERGVYKVLGSPTTTTNFCGVALQDFDQLELEPFAMSLSCKLAARACWDVRIQLQGMGLELHIGSMGILVRSLYKALGSPTTTTSLCGVALL

SEQ ID NO: 218121 - protein, 292 aa, Glycine max
  Coding DNA Sequence Number=SeqID_101343
  Gene Ontology: Cellular component=membrane
  Homolog annotation: Hit_ID=Q1SRU7; Match level="QueryCoverage=78%, HitCoverage=42%, E-value=6e-35, Identity=37%"; Hit description =Exostosin-like
MAYWHFIFCDLNISASEAPSISELVNNVTLFNPANSAGDQALEIANKTMSGENDTIPRTGFVLEPGSTPNNVSGINRSENVSETQLVGDPGPSSFNNTIGLSFSTNHSQEDNLASLEHKSGSPYASSTNISTNIVTAVLSNDSSISLFQKDNTTNSIKEDSSVRPSWFSAVDQELLQARSEIEKAPIVKKDPNFYAHIYHNVSMFKRSYELKEKTLKVYVYSEGARPIMHSPFFTGLYASEGCFMKQMEANKRFVTRDPNKATLFYLPFSSQMLEETLTGVADHFVVGCHDR

SEQ ID NO: 218122 - protein, 248 aa, Glycine max
  Coding DNA Sequence Number=SeqID_101344
  Pfam annotation: Domain name=Transposase_23; Domain location=158-229; Score=-14.7; E_value=0.046; Accession=PF03017.5; Description =TNP1ENSPM transposase
  Subcellular localization annotation: CTP_CleavageSite=38; ConfidenceScore=5.42e-01
MDTSPISPPPPDSATHSTSTLKRTRKVTWLRSLATRPVGMEKPQVHVDPATGKVNGPHRKKLSTYLGIIAHDKAEFDTPEASDLRTKKKILKNMGEWWKQFKSDWTSKCALANDKEGVDDTMQSQRLVLPPEPKVGPSDACVSIKESYVDPSGHDQDTGDSKKCGLYVDENPPRLVALGRFYEWSTTVHNIPLGNDQVKVSVEEVRDVDAHFPIPTQEEKRGVEGSVKLADRSDLDVNPLYLMTLTIP

SEQ ID NO: 218123 - protein, 206 aa, Glycine max
  Coding DNA Sequence Number=SeqID_101345
MGVFYHEEPPNHPKRCKYLVATLKEVFSRCQTFAARLSTSSFEDECPVSDFDEKQELFISAVISRNMEKQKHKPSVLRHSFSWVYSPATKELYFTQAVAPEEKVVKGDEESGEGEEFLSVKSCFSRCSSSPSGEAFYSVKTNLSRCSSLNELDLSKYWRRSVIQEFCHCQGWPFGLCRRAVLLPPLPMSPSESWLSRKMQPTIKKP

SEQ ID NO: 218124 - protein, 201 aa, Glycine max
  Coding DNA Sequence Number=SeqID_101346
  Homolog annotation: Hit_ID=Q00V37; Match level="QueryCoverage=54%, HitCoverage=60%, E-value=2e-12, Identity=31%"; Hit description =Homology to unknown gene
VVESWRKEKLEEVKSALVKGTSNSTIPHEEADCVMLLDNALCKLVMDALQIFDTLYIILFQLPRNLFFGLTKYTFSPEDEILPGRPVSPECHAELHTDYDGAAVRWGLTFHKDSAADCCQACLDHAKHAKEGEKKCNIWVYCPSEFGCHSPDIYQHKHQECWLKYAEKPRLNFKDKYPESYRNSHPSAPVIVPWVSGVISS

SEQ ID NO: 218125 - protein, 116 aa, Glycine max
  Coding DNA Sequence Number=SeqID_101347
REFAKRNLQWLSARKNPKEDELSSLLSAPLQVNKHIASAHPLSEISALSDPDLRHEHEQGHLFKPEIRFAKGVWTFLEKLCMHEGSRERKVQVPKSSERFCCVKIYRDASSKRKPF

SEQ ID NO: 218126 - protein, 126 aa, Glycine max
  Coding DNA Sequence Number=SeqID_101348
  Homolog annotation: Hit_ID=Q1RWU1; Match level="QueryCoverage=44%, HitCoverage=15%, E-value=4e-09, Identity=49%"; Hit description =Resistance-like protein HAAS-2-related
MLVELLMVSTEAARAETGQCRGLYVHLQWALRDLSLTGRYTWGVAALVHMYDHLNGASICTSRQLGGYITLLQCWICEHFPLIVKSAADRDYDEGSLHAWSAWTDSGFRMSVGSHMGSTNRSRSSI

SEQ ID NO: 218127 - protein, 133 aa, Glycine max
  Coding DNA Sequence Number=SeqID_101349
MGIVRNAKEGLWFVGDAPTMLLLSNNEKDNKNKEKGKSEKEKVVKIIGGRDVGLKGGVVSRTIDGYLVLELSRSGEKVKGDQSGSQCFVRMLQPYGINIGLKEHSNRVTPKAYTLKSLSGSLPPDSGPTQKAF

SEQ ID NO: 218128 - protein, 123 aa, Glycine max
  Coding DNA Sequence Number=SeqID_101350
  Gene Ontology: Mol. function=transferase activity; Cellular component= membrane
  Homolog annotation: Hit_ID=Q1SRU7; Match level="QueryCoverage=65%, HitCoverage=13%, E-value=2e-28, Identity=71%"; Hit description =Exostosin-like
MECYIGYVVELGSKEEEGCFRRSKALKTECEDKVSMSKRGKDEVRNVLLQNNNCKGFPILNLKKGWHKIVGYYNRNAFIENGFHQCWTVHFIGFGTNAVLTALHVLDVVPVAPGLWQSLKDFH

SEQ ID NO: 218129 - protein, 225 aa, Glycine max
  Coding DNA Sequence Number=SeqID_101351
  Gene Ontology: Mol. function=nutrient reservoir activity; Biological process=lipid metabolic process
  Homolog annotation: Hit_ID=Q9FZ09; Match level="QueryCoverage=99%, HitCoverage=90%, E-value=4e-65, Identity=69%"; Hit description =Patatin-like protein 1
  Pfam annotation: Domain name=Patatin; Domain location=23-181; Score =93.7; E_value=5.7e-25; Accession=PF01734.12; Description=Patatin -like phospholipase
MERTLSSLLQIQPPTYGNLVTILSIDGGGIRGIIPATILAFLEAQLQELDGEDARLADYFDVIAGTSTGGIVTAMLTAPNDNQRPLFAAKDIKPFYLEHCPKIFPQHRKVVEIIGRTEIQWKIPSRSGERESRGDTGLLAWMLDSPTYASALLPHLLIFQPTTSTTKIQKGTCTNSTLLTVTKENLEKLSQIGERLLKKPVSQINLEDGLFEPVGNGETNEDALK

SEQ ID NO: 218130 - protein, 149 aa, Glycine max
  Coding DNA Sequence Number=SeqID_101352
  Homolog annotation: Hit_ID=Q10P22; Match level="QueryCoverage=28%, HitCoverage=13%, E-value=7e-12, Identity=69%"; Hit description=Rap8, putative, expressed
  Subcellular localization annotation: CTP_CleavageSite=75; ConfidenceScore=5.49e-01
MATETKSSTVKLKSRAPDGSSKGKIDSSAVRKKVESSSKLPADSKMKSVSTVTKSEVKSKSTSSSSKTVTQTTTKAREKKVYSLPGQKHDPPEQKEPLRVFYESLSKQIPTSEMAEFCLKLSSFYAVLCFKNSKLSCLDSDWRRRIGES

SEQ ID NO: 218131 - protein, 197 aa, Glycine max
  Coding DNA Sequence Number=SeqID_101353
PVGAKRPVVHVDPTTRKADGLHRKKLRTYLGIVANDKGEENKVCQKYDISKEKWNQFCQSCRDPSWEGSRTSSSMAPDDLKRLTQKIRDQLEESITQKVTQQLMMSFSQMQPQIQSHGLALPPEAEVGAFAARVSIKKSCVDPSRQDRKMGDSNKGGLYVNDSLPQLVALGRVYEGSMTVHNVPLGKDQVKVGIEEL

SEQ ID NO: 218132 - protein, 190 aa, Glycine max
  Coding DNA Sequence Number=SeqID_101354
  Gene Ontology: Mol. function=transcription factor activity; Cellular component=nucleus; Biological process=regulation of transcription, DNA-dependent
  Homolog annotation: Hit_ID=Q75UJ6; Match level="QueryCoverage=99%, HitCoverage=79%, E-value=8e-43, Identity=53%"; Hit description=DREB -like protein
  Pfam annotation: Domain name=AP2; Domain location=1-57; Score=110.6; E_value=4.5e-30; Accession=PF00847.10; Description=AP2 domain
MRNWGKWVSEIREPRKKSRIWLGTFPTPEMPARAHDVAALSIKGNSAILNFPELAASLPRPVSLAPRDVQAAAAKAAHMDLPSTSSSISSSLVPTTQSASSSSSSLSSLTSADLLPTASEELSEIIKLPRLETTSYELGNEFVFMDSQDAWMYQPPIPWLHTTYDGSDADEFVVPESGVVTSFESFLWDY

SEQ ID NO: 218133 - protein, 119 aa, Glycine max
  Coding DNA Sequence Number=SeqID_101355
MPEDGVGMWRVSDSPQHCYFSFLNDFSWNLFSSGKATEIGHKGARVTTHKNIIEEIAKVAEYTATWHRHTLEFEASTAPETRNPQYDMVTNDFQPTDPGHSPGAGHSSPHANIVSISKP

SEQ ID NO: 218134 - protein, 202 aa, Glycine max
  Coding DNA Sequence Number=SeqID_101356
  Gene Ontology: Mol. function=cytochrome-c oxidase activity; Cellular component=integral to membrane; Biological process=electron transport
  Homolog annotation: Hit_ID=Q6D834; Match level="QueryCoverage=71%, HitCoverage=71%, E-value=9e-62, Identity=79%"; Hit description =Cytochrome o ubiquinol oxidase subunit III
MLRLYIIQSEPTTTIPMIIAVNSNATRFQRSSDEDGGMRGSAVHYHRKWNYRQDDRQDKADQVDNGKYADPDHVQEVPEQAQAHQAGFVGRGQAELAHLNHQHDDPNQAGSYVQTVGADQREEAGQERAAIRTEAFGDQMMEFIDFHRHEAQTKQEGQEQPGVYTANFTLVHGDHRHAVSDGAEQQQESFDQDKLQVEDVFT

SEQ ID NO: 218135 - protein, 78 aa, Glycine max
  Coding DNA Sequence Number=SeqID_101357
MKNKKVVVAGVSLSEACALSEALSPLSELGESGGESVKHLRAQCVINLLSESFVFSRAKRTQLAQWKIIYLRLARKWC

SEQ ID NO: 218136 - protein, 332 aa, Glycine max
  Coding DNA Sequence Number=SeqID_101358
  Gene Ontology: Mol. function=nucleic acid binding; Cellular component= cytosol; Biological process=regulation of mRNA stability
  Homolog annotation: Hit_ID=Q93YF1; Match level="QueryCoverage=84%, HitCoverage=62%, E-value=1e-117, Identity=53%"; Hit description =Nucleic acid binding protein
  Pfam annotation: Domain name=MPPN; Domain location=240-331; Score= -4.1; E_value=0.00037; Accession=PF05172.3; Description=MPPN (rrm -like) domain
  Pfam annotation: Domain name=RRM_1; Domain location=146-218; Score =68.6; E_value=2e-17; Accession=PF00076.12; Description=RNA recognition motif. (a.k.a. RRM, R
  Pfam annotation: Domain name=RRM_1; Domain location=251-316; Score =80.3; E_value=5.9e-21; Accession=PF00076.12; Description=RNA recognition motif. (a.k.a. RRM, R
  Pfam annotation: Domain name=RRM_1; Domain location=53-124; Score =45.3; E_value=2e-10; Accession=PF00076.12; Description=RNA recognition motif. (a.k.a. RRM, R
  Pfam module annotation: Pfam domain module=MPPN::RRM_1::RRM_1::RRM_1; Domain location=240-331::146-218::251-316::53-124
MPMQYPAAAMVMQHHMMPPQHYAPPQPYMAYHQYQQQVPQAHHLGSSAENKTVWVGDLHHWMDENYLHRCFASTGEISSIKVIRNKQTGLSEGYGFVEFYSHGTADKVLQNYAGILMPNTEQPFRLNWATFSTGDKRSDNVPDLSIFVGDLAADVTDSMLHETFTNRYPSVKAAKVVFDANTGRSKGYGFVRFGDDNERSQAMTEMNGVYCSSRPMRIGAATPRKTSGYQQGSQSNGTSSQSEADSTNTTIFVGGLDPNVTAEDLKQPFSQYGEIVSVKIPVGKGCGFVQFANRNNAEEALQKLNGTTIGKQMVRLSWGRSPANKQVYSLHS

SEQ ID NO: 218137 - protein, 233 aa, Glycine max
  Coding DNA Sequence Number=SeqID_101359
  Gene Ontology: Mol. function=uroporphyrinogen-III synthase activity; Biological process=tetrapyrrole biosynthetic process
  Homolog annotation: Hit_ID=Q8LBE8; Match level="QueryCoverage=98%, HitCoverage=69%, E-value=9e-73, Identity=60%"; Hit description =Uroporphyrinogen III synthase
  Pfam annotation: Domain name=HEM4; Domain location=2-233; Score=17.3; E_value=7.1e-07; Accession=PF02602.6; Description=Uroporphyrinogen -III synthase HemD
MKRILKAKHEINCLELPLIEHIQGPDLGRLPSVLGDNAFDWVVITSPEAGSVFLEAWSTLYDYLVLIVVPRSSGMPHVKIGVVGAGTASIFKEALQSSNRSIDIAFVPSKATGKVLATELPKIGNKCTVLYPASAKASNEIEEGLSNRGFEVTRMNTYTTVPVQHVDHTVLKIALAAPVVTVASPSSIRAWKNLLSDSEWNNSVACIGETTATMARSLGFTNVYYPAQPGIEG

SEQ ID NO: 218138 - protein, 83 aa, Glycine max
  Coding DNA Sequence Number=SeqID_101360
MQQIEALKKQIGQLPQQYHQGGPQKTHQAHQRRPIIYRTKPDLNKTFKEATKAIEVAQVLLTTLIEVFQIGVHNNNKLNQIEC

SEQ ID NO: 218139 - protein, 190 aa, Glycine max
  Coding DNA Sequence Number=SeqID_101361
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=99%, HitCoverage=16%, E-value=1e-95, Identity=82%"; Hit description=DNA -directed RNA polymerase beta'' chain
MDSVGIRSANPYLATPGATVHGHYGEILSEGDILVTFIYEKSRSGDITQGLPKVEQVLEVRSIDSISMNLEKRVDTWNGRITKILGIPWGFLIGAELTIAQSHGMSNVFLPGELIGLLRAERAGRSLEEAICYRVLLLGITKTSLNTQSFISEASFQETARVLSKAALRGRIDWLKGLKENVVLGGMIPV

SEQ ID NO: 218140 - protein, 297 aa, Glycine max
  Coding DNA Sequence Number=SeqID_101362
  Homolog annotation: Hit_ID=Q69MD6; Match level="QueryCoverage=37%, HitCoverage=20%, E-value=5e-11, Identity=38%"; Hit description =Ternary complex factor MIP1-like protein
MNSGRIRKNLNGKRIMVHHDDMRLSPLWLKPSTQVTVPASILGCTSECFLDEKKLTIEFPLSSGRYIHAVAADLEEVQKMNTSVRPRLQHRKAPTPTTVSHEKRESSQSHPKLWLQFLMINDPRNSENLILTSKALNEKAEMRGSSRGGANNAVKGGKTSSKDRKLALQQDVDRLKKKLKREENIHRALERAFNRPLGALPRLPPYLPPYTLGLLAEVAVLEEEIVRLEEQVVHFRQDLYQEAVYMSSSKMKLEQSARVNNASPNSSPKLGKLKSLSQTMDDAATSETRPTTTLPSE

SEQ ID NO: 218141 - protein, 78 aa, Glycine max
  Coding DNA Sequence Number=SeqID_101363
MKKALEKKKLTSEEARNAERLAMQAFHENNALVEEGDNGENSDEEEHELTQWEAIIWLAILTTEVSILSGYLVEAIWV

SEQ ID NO: 218142 - protein, 301 aa, Glycine max
  Coding DNA Sequence Number=SeqID_101364
  Gene Ontology: Mol. function=kinase activity; Cellular component =cytoplasm; Biological process=regulation of transcription, DNA -dependent
  Homolog annotation: Hit_ID=Q45GG2; Match level="QueryCoverage=92%, HitCoverage=50%, E-value=1e-81, Identity=56%"; Hit description =Expressed protein
  Pfam annotation: Domain name=DUF547; Domain location=75-223; Score =267.6; E_value=2.6e-77; Accession=PF04784.5; Description=Protein of unknown function, DUF547
MSAAKNLDSTADVPPLRTPKSKNCVEGIEFWDPYSICLEFGKRDIGPYKQLRSIETKSFDPKRTAKSLFLLHRLKLLLRKLACVNIENLNHQEKLAFWINIYNSCMMNAYIENGIPESPEMVAALMQKATINVGGHLLSATTIEHCILRLPYHWKFKIISFLQLNSKQTLSKGGKNHETYGLELSEPLVTFALSCGTWSSPAVRIYTASQVENELEMAKREYLQAAVGISISKFLIPKLLDWYLLDFAKDLESLLDWICLQLPSDVGKEAIKFLEKRKTGPLSQFVHIMPYEFNFRYLLCT

SEQ ID NO: 218143 - protein, 84 aa, Glycine max
  Coding DNA Sequence Number=SeqID_101365
MEGENSSSIEVDGHILNKALTNTLIIKFSFLRLTSVKECEEERLLMEIGESALLTTTCGKNKAAKSQANQKGNGYAKPKETSGK

SEQ ID NO: 218144 - protein, 96 aa, Glycine max
  Coding DNA Sequence Number=SeqID_101366
MKQLDTIGLENGRSNERRLEEVGLQSVRRQRRRGLGKSVRVWGGSNNFGMRIATIYFRYQFLGPIVLHGQAERASNPTKKKKSEHILLASYKYKRP

SEQ ID NO: 218145 - protein, 83 aa, Glycine max
  Coding DNA Sequence Number=SeqID_101367
MNYLKKWSCWVEKEWVPEIEVDAPLHFITVPCLRIQTAELKKEETFLAKLYQKIFVFSFMAVHNEKLKEVENTFLSVSDLVIT

SEQ ID NO: 218146 - protein, 118 aa, Glycine max
  Coding DNA Sequence Number=SeqID_101368
  Homolog annotation: Hit_ID=Q69JV9; Match level="QueryCoverage=59%, HitCoverage=28%, E-value=2e-07, Identity=38%"; Hit description=Zinc finger (C3HC4-type RING finger)-like protein
MAPFKPGYTANSPVCHPGDTSIDISDDWATTRNPLDLHNARLLAIAAVDYQVPETEHEDYVNAGTGGTTLWHSVGLILMALLLLRHAAPLFNADVEKAIAYFYQSAEELAFMLQAEEQ

SEQ ID NO: 218147 - protein, 493 aa, Glycine max
  Coding DNA Sequence Number=SeqID_101369
  Gene Ontology: Mol. function=transferase activity; Cellular component= membrane
  Homolog annotation: Hit_ID=Q6Z527; Match level="QueryCoverage=75%, HitCoverage=68%, E-value=1e-144, Identity=62%"; Hit description =Exostosin family-like protein
  Pfam annotation: Domain name=Exostosin; Domain location=116-440; Score=382.1; E_value=8.5e-112; Accession=PF03016.6; Description =Exostosin family
MSEKIMVHSRFIFCMMIISLFLLILSSIFLLQFSSHSLIPRSVLELILVNNASLYFMPNLKREQVLHPPYPSGDLKFQSQNPRESDCQTSNSSQKTTSVGQQMNMVSYPTRPLLKVFMYDLPPEFHFGLLGWKRSVNQTWPEVNNPKRIPRYPGGLNLQHSMEYWLTLDLLSSKVGQPCTAIRVQDSSQADVIFVPFFSSLSYNRHSKLNGEEKVSLNKMLQDRLVQFLMGQKEWKRSGGKDHLIVAHHPNSLLDARRKLGAAMLVLADFGRYPTELANIKKDIIAPYRHLVSTIPKAKSASFEKRTTLVYFQGAIYRKDGGAIRQELYYLLKDEKDVHFTFGSIGGNGINQASQGMAMSKFCLNIAGDTPSSNRLFDAIVSHCVPVIISDEIELPFEDVLDYSDFSIFVRASDSMKKGYLLNLLRSITQKEWSKMWERLKQITHHFEYQYPSQPGDAVNMIWQQVERKISSIRFNLHRKNRYQRSQLRVKSN

SEQ ID NO: 218148 - protein, 91 aa, Glycine max
  Coding DNA Sequence Number=SeqID_101370
MRQIAPFGTLLETYSLDGVIFKVFPRRGCFVRKLHGVTKQIASETGEFAVREGIATGNGDLAMHGEPPVKLASSTAQEVGSGFLEMASASS

SEQ ID NO: 218149 - protein, 117 aa, Glycine max
  Coding DNA Sequence Number=SeqID_101371
MGEHVVLSVLDSLIAPATLQPQHDGDGDALGSLIEGATHVNDVGECDTLEEEEEEEEDLIKMVECRICQEDDTLQNLDIPCACSGTLKGYVGYTQNIDNFAYRLYNVTIVGNIVGKP

SEQ ID NO: 218150 - protein, 94 aa, Glycine max
  Coding DNA Sequence Number=SeqID_101372
  Gene Ontology: Mol. function=protein kinase activity; Biological process=protein amino acid phosphorylation
  Homolog annotation: Hit_ID=Q1SN45; Match level="QueryCoverage=90%, HitCoverage=5%, E-value=1e-14, Identity=47%"; Hit description=AAA ATPase
  Pfam annotation: Domain name=DUF889; Domain location=1-91; Score= -120.9; E_value=0.0027; Accession=PF05970.5; Description=Eukaryotic protein of unknown function (DUF889)
MANLENLTMVMQRAILTSTKDVVDSINDYVMSLISTDEKEYCSVDSVDKSDELLNPTFGVLTPEFLNSLKTSGIPNHKLKIKVDPPIIRRWVMQ

SEQ ID NO: 218151 - protein, 292 aa, Glycine max
  Coding DNA Sequence Number=SeqID_101373
  Homolog annotation: Hit_ID=Q10QR1; Match level="QueryCoverage=58%, HitCoverage=74%, E-value=2e-34, Identity=45%"; Hit description =Expressed protein
  Pfam annotation: Domain name=GRP; Domain location=211-288; Score= -12.8; E_value=0.0015; Accession=PF07172.2; Description=Glycine rich protein family
MAQGKRKGHRATLLKTALTETVYELWKYRNEGFRIFTKPSMAEEAAPKVVDPNTVVAAAAAAAVDMDVENIEAGDNGAEPNQKRAREEEEPLGDDDDVLKKQKVAEEKEQSVEEQRLEKRDEKEEKEAEKEEEEKEASGSVNLGFKSFVSSSEMFHYFYNFLHTWPQYLNVNKYEHLMLLELLKNGHAEPDKKIGGGVRAFQVRKHPTFKSRCFFLIREDDSADDFSFRKCVDHILPLPEEMHLKFDANKALGGGGGGGGKHYGGGKGGRGGRGGRGGGGRGGHGRGGKWRH

SEQ ID NO: 218152 - protein, 268 aa, Glycine max
  Coding DNA Sequence Number=SeqID_101374
  Gene Ontology: Biological process=regulation of transcription
  Homolog annotation: Hit_ID=Q6Z2T5; Match level="QueryCoverage=51%, HitCoverage=62%, E-value=4e-32, Identity=50%"; Hit description=RWP -RK domain-containing protein-like
  Pfam annotation: Domain name=RWP-RK; Domain location=133-184; Score =66.0; E_value=1.2e-16; Accession=PF02042.6; Description=RWP-RK domain
MENQQLTFWKSNYDIDDYYPFAPTSQFSSYDYCGWGSAADGYHWPHEFPLQDSYLDAIPFMKFYYPHDILYETTLPIEPTSLSIQDYDFSDWNEIDGSDHKPVFSSCNDGESVSEMKEDLNAKKCREEKISSSAKMLSRTTVSQYFYMPISKAARELNVGLTHLKKRCRELGIQRWPHRKLMSLQTLIKNIQEQGEAEGHENDEKLRAAIEMLKREKRKVEEMPDLELEDNTRRLRQACFKANYKKRKLVGMRFIEPESSLSGLSNKY

SEQ ID NO: 218153 - protein, 60 aa, Glycine max
  Coding DNA Sequence Number=SeqID_101375
  Subcellular localization annotation: CTP_CleavageSite=18; ConfidenceScore=5.43e-01
MHAGTASQTGKFQQLGASVGEVRSGCRTQRSRSGAAGRQQWCRGHCPSSSNYVVSLFLIF

SEQ ID NO: 218154 - protein, 140 aa, Glycine max
  Coding DNA Sequence Number=SeqID_101376
  Gene Ontology: Mol. function=acyltransferase activity; Cellular component=cellular_component; Biological process=biosynthetic process
  Homolog annotation: Hit_ID=Q39706; Match level="QueryCoverage=65%, HitCoverage=59%, E-value=2e-14, Identity=43%"; Hit description =Chalcone synthase
  Pfam annotation: Domain name=Chal_sti_synt_N; Domain location=2-131; Score=-84.1; E_value=0.037; Accession=PF00195.10; Description =Chalcone and stilbene synthases, N-te
MEAEPLSFIEVFLMVIFSHEVAVEDKREEIGQFVIHTTFCFGTILDLINYLFELLKLKLTINHLMLFNHGCHVVGIVLHEVKDIVQNNLESCVPVVCVETMLTSFYTPTESNVDALIGHTLFGDGATHAEEEGREKKRLS

SEQ ID NO: 218155 - protein, 80 aa, Glycine max; identical to SEQ ID NO: 135795
  Coding DNA Sequence Number=SeqID_101377

SEQ ID NO: 218156 - protein, 74 aa, Glycine max
  Coding DNA Sequence Number=SeqID_101378
MSAGYLFLKIRVLIVPELDASFSVERPSFDGLKALLVLDTPETMAIKLEGSTGPFIRGIPPRSLHGKLFRSHFL

SEQ ID NO: 218157 - protein, 149 aa, Glycine max
  Coding DNA Sequence Number=SeqID_101379
MIMRGQDIYSSQDEATTSPSSSESEEAKEEESSEEIYPQEEGQPLMVKEECKEVSVSSKRLAKKESHFEIKNNIKETSPLRQPPHLLLCKKTLVSTATPLRLEVIPQVLIWDTIGVEGRSLEYEEPRDLRSNPFQGGGDDAILPPKGIG

SEQ ID NO: 218158 - protein, 117 aa, Glycine max
  Coding DNA Sequence Number=SeqID_101380
  Gene Ontology: Mol. function=Rab GTPase activator activity; Cellular component=intracellular; Biological process=regulation of Rab GTPase activity
  Homolog annotation: Hit_ID=Q1SCV0; Match level="QueryCoverage=55%, HitCoverage=14%, E-value=3e-17, Identity=64%"; Hit description =RabGAP/TBC
MGDKRRKSTSAFFRIVFLDRREGVLRRKRLEYVDCISQYYHIPDTERSDDEVNMHRQIGIDCPRIVPDVPFFQQQQVQKSLEQESNQLIQQQISRRHTTRQLSDIMQTRLESYVPAL

SEQ ID NO: 218159 - protein, 135 aa, Glycine max
  Coding DNA Sequence Number=SeqID_101381
  Homolog annotation: Hit_ID=Q1RYJ7; Match level="QueryCoverage=35%, HitCoverage=3%, E-value=2e-10, Identity=64%"; Hit description =Timeless protein; Timeless C-terminal
EVLPNANSTGEDVIPDDNEHENHVEEVGNSQVGLEPMGATNSEHVNEDMLDGTNDFSEDEQLHAYNEVDFKTHLLLEVASPLSLPFSIPLPFIFQEAKESIDEEDPRPTSSNGACIKFDKPKLVLVWINEKSLYY

SEQ ID NO: 218160 - protein, 462 aa, Glycine max
  Coding DNA Sequence Number=SeqID_101382
  Homolog annotation: Hit_ID=Q1RYJ7; Match level="QueryCoverage=98%, HitCoverage=34%, E-value=3e-57, Identity=47%"; Hit description =Timeless protein; Timeless C-terminal
MVLPHFKHSRFKDDQHCSHRITEVLDPDGKISPTQIFNMLKRLGLAVAPRRKMCDADAEGPLSTSPNQLDGDKITGATNHKSVNLEGSLLVQHIFKDHRRCSYMIANALDKDGKFTTAQVSRKLKLLGLSLPLKSSGGKMHPKGADLMDRSNERMDESDDETLVSLVKRKKMESGKLSRGQLHGQTSEDKLSKGDSDDEMLSSVLKKKINSKVSTEQLLEPINVDSSSRDDSDDECSALLSIVYSSTVRIRFNFLCIGIISGCRRTRRPSLKSKQVELENIQIHERIMGDDSFNGRITEGCFSLTNTAISIDVPARTMQVSINSALMSLQGLCRKMLKKMKKQPLLFVELLFWKTRRECHYINVEYLLSELGHLKKESANWNNTLGDEEIGSSPAKVWTQDIKNKLDDVIKGFAPTSGSNSDKDDHNGEQLMEDESQIALRRRKKLVLDGDLERQIKDLHEK

SEQ ID NO: 218161 - protein, 184 aa, Glycine max
  Coding DNA Sequence Number=SeqID_101383
  Homolog annotation: Hit_ID=Q9LX18; Match level="QueryCoverage=38%, HitCoverage=19%, E-value=2e-24, Identity=69%"; Hit description =Trehalose-6-phosphate phosphatase-like protein
  Pfam annotation: Domain name=Trehalose_PPase; Domain location=28-180; Score=-60.8; E_value=0.0066; Accession=PF02358.7; Description =Trehalose-phosphatase
MKQLHHPSALDMFDKIIDAPKGKQFVMFLDYDGTLSPIVDDPDRAFMCDSMRKTMRKLPRCFPTAIVTGRCKDKIRKLDDSEFRNAFSRAFIRVILEVLVVIQGGAILEASAAVHMSHEAAAIAAAEVIAIVTGAEVGLRNQNTLDVQYLFQVNEYPCVIVTRVFLLESMFLSSFLIGSIMWLI

SEQ ID NO: 218162 - protein, 75 aa, Glycine max
  Coding DNA Sequence Number=SeqID_101384
MTWSNFPARTSKFMNKLVCIKEWQFVNKDIGVKKPGNIFEQQLIHTSLGCKRVLDYISMNGRYLGWVMVTPEREQ

SEQ ID NO: 218163 - protein, 96 aa, Glycine max
  Coding DNA Sequence Number=SeqID_101385
  Gene Ontology: Mol. function=ATPase activity, coupled to transmembrane movement of substances; Cellular component=integral to membrane; Biological process=transport
  Homolog annotation: Hit_ID=Q9LHK4; Match level="QueryCoverage=67%, HitCoverage=5%, E-value=1e-19, Identity=69%"; Hit description =Putative multidrug resistance protein 22
MGSPKMDESETPKVTIITYKTYKAEVEKCNLYFVYLGLATMVVAFKEGYCWSKTSERQALRIRYKYLEAVLRQEVGFFDSQEAIKETKMSKCRRST

SEQ ID NO: 218164 - protein, 58 aa, Glycine max
  Coding DNA Sequence Number=SeqID_101386
MADIGRLGFFVRAQPKLCFGRHRHVLINSARKTLFSDTDRKENDSRCRPGKVADRGLQ

SEQ ID NO: 218165 - protein, 99 aa, Glycine max
  Coding DNA Sequence Number=SeqID_101387
IMVRTIDLGFASDRVIGRALGREDNRDSGEALQRRRPTTFAHRQKEAVAEDVHHVDDTQLRRSSNSLKKQLLMPKECLELKLSSHGRKAQKFDKPAAEI

SEQ ID NO: 218166 - protein, 274 aa, Glycine max
  Coding DNA Sequence Number=SeqID_101388
  Gene Ontology: Mol. function=nucleic acid binding; Cellular component= intracellular; Biological process=DNA integration
  Homolog annotation: Hit_ID=Q8RUQ2; Match level="QueryCoverage=77%, HitCoverage=22%, E-value=5e-34, Identity=37%"; Hit description =Putative retroelement
MNNQEKDRWMSVTVEEMNSLQKNQTQELVELPTSKRVIGFMRHTSIKVVLALALVVSHDMHLGQIDVKTTFLHGDLEEQIYMEQPEGFSKGGSSHLDDESFIFLLLYVDDMLIASNHLRDVNELKSLLSKEFEMKDLGPAKKILRMEIHKDRKSRRLHMLRWSKCQRFPMPMRKVTLGSSEVDLEQGDPLVARYVDFDYVGDLDDRRSTTEHVFTLEGLVKKLSIEQGGVQLHCDSQSAIDLVHTSDNAANMITMAVTTDKFKHCLDLLNVGQC

SEQ ID NO: 218167 - protein, 143 aa, Glycine max
  Coding DNA Sequence Number=SeqID_101389
  Subcellular localization annotation: CTP_CleavageSite=57; ConfidenceScore=5.42e-01
MAGGSTSPAKAIFWPKSLIAGSLFSCIFWRSKRDTTQQQKRTREINGFLFMLMFMVVAAVSVGNGKHDDLDFDPFKPEQGATSPGVSILGHKFLWLAIDFLLKVFDSLFSALLHALSVHSTRRHVGVLARVPQFWPPWRDVIG

SEQ ID NO: 218168 - protein, 374 aa, Glycine max
  Coding DNA Sequence Number=SeqID_101390
  Gene Ontology: Mol. function=nucleic acid binding
  Pfam annotation: Domain name=zf-CCHC; Domain location=113-130; Score =33.9; E_value=5.5e-07; Accession=PF00098.13; Description=Zinc knuckle
MALNSRAKLEVGKFDGMGILDCDKGELRICWQSKEELQDRGNNTFVFGRRGPLSSGVEVSGGGGFESSTGCECLQSDYQRFFKGKHERERTQDKGSGGWQRKKSRTRERKQTLECYKCNQKGHFKRDCPELKRYGKGTSRSSNVVETDDSDYYTTEDVYYSERNVLSSSCSQLIEAWILDFGFSYHMTPNREWFTTYMSDNFGADCDVGGVRTLGDVRHIPELRENLISHGNLQANSFIYKTDGDRDTLRVCKEVLIVMKAQRIARRLRWRTRRKKRSGFWTKVVNKTCYLLNQSPQASLDEKVAEEVFIGYSKGVKGFKFWDPISKKMVINRDVVFDEQSMLLEIVHATMQVSNGVPQLHGGSGGLRAAINDS

SEQ ID NO: 218169 - protein, 421 aa, Glycine max
  Coding DNA Sequence Number=SeqID_101391
  Gene Ontology: Mol. function=zinc ion binding; Cellular component =nucleus; Biological process=regulation of transcription
  Homolog annotation: Hit_ID=Q39540; Match level="QueryCoverage=80%, HitCoverage=90%, E-value=1e-103, Identity=57%"; Hit description=AOBP
  Pfam annotation: Domain name=zf-Dof; Domain location=83-145; Score =141.8; E_value=1.8e-39; Accession=PF02701.6; Description=Dof domain, zinc finger
MDVDKDEEDDFGDSETEDEKDKDPRAEKVSEKTKEADPPPNAADSKKTPEGIQNPNTPSIDEESAKSKTNKSENNNNNKTLKKPDKILPCPRCNSMDTKFCYYNNYNVNQPRYFCKACQRYWTAGGTMRNVPVGAGRRKNKNSASHYRHITISEALQAARIDAAPNGTHHLLKPNGRVLSFGLELDPPICDSMASVLNLTAEKKGTLNNNSRNNNNNNNNNGDDCSSASSITVSNEENGKSTSQESIVVPNSNGFIHHVPCISTLPWPYPFPSGAPAMCPPGFPMSFYPAAFWNIPWFPSQHSHHSSAPTPRSPNSPTLGKHSRDDDATKQYHLQEEQPPSRQRNGSVLVPKTLRIDDPSEAAKSSIWATLGIKNECVTGGGMFKGFQSKKEEKDHVVEASPVLRANPAALSRSLNFHENS

SEQ ID NO: 218170 - protein, 133 aa, Glycine max
  Coding DNA Sequence Number=SeqID_101392
MAMGSFSQARGALGKIARFQVWWLEGFGGGLCNKKRNWLDSGGRRQVQILGGLVTTISCMGTNNSTGWEWNLTWRRDLFESELLLADTFIGDLAQQQVQPHREDKWIWKHDHSGHYSSKSGYDLIWRELRGSI

SEQ ID NO: 218171 - protein, 55 aa, Glycine max
  Coding DNA Sequence Number=SeqID_101393
MWYRVSEKSPWGAEEYITRHITTWACQAYTPKSLLEPLPPDSGPTPKIIFAYRHC

SEQ ID NO: 218172 - protein, 176 aa, Glycine max
  Coding DNA Sequence Number=SeqID_101394
  Gene Ontology: Mol. function=heat shock protein binding; Cellular component=integral to membrane; Biological process=protein folding
  Homolog annotation: Hit_ID=Q7Y151; Match level="QueryCoverage=92%, HitCoverage=22%, E-value=4e-53, Identity=60%"; Hit description =Putative heat shock protein
MQLICQNACKRCAGFHVWIHTRKQKSRARWCQDCQDFHQAKDGDGWVEQSSQPFLFGLLQKVDAPSAYVCAGSRIYDAIEWYICQGMRCPANTHKPSFHVNTNLMSKHNSGKGTSSGQRGGHMPTPNIEETMTEEELFEWLQNAVHAGAFDNFSGTAIESPSPKSRNGMKSLCEPC

SEQ ID NO: 218173 - protein, 95 aa, Glycine max
  Coding DNA Sequence Number=SeqID_101395
  Gene Ontology: Cellular component=protein complex; Biological process= regulation of progression through cell cycle
  Homolog annotation: Hit_ID=Q1RY20; Match level="QueryCoverage=73%, HitCoverage=8%, E-value=2e-17, Identity=63%"; Hit description =Proteasome/cyclosome, regulatory subunit
MQPRMLWIVDENLKPLSLPVCVGQAVNVVGQAGHPKTITGFQTHYTPILLCVGDRAKLAMEKYLPLSPILEDAEKGRGYLLRVAATGSTQSEGKP

SEQ ID NO: 218174 - protein, 123 aa, Glycine max
  Coding DNA Sequence Number=SeqID_101396
MTIIIPDTIGLACLRMIKGTLIVSEQLNQVTITVFACQQACLPLVDEVETAIVSTCRLRMTKSQSTDIESLTKSADNHVGLCVSSDLSSPNDEGADNHKPSPDDEGADNHEVSPRVIRLVISG

SEQ ID NO: 218175 - protein, 144 aa, Glycine max
  Coding DNA Sequence Number=SeqID_101397
MGRNLTPENSAMIIIIIIRGRTMRGKKKKKKKKKKKKKNYERESSSSKRHIDDVLSTPSHANFMNTREKLNSKEQCHDNNKKKNYEREESFGWKPLNKGNDTSERFYSQSMGKGRDKNKNIVENECEQCILSDSINYSLIWSFE

SEQ ID NO: 218176 - protein, 151 aa, Glycine max
  Coding DNA Sequence Number=SeqID_101398
  Gene Ontology: Mol. function=RNA binding; Cellular component =membrane; Biological process=translation
  Homolog annotation: Hit_ID=Q1H274; Match level="QueryCoverage=95%, HitCoverage=94%, E-value=1e-69, Identity=86%"; Hit description=SsrA -binding protein
  Pfam annotation: Domain name=SmpB; Domain location=1-69; Score=142.5; E_value=1.2e-39; Accession=PF01668.8; Description=SmpB protein
MTIAQNKKAFFDYFIEEKYEAGIVLEGWEVKAIRDNRINLKESYVVIMRGEIYLIGCHVTPLGSASTHVRPDAIRTRKLLLHNEEIAKLIGKVERSGYTIVPLDMHFTRGRIKVQIGLAKGKKQHDKRDVEREKDWKREQSQLLKNKARER

SEQ ID NO: 218177 - protein, 219 aa, Glycine max
  Coding DNA Sequence Number=SeqID_101399
  Homolog annotation: Hit_ID=Q1H275; Match level="QueryCoverage=55%, HitCoverage=84%, E-value=6e-38, Identity=59%"; Hit description =Cyclase/dehydrase
  Pfam annotation: Domain name=Polyketide_cyc; Domain location=10-123; Score=83.7; E_value=5.8e-22; Accession=PF03364.10; Description =Streptomyces cyclasedehydrase
  Pfam annotation: Domain name=UPF0125; Domain location=129-212; Score =121.2; E_value=2.9e-33; Accession=PF03658.5; Description =Uncharacterised protein family (UPF0125)
  Pfam module annotation: Pfam domain module=Polyketide_cyc::UPF0125; Domain location=10-123::129-212
MAQVEKTVLVMHSSAAMFQLVDAVEDYPSFLPWCGGSELIERTENITQATIYIRYHGIQQHFTTRNHKQFPNRMEITLVDGPFKQLAGHWHFTALREDACKIEFKLEYVFANSLVERIIAPVFTPTDTIPVEVAYALPHKQSLIALDVLTGTTALQAVMQSGILEKYPDLTASKLTLGIFGKRVAADTILHAFNRVEIYRPLLADPKEARRQRAAAKNG

SEQ ID NO: 218178 - protein, 346 aa, Glycine max
  Coding DNA Sequence Number=SeqID_101400
  Gene Ontology: Cellular component=integral to membrane; Biological process=polysaccharide biosynthetic process
  Homolog annotation: Hit_ID=Q46633; Match level="QueryCoverage=99%, HitCoverage=90%, E-value=2e-45, Identity=32%"; Hit description =Amylovoran biosynthesis protein amsC
TWLILVAVVVLCTFGGIRGLGTGLDDFQYRDFYAQFIDKIIIEGFWRAVVEFRYEPAIYAIAGATRIFTANPDIFIFVFAVIAVGVNAHYFRKLTPLPLVALAVYSAHLFINKDMNQIRFGLCSAFLMGFVWHMSRRSKSGMITTFILSFISHATAIVALLIPLAMIVRKNKYIPIAIVVASLPLAFLGSSALIAALSSHLGALGDRAMGYADADSRQEQGILTLSNLKNIGFVFIFSYMLLSDKIKNFDPEKFNTYYILVITFAIGSGLRMALQDYASGGRLANYLLQVEPVLISLCIWETRKLKKVLAVAVTILMVLYYLYYNTVSSKQSIVGYEVSRTFQLFR

SEQ ID NO: 218179 - protein, 209 aa, Glycine max
  Coding DNA Sequence Number=SeqID_101401
  Gene Ontology: Mol. function=transferase activity, transferring groups other than amino-acyl groups; Cellular component=membrane
  Homolog annotation: Hit_ID=Q1ZM69; Match level="QueryCoverage=89%, HitCoverage=62%, E-value=3e-15, Identity=30%"; Hit description =Putative o-antigen acetylase
MHDLRLVVCSGGWHNRRMSVMGALQETALQQIPGGVSQRQLHHNRQPQASKRIGIKHTKMLQYLNNRPVIEVHAVREIAVLADFNLFTQAGAEQNHYRRKRHRLNDKRVIRALEQQEHHQRHNGDLFQAVKGWLMHRQQAAKEEVGRQRNKLLGQRIGFRAAVQRGEVEVPGAGDNKNHAPHFQRASLQQRHDKGQQHVECQLGFDGPQ

SEQ ID NO: 218180 - protein, 174 aa, Glycine max
  Coding DNA Sequence Number=SeqID_101402
  Homolog annotation: Hit_ID=Q40538; Match level="QueryCoverage=20%, HitCoverage=64%, E-value=5e-08, Identity=86%"; Hit description =Nicotiana tabacum (clone 5) activating factor DNA sequence
MYPPLFSLNNLVDVPSTRTDPQEMYPLLFSVNNHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 218181 - protein, 52 aa, Glycine max
  Coding DNA Sequence Number=SeqID_101403
PLKCVFVLASSTHELGAPSSDCLVPFCIFYVFVGCALNCVFVHASSTHEFRA

SEQ ID NO: 218182 - protein, 148 aa, Glycine max
  Coding DNA Sequence Number=SeqID_101404
  Gene Ontology: Mol. function=hydrolase activity, acting on acid halide bonds, in C-halide compounds; Biological process=metabolic process
  Homolog annotation: Hit_ID=Q8UAG6; Match level="QueryCoverage=100%, HitCoverage=52%, E-value=8e-72, Identity=90%"; Hit description=2 -haloalkanoic acid dehalogenase
MSFDVVGTLIDFERGLTSTLAAIGAENGVEGDGEKALALYRAARYSDATDLFPDDLVRVYLIIAPELGLPVERAYGERLRDAAKNWKGFSDSRAAMAELSKTHRLIAMTNARRWAFDYFSKELGNPFHAAFTADDTGTEKPDPAFFEK

SEQ ID NO: 218183 - protein, 399 aa, Glycine max
  Coding DNA Sequence Number=SeqID_101405
  Gene Ontology: Mol. function=nucleic acid binding; Cellular component= chromatin; Biological process=DNA integration
CPTKRLQSITPEEAWTGDKPMMNRLRIFGSLTYRHIPDEKSKKLDDKSEALILVGYHPTDAYKLHSPLKQQVVISEDVMVDETAAWKWENESKIPNSYILMDSPRAKDVNPASSMQPLIRRSKRTRFPSIRLADYELYSNSSISDNGEMVHFAFMFDMELVHWKQALDIREWKATMKEELDAIEKNRTWELVDLPHNKHPIDVRWVFKGSIHLAALYGLKQAPRAWNKVIDNFLSKQGFVKYTVEFGDVNEEIEQFKEKMKSEFDITDLGILHYFLGFEFMHTQKGIFLHQRKYTGEVLKCFNRENCITVPVPVMPNLKLIEELDERPVDATLFKQIIGSLRFLCNSRLDISYGVGLLSRFMGNPRAPHMTIAKHILSDKVERKSTSGYLLKYLDAPIS

SEQ ID NO: 218184 - protein, 78 aa, Glycine max
  Coding DNA Sequence Number=SeqID_101406
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q2PMM9; Match level="QueryCoverage=98%, HitCoverage=24%, E-value=1e-17, Identity=71%"; Hit description=NADH -plastoquinone oxidoreductase subunit 5
MGEYNQLSLRISSLDQKQAKGGIPQRESVPTKKEVFVIGRTMKRGRSRATRKIPAATIVAACKGGNWSSPSIASGSHT

SEQ ID NO: 218185 - protein, 104 aa, Glycine max
  Coding DNA Sequence Number=SeqID_101407
METGERGRGDEGGSSVEGGAGVDLPRRFVEQEEESVSEKESFGKRKRHYIGERKKALEITEAIEEIKKELACGGGELQDTLPNSWCIEILTPRQSHFVTNYKYS

SEQ ID NO: 218186 - protein, 197 aa, Glycine max
  Coding DNA Sequence Number=SeqID_101408
FKSFDEDLLTIVERVDKAILDQFSVLLDARAILSLPSTNNPLSALHDIMGDFAWKPLVKPIGPIGGDMSSFAAKNRTMRKRDGGVPSCKRSRALFSLRVMKQAIGFMTSLGCPSSVGSQGLPLTPLVVHATTALLEPHSILAPSASPSSTIMTLLSAGVMTTNFSADLPPSSLALPASVPIALSWRRVPPLLDQVST

SEQ ID NO: 218187 - protein, 260 aa, Glycine max
  Coding DNA Sequence Number=SeqID_101409
  Homolog annotation: Hit_ID=Q1S0F5; Match level="QueryCoverage=69%, HitCoverage=58%, E-value=3e-17, Identity=29%"; Hit description=IMP dehydrogenase/GMP reductase
MVSIWDLARVEVSMEPIASLAQYYDQPLRCFTFEDFQLVPTVEEFEEILGCPLGGRKPYLFFGFYPSTTRVSKANGLSFIDILALLIFGVVLFPNMEGLVDLAVIDAFLAFHHGKESPFVAIFCHEGRIKILSSCEGCPNVLLMGTRGCINYNPVLAIRQLGYPMRGVPSDESITPFIARGFSDHNARDRELRGSSNGIIGGYHKWLRVRTQGLDWLPNLKTVRDDEVKASEESDEVQALKAELERAWVVEEKFKSIAIK

SEQ ID NO: 218188 - protein, 126 aa, Glycine max
  Coding DNA Sequence Number=SeqID_101410
  Gene Ontology: Mol. function=galactosyltransferase activity; Cellular component=membrane; Biological process=protein amino acid glycosylation
  Homolog annotation: Hit_ID=Q1SXJ8; Match level="QueryCoverage=62%, HitCoverage=65%, E-value=2e-11, Identity=38%"; Hit description=LGC1, related
MAATFKYLFPILFLTLIVKGSCECSINNINIGTTRSGRVIQGQPEWNVVVINNCTCTQSQIRLSCKGFKTSESVSPSILSIEGQSQRQVLAVKLSVLGLIFKATQVQGAQGCGGGSGGSCCRKEEE

SEQ ID NO: 218189 - protein, 74 aa, Glycine max
  Coding DNA Sequence Number=SeqID_101411
MALGIMAASPSKLRLTPKVLLEIAYQLLRSCSEQIKDWGWICNIHAQNSESFRRRDVIFRFILIMPHAKFNVIY

SEQ ID NO: 218190 - protein, 47 aa, Glycine max
  Coding DNA Sequence Number=SeqID_101412
  Homolog annotation: Hit_ID=Q9FGV1; Match level="QueryCoverage=54%, HitCoverage=3%, E-value=2e-08, Identity=100%"; Hit description=Auxin response factor 8
  Pfam annotation: Domain name=Auxin_resp; Domain location=3-46; Score=- 2.7; E_value=0.00033; Accession=PF06507.4; Description=Auxin response factor
MFDSKNKRIFISCFPWHIKYRYMGTITGISDLDSVRWPNSHWRSVKK

SEQ ID NO: 218191 - protein, 158 aa, Glycine max
  Coding DNA Sequence Number=SeqID_101413
  Subcellular localization annotation: CTP_CleavageSite=60; ConfidenceScore=5.16e-01
MQGTIWSRTFFHLLSSRGGGPNDMRGTIWSRTFFHLLSSRGGRPDDMRGTIWSRTFFQLLSSRGGGPDDIRGTIWSRTFFHLLSTRGGGPDDMRGNLLAPHFFTFGYVETRLTLSSAPFVIQGQRVGRWTKIPYGHPRLSSIERNEFGSIRMMLVVRC

SEQ ID NO: 218192 - protein, 84 aa, Glycine max
  Coding DNA Sequence Number=SeqID_101414
MTWKYDLLIDVGNALACACCVCSWGALCTDLSGSLALAFGHVHTLDVVYDRGGALCTDLPGSLALAFGHDHTSYEVYVMGGRVH

SEQ ID NO: 218193 - protein, 109 aa, Glycine max
  Coding DNA Sequence Number=SeqID_101415
MLKLGIPHKILTLTSQFGQSTILKCSSLVLEYTKISLSQPTLLRASEARLTGASSKGGKCAESPPMFICGKHWKNRRKPVMKNIPDSGVVFKFEEGISTSHVCPKRQQP

SEQ ID NO: 218194 - protein, 70 aa, Glycine max
  Coding DNA Sequence Number=SeqID_101416
MGTTKVITKCQEGGTPSSFTPPSIYRKIGEEFATQLVQASQVASYRSNRLLEEQSGRSKWVWLLFAPPFY

SEQ ID NO: 218195 - protein, 73 aa, Glycine max
  Coding DNA Sequence Number=SeqID_101417
MASDGDKCQLSVVFGIKLFIHDSKQSFKEGQNGHFMKVSDPKFAQASIWLAWAKEKTSAISKPLAWASSSSPG

SEQ ID NO: 218196 - protein, 131 aa, Glycine max
  Coding DNA Sequence Number=SeqID_101418
GSDEDITKGKDHEALEGPMTRGRLKQAQHVIETRNFWHLIKFGESFSLSSLLNQSQTYQGSHHSVPRASIIPYAIPRRIMMRATKANNKIGDKEWVVSFTGNKEDPTSSSSDSESTDDTHISPLYKHASST

SEQ ID NO: 218197 - protein, 108 aa, Glycine max
  Coding DNA Sequence Number=SeqID_101419
MRLLRLPSLELLIFQEAATPQRTPQTPKDPLLSWMELSFAQQVADPPTPVHERQAYPPTPIMEMPEDPTTPVLRLSSTLPATPVLHLIDEEDMQDQDTQGTQDQSQEF

SEQ ID NO: 218198 - protein, 331 aa, Glycine max
  Coding DNA Sequence Number=SeqID_101420
  Gene Ontology: Mol. function=protein serine/threonine kinase activity; Biological process=protein amino acid phosphorylation
  Homolog annotation: Hit_ID=Q7WRD6; Match level="QueryCoverage=54%, HitCoverage=43%, E-value=1e-50, Identity=57%"; Hit description =Putative membrane protein
LLQRLRRGHAVGSAGRQTGTAGQHKRGSEHIAEKANFHRLSAKGGIWRYAIVPQPDALGHFRQCPCVTDWIIFRLSAVNPFSRPLRSILNMSSSAGLHTPRSPFSGAAPLALRPLSAIAASAAGGVPEARIKRLLSDLLPSLMGLHAQGEICGDISLDTVGMDEGARAHLLPELALPRSRRTGLTPIPGFAPFELYTDSAEWPRGPWTDVYALSAVMHALVIGLRPPPAPERRATDSYEPLLSLGLTKYSPAFLGAIDRGLAMLPADRPQTLAELAAMLDIPAYAEAAPVAREASRADVAAPVAPAAQEVRKPRNAGRPLLVLLLLVALIG

SEQ ID NO: 218199 - protein, 276 aa, Glycine max
  Coding DNA Sequence Number=SeqID_101421
MKQEGKMRILELSHWDNATTLHTRTNTSYFYTKLPNLENWDVTKCNILPQLIYLKLIRMFWRNSEFLNNKAIVSKVLRMKKFNKSNLKVIKVMIDVAKKEVPQMDKEAINRKKKRKSNAQKQASPAPKKVKAPSKAVDKEWTPPFPPSSSSSKTTHDAPISPQRMHLLSIEQHPPLSIINLKKFKSTQKMKVPLTDDQRFPLAFILGSLQLIIDATTLVGSWNITMCLSINGGPEVAWRNLIRSKEHKSTQNGIPLDLFVKHKMDPSQEVQPPKVE

SEQ ID NO: 218200 - protein, 326 aa, Glycine max
  Coding DNA Sequence Number=SeqID_101422
  Gene Ontology: Mol. function=nucleic acid binding; Cellular component= chromatin; Biological process=DNA integration
MRRNHLESQIIGDPTKRVQTRSTLRSQGHTTLILEVEPKHIDEAMQDKNWVKAMQDELLVELPKDKKVVGAKWIFHNKLDENGKVMGNKARNMKLYQMDIQSAFLNGLILEEVYVEQPLGFESDTFCHMFSNLTKLCMGSRILLELEFEMSMMGELKFFLGLQIKQTRNGIYSHQTLYMKELLKKFNMDDAKVMKTPMHPTTYLELDEKSKKVDETQYKAMIDHFYTLQRYQKNQGKSIICCQTQFLDILLELLTLVYTLKLTSYYDADYVGDKLERKNTSESFHFIGGNLVTWICKKQGSSVLSATKAKYISTTSYCAQLLWIKN

SEQ ID NO: 218201 - protein, 138 aa, Glycine max
  Coding DNA Sequence Number=SeqID_101423
MSSMPSNPSFFIDAIKTRWEHDDMLYVDYFYGFLCCHHAPNPDIIVIPSKSYSLSADDVMSSTGSYSSSKDTKAISPTLTSPRWVLPESQVPPRVDLVDLVSKDEGEDLEEDTSFEKDPSMDKEDLVMDPKFMEEDSL

SEQ ID NO: 218202 - protein, 81 aa, Glycine max
  Coding DNA Sequence Number=SeqID_101424
MVRIAARLPWWHCRMKLPENAQQLPLADMDKSSEQAAATEPQSRRRRSNLAWEEEEEATGSFVNPNFFGEEEATLRVRENL

SEQ ID NO: 218203 - protein, 87 aa, Glycine max
  Coding DNA Sequence Number=SeqID_101425
  Homolog annotation: Hit_ID=Q1S3H4; Match level="QueryCoverage=65%, HitCoverage=13%, E-value=5e-08, Identity=40%"; Hit description =Integrase, catalytic region
MRIPNFYKKKTKKFHDSLIAKKDFVVGQKVLLYNSRLKLMSVEIKSESTDKSFKVNGHRLKPFLTNPFLMDVMVEETSLLHPTSLLP

SEQ ID NO: 218204 - protein, 165 aa, Glycine max
  Coding DNA Sequence Number=SeqID_101426
MSGKGLQHVRKSLSQYQRLRACLEIKWDTNWERGFVVYVKNSKTSTSLPSGTLERWQRHSKRHDFGYMAVVGAAGPLRLQVLHGGKQNVRVVAGWSSRRDEVVQAIAGALGFWRVRERVFTVRLYKLQNLRRCLMTSTLYVTISRTVYLQAPSFMTSIKTTTTGL

SEQ ID NO: 218205 - protein, 170 aa, Glycine max
  Coding DNA Sequence Number=SeqID_101427
  Gene Ontology: Mol. function=actin binding; Cellular component =cytoplasm; Biological process=cytoskeleton organization and biogenesis
  Pfam annotation: Domain name=Transposase_21; Domain location=77-170; Score=-24.4; E_value=1.6e-12; Accession=PF02992.5; Description =Transposase family tnp2
MKYQKIHACPNDGLLYRNEFEEMHNCPRCGVSRYKVKNDDEYNSDESTKKGPSAKVLWYLSIIPRFKCLFDNANDTKDLTWHADWRNCDGMLYHPDDSSQGKNINSRYPEFNKEARNLRLGLASDGMNLYDNLSNQHSSWLVLLVIYNLPPWLSMKQKYMMLSMVISSPR

SEQ ID NO: 218206 - protein, 272 aa, Glycine max
  Coding DNA Sequence Number=SeqID_101428
  Homolog annotation: Hit_ID=UPI0000E478AA; Match level="QueryCoverage =65%, HitCoverage=24%, E-value=6e-13, Identity=30%"; Hit description =PREDICTED: similar to cortical granule protein with LDL-receptor -like repeats
MDTLEPYTGAMKGTMHKPQVNLGEDKKFSPNRFPATRGLYILAFRGLKSSPSESYTSSTSEGYTSSPPEGCTSSALRGLHVLTFRGLHRATRPRLQRATRPRLQKFVHPLLQRVVRPRLERATRPRLQRAVRPPPSEGYKSSLSEGCTSSPSESYTPSPPEGYTSSAFRGLHVLAFRGLYIVAFEGLHVLTFRGLHVLAFRVLHVLAFRGLHILDFRGLHILAFRGMYVLAFRGLHVLASIGLYVLRLQRATCPHLQRAVRTCLRRATYPRL

SEQ ID NO: 218207 - protein, 140 aa, Glycine max
  Coding DNA Sequence Number=SeqID_101429
MCKIRMLRIRMLKIIMLKIRMFKITNNRMHRFTSYGMLRMIKRIAFFGRWRPQPAYGWLPRRRKFFSLISVLCPTSSICVQCYKYCLLSIGSLSAPLHLSKHTASVHLLSEKGTLSQKSLTCAKRSIRVLSAGARTRPPI

SEQ ID NO: 218208 - protein, 86 aa, Glycine max
  Coding DNA Sequence Number=SeqID_101430
MEFGVFLEEASACTRVWPWLEAFACLGSSRERKVQVPKSSEIFCCVKICRDASSKRKPFKELEMSLRFPDYGKLNPLLDLPYRYLM

SEQ ID NO: 218209 - protein, 254 aa, Glycine max
  Coding DNA Sequence Number=SeqID_101431
  Homolog annotation: Hit_ID=Q47522; Match level="QueryCoverage=14%, HitCoverage=44%, E-value=8e-14, Identity=100%"; Hit description=LacZ protein
DLPSQWLLFLSAVPPVQLLTGWCVTAKAPPDISAGKCSGRVPFAIQAAQLLGRAIGAGLFAITPAGERGMCCKAIKLDVSEDVRVYTENENKFKIEIPQEWQVGTRDGESSGFKSITAFYPTVGNKEWICGLLLNLVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 218210 - protein, 53 aa, Glycine max
  Coding DNA Sequence Number=SeqID_101432
VIQHLTFNVSTVLETTYFHIIPDISTDVETDIFYIVYQGMTDLEDVISTSVVG

SEQ ID NO: 218211 - protein, 52 aa, Glycine max
  Coding DNA Sequence Number=SeqID_101433
  Gene Ontology: Mol. function=electron carrier activity; Cellular component=integral to membrane; Biological process=cytochrome complex assembly
  Homolog annotation: Hit_ID=Q13LA1; Match level="QueryCoverage=93%, HitCoverage=8%, E-value=5e-17, Identity=78%"; Hit description =Putative transmembrane protein
NNYAIWNAFGNQYWPAHYFFDARGQLRYTAFGEGDYARQEQVIQQLLREART

SEQ ID NO: 218212 - protein, 490 aa, Glycine max
  Coding DNA Sequence Number=SeqID_101434
  Gene Ontology: Mol. function=pyridoxal phosphate binding; Cellular component=cellular_component; Biological process=amino acid and derivative metabolic process
  Homolog annotation: Hit_ID=Q9S0P8; Match level="QueryCoverage=99%, HitCoverage=100%, E-value=0.0, Identity=93%"; Hit description=L-2,4 -diaminobutyrate decarboxylase
  Pfam annotation: Domain name=Beta_elim_lyase; Domain location=115 -390; Score=-112.5; E_value=0.0039; Accession=PF01212.11; Description= Beta-eliminating lyase
  Pfam annotation: Domain name=Pyridoxal_deC; Domain location=45-417; Score=156.6; E_value=6.5e-44; Accession=PF00282.9; Description =Pyridoxal-dependent decarboxylase con
  Pfam module annotation: Pfam domain module=Beta_elim_lyase::Pyridoxal_ deC; Domain location=115-390::45-417
MSKLNPILAGSAASIDAYQQVISQASQAVAQWLQQPEMYQGKSVDELRERITLDFNEQGLGNQAAIERAIEYFLKDSLSVHHPQCVAHLHCPSLVISQAAEVLINATNQSMDSWDQSPSATIIEMKLIEWLRAQVGYPAGDAGVFTSGGTQSNLMGLMLARDAFFARQGHSIQQDGIPGDIRQYKVLCSENAHFSVQKNMALMGLGYRSVTLVKTDEFARMDVTDLKAKIAQAQANGEQIMAIVATAGTTDAGAIDPLRDIAGIAAEHQIWLHVDAAWGGALLLSEQYRDYLDGLELVDSVTLDFHKQFFQTISCGAFLLKDARHYELMRYQAAYLNSEFDEEHGVPNLVSKSLQTTRRFDALKLWMGLEALGKKQYASIIDHGVTMAKNVAEFVKSQPTLELVMQPQLASVLFRSRPAQMAGSDSAAIALLNQRVGDALLESGRANVGVTEHNGVTCLKLTLLNPVVTLDDVKVLLSLVERTAQELLAK

SEQ ID NO: 218213 - protein, 54 aa, Glycine max
  Coding DNA Sequence Number=SeqID_101435
MLTQEMEALEEDYGDGNGKNESRQYIEGSLQARALTAMCDLMQVMPRALQEDFK

SEQ ID NO: 218214 - protein, 98 aa, Glycine max
  Coding DNA Sequence Number=SeqID_101436
MATNLEKGEKEGEVGGSRWNRLPFLAMYSLSQSRCLLFTYSCWELDFGMEEVKRICQIIPVTSKVAFPGRFLLDRIQQNLRKWTIGMVDDGLNCLFCQ

SEQ ID NO: 218215 - protein, 183 aa, Glycine max
  Coding DNA Sequence Number=SeqID_101437
MRASGNRLPRGCNRLPGLEKGLEHCGGLWNGSLVIDYQIVMAAQLIRDRVEMECLEGAWETLEGNTRCRFRGTIRFTATSLVHPDEPARTLQLTVEWILPTPTPYRLVEPVQVIEVTSSEEDPEEDPKELPPEPAVDALDFLEGDEDPLLEVDSPEEVMSASEADSTEDSGPGEMAISGGSSS

SEQ ID NO: 218216 - protein, 211 aa, Glycine max
  Coding DNA Sequence Number=SeqID_101438
  Gene Ontology: Mol. function=protein binding; Cellular component =integral to membrane; Biological process=protein amino acid phosphorylation
  Homolog annotation: Hit_ID=Q1T2W9; Match level="QueryCoverage=98%, HitCoverage=20%, E-value=1e-67, Identity=61%"; Hit description =Leucine-rich repeat; Leucine-rich repeat, cysteine-containing type
  Pfam annotation: Domain name=LRR_1; Domain location=33-55; Score =17.1; E_value=0.062; Accession=PF00560.23; Description=Leucine Rich Repeat
  Pfam annotation: Domain name=LRR_1; Domain location=57-79; Score =13.7; E_value=0.7; Accession=PF00560.23; Description=Leucine Rich Repeat
  Pfam annotation: Domain name=LRR_1; Domain location=81-102; Score =8.2; E_value=8.3; Accession=PF00560.23; Description=Leucine Rich Repeat
  Pfam module annotation: Pfam domain module=LRR_1::LRR_1::LRR_1; Domain location=33-55::57-79::81-102
MELAKILTIFTSIDFSSNHFDGPIPEELMDWKELHVLNLSNNALSGKIPSSIGNMRQLESLDLSQNSLGGEIQVQLASLSFLSYLNLSFNHLMGKIPTSTQLQSFPASSFEGNDGLYGPPLTKNPDHKEQEVLPQQECGRLACTIDWNFISVELGLIFGHGVIFGPLLIWKQWRLWYWQLVHKILCQIFPQVYLEYVTWRGQTYEALRWRH

SEQ ID NO: 218217 - protein, 89 aa, Glycine max
  Coding DNA Sequence Number=SeqID_101439
  Subcellular localization annotation: CTP_CleavageSite=43; ConfidenceScore=5.25e-01
MAEIKEGSSTKPHGTLLLTYMCICVKIKGLRRVSSSSPSTVAAAAAVSSRTGSWAAEAPPPPEGKGWAPSQATCAWNSSMLMMDGKPKP

SEQ ID NO: 218218 - protein, 111 aa, Glycine max
  Coding DNA Sequence Number=SeqID_101440
MGLAKCGEAHGGIGAFPQDVETKGSAKSIYNGESVRLAAGVSLRKACVLSENNALSEALSPLSDAPSSLSGYSLTRAKLENGVKRAFEDRKPFLRLKLEKSSIRQREHELE

SEQ ID NO: 218219 - protein, 82 aa, Glycine max
  Coding DNA Sequence Number=SeqID_101441
MITEQGPIVGTTLGLEGRLIFMVIGAAHAMAGDGFNGATNVDNFLYGIPPYQTKQSVVSSMIALNSCSISFFNILYITLYPG

SEQ ID NO: 218220 - protein, 97 aa, Glycine max
  Coding DNA Sequence Number=SeqID_101442
MNQGDVKNARTRRPRSIVEEEQWFLNDTMKGQPMEKKPPTRSHKRRQQKEEIHAKAQILLLVWEDFELDGLLLDDAYVPTVVVSILPVEFASQDQLS

SEQ ID NO: 218221 - protein, 124 aa, Glycine max
  Coding DNA Sequence Number=SeqID_101443
MEEPEEGGATEIGINQDYVEDITTAQGTWDPWPTSAQDAPTPPQDDPAPAQEDCYRRALYSLRKICPKFGGVCLGDLCCRNESNSYIESEICRPKKRRCKNLLLNSLSEVDWLSEPQPLSEAAS

SEQ ID NO: 218222 - protein, 107 aa, Glycine max
  Coding DNA Sequence Number=SeqID_101444
  Gene Ontology: Mol. function=nucleic acid binding; Cellular component= nucleus; Biological process=DNA integration
MKSSETQDMELEKLNVKTTFLNESLEEDILMQQLEGFEVQGKVEDGSHIYMLLYMDDILIASQDKSEILNLKSLLSSEVEMKDIGVVEKFLGMEIKRDPVQKKIFLC

SEQ ID NO: 218223 - protein, 88 aa, Glycine max
  Coding DNA Sequence Number=SeqID_101445
MQLRSSSHRANIQIVCRPKKRRCKKLLMNSLSKVDWLSEPHPLSEAASSLSGWETLEEDKSEICTLSAQSAHPARTLSLLALSVSKLA

SEQ ID NO: 218224 - protein, 82 aa, Glycine max
  Coding DNA Sequence Number=SeqID_101446
  Subcellular localization annotation: CTP_CleavageSite=37; ConfidenceScore=5.26e-01
MDIFRKNLLPETFRMSFFRKYFLSTSENQKFFFRKISGKRFSGMFPEKIFFRKMNCLRTVSPLHCLLDAPTIMLGARSNSLI

SEQ ID NO: 218225 - protein, 36 aa, Glycine max
  Coding DNA Sequence Number=SeqID_101447
MAREVVVNGEDEQCKLGNVTVSHSKTIIITALECTT

SEQ ID NO: 218226 - protein, 102 aa, Glycine max
  Coding DNA Sequence Number=SeqID_101448
  Gene Ontology: Mol. function=tyrosine decarboxylase activity; Cellular component=membrane
  Homolog annotation: Hit_ID=Q9FNH8; Match level="QueryCoverage=76%, HitCoverage=36%, E-value=6e-27, Identity=74%"; Hit description =Lysine decarboxylase-like protein
MDTQSEMRHSKFKRICGFYGSSPDKKSTYQDAAIELGNELVSRNIDLVYGGGSIGLMGLVSQDVHDGGHHVIGVIPKTLMPREVCICASATKKSLNLFFFKL

SEQ ID NO: 218227 - protein, 89 aa, Glycine max
  Coding DNA Sequence Number=SeqID_101449
MALPEVVKWLKELHFEKVIIEGALFYVKSMPCRTQTAIANGEFGVSEQLAYGTGDTASPAMAVQQRVSQGQIANGNGDLPCPRIASMAG

SEQ ID NO: 218228 - protein, 67 aa, Glycine max
  Coding DNA Sequence Number=SeqID_101450
MQIAALIDVFVLDATAGHGVVSFNGVLQELGLASLTGELRKFAGGTTFSQMKAPVLLAICAAVGSSQ

SEQ ID NO: 218229 - protein, 93 aa, Glycine max
  Coding DNA Sequence Number=SeqID_101451
MGCFCYYFRQGALFYVKSMPCSTQTAIANGEFGVKAIGNRQSNWRVPWSDAAATSQALFQCRLGCRSFKGELQLPLASCLEVATPIGDLGHKK

SEQ ID NO: 218230 - protein, 64 aa, Glycine max
  Coding DNA Sequence Number=SeqID_101452
MVQCGNWLRRENGGSGSMDMEIPCIKSLPGVATVQGTRACWGQWLDESGKPLLSSKGHHWIFVD

SEQ ID NO: 218231 - protein, 151 aa, Glycine max
  Coding DNA Sequence Number=SeqID_101453
MASRKRKSTISRPWEPYDTTRFILEGAWERYSQNVHSHRGTSFFMKLDGHIDVALVKEFYSNLYYPEDKSPKQVRVRGKLIKFDAESLNTFLETPVILEHGEQYTTYTRFYHSRLDPQEFAAKLCIPGRGFVLNAEGAPWKLLRKDLTTLA

SEQ ID NO: 218232 - protein, 184 aa, Glycine max
  Coding DNA Sequence Number=SeqID_101454
LSDIDATFFVNQGSFGMGFCMRDHGGRLINAYSDFKPIIRPSIQEGEALALKEALLWLRDCGVEAITIESNQIVPRDCPKLKKSGEGATRSTNEVEIDDSDYYSEGDVLYGSCSNFGSVYNGNDKACVVVGMGRMQIAMDDGGVRMLCEAHNTRLGECGSPGNLQKKFEDDPMVNESGRAILLK

SEQ ID NO: 218233 - protein, 89 aa, Glycine max
  Coding DNA Sequence Number=SeqID_101455
  Subcellular localization annotation: CTP_CleavageSite=53; ConfidenceScore=5.28e-01
MYEKKHPFKESPHRMLDFFAIQAMDYGGKAVIGGTSSTSSSSSLSSSSLKGPSSSLAKPGSVVNLGSFGRVDEVGSTVEYSNMGVVDPQ

SEQ ID NO: 218234 - protein, 64 aa, Glycine max
  Coding DNA Sequence Number=SeqID_101456
MVIFYHGDAAEDKGEERGSFNGSPSLPLPPLIFSYLQVMPPSLQTLAQAIGNENRGEATGAVEY

SEQ ID NO: 218235 - protein, 86 aa, Glycine max
  Coding DNA Sequence Number=SeqID_101457
MRVRDLFMHREGDCPCSYVSLGGMRNSDLRNSSKEKWHLGAMAARPSKLMLTPEVIGSHKRATARPGELVPSALSNLGAQACQRLA

SEQ ID NO: 218236 - protein, 165 aa, Glycine max
  Coding DNA Sequence Number=SeqID_101458
  Gene Ontology: Mol. function=catalytic activity; Biological process =metabolic process
  Homolog annotation: Hit_ID=Q9FDB0; Match level="QueryCoverage=83%, HitCoverage=6%, E-value=7e-32, Identity=50%"; Hit description=Six -domain nonribosomal peptide synthetase
MGGRRWALVIKRRQIFHQQAKAHGIAGDHIEIDMQAAAPFRQQAQADIAGHTLFQRQQLGTFCLAFGGERGCQRRCIGVPPVVEMQGVPGAGRRDRLPAIIGNAQAQQRMMQLAAVEFRIQVGGHAAEGRSGLSAYPIGGLHRGQSFHRVLFIRGFSDAGQIGLW

SEQ ID NO: 218237 - protein, 178 aa, Glycine max
  Coding DNA Sequence Number=SeqID_101459
  Gene Ontology: Mol. function=chitin binding; Cellular component =extracellular region; Biological process=chitin metabolic process
  Homolog annotation: Hit_ID=UPI000065F7CF; Match level="QueryCoverage =63%, HitCoverage=16%, E-value=6e-07, Identity=35%"; Hit description =Homolog of Homo sapiens "Leucine-rich repeats and IQ motif containing 1
LPSPLRGLHVLALRGLHVLTIRGLHALTIRGLHVLALRGLHALTLVTLTVERTTRPRLERTTRPHHQRAARPHLQRTTCPRLERATRPHLGYSLPSPLRGLHVLALRGLHVLTIRALHVLTFRGLHVLAIRGLHVPHFQRGACPHLQRIAHPCHHRTTLPRLRKATRPELQRATRPRL

SEQ ID NO: 218238 - protein, 84 aa, Glycine max
  Coding DNA Sequence Number=SeqID_101460
  Subcellular localization annotation: CTP_CleavageSite=60; ConfidenceScore=5.25e-01
MYLSQPTLLRASEARLTDASSKGRKCSKSPPTFIERKTSTKAGLLLLRTLRRRGNQTYVVLANGANQVILFYLEGSHLRRWTLK

SEQ ID NO: 218239 - protein, 53 aa, Glycine max
  Coding DNA Sequence Number=SeqID_101461
  Subcellular localization annotation: CTP_CleavageSite=41; ConfidenceScore=5.23e-01
MDSGRFQVSVPGNSYPMVLGASSPLYLSKSSTLNLGGVMILGSRNNSFGLAKA

SEQ ID NO: 218240 - protein, 78 aa, Glycine max
  Coding DNA Sequence Number=SeqID_101462
MGLRIRFDGGGCTNSARKSIRGALDSMAINLWGSGLDGGGCMNGNQFMGLQIRFDGGGCTNNVRQSIRGAPDSMVEDA

SEQ ID NO: 218241 - protein, 160 aa, Glycine max
  Coding DNA Sequence Number=SeqID_101463
  Gene Ontology: Mol. function=pyridoxal phosphate binding; Biological process=metabolic process
  Homolog annotation: Hit_ID=Q7CK24; Match level="QueryCoverage=91%, HitCoverage=42%, E-value=2e-51, Identity=63%"; Hit description =Putative cysteine synthase
MSAGTGGTSATLGRYIRYQGHDTRLLVVDPQHSVFFDYWHSRDRTLRSERGSLIEGIGRPRVEPSFLPDVIDEMMKVPDGATVAAMLRLEQILGRRPGASTGTNFWGMLQVAKRLRAQGQSAALVTLLCDSGERYPDTYYNPQWIAEQIGDIQAWQRELQ

SEQ ID NO: 218242 - protein, 87 aa, Glycine max
  Coding DNA Sequence Number=SeqID_101464
MWKRIMRVELVLWMRWWLRNDELLKPKRRRMNPYVSLTILPFEGVFKKIAIYGSRFDEEMNEIGRFGGLGMEERRKGEGTAQGILKT

SEQ ID NO: 218243 - protein, 336 aa, Glycine max
  Coding DNA Sequence Number=SeqID_101465
  Gene Ontology: Mol. function=transferase activity; Biological process= fatty acid biosynthetic process
  Homolog annotation: Hit_ID=Q6CYL3; Match level="QueryCoverage=93%, HitCoverage=82%, E-value=1e-79, Identity=49%"; Hit description =Putative beta-ketoacyl synthase
  Pfam annotation: Domain name=ACP_syn_III; Domain location=137-201; Score=-20.8; E_value=0.088; Accession=PF08545.1; Description=3 -Oxoacyl-[acyl-carrier-protein (ACP)
  Pfam annotation: Domain name=Ketoacyl-synt_C; Domain location=220 -331; Score=111.0; E_value=3.4e-30; Accession=PF02801.12; Description= Beta-ketoacyl synthase, C-terminal do
  Pfam annotation: Domain name=Thiolase_N; Domain location=26-287; Score=-168.2; E_value=0.057; Accession=PF00108.13; Description =Thiolase, N-terminal domain
  Pfam annotation: Domain name=ketoacyl-synt; Domain location=17-218; Score=7.9; E_value=4.3e-08; Accession=PF00109.16; Description=Beta -ketoacyl synthase, N-terminal domain
  Pfam module annotation: Pfam domain module=ACP_syn_III::Ketoacyl-synt_ C::Thiolase_N::ketoacyl-synt; Domain location=137-201::220-331::26 -287::17-218
MVNALGSSLAQIAAQLQQGTAPGMQPRDGWLAQGKRCWLGEVPGALPPVPAELAAHDTRNNRLLLAALQQCQPALDEAITRYGRARVAIVLGTSTSGVDEGDRQTDGGHAGYDYRMQELGDPSRFLAHYLQLDGPAYTISTACSSSARAIISGARLIAAGLADVALVGGADSLSRMPINGFASLDSLSEHHCAPFSAGRDGISIGEAAALLLLTREPQPLALLGCGESSDAWHMSAPHPQGVGAEAAMRMALQQAGLQPHEVGYINLHGTATPLNDQVEAAVIHRLFGDAVPCSSTKHLTGHTLGAAGATEAALAALIIQQQLSLPPQDFSHATQD

SEQ ID NO: 218244 - protein, 118 aa, Glycine max
  Coding DNA Sequence Number=SeqID_101466
  Gene Ontology: Mol. function=phospho-N-acetylmuramoyl-pentapeptide -transferase activity
  Homolog annotation: Hit_ID=Q8X6L1; Match level="QueryCoverage=98%, HitCoverage=60%, E-value=2e-41, Identity=67%"; Hit description=No significant matches
AAVAVRAREEQNPVIAGAAQRGCAADLAGRAVVAWHPAIPRHLRSTGDSYPADDGAARPAASQPGAGRYYAELLAGQRVAAAIAVRLDATRCGRPARIARCLRPVDQPDSLSAARGTA

SEQ ID NO: 218245 - protein, 214 aa, Glycine max
  Coding DNA Sequence Number=SeqID_101467
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSLVAWLRETTGAVAKASLHRAIVTAYGPEPGSEPTDVEESADELWLGVKCHSNPELAGSPRNALRRSS

SEQ ID NO: 218246 - protein, 101 aa, Glycine max
  Coding DNA Sequence Number=SeqID_101468
  Subcellular localization annotation: CTP_CleavageSite=55; ConfidenceScore=5.49e-01
MENFAKVSTVLRRSSFVFHRSSIFNGLSSLVTDAWGANTFPVRKYNSRTFHLKVRRSRLFRFFRRFPQINVGGDSARIPFVEHASRESRVALPPKGRLRQT

SEQ ID NO: 218247 - protein, 75 aa, Glycine max
  Coding DNA Sequence Number=SeqID_101469
MTDRGLKKNLHKIMRIELFLTDIMQISFTDWIENSIADIRREVAPLKAQVEKDEGPSGEGQSPQVEKDEGSSGEG

SEQ ID NO: 218248 - protein, 109 aa, Glycine max
  Coding DNA Sequence Number=SeqID_101470
MEVPRPDKPNWPMMHVLPFPKRITPKTGLPGPSLGISRSWPLRALQLGVKERMGNKNKNVKRKGRAQAWNAERSVLRRGVHSPLAWISIYRCRNGLWAFEGVLSATPRA

SEQ ID NO: 218249 - protein, 83 aa, Glycine max
  Coding DNA Sequence Number=SeqID_101471
MRTRSLLKARACNPLMARTYSPLKVIGTSSQGSTFMRKQEIDSSRGPIDCPFEKGDNSCNLILSFANLSGNSLRVYVLFDLVT

SEQ ID NO: 218250 - protein, 224 aa, Glycine max
  Coding DNA Sequence Number=SeqID_101472
  Pfam annotation: Domain name=G-patch; Domain location=111-155; Score =27.4; E_value=4.9e-05; Accession=PF01585.13; Description=G-patch domain
VACLHPPDLPIQPMNIKGKAKVVEEQDDKTPLTPNEDIPVKGLLEKRDGYGKKEVSLEEASEFLRIIQQSEFKVIEQFNKTFGGSRSLYAPPEIEVRSGRAFGYRIGRGINLVMVARVMLGNGYEPEMGLGKDNGGITSLISAKGNRGKFGLGYKPTQADIRKSIAGRKSGRAISAGLGDEGQVVAICEYDASSGSGLVRPCPPDFRLGNWRVEERPDIYATSI

SEQ ID NO: 218251 - protein, 86 aa, Glycine max
  Coding DNA Sequence Number=SeqID_101473
  Gene Ontology: Mol. function=nucleic acid binding; Biological process= RNA-dependent DNA replication
MGNQNKGKVVGAIEYQGLDRFQRNNLPTFNGRYNPDGAQNWIREIGKIFRVKVCPKGPKVPLGTYISVEEAKYWWDNPHQCLEAAG

SEQ ID NO: 218252 - protein, 132 aa, Glycine max
  Coding DNA Sequence Number=SeqID_101474
MEVEVVRMAPEYRNFDNPFLALQNELESLAAELEADPGLQLHSKDSSYKQIKIYIQQCHEFVNIAFKNSSKYGISGKINQSLLKIRQQIERINEIIKLLVINGDEDVIIKSKQLMFNILRNKAAGDDCCNYD

SEQ ID NO: 218253 - protein, 101 aa, Glycine max
  Coding DNA Sequence Number=SeqID_101475
MSHAVKDHRGKWAPNYEGPFVVKRAFSGGALGQDHLGLPSGVETKHERQKPIKVLKDERKWGWGHDRPIVALLCAKQAENVAARQPRILCILQLSFTFCLF

SEQ ID NO: 218254 - protein, 287 aa, Glycine max
  Coding DNA Sequence Number=SeqID_101476
MASQENWGPFVDILALLIFGLVLFPNVAGLVDLAAIDAFLAYHHSKESPVLSVCGWFHTYSNKTQDTRVRFKVIAHAPKKEESIGTTFGWDRRHAINWFPRWKEGKEGVLSRIRRAKSQGDTKSPQGVERSVEEDKELRGIRWRHRWLSWMAKCSHAREDEEIQALKLELGKARLAKEKFKSAATHIRKEYTELQEENAATARALEQETKRARKEEHGRNKFRGALWGSNNELTLRREERDRSWVHGMILKEELAACARSKRSLAQHLEATEQSMLAIIGQYKEELN

SEQ ID NO: 218255 - protein, 133 aa, Glycine max
  Coding DNA Sequence Number=SeqID_101477
  Gene Ontology: Mol. function=nucleic acid binding
  Homolog annotation: Hit_ID=Q94HV4; Match level="QueryCoverage=38%, HitCoverage=3%, E-value=2e-11, Identity=61%"; Hit description =Putative retroelement
MGLFREPRGLPPKREQEHAIHLVEGHGPVNVRPYRYPHHHKDEIEKQTKVEVVQRDLMEKDECLRQLNISYFSSQEGCGNYRVEKELPKELENEPSTKWEPIQVLASRVVSARRDSVQHFLIQWKHKLVEEAT

SEQ ID NO: 218256 - protein, 300 aa, Glycine max
  Coding DNA Sequence Number=SeqID_101478
  Homolog annotation: Hit_ID=Q47522; Match level="QueryCoverage=19%, HitCoverage=77%, E-value=5e-19, Identity=74%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDHGLVQIGAFQAFAVDPDDVARALQRLRRHLVLRGDAGEVDRAQLLVQALAVTGQRADHDRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 218257 - protein, 215 aa, Glycine max
  Coding DNA Sequence Number=SeqID_101479
MTMLDESMGCMLGQHDDFKKRERVVYYLSKKFTTCEMNYSLLERTCCALVWASHRLRQYMLSHTTWLVSKMDPVKYIFRSPLLWGGSLGGRSVKVDVSLRELNALSECHPLSKASTRLADRRNLKGNLSHRHALSASLARSTSRLSPSRLSASLALSENSLTRAKCENGAKHDVEVSKPFLKPGITEREERALNSRKSLKSEIHRGKEQSKEAKF

SEQ ID NO: 218258 - protein, 69 aa, Glycine max
  Coding DNA Sequence Number=SeqID_101480
MRVHIIWYQSLMMRSMRGWIKWRIEIIMKKKGGEEGMMVFLDKTELMVLNSTFLHLKERIIRRPTWSGR

SEQ ID NO: 218259 - protein, 131 aa, Glycine max
  Coding DNA Sequence Number=SeqID_101481
  Gene Ontology: Mol. function=nucleic acid binding; Biological process= DNA integration
MQEKFIACFFFGTHAIWLRNLMIGLHIVNYIARPLKIFWDSNASMFYTKNNKIYRGSKHLDLKYLTVKDLVKDGSIVVDHVNTDSMLADPLTKGLSLLFLDDMLKKWALLLKLGAIRITMSVVNTRIGAEA

SEQ ID NO: 218260 - protein, 82 aa, Glycine max
  Coding DNA Sequence Number=SeqID_101482
DAGVGATEVEGSSDGLALTFLAPRIETVNDRAQALEGKAVRDNPSGFANNAVIRAGNPSLEVLDWAIEVIWPEISAPMFISK

SEQ ID NO: 218261 - protein, 142 aa, Glycine max
  Coding DNA Sequence Number=SeqID_101483
MASRKRKSIGTRPTSQYDTRRFSSLDAWTRYTDNFLGRNILPERKAELERCNFHKRLTNLADWSIDLAFVKEFYANLYSSEDRPPKQFRVRGHLVKIDADNLNTFLETPVVLGEGKTLPAYSRYCKLPTNFREIEDALCIPG

SEQ ID NO: 218262 - protein, 82 aa, Glycine max
  Coding DNA Sequence Number=SeqID_101484
MGEVVTTQLSQASSARPGELDYATIPSSASGMLRNFTDWAIMIPFDSRHVAELHGLLNDGCQVPRSGQAKVACHQTMVPGQN

SEQ ID NO: 218263 - protein, 86 aa, Glycine max
  Coding DNA Sequence Number=SeqID_101485
MYETKGVEPDLKETLKVHTCTFEKKTHSTRRSWKTPKANSDSRVHVMLVAHAKLLRIPLNPMVAFASGSARVIKFQWDQQTHGITL

SEQ ID NO: 218264 - protein, 59 aa, Glycine max
  Coding DNA Sequence Number=SeqID_101486
MEEKMLSDIIRIFEVPRKLSLFFQRNRIERSVTALLLCLQEVKLIFKGGPERDRVIQKY

SEQ ID NO: 218265 - protein, 253 aa, Glycine max
  Coding DNA Sequence Number=SeqID_101487
  Homolog annotation: Hit_ID=Q2R3L0; Match level="QueryCoverage=90%, HitCoverage=51%, E-value=3e-29, Identity=34%"; Hit description =Expressed protein
MGCFVSTPKDSGGNRRRPGSIGEVSVYVPGLRIPKPVDFAQSLGDYLSKNIVERLSALRTRIVVMAGQEGPTITRTKRKSATQHGGSTLADLQQALEDYLPVLLGLVENGSHLQYKVQFDWVNQEDDTEETTMSNAWYEVLSVLHLMAMLLLSQANLLLLPRTSTDSHQPKVSEESRRASVDIFLKAAGYLDCAVRHVLPQLPGELRRNLPVDLTEGVLRALCLQALGQQMINRFSLLGFIYVFTIKLGMDEA

SEQ ID NO: 218266 - protein, 1054 aa, Glycine max
  Coding DNA Sequence Number=SeqID_101488
  Gene Ontology: Mol. function=RNA-directed DNA polymerase activity; Cellular component=chromatin; Biological process=chromatin assembly or disassembly
  Pfam annotation: Domain name=Chromo; Domain location=929-977; Score =11.9; E_value=0.038; Accession=PF00385.14; Description='chromo' (CHRromatin Organisation MOdifier
  Pfam annotation: Domain name=rve; Domain location=680-809; Score =35.1; E_value=2.4e-07; Accession=PF00665.16; Description=Integrase core domain
  Pfam module annotation: Pfam domain module=Chromo::RVT_1::rve; Domain location=929-977::214-418::680-809
MAFRREKGLCYNCDDKWSPNHRCKGRILLFIADDLPPDDDDPGSVTTNSGLEGNGGDSEPAIDTSFPHANLHAMFGLPSSETFRIYGTIKNARLTILIDSGSTHNFLQPRVAQFLHLPVETTQPLRVLVGNGSVLDCNQRCTDTQLSIQGHSFPVHPFGLRNIPASRCSYWTRTCFSNPTSTVSHLPPLAEPVERLLRRYDKLFQSPTHLPPSREVNYHITLLHSMAPVNVRPYRYPHFQKTEIEKQVFELLSAGLIRTSTSPYSSPVFLVKKKDGTWRLCVDYRSLNTVTIRDRFPIPTIDELLDELGHALWFSKLDLRTHHGHYEYLVMPFGLCNAPLTFQAAMNHLLASFLRRFAAVFFDNILVYSDSLSSHLEYLRHVVFGKGVAPEPSKIQAIIQWPAPTSAKELRAFLGLTGFYRKFIQKYAAIATPFTNLLCKDAFEWSLESQTAFEKLKSAMTTAPVLALPNFNEPFTVETDASGSTMGVVLMQQGHPLAFFSKNFNPHLLHASTYVRELHAIIAAVIHTPKQHYYLSKLLGFDYKAGATNIVAEALSRRPPDSGQLLLLSVPQMDFMSDIQQTLENDPSFQELVRNIKVNPSAYPQFRLSKGYLLFNGRIWLNKTNPYIPSLLLEFHATPLGGHLGIAKTTHCLESSFFWEGMKHDSSTRHMEGLLQPLPVPTGVWEDISRDFITHLPPSNDFTVILVVVDRYSKGMHLGALPTGFSAFKVATVFIDIICKHHGFPKSIVSDRDPSDGQTEVMNRALEQYLRCFVHSQPPTWFRYLSLAEWCYNTSLHSSSGLTPFEVIYGKPSPSIPQYIPGLTNNEVVESLVASRQAMNAKLQKTLKKAQGSMKKYADAQREDITFFVGQWVYVKLRPTREVAYRLELPAEARIHPVFHCSLLRHYHGAPPSATEPWPLEIIGHKPLQRPLCILDNKLDTSTSLPTQLVLTQWAGQPPEDTSWESWPELQEAYHLEDKVVSGGGGIVSTHNTHAASDEDERRPPAVATTRPTRAITKPRGALPRIWATTSLPSLTCATIKPQVSTCATIKPQQ

SEQ ID NO: 218267 - protein, 64 aa, Glycine max
  Coding DNA Sequence Number=SeqID_101489
MGYELGQKRMRITWGKQRRNIWSGPRTDPTEIGYLTFTDAQDVARCTGHIACAPSIATKFQKYP

SEQ ID NO: 218268 - protein, 97 aa, Glycine max
  Coding DNA Sequence Number=SeqID_101490
MEVDEPWLGLWLPLNYQVVFVIGSAVDRLCGRFRDGLCGYLGGGNGSHNMGFSLILTLFICPSFLSRPSRMIKFASFRTHIDPFTGEDQIRKAFESA

SEQ ID NO: 218269 - protein, 110 aa, Glycine max
  Coding DNA Sequence Number=SeqID_101491
MSEIQQLQEQMKVDMEIMKELMTTMMEAMMSMRKTIEDNTATVVAMSTAIKMDPIHPVDFNQVNHPVSDVVGQGGEATKNACGPHHVQIQRKHSFLLYGLPLNYTLPTVV

SEQ ID NO: 218270 - protein, 353 aa, Glycine max
  Coding DNA Sequence Number=SeqID_101492
MASYGVASPLSFPFSIPLPFIFQEAKESIDEEDPRLTSSNGACITFDVTLDKAKLIYGIIMKMDMNVGYLISHQISITAQHDTSRLGFLTLIIVLCKARGVQPDSRSLENLSLAINLAYIKKNCWNLDDPTVTFRGPRKARGKRSEVPTTSAAPETPTPSSSIALVPPIQTPVIPSTIPPTSTQIQLLAPLSAGLSDFSFTPQMLHFMLQSLHRGQSIIMQSLQGLGLPSIISMDEFDAQVAWPGVQPSPSRGGGASAAQELEPEEPAAATTEGEDELTPPEPFYFDTGVHMAQEEETSTDQILEPSPTPIPDDAIPSAPASELEQPISQDSPAAQVLDLNEHAQEQPQEQDI

SEQ ID NO: 218271 - protein, 89 aa, Glycine max
  Coding DNA Sequence Number=SeqID_101493
MAEATIIKISPKAENNKPKQKNWAILDMERTSRSTKLKGIKSDIKPETTVPYAYSPEIPTHGGGRLTHGGQKSPHDSGDKKNKGVLLRA

SEQ ID NO: 218272 - protein, 310 aa, Glycine max
  Coding DNA Sequence Number=SeqID_101494
  Gene Ontology: Mol. function=zinc ion binding; Cellular component =nucleus; Biological process=regulation of transcription
  Homolog annotation: Hit_ID=Q0GLD3; Match level="QueryCoverage=50%, HitCoverage=100%, E-value=2e-62, Identity=77%"; Hit description=Dof19
  Pfam annotation: Domain name=zf-Dof; Domain location=40-102; Score =139.0; E_value=1.3e-38; Accession=PF02701.6; Description=Dof domain, zinc finger
MDTAQWPQEMVVKPIEDIVVTNTTCTKAAVGSVERKPRPQKEQAINCPRCHSINTKFCYYNNYSLTQPRYFCKTCRRYWTEGGTLRNIPVGGGSRKNKRSSASCSNNSHHNDNNSTNKKLSADLVITPPTLSHTTQNPKSNDNSIIHQGQDLNLAFPSTTTTTSDFRKISELVQQNNNNNSSNNSMSASSSTTTTTTSTSHHLSALELLTGITSSSSTGLSTSFMPIPVPSNPNSIYTCGFPLQDFKPGTLNFSLDGIGKGYTSLQNVHGGRLLFPFEDLKQVSSTTTMNQTQQGDSTGYWTGMLGGGSW

SEQ ID NO: 218273 - protein, 68 aa, Glycine max
  Coding DNA Sequence Number=SeqID_101495
MDSTKKNARHDNSPCNSGIPAGLPHLGPCSRKKISYGDGDGDEKLPAVNSGTSTMLLAPQDSRIPAYI

SEQ ID NO: 218274 - protein, 960 aa, Glycine max
  Coding DNA Sequence Number=SeqID_101496
  Gene Ontology: Mol. function=protein serine/threonine kinase activity; Cellular component=integral to membrane; Biological process=protein amino acid phosphorylation
  Homolog annotation: Hit_ID=Q9FGN6; Match level="QueryCoverage=96%, HitCoverage=98%, E-value=0.0, Identity=53%"; Hit description =Receptor protein kinase-like
  Pfam annotation: Domain name=LRRNT_2; Domain location=27-74; Score =26.7; E_value=8.2e-05; Accession=PF08263.3; Description=Leucine rich repeat N-terminal domain
  Pfam annotation: Domain name=LRR_1; Domain location=104-126; Score =18.5; E_value=0.024; Accession=PF00560.23; Description=Leucine Rich Repeat
  Pfam annotation: Domain name=LRR_1; Domain location=128-150; Score =16.4; E_value=0.11; Accession=PF00560.23; Description=Leucine Rich Repeat
  Pfam annotation: Domain name=LRR_1; Domain location=152-174; Score =12.2; E_value=1.5; Accession=PF00560.23; Description=Leucine Rich Repeat
  Pfam annotation: Domain name=LRR_1; Domain location=176-198; Score =9.2; E_value=5.4; Accession=PF00560.23; Description=Leucine Rich Repeat
  Pfam annotation: Domain name=LRR_1; Domain location=200-222; Score =19.9; E_value=0.0092; Accession=PF00560.23; Description=Leucine Rich Repeat
  Pfam annotation: Domain name=LRR_1; Domain location=224-246; Score =5.7; E_value=24; Accession=PF00560.23; Description=Leucine Rich Repeat
  Pfam annotation: Domain name=LRR_1; Domain location=248-270; Score =15.1; E_value=0.25; Accession=PF00560.23; Description=Leucine Rich Repeat
  Pfam annotation: Domain name=LRR_1; Domain location=272-291; Score =10.0; E_value=3.8; Accession=PF00560.23; Description=Leucine Rich Repeat
  Pfam annotation: Domain name=LRR_1; Domain location=296-318; Score =13.6; E_value=0.73; Accession=PF00560.23; Description=Leucine Rich Repeat
  Pfam annotation: Domain name=LRR_1; Domain location=320-342; Score =7.6; E_value=11; Accession=PF00560.23; Description=Leucine Rich Repeat
  Pfam annotation: Domain name=LRR_1; Domain location=344-366; Score =13.1; E_value=0.99; Accession=PF00560.23; Description=Leucine Rich Repeat
  Pfam annotation: Domain name=LRR_1; Domain location=368-390; Score =7.0; E_value=14; Accession=PF00560.23; Description=Leucine Rich Repeat
  Pfam annotation: Domain name=LRR_1; Domain location=392-413; Score =4.2; E_value=46; Accession=PF00560.23; Description=Leucine Rich Repeat
  Pfam annotation: Domain name=LRR_1; Domain location=415-437; Score =12.0; E_value=1.6; Accession=PF00560.23; Description=Leucine Rich Repeat
  Pfam annotation: Domain name=LRR_1; Domain location=439-461; Score =5.8; E_value=24; Accession=PF00560.23; Description=Leucine Rich Repeat
  Pfam annotation: Domain name=LRR_1; Domain location=463-486; Score =6.4; E_value=18; Accession=PF00560.23; Description=Leucine Rich Repeat
  Pfam annotation: Domain name=LRR_1; Domain location=488-509; Score =4.7; E_value=38; Accession=PF00560.23; Description=Leucine Rich Repeat
  Pfam annotation: Domain name=LRR_1; Domain location=511-533; Score =12.4; E_value=1.3; Accession=PF00560.23; Description=Leucine Rich Repeat
  Pfam annotation: Domain name=LRR_1; Domain location=535-557; Score =15.9; E_value=0.14; Accession=PF00560.23; Description=Leucine Rich Repeat
  Pfam annotation: Domain name=LRR_1; Domain location=559-581; Score =4.9; E_value=34; Accession=PF00560.23; Description=Leucine Rich Repeat
  Pfam annotation: Domain name=LRR_1; Domain location=583-606; Score =13.7; E_value=0.68; Accession=PF00560.23; Description=Leucine Rich Repeat
  Pfam annotation: Domain name=Pkinase; Domain location=684-944; Score=- 46.0; E_value=8e-06; Accession=PF00069.15; Description=Protein kinase domain
  Pfam annotation: Domain name=Pkinase_Tyr; Domain location=706-944; Score=-105.1; E_value=5e-06; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=27-74::104-126::128-150::152-174::176-198::200-222::224 -246::248-270::272-291::296-318::320-342::344-366::368-390::392 -413::415-437::439-461::...
  Pfam module annotation: Domain location=463-486::488-509::511 -533::535-557::559-581::583-606::684-944::706-944
MEIFKCFYIKNLILVTFFMVSSAVLAIDPYSEALLSLKSELVDDDNSLHNWVVPSGGKLTGKSYACSWSGIKCNNDSTIVTSIDLSMKKLGGVVSGKQFIIFTNLTSLNLSHNFFSGQLPAEIFNLTSLTSLDISRNNFSGPFPGGIPRLQNLVVLDAFSNSFSGPLPAEFSQLENLKVLNLAGSYFRGSIPPEYGSFKSLEFLHLAGNSLTGSIPPELGHLKTVTHMEIGYNEYQGFIPPELGNMSQLQYLDIAGANLSGPIPKQLSNLTSLQSIFLFRNQLTGSIPSELSIIEPLTDLDLSDNFLIGSIPESFSELENLRLLSVMYNDMSGTVPESIAKLPSLETLLIWNNRFSGSLPPSLGRNSKLKWVDASTNDLVGSIPPDICASGELFKLILFSNKFTGGLSSISNCSSLVRLRLEDNSFSGEITLKFSHLPDILYVDLSKNNFVGGIPSDISQATQLEYFNVSYNPQLGGIIPSQTWSLPQLQNFSASSCGISSDLPLFESCKSISVIDLDSNSLSGTIPNGVSKCQALEKINLSNNNLTGHIPDELASIPVLGVVDLSNNKFNGPIPAKFGSSSNLQLLNVSFNNISGSIPTAKSFKLMGRSAFVGNSELCGAPLQPCPDSVGILGSKGTWKVTRIVLLSVGLLIVLLGLVFGILYLRRGIKSQWKMASFAGLPQFTANDILTSLSATTKPTDIQSPSVTKTVLPTGITVLVKKIELEARSIKVVSEFIMRLGNARHKNLIRLLGFCHNQHLVYLLYDYLPNGNLAEKMEMKWDWAAKFRTVVGIARGLCFLHHECYPAIPHGDLRPSNIVFDENMEPHLAEFGFKHVSRWSKGSSPTTTKWETEYNEATKEELSMDIYKFGEMILEILTRERLANSGASIHSKPWEVLLREIYNENGASSASSLQEIKLVLEVAMLCTRSRSSDRPSMEDVLKLLSGLKHLEDGRTSKEGQ

SEQ ID NO: 218275 - protein, 317 aa, Glycine max
  Coding DNA Sequence Number=SeqID_101497
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=98%, HitCoverage=23%, E-value=1e-104, Identity=55%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MDDLLLTRSSSTGIDSLKQNLKKEFEMTDLGTLLYFLRMEFAYTEQGIFMHQKKYISDVLKRFNMWNCNSTETPAEVNLKLAKGENEASVDGTLFRQIVGSLRFICHSRPEITFNVGLVSRFMGDPRQSHFLAAKRIMRYLKGTLGYGIIFPHQTKKDDNLHLVAYSDSDWCGDLVDRKSTTGQVFLLSGSPISWNSKKQSMVALSTCEAKYIAACSTACQALWLSSLINELKVSSDEAVELIVDNKSAIDLAKNPVAHGRSKHIDTKFHFLRDRVSKDRIKLRHCKSKVQLADIMTKSLKVERFKVFRKLLNVVCM

SEQ ID NO: 218276 - protein, 220 aa, Glycine max
  Coding DNA Sequence Number=SeqID_101498
  Homolog annotation: Hit_ID=Q10NZ2; Match level="QueryCoverage=96%, HitCoverage=62%, E-value=5e-54, Identity=51%"; Hit description =Expressed protein
  Pfam annotation: Domain name=TIM21; Domain location=22-173; Score =17.9; E_value=1.5e-07; Accession=PF08294.2; Description=TIM21
AKKDVANVEDPFSAPTYNIPEKPVTFVEGASYGVVILAGLGIAAAAGYAVFKELIFQPKEYKIYNKALKRIQDDGQIRVRIGFPITGYGQESRNRAARQRIPHRVWTDEEGVEHVELNKKLQEKVVREETKMKKRERKEARDSERRWGDLIKFETFGLLESEGEVNFYIRGPHGHGKVFAEMFKGADNEWKFTYLIVEIRAPSTAQIILESYIPSYSATK

SEQ ID NO: 218277 - protein, 451 aa, Glycine max
  Coding DNA Sequence Number=SeqID_101499
  Gene Ontology: Mol. function=alpha-glucuronidase activity; Cellular component=extracellular region; Biological process=carbohydrate metabolic process
  Homolog annotation: Hit_ID=Q4UNZ2; Match level="QueryCoverage=51%, HitCoverage=31%, E-value=2e-84, Identity=66%"; Hit description=Alpha- glucuronidase
  Pfam annotation: Domain name=HTH_3; Domain location=313-370; Score =21.5; E_value=0.003; Accession=PF01381.12; Description=Helix-turn -helix
  Pfam annotation: Domain name=LacI; Domain location=323-348; Score =41.7; E_value=2.6e-09; Accession=PF00356.11; Description=Bacterial regulatory proteins, lacI f
  Pfam module annotation: Pfam domain module=HTH_3::LacI; Domain location=313-370::323-348
MGTTVILWAGLPFGVRLDQEAAKIRNARMDLIDLVAPPAPHSRIQGISRCQAAEFDGCTEARAQVDPDAIGAEQVGQRGGLGQIGRRQAHRTGIDVVEDGAVDAERGVGTGVIGVARVTPLRQRLPVPERAACIATLDVTIQVVPMVEHTQCDPRRLTHLQPPQRRATLQQAQQMEGAVQHADILACRHKQYIAPLDPDPPDQEPPVAQRGDLVAVRGDEGRGLRRAQHQGMRPLRQPAGTASTAHSHPPPVPRQHRPAARAGPTAACRQRATTALTCAFVDYVRARGSASSSFAPARQRHQEQRDRALDKPKKSVRRRTAGVTIDEVAALAGVSPMTVSRVINQGKVRDVTRERVLRAVRELGYTPNLAASSLAAAQHTRIALIYTNPSGAYLRELLVGLLRVASSSAIQLVIDYWDNLDAESERRAARALAGRVDGVILPPPLCESQAA

SEQ ID NO: 218278 - protein, 66 aa, Glycine max
  Coding DNA Sequence Number=SeqID_101500
MGRLAAGEEPAKPKVSHMDLRLAKGRLCLAALNWAKISLSYGGLANRNAQISKCHKEFPLAQEILA

SEQ ID NO: 218279 - protein, 94 aa, Glycine max
  Coding DNA Sequence Number=SeqID_101501
MASPWLSETQCHQVRFIAVRIDGHGTERVICGLSGYSCAYALSDAIDRSAPASLYLNCIILAKQTKAWLSGNCRFSNLHILLSDNILTLSQILC

SEQ ID NO: 218280 - protein, 108 aa, Glycine max
  Coding DNA Sequence Number=SeqID_101502
  Homolog annotation: Hit_ID=Q1SNJ2; Match level="QueryCoverage=89%, HitCoverage=33%, E-value=4e-11, Identity=37%"; Hit description =Ankyrin
  Subcellular localization annotation: CTP_CleavageSite=50; ConfidenceScore=5.26e-01
MLEPLIPWSFLPGVTPPLTTTSKQPNMVIRSFVSTLSHACDVPLSQLQVPCPKGDAIAIKLPEKEYQEGLESRKNNLNDHMVLLNKDTLPHIHDLRKNLSALWKLVGN

SEQ ID NO: 218281 - protein, 68 aa, Glycine max
  Coding DNA Sequence Number=SeqID_101503
  Homolog annotation: Hit_ID=Q9ZU41; Match level="QueryCoverage=68%, HitCoverage=13%, E-value=3e-10, Identity=58%"; Hit description =Predicted by genscan and genefinder
SCSSDQNVQCLPPGKDTIEYFTLKDLWDCYSEWSAFGACIPLMLENGDTLVQYYVPNLSAIQIYRSKS

SEQ ID NO: 218282 - protein, 610 aa, Glycine max
  Coding DNA Sequence Number=SeqID_101504
  Gene Ontology: Mol. function=nucleic acid binding; Cellular component= intracellular; Biological process=DNA integration
  Homolog annotation: Hit_ID=Q1T010; Match level="QueryCoverage=88%, HitCoverage=46%, E-value=1e-118, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=367-527; Score =129.3; E_value=1e-35; Accession=PF00665.16; Description=Integrase core domain
MGEYLGRVQILTNQMIVCGESLKEQIIVEKVLRSLHSRFDHIVVAIEESKDLEILSLEQLQYSLEAHEARINERNAEKDVVEALWVHGGKLGRGNGSMKKNKGKLKNKDKRKWKRGSNSEIVTRIIGWGHFAKECKNPKRPRVQNDEAKLVQEEDSEDYHVILMVTTALKGGSREENAWYLDTGCMNHMTGRKDWLVDLDLSNKGKVRFVDDNTIRTEGMGIVQIQKKDGGISRISEVLYVPTINNNLLSLGQLLQNGYRMLLEDNALKIFDKKNRFILKTPMLKNKTFKVEIQANQEVNCLSVTEEGESWLWHKRYDHLNFKSLNILHDQSMVSGLPKLVAPGRVCAGCCISKQPRKSYRNLIHSRTKSALEVVHSDVCGPMEVETLGGNKFFVTFTDEFTRKVWIYLLKKKSQVFRVFRKYKTMVEKQSKLSIQTLRTDGGGEFTSQDFEMFCEQEGIVHEVTPPYTPQHNGTAERLNRHVPDQRRQKLDDKGEPMILLGYHQTGAYRLFDPNTKKIVISADVVFDEWRGWNWDRLPNSQTKFTWVSSEGENSVESGANQVTDHTGVTENTRFQGEGNQIPIVSATGRPQRHTNVPPRLNDYQILKDT

SEQ ID NO: 218283 - protein, 312 aa, Glycine max
  Coding DNA Sequence Number=SeqID_101505
  Gene Ontology: Mol. function=hydrolase activity, hydrolyzing O -glycosyl compounds; Cellular component=membrane; Biological process =carbohydrate metabolic process
  Homolog annotation: Hit_ID=P14749; Match level="QueryCoverage=84%, HitCoverage=57%, E-value=1e-114, Identity=73%"; Hit description =Alpha-galactosidase precursor
  Pfam annotation: Domain name=Melibiase; Domain location=49-312; Score= -158.6; E_value=7.8e-07; Accession=PF02065.9; Description=Melibiase
MKRGRDKEREDGTIAKYWEIGWSWRLAMEMLLALCFLVLLHANPSSARLLVNRSRGISTSTKQVTRRNLVENGLGQTPPMGWNSWNHFGCDINESVIRETADAMVSTGLAALGYRYVNIDDCWAELNRDSEDNMVPNAAAFPSGIKALADYVHSKGLKLGIYSDAGYQNITLSLDLERMSKVSSLSDHLQFPYRNQTCSKRMPGSLGHEEQDAKTFASWGIDYLKYDNCENNGIKATDRYPPMSEALLKTGRPIFFSMCEWGWQDPATWAKTVGNSWRTTGDIEDNWNSMTTIADANDRWVSYAGSGGWNGN

SEQ ID NO: 218284 - protein, 90 aa, Glycine max
  Coding DNA Sequence Number=SeqID_101506
NDPEFPILLFLYAPCVRGASTSVQDCRCRCGVGEEVSSCLASCNSGGLRGKEGGKRGGGCDFTGAGAGAVGARCMPEIISGGGERWPVTK

SEQ ID NO: 218285 - protein, 292 aa, Glycine max
  Coding DNA Sequence Number=SeqID_101507
  Gene Ontology: Mol. function=hydrolase activity, hydrolyzing O -glycosyl compounds; Cellular component=membrane; Biological process =carbohydrate metabolic process
  Homolog annotation: Hit_ID=P14749; Match level="QueryCoverage=98%, HitCoverage=72%, E-value=1e-148, Identity=82%"; Hit description =Alpha-galactosidase precursor
  Pfam annotation: Domain name=Melibiase; Domain location=1-234; Score=- 171.1; E_value=4e-06; Accession=PF02065.9; Description=Melibiase
MVPKASTFPSGIKALAHYVHGKGLKLGIYSDAGNQTCSKRMPGSLGHEEQDAKTFASWGVDYLKYDNCENNGILATERYPPMSEALLKTGRPIFFSMCEWGWQDPATWAKTVGNSWRTTGDIEDNWNSMTSIADANDRWASYAGPGGWNDPDMLEVGNGGMTTEEYRAHFSIWALAKAPLLVGCDIQAMDNTTYELISNREVVAGKKVKNNNGLEVWTGPLRGNKVAVILWNRSSSNATVTACWSDIGLEPGTIVDARDLWEHSTQTSVSGKISAELDSHACKMYVLTPRRY

SEQ ID NO: 218286 - protein, 94 aa, Glycine max
  Coding DNA Sequence Number=SeqID_101508
  Pfam annotation: Domain name=DUF789; Domain location=3-88; Score= -188.5; E_value=0.05; Accession=PF05623.3; Description=Protein of unknown function (DUF789)
CASKYEGIDTGNDASCLIGWRSIVGEKCKKKESGCMSLSPFGLATFKMRKSVWLNSYNNNNQVVTNLYNAADSWLKHRNADHPDFNFFTRQPTL

SEQ ID NO: 218287 - protein, 91 aa, Glycine max
  Coding DNA Sequence Number=SeqID_101509
  Gene Ontology: Cellular component=plastoglobule
MAHVAPELCHVNFVANFTVRLLTIVAPSYSAIQEPVAFLGGMFAGILRLDLNEEPLKEWVTRTVEAAGISEEEANTEESTTEEAPQEIQIE

SEQ ID NO: 218288 - protein, 252 aa, Glycine max
  Coding DNA Sequence Number=SeqID_101510
  Homolog annotation: Hit_ID=Q6H4U3; Match level="QueryCoverage=57%, HitCoverage=69%, E-value=2e-19, Identity=34%"; Hit description=HIN1 -like protein
  Pfam annotation: Domain name=Hin1; Domain location=89-226; Score =146.2; E_value=8.9e-41; Accession=PF07320.4; Description=Harpin -induced protein 1 (Hin1)
MADHQRLRIHPMEGEAPPPPTTPLVPPGSSRSEKGVPLHHPPPLPRAMPAAYPTPHKRSSSCCCKCICWTIILVVLLLIIFAASVGILYLVFQPKLPDYSVDTLRISDLRLNFDMSLYAKFDVKITATNPNKKIGIYYEKGGKLSVWYTNTRLCEGSLPQFYQGHENKTVLNVSLSGQVQSGSTLMNALQQQQQTGRIPLDLKVHAPIAIKLGRLKLMKVRVLGECLLVVDSLSSNNLISIKASNCKFRLKL

SEQ ID NO: 218289 - protein, 147 aa, Glycine max
  Coding DNA Sequence Number=SeqID_101511
KEHALRCSYRMHARARVMSEIEEVQEQIKADMEAMKEKMTTMMEAMMSMRKMMEVNTTTVIAASIAIEVDLTHPSGLNQVNPLVSDMVGQGDKALGSMGGPHSVQVQKKHSFPPYGLPPNYTLPNVAHAPDENVNNSTPILIESQQP

SEQ ID NO: 218290 - protein, 203 aa, Glycine max
  Coding DNA Sequence Number=SeqID_101512
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=99%, HitCoverage=49%, E-value=1e-102, Identity=95%"; Hit description =Acetyl-coenzyme A carboxylase carboxyl transferase subunit beta
MGSSDRIELSIDSGTWNPMDEDMVSLDPIEFHSEEEPYKDRIDSYQRKTGLTEAVQTAIGIMDFQFMGGSMGSAVGEKITRLVEYATNQLLPLILVCASGGARMQEGSLSLIQMAKISSALYDYQKNKKLFYVSILTSPTTGGVTASFGMLGDIIIAEPNAYIAFAGKRVIEQTLNKAVPEGHKQLNIYSIRAYLIQSYRVIF

SEQ ID NO: 218291 - protein, 75 aa, Glycine max
  Coding DNA Sequence Number=SeqID_101513
MPSRHRDRAHRTPSGPKEVQQGPGVSRSDCGPLSSGPLLIELSSRGVAPPGRRKAKHHSSLGMASNRQQMHRRHL

SEQ ID NO: 218292 - protein, 73 aa, Glycine max
  Coding DNA Sequence Number=SeqID_101514
VISLEPLSCATLWSRGDSKLFIKGGFSGNCQRGSDAILPPRTLDRRLQEDWAKDAREGPRVLMSLRIDFGPMG

SEQ ID NO: 218293 - protein, 125 aa, Glycine max
  Coding DNA Sequence Number=SeqID_101515
MVKEVGVNKCYVQGSRTFKISDIVMHVWKYRSNVQHPDVRNERALAHSHFTMTVLWSECDGTDVASPNGGKSGGLIGALLRDRAALAAATARSTSSLVGCKHSSEYLLWLLSYPNFVRGPLLDDM

SEQ ID NO: 218294 - protein, 281 aa, Glycine max
  Coding DNA Sequence Number=SeqID_101516
MAKEFQAAIYGESWWNIINPTRSVFPLMPSTFSMAAADAGNYNNWQSTIDFMDLKGTKSCDEETNINLVSSEEIEIGGGGSSNDSKIQKDWSPKNLSYVGGSEQVSTIDAFKPMNQEFSLDQQSLNSVVTSTDGSLSNGNFLVVSASYGYPSTFIQSLYEHQPQPQNSIFTNLSMSYGTCSNELSPTWSKVFSLLKPSMPKQQLSGLHFSNNTTPFWNSSAEALNDIRAGVFASSQVQYQTPKFEEKPNCPHTLLKKREESLDAAKKNSPEPAAFKALGDE

SEQ ID NO: 218295 - protein, 184 aa, Glycine max
  Coding DNA Sequence Number=SeqID_101517
MAPPSLSSRPRVLLDHMYTFSNADSLWGATYRPKTLQILPKYFPEKFGNSRGEWTVAPKGFAQGDVLGGIAAERDKLEKLVADLEAWLKDSKSRLGDSELRVTKEREANKELKEEPLIYKKKVVEQHEKGFQKVVRQAEFFTKDLDLSLFDPFKDAKGGVLLDEEENSTEDEAINEEQSDDAAI

SEQ ID NO: 218296 - protein, 145 aa, Glycine max
  Coding DNA Sequence Number=SeqID_101518
MACSCICVTYEVACIGDMVVARTGDLVACSCIHVTHRGWHVLETQWHALAYMSLTVGGTYWRLSDVLLRTCHSLWVAPTRDLVECALAYMSLVVGGMYWRHNVRRMAHQGRPLGFKSLGAMTMNNNSLLIDGFPTSMGIMAFVPY

SEQ ID NO: 218297 - protein, 77 aa, Glycine max
  Coding DNA Sequence Number=SeqID_101519
CVEGSMEPSIYRRGVELCVLVYRGLSVCPPPSPPPAILIQEATPDVGEVSMSAALADFVKDFTKIVEISSGLLEYWT

SEQ ID NO: 218298 - protein, 163 aa, Glycine max
  Coding DNA Sequence Number=SeqID_101520
  Homolog annotation: Hit_ID=Q6DC23; Match level="QueryCoverage=48%, HitCoverage=50%, E-value=2e-09, Identity=40%"; Hit description =Coiled-coil domain containing 12
  Pfam annotation: Domain name=cwf18; Domain location=6-153; Score =134.9; E_value=2.1e-37; Accession=PF08315.2; Description=cwf18 pre -mRNA splicing factor
MGSEEDSIEQSVASRRERLLALRAAQELSSVPEPEPNGNKDDDNEEDQEPQEMKFRNYVPHDKNLQEGKLAPAVLPKFEDPVDDVPPPEPEAKEDPFLNIAPKKPNWDLRRDVQKKLDKLEKRTQKALYQLMGIYASPYYSSILLFDEFTHLINICYTMAIFS

SEQ ID NO: 218299 - protein, 179 aa, Glycine max
  Coding DNA Sequence Number=SeqID_101521
  Homolog annotation: Hit_ID=Q2R3L0; Match level="QueryCoverage=79%, HitCoverage=28%, E-value=3e-18, Identity=33%"; Hit description =Expressed protein
MARILLVRIGQSSPLELPIESEAAAYYYHGLILDEGNTEKSHGMAVASLQAADEYFKESKKLCEAFNAVPPLSSSQENSTFGGNMLFHDPSNWQSWCRNPPLWGTMKYLYEKIPKDTSSKVRINRDLYSYERIMETAPTLPDFALALKPDEYQLPQMDPSWRTENVKDGQSGTTNHING

SEQ ID NO: 218300 - protein, 65 aa, Glycine max
  Coding DNA Sequence Number=SeqID_101522
  Subcellular localization annotation: CTP_CleavageSite=55; ConfidenceScore=5.35e-01
MKQRFAAAPGLVPKPHVLCHRLHGFCVAVATTKMLLRTVTTMGTTETTRLQWLSRDMAEASGTKD

SEQ ID NO: 218301 - protein, 312 aa, Glycine max
  Coding DNA Sequence Number=SeqID_101523
  Gene Ontology: Mol. function=oxidoreductase activity; Cellular component=membrane; Biological process=electron transport
  Homolog annotation: Hit_ID=O81972; Match level="QueryCoverage=100%, HitCoverage=59%, E-value=1e-163, Identity=91%"; Hit description =Cytochrome P450 82A2
  Pfam annotation: Domain name=p450; Domain location=37-312; Score= -161.5; E_value=0.0013; Accession=PF00067.12; Description=Cytochrome P450
MDLVLNTTTIGVGVVSLILLYLFLCRRSSKSGEEGPPTVAGAWPIIGHLPLLLGSKTPHKTLGDLADKYGPIFSIKLGAKNAVVISNWEMAKECYTTNDIAVSSLPNLISANLLCYNRSMILVAPYGPYWRQMRKILMSEFLSPSRVEQLHHVRVSEVQNSITDLFGAWRSNKNVESGCALVELKQWFSLLVFNMILRMVCGKRYFSATTSDDEKAKRCVKAVDEFVRLAATFTVGDTIPYLRWFDFGGYEKDMRETGKELDEIIGEWLEEHRQKRKMGENVQDFMNVLLSLLEGKTIEGMNVDIVIKSFVL

SEQ ID NO: 218302 - protein, 300 aa, Glycine max
  Coding DNA Sequence Number=SeqID_101524
  Homolog annotation: Hit_ID=Q1SZU4; Match level="QueryCoverage=28%, HitCoverage=9%, E-value=2e-13, Identity=51%"; Hit description =Protein kinase PKN/PRK1, effector
MESLGSALHEVSAKAREAKENLLHSQPESESYDAQIEDLKFVLKATNEKYNSMLDEAENLLKEASQGGELSYERASSPSFLSKAHLGGEAPSSMAYSLVDGASSHLFSFLFRCISIVGRRDRSVTMNVESKRKDEQEVKGWRKALKSVGNWLAHKDKDEWLKDMRGMLILLSTVIATMTFQSALNPPGGVRPGNESGVVQCPVNKADNNPCPGESILVVVYPDEYGKFLIWNTTSFISSLAVCLLLVETEQEANAKREEKAQLKEKLKEVAAEAIQMQEALKETTTHNMKLKENLLDKEN

SEQ ID NO: 218303 - protein, 97 aa, Glycine max
  Coding DNA Sequence Number=SeqID_101525
  Subcellular localization annotation: CTP_CleavageSite=15; ConfidenceScore=5.04e-01
MAVLSNPSIPLAPLLAATLANQTNKPEQHPTFVNTKDHSYMMLSVPSSNSKLYDCAKNMGADTTKFKEGHHKALLPQRLCIRKKGRKEHDLEADPQR

SEQ ID NO: 218304 - protein, 144 aa, Glycine max
  Coding DNA Sequence Number=SeqID_101526
MSPSTRDESGGITSSTIFKLCDAILPRKGPVTRTMSKRLQEDWARAAKEGPRVLMNLRVDFRGHGPRALLEHKISCSSLPLPSFISFFLQALIHGLLWCGVSSLSSFSIPLPFIFQGAKESIDEEDHRPTSSNGAYTTVSGRRN

SEQ ID NO: 218305 - protein, 225 aa, Glycine max
  Coding DNA Sequence Number=SeqID_101527
  Gene Ontology: Mol. function=oxidoreductase activity; Cellular component=membrane; Biological process=electron transport
  Homolog annotation: Hit_ID=O81972; Match level="QueryCoverage=94%, HitCoverage=40%, E-value=1e-111, Identity=92%"; Hit description =Cytochrome P450 82A2
  Pfam annotation: Domain name=p450; Domain location=1-211; Score= -157.1; E_value=0.00081; Accession=PF00067.12; Description=Cytochrome P450
MMYMYLICSAAKVCIATIIQAATEASITTLVWATSLILNNPSVLEKLKAELDIQVGKERYICESDLSKLTYLQAVVKETLRLYPPGPLSRPREFEEDCTIGGYTVKKGTRLITNLSKIHTDHNVWSNPLEFKPERFLTTDKDIDMKGQHFQLLPFGSGRRICPGVNLGLQTVHLTLASFLHSFEILNPSTEPLDMTEVFGVTNSKATSLEILIKPRLSPSCYESM

SEQ ID NO: 218306 - protein, 91 aa, Glycine max
  Coding DNA Sequence Number=SeqID_101528
  Gene Ontology: Cellular component=chloroplast envelope
  Homolog annotation: Hit_ID=Q9SJX7; Match level="QueryCoverage=82%, HitCoverage=24%, E-value=7e-22, Identity=56%"; Hit description =Expressed protein
MDSEPKRWRLLWSYQGMVVVSARATRLPIYSSFAKEGNLGDLFAKGEAFSTLFNVIGIGVGIQLASTIRASMQGKVRPPNGSHANNVSYTL

SEQ ID NO: 218307 - protein, 108 aa, Glycine max
  Coding DNA Sequence Number=SeqID_101529
LVWNQRARTKRNLQVTRQGIRGVALDRVFGTSFWPRSYVGCCVCSWGALCTDLPGSLALAFGHEHTSYGVYVMGGTLIGPWSLTLTFGRDHSSYDTGNRVTVAKCTLY

SEQ ID NO: 218308 - protein, 286 aa, Glycine max
  Coding DNA Sequence Number=SeqID_101530
  Homolog annotation: Hit_ID=Q9SLB9; Match level="QueryCoverage=75%, HitCoverage=50%, E-value=3e-71, Identity=58%"; Hit description =Expressed protein
MKNNSESTQFSLEGFDCSQFFEADDNVQHGENIIPNILPNICPPPSAFLAPECALWDYFRLAQGVEWCQNYCSSCHELLANNEGLPGMTPILRPWGIGVKDGPLFTVVLAKTRGKEVGIPSCEEFFDLSFLEGETVREWLFFNKPRRAFESLNRKQRSLPDYSGHGWHESMKQVMKEHGGQKRSYYMDPQPLSYLEWHLYEYEINNQDCCALYILELKLVDKKKSPKGKVTKESLTDLQNKMGQLTATVPSTDDDNQSREKQMPNMRMTNLPTSKLILRCAILPYY

SEQ ID NO: 218309 - protein, 144 aa, Glycine max
  Coding DNA Sequence Number=SeqID_101531
MSIEQFIEKVVWPGARPSFVGDNESFTTQAPQQHETEPENDDSSKATISGAIDFKKRRLETRSNEAAYPGPVPASADAPFPGVDPSSPQHAADSSTPVLEIHEGQTIPVLPLDTSPLATPVWHLTDERMFRYRTIRTSHSHFNS

SEQ ID NO: 218310 - protein, 82 aa, Glycine max
  Coding DNA Sequence Number=SeqID_101532
MRVQIATRPTWAFPIVPPEGGCFWRKQPGSPGRAGWQAPHLFPINRGRSEEEKGSALLVLRDFAKIFNRSSSFVLRRSSVFN

SEQ ID NO: 218311 - protein, 117 aa, Glycine max; identical to SEQ ID NO: 167823
  Coding DNA Sequence Number=SeqID_101533
  Gene Ontology: Mol. function=DNA-directed RNA polymerase activity; Cellular component=mitochondrion; Biological process=transcription
  Homolog annotation: Hit_ID=O47884; Match level="QueryCoverage=91%, HitCoverage=12%, E-value=1e-27, Identity=63%"; Hit description=RNA polymerase

SEQ ID NO: 218312 - protein, 95 aa, Glycine max
  Coding DNA Sequence Number=SeqID_101534
MARNLHHLEKIIVVLRITGTHFLFLRHFHLFAFTFVLVRGLLLDVLICSSVLFDGGALFTVVRRQVVVVVAVVGLATEGGGKVFDLVFFRAKLAD

SEQ ID NO: 218313 - protein, 80 aa, Glycine max
  Coding DNA Sequence Number=SeqID_101535
MIMIRTRGLGRALGTRKPTASARRQREYAPVAEDELVVGSDDPLVDADVDFTFLTSPRSKIESISKEKNLGCKKNSYDGH

SEQ ID NO: 218314 - protein, 156 aa, Glycine max
  Coding DNA Sequence Number=SeqID_101536
MAMGVKPSEVINNAPRMKLGTVCVRITAGYIRMPPDSWIGVAELYNHLGYFRPPPDAWVGITKDADISRKRANDDVQMMMLVTACYQDLSLTDRNETFSQSRPEDADIFGKGAGDDVQITIRYLRMSSYSPSLDDKGADDDISLYVSMGSLPLADK

SEQ ID NO: 218315 - protein, 239 aa, Glycine max
  Coding DNA Sequence Number=SeqID_101537
  Subcellular localization annotation: CTP_CleavageSite=48; ConfidenceScore=5.11e-01
MAVTAWVPPSFSSFSLGFPFIKAFKTSFRGPLPYRDLDDLVQLCIRVEQQLKRKPTLKSYGSHSYPKKDQGQGILGVAPSKPKDVKRDEEEILEKQKEKRIIRPCLQRPRGRKKRKRISPRRLLRRKIILQQKVISKEHSFLNNPSTFSYQGKPPLAQPYLLSLRYYKVPNPYDRWYDECVECDQGVPMDPKRIKVIPKWHTPPSVKGRSLEFQEPLDLRSKPFQGGGDDAILPPKGIG

SEQ ID NO: 218316 - protein, 51 aa, Glycine max
  Coding DNA Sequence Number=SeqID_101538
MKVARPGELLLHSKATLLAQGSKDKDTNFIRAILLFDRATGENQGSETEKT

SEQ ID NO: 218317 - protein, 115 aa, Glycine max
  Coding DNA Sequence Number=SeqID_101539
TFRGIHVLDFRGLHVLTIRGLYVLAFRGLHVLTSIGLLASRGLYILAFRGLHVLDFRGLHVLTFRGLHVLAYGGLHVLASIGLLIRQVCEVLIFTLSLSQSTGLASHPLSATLLD

SEQ ID NO: 218318 - protein, 50 aa, Glycine max
  Coding DNA Sequence Number=SeqID_101540
MEVEESLLGLWLPLHYCVDMGQAGFVADLKVAFVDDWVFLADRVVGNEKG

SEQ ID NO: 218319 - protein, 173 aa, Glycine max
  Coding DNA Sequence Number=SeqID_101541
  Subcellular localization annotation: CTP_CleavageSite=71; ConfidenceScore=5.69e-01
MDTNLGSLISGQISLIATQKSRARRSEGPPSSAPAPAHVSTSAPFASSPSTSTTLVPPVLTGFPAQSSEHSLSMLQSLHQGQLLIMQSLQDVVHQRPEPQPAKKDASANISEPSPSEPYSFETDPVIVQDDVVVPEPSSQPEPEPSAPVLDLPISYDPPSAPTLDLNDATQDN

SEQ ID NO: 218320 - protein, 182 aa, Glycine max
  Coding DNA Sequence Number=SeqID_101542
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q9T3G4; Match level="QueryCoverage=65%, HitCoverage=25%, E-value=3e-34, Identity=79%"; Hit description =NAD(P)H-quinone oxidoreductase chain 2, chloroplast (EC 1.6.5.-) (NAD(P)H dehydrogenase, chain 2)
  Pfam annotation: Domain name=Oxidored_q1; Domain location=1-114; Score=-78.4; E_value=0.0014; Accession=PF00361.10; Description=NADH -Ubiquinoneplastoquinone (comple
MILGNLIAITQTSMKRMLAYTSIGQIGYVIIGIIVGDSNGGYASMITYMLFYISMNLGTFACIVSFGLRTGTDNIRDYAGLYTKDPYLALSLALCLLSLGGLPPLSGRLIFLSFNRTPYECCFYLLLFKNNQIDIIFMEYDSLSRCLGGEMVDTRDSKSRAKERGGSSPLQGIILRSLIELE

SEQ ID NO: 218321 - protein, 380 aa, Glycine max
  Coding DNA Sequence Number=SeqID_101543
  Gene Ontology: Mol. function=nucleoside-triphosphatase activity; Cellular component=membrane; Biological process=cobalt ion transport
  Homolog annotation: Hit_ID=Q62MX9; Match level="QueryCoverage=97%, HitCoverage=94%, E-value=7e-76, Identity=40%"; Hit description =Peptide ABC transporter, ATP-binding protein
  Pfam annotation: Domain name=ABC_tran; Domain location=35-219; Score =128.9; E_value=1.5e-35; Accession=PF00005.17; Description=ABC transporter
MAHFAQSPSVILHQVSCQFATGDILFGPLNLTLEPSLCALVGRNGSGKTRLLRMLAGRDEPASGHIERFGSHFYVAQQQAISPQTTLAELLGYGAMFAARKRVDSGDYQPDDLDILDGHWDLAERLSEAFIHAQLPAFDPDKPAGELSGGERIRALLCGAFTADADFLLLDEPTNHLDRQGRAWFYDQLRRFQGGVLVASHDRELLEQVPRILELSASGLRSYGGNYADYQTQRDAEQQAARAALEHAATERKRTRARMQKEHDDSQRRSAKTLRTVDTLNIASFERVKYKGAAKERIGSWKKQHSEQNEALNAAVNKARERVEEDAPIMFTLPGSHIAEGKQVLVLEDLQLPHVSLPPVNWRMDGPMRLALRGPNGCGK

SEQ ID NO: 218322 - protein, 122 aa, Glycine max
  Coding DNA Sequence Number=SeqID_101544
  Homolog annotation: Hit_ID=Q8H6Q8; Match level="QueryCoverage=99%, HitCoverage=4%, E-value=5e-08, Identity=26%"; Hit description=CTV.20
MLEVVSNPWRFTVGNWLCDSDLVSPTGIERVLTEKDLLADSYSDLEASIFDEKEFLLLKVISTFPELSCLICSMVGAGRGIDDVALSITHLSGRVTSSHFIFLGRDTLAFVISVINKVVSPF

SEQ ID NO: 218323 - protein, 110 aa, Glycine max
  Coding DNA Sequence Number=SeqID_101545
MAKIHHQAWPTKTYHPMKHTPHTYSQNNSKAPKFLKGRGNIGSKGLSKELIQGRLIWLEAYKNKMPKSSPNMHVKQEVSTRVKPRLFCKQSMEQNTQNKIDDDGSNSHQG

SEQ ID NO: 218324 - protein, 104 aa, Glycine max
  Coding DNA Sequence Number=SeqID_101546
  Gene Ontology: Mol. function=DNA binding; Biological process=DNA integration
  Homolog annotation: Hit_ID=Q1SKC8; Match level="QueryCoverage=94%, HitCoverage=32%, E-value=5e-12, Identity=33%"; Hit description =Integrase, catalytic region
MEHKAYWALKFLNFDEAASREQRRLQLLELEEMRLTAYESSKLYKERVKKPFTIKKVRPYGAVELYDPQAKDPDRALVVNGQRQKLYHGGTIERLNTILYFQEA

SEQ ID NO: 218325 - protein, 123 aa, Glycine max
  Coding DNA Sequence Number=SeqID_101547
  Gene Ontology: Mol. function=transition metal ion binding
MNPVERYMKILKGYTKNLHYPEASIVKRYIAEKTIEFCSEYIEKEKYVGLPESRHDERVRVFHETLVKESKPKMTKHRVLKEHKKTFLDWLKNTCRSKLHDDESSMIQVVLMMTKSPKECCQD

SEQ ID NO: 218326 - protein, 93 aa, Glycine max
  Coding DNA Sequence Number=SeqID_101548
MTCLEGKKVAFGIYTLVEEAKHWWENTLPQFYGVPVTSSKGIMPPTNRAFIKKYCVPRQAQGETPQQPGDDRQRATDAPPSPLEFTSAHPQKG

SEQ ID NO: 218327 - protein, 86 aa, Glycine max
  Coding DNA Sequence Number=SeqID_101549
  Homolog annotation: Hit_ID=Q67Y64; Match level="QueryCoverage=37%, HitCoverage=11%, E-value=1e-07, Identity=66%"; Hit description=MRNA, , clone: RAFL25-13-C17
MATKVVLQGWKDEENSMPKWMCRFMWITYLCTRYLGGVDPRYGKRDNMEGRVVYCGGGIDGEKMKLSSSPSWEKTFVGVVGKSCLS

SEQ ID NO: 218328 - protein, 272 aa, Glycine max
  Coding DNA Sequence Number=SeqID_101550
  Gene Ontology: Mol. function=DNA binding; Cellular component =cytoplasm; Biological process=DNA integration
  Pfam annotation: Domain name=rve; Domain location=1-102; Score=14.4; E_value=0.00037; Accession=PF00665.16; Description=Integrase core domain
MVERQFDIKVKMMRSDNGSEFILRQFYDEIGIIHQTSCVETPQQNGIVERKHQHLLNVTRSLLFQSNLPFICWSYALIHFGILVNCIPTTFLGNKTPYEKLYGTPYDISSLRVFGCLCFTSSLTANKKKLDLRVAISIFLGFKPNTKGYVTLDLKTKAISISRNFGDFPSESPIDHPIDELANTVIDPDTTRRVTQTPRRSMRQIHKPSKYKDFHITYPSSTVSNLSTSTTLYPLSFVLSYNILSPSYQKVILFITQQVEHQSYSATFKDPY

SEQ ID NO: 218329 - protein, 169 aa, Glycine max
  Coding DNA Sequence Number=SeqID_101551
  Gene Ontology: Mol. function=DNA binding; Cellular component =mitochondrion; Biological process=DNA integration
  Homolog annotation: Hit_ID=Q1S1E0; Match level="QueryCoverage=95%, HitCoverage=16%, E-value=4e-44, Identity=44%"; Hit description =Integrase, catalytic region
MLCNILSHFVTKPTSAHQQATFKILQYIKGSPGAEIFLSADSNIHMKGFNDSNWAGCIDTRRSIIGYAIYLDNSLISWKSKKHVTVSRNSLEVKYKALPSATYANPVFHERTKHFEIDCHLVREKMQKGIVKLLPVTSTNQLANIYTKASLLGAFQFMYSKLGMSNIHS

SEQ ID NO: 218330 - protein, 109 aa, Glycine max
  Coding DNA Sequence Number=SeqID_101552
  Gene Ontology: Mol. function=RNA-directed DNA polymerase activity; Biological process=RNA-dependent DNA replication
MGAYAKDEKLLIHFFQESLTRVAVTWYTNLEPSRVHSWKDLMVTFIRQYQYNSDVAPDRMQLQNMCKEGARILQRIHPKVERSGSPGGTPNDEKGDDNNDSRHITSILL

SEQ ID NO: 218331 - protein, 88 aa, Glycine max
  Coding DNA Sequence Number=SeqID_101553
  Gene Ontology: Mol. function=ribonuclease H activity; Biological process=DNA integration
MSNGRLYQRRVKNAFDKKVRPCKLNEGDLVLMKVSQALRDNRGKWAPNYIGPFIVKKAFSGGVLVLANMDDEELPSPVNVDVVKRYYA

SEQ ID NO: 218332 - protein, 112 aa, Glycine max
  Coding DNA Sequence Number=SeqID_101554
MACNLCLTASRYLAPFVAQYVKFRDMPEITRKHCYAIRPLGPSRLFLQKAVASGGSNLARPGELGGKLLPYFPINRGRSEEEKSSALLVLRNHLKLVRKIVSVKKIQAEALP

SEQ ID NO: 218333 - protein, 193 aa, Glycine max
  Coding DNA Sequence Number=SeqID_101555
  Gene Ontology: Mol. function=chitin binding; Cellular component =extracellular region; Biological process=chitin metabolic process
  Homolog annotation: Hit_ID=UPI000044A8F0; Match level="QueryCoverage =76%, HitCoverage=99%, E-value=5e-21, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=28; ConfidenceScore=5.36e-01
AQRPHLQRATRPRLHLLDTSTLTFRGLRALAFRRLRVLNFRGVHALASRRLGTLAFRRLHILTFRGLHALAFRGLHALTFRWLHVLAFIGLHDLAFRGDACPRLRGLHALTFRGLHALTFRGLHVLAFKGRQVLNFRGLHTLAFRGLHILAFRGVHIVAFRGLHVLAFRGLHVLAFRGLHVLAFRRLHVASLN

SEQ ID NO: 218334 - protein, 148 aa, Glycine max
  Coding DNA Sequence Number=SeqID_101556
MKDSGIFSTESLRRILRIPLGLKHSSWCGGSTASNNDSWRPPVVVGGGEGGVRVWVISLSELVSLSGSPLFVTIRTKCNSFCTNSRLAALILAQCNSLWVGIALSAPLVLSETSKVVIFEIPTVRLENCLRKLQPKFEDNPTVNESGS

SEQ ID NO: 218335 - protein, 78 aa, Glycine max
  Coding DNA Sequence Number=SeqID_101557
MDKQINYPKHYTKPPTMETQMTVREKSAYLDNPDALKKKKKKKTTFMPRREKRTLQNEAAEDQNQAQEEDTDAGCTGS

SEQ ID NO: 218336 - protein, 81 aa, Glycine max
  Coding DNA Sequence Number=SeqID_101558
MTTATVNTGTFTFTEPNRCQGTEENTAPKREKREEECTKMAGASTMMLGAPSNSLHHVVSDTRHILRILNKAIITWTWVSG

SEQ ID NO: 218337 - protein, 348 aa, Glycine max
  Coding DNA Sequence Number=SeqID_101559
  Gene Ontology: Mol. function=protein dimerization activity
  Homolog annotation: Hit_ID=Q1S735; Match level="QueryCoverage=96%, HitCoverage=85%, E-value=5e-82, Identity=60%"; Hit description =Probable transposase [imported]-Arabidopsis thaliana-related
  Pfam annotation: Domain name=DUF659; Domain location=46-140; Score= -31.3; E_value=7.8e-05; Accession=PF04937.6; Description=Protein of unknown function (DUF 659)
MDEDTVRIVEELRRPPKPISSKSQKGKNTPYVDDYFMPRTTPGAQPSLKSVLQNKQIVEKCDKAIAKWMIDASMPFNAVNSTYYQPMIDAISSMSPGLLEKEFPKIYWSPCATHCINLMLQNFGKFEEVSEIVSHASKITKYIYNHCYALFLMRQHTGGRDMLRPALTRFATNFIALQSILAQKDALRAMVTSRDWIGSTYAKDSKAKKFVKQILDSSFWKQCAAIVKLTEPLVHVLCIVDNQHKPAMGFLYQAMYKAREKMVKRFNAEEFKKHRNTQSSILKLIDSYTLGDLELQDKLNEGMRIYKILKEILQDELQYVKGTQSCQINCGIVMDVVLHNCKNWLFMF

SEQ ID NO: 218338 - protein, 229 aa, Glycine max
  Coding DNA Sequence Number=SeqID_101560
  Gene Ontology: Mol. function=microtubule motor activity; Cellular component=microtubule associated complex; Biological process =microtubule-based movement
  Homolog annotation: Hit_ID=Q9C9S6; Match level="QueryCoverage=54%, HitCoverage=11%, E-value=1e-16, Identity=42%"; Hit description =Kinesin-related protein; 103921-99132
LQQNNLFKAREEKYQSRIRVLEALASGTIDKSEGEKIKEKVKKVDENEVVRLIKEQEDKNLEISALKVELETTKRTYEVQFSQMEEEANSFKAALTRKVQEYEHQLEELRNEDKSINVLEWSAKQKIAVGEARGLRYQNSQARLTSASSKGGKCAESPPTFICGKCRKNRRKPVVKNIPDSGVVFMFEDGISTSHVDNSGALAPMYPPSKRKSDLCSSFYQAILFTWKE

SEQ ID NO: 218339 - protein, 203 aa, Glycine max
  Coding DNA Sequence Number=SeqID_101561
  Subcellular localization annotation: CTP_CleavageSite=15; ConfidenceScore=5.42e-01
MATPSSSPPLESAPSSSMLKRTRKATQLRSLSTRPMGVERPLVHMDPTTWKANGPHKKKLRAAYLGSNLTSKWALAQGKEDDDDKVCEKYNINKEKWNQFCQSRRDPSWEDVLTTFVGRPEHPGHVHATGVGEIVPPTKLEVAPFAACVSTKESCVDPLGQNPDTAASDRILYVDDNPTCVVKVGVEEVQDIDACILLPTKEI

SEQ ID NO: 218340 - protein, 160 aa, Glycine max
  Coding DNA Sequence Number=SeqID_101562
MLSQLGGVEEPVESFKLLWILKVPNKAKLLIWRALKYRLPTIDNLVERNGELSSFVGVLFLKVSKFTSRVANLGESSSMATFSGLQIQHLVFKDGWDKEIHFFGFDINHYMLQIYFIRSDVAPCGACRPWIFFINGFLCFLRSNCSGMEKEKDEWRRHFK

SEQ ID NO: 218341 - protein, 107 aa, Glycine max
  Coding DNA Sequence Number=SeqID_101563
MGTCWEVRVGDWGETIPVPALPRPIAMSRRMHNYERVTILGDLEMKRPMGKMHSQQPLRCQRPPMLGPFVNNLCKKHAFDMDELQCRVAKYMQNWLNTGTMFKSRLH

SEQ ID NO: 218342 - protein, 84 aa, Glycine max
  Coding DNA Sequence Number=SeqID_101564
MTKRLYGLTICISYTIDNTQIEVVEKKHTSVVTHNTNHHDNKKLPMNHRNNEPWPNQTQKRRRSSRNECFMKKTMNGQNREGER

SEQ ID NO: 218343 - protein, 94 aa, Glycine max
  Coding DNA Sequence Number=SeqID_101565
  Subcellular localization annotation: CTP_CleavageSite=33; ConfidenceScore=5.33e-01
MRLHCYQASRRPSMTTNQPPLPMSHTDLGIGPSTSMRVQRARRKEKGMSSKKENAWESPPTEGISTQRARHKGQQPLIKYAKGVALAPTYPQVQ

SEQ ID NO: 218344 - protein, 157 aa, Glycine max
  Coding DNA Sequence Number=SeqID_101566
MAENMRHKWALGGGGGAKQWSRVSGVLGGKSHTNQVALELTGHRDDTEHIWFPWDLHVDLVCLVHAHGDGAGWCGSRGGGGGFSGGRTRRRCGVENSFYIDYMNNQCKKVEKIKIFPSTYKKEIIIKVMAMVARDPYVRLLPKVEALGDGVFQKLLA

SEQ ID NO: 218345 - protein, 117 aa, Glycine max
  Coding DNA Sequence Number=SeqID_101567
MSSTKTSIRVLTRLRKMKDVMDDLDLVEGIRHINTISWKTTTLPRKFLWRVAVVGGEVHRGLYDEWVVEDDIEQCCKEKRFDCDSDDETMRDRDIWTENKMSTKDNHDLAITGLAGN

SEQ ID NO: 218346 - protein, 68 aa, Glycine max
  Coding DNA Sequence Number=SeqID_101568
MKADIEAMKEQMTTMMKAMMSMRRMIEANTTTIVAASAAIEVNPTHPPGFNQVNRLALETHQVPHKKQ

SEQ ID NO: 218347 - protein, 94 aa, Glycine max
  Coding DNA Sequence Number=SeqID_101569
  Gene Ontology: Mol. function=RNA-directed DNA polymerase activity; Biological process=RNA-dependent DNA replication
  Homolog annotation: Hit_ID=Q1SYR3; Match level="QueryCoverage=87%, HitCoverage=3%, E-value=1e-19, Identity=53%"; Hit description=RNase H, putative
MNPPLLVPPVPGRPLILYMIVLDESMECVLGQHDESEKREQTVYYLSKKFTACEMNYFLLERTCCALVCALVVLWLVSKMDPVKYIFEKPALTG

SEQ ID NO: 218348 - protein, 622 aa, Glycine max
  Coding DNA Sequence Number=SeqID_101570
  Homolog annotation: Hit_ID=Q9LHL0; Match level="QueryCoverage=48%, HitCoverage=29%, E-value=7e-18, Identity=28%"; Hit description =Arabidopsis thaliana genomic DNA, chromosome 3, P1 clone: MJH23
  Pfam annotation: Domain name=WW; Domain location=1-25; Score=14.8; E _value=0.041; Accession=PF00397.16; Description=WW domain
MVMHEESQRCYYWNIETGETSWEVPQVLAHADQLANDSIPHAFVNDKTKSAAVGDNSNVLSAVMQDTSSAFIIDCSLEATVASHKELYGHGSQINGGSVECTNQNQGSDVNGNELTRNDGHMSLSDKGHHSSVSKFGVEEQQLDIVFPSRLVEQSESLLERLKSLKNVKSLYLPVPDLTNRILHRSKDNLQGQDFLSKYMLEIEIRLSDIRSLASYGSSLLPFWEHSDRKIKLLESLITDDLMQTGNSSHDEVEDVEDKLVPVSEELADQLNGMGHESEVDNNKNKGSLLTCDVSNESQVDASAAVLEDINNNISANGQHVPLSSSPGSHMETDVEINSKVEAIINPQEPIHKHGYNVGEDVDMDVDMEVEDMNSSGNTTVIDVPVANDSVHTDQLVQLNPPVDYHSVLPEEGEFVPPPPDDEWIPPPPPDNEHVPPPPPPDNDQVPPPPGDPLAPSYSVLPCYAETGQPLSYAQYSLYPGVAAEYYGQTAAEVPSSNIYGQIAMPPAQIYYNTAVPNIYSENPQFMINPTGTVAYYEVQDGAGSKSIPAININDSGVGEADWASCDSPSTSSSIHAPATVSVDEGVSLPPATAKSAAENNTSSLVPKAQTKGTDTEQVYCY

SEQ ID NO: 218349 - protein, 224 aa, Glycine max
  Coding DNA Sequence Number=SeqID_101571
  Homolog annotation: Hit_ID=Q9LHL0; Match level="QueryCoverage=59%, HitCoverage=16%, E-value=4e-32, Identity=49%"; Hit description =Arabidopsis thaliana genomic DNA, chromosome 3, P1 clone: MJH23
MYLLNAVHAPCELLSCMINSYPVIYDYLPFPSLFSVARNRKRAVAVGSSLKSNKKWKAAKEELLEEEEEPDSVFEVLERKRQREIEEWHAKQIASGEAKDNANFQPLVGDWREKVKRRRAQAAKESVSTPQDAIEHNQQQHDLSEHSKGLPTNWQAYWDDSTKQVYYGTGPDGAWNRTSYKISELLRTGASPFVAVPRKDFLCKFPKLCPHNCALLSSRNNLLR

SEQ ID NO: 218350 - protein, 161 aa, Glycine max
  Coding DNA Sequence Number=SeqID_101572
MEHLRKKIAADLESLRQKHKVNMRRLKEENGNLKARLVVHHPPPPPPISPSFQAPTHAEMRNQENHTHLSFYSNREEIPIHSKLRSLNIHNDVFSTFLKGPALTWYKFLPLRSVDSFTTLAQCFEVQYAISRPHSQPYTIFVALVNLRQTNDESSWSFMER

SEQ ID NO: 218351 - protein, 198 aa, Glycine max
  Coding DNA Sequence Number=SeqID_101573
  Gene Ontology: Mol. function=zinc ion binding
  Homolog annotation: Hit_ID=Q1S950; Match level="QueryCoverage=93%, HitCoverage=74%, E-value=2e-53, Identity=80%"; Hit description=Zinc finger, RING-type; RINGv
  Subcellular localization annotation: CTP_CleavageSite=44; ConfidenceScore=5.79e-01
MASAQNSHSPASSPSFMTRVAMRISRSRWFTFLRRVFHYQNGPRSDLGSNPFNSSTWMMLELIALLVQITSTTFTLAISKSEKPIWPMRVWIAGYDIGCVLNLLLLCGRYHQLHVTQGNNALTLSELEQQRNNEESRESPIIVVGLWECTWCTWGNKRGMRAGKGGHLKIKSHNSQVGDIKGFTPTWTLAMTLKAVKD

SEQ ID NO: 218352 - protein, 207 aa, Glycine max
  Coding DNA Sequence Number=SeqID_101574
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=2e-25, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=37; ConfidenceScore=5.08e-01
GLHALAFRGLHALIFRGLHVLAFRGSCTFIFRGLHVLAFRGSCTFTFRGLHILASRGLPVLTFRGLHILTFRGLHALTFRGLHALTFRGLHALAFVGLHALTFRGLHVLASRGLHVLAFRGPHTLFFRGLHVLTFRGLHVLTFRGLHTLAFRGLHALAFRGLHAFAFKRRHVLNFRGLHALAFRGLCVLTFSGLHIHTLREFKVFCP

SEQ ID NO: 218353 - protein, 101 aa, Glycine max
  Coding DNA Sequence Number=SeqID_101575
MVKNDVGIDRGCDLEASLPQKNTKNTQKGGQKGHLGVFLILGSLRLASGSPGPRRLRGEVTNSPTRVRKRFNLHILKAFSEIKEKKEKEEKRGRGAFESQP

SEQ ID NO: 218354 - protein, 81 aa, Glycine max
  Coding DNA Sequence Number=SeqID_101576
MAHGGRSQGQALLGITPPRHPVDPKKSNRALGFPALITGLCQFYGVSITPTKLIWPPINRAFIEKYCMPRQVEQQQEEDQQ

SEQ ID NO: 218355 - protein, 94 aa, Glycine max
  Coding DNA Sequence Number=SeqID_101577
MAPKKLLAKRSRKDVTGEGSSAAPQVDMEFDGHQFRSEEHQHRFQAIKGWSFLKERRVQLREGEYTDFQEEIARRQWTQLAAPIVEASFMMNQD

SEQ ID NO: 218356 - protein, 661 aa, Glycine max
  Coding DNA Sequence Number=SeqID_101578
  Gene Ontology: Mol. function=molecular_function; Cellular component =integral to membrane; Biological process=biological_process
  Homolog annotation: Hit_ID=Q9FG69; Match level="QueryCoverage=98%, HitCoverage=99%, E-value=0.0, Identity=63%"; Hit description =Arabidopsis thaliana genomic DNA, chromosome 5, P1 clone:MYN21
  Pfam annotation: Domain name=UPF0118; Domain location=207-645; Score=- 57.4; E_value=0.0068; Accession=PF01594.7; Description=Domain of unknown function DUF20
  Subcellular localization annotation: CTP_CleavageSite=39; ConfidenceScore=5.18e-01
MELVPYSDPSSTTPAWQDMFRSASARHPSSTPPPHAPPSQSHAPSPSPHAPPNPPSDADPDGKNTFSGDPQVRLALYIAMAHAGLAFAIFILYTFSKLLEQYLRPLQWAVLCSIPLRGIQQTLVKFWSEPLRLGLTETVLAVPVAVFRAFVGTLVEIREASFRVILRKPKPQQNRPSRKRSGFSKLLRLLVSFGIFTIAYERLGGFGALSLLGLGFLFSSNNVDSTMHTLSSYRSLSFRRSAISAFFTRGILRKLKIIVAIGLIVCMIVGFLSGVIFFSYKIGVEGKDAVISLKLHVEENNYAERIGVKKWMDENDVAGMVDSYTTKIYETVSDQIDGLALQYNMTEFVTGIKHFVISNPVNYSAPSKVLMTPSPYAEKFLSLKTRVRNREWSQIYAEVDSILRELVITREDLVEKAKGFAFKGMDVSQRIFTSSRTVLGSSTKFMFSIANSIISGAAEVFNFVSQSMVFIWVLYYLITSESGGVTEQVMCMLPISNSTRDRCVEVLDKAISGVLLATAEIAFFQGCLTWLLFRLNKIHFLYMSTVLAFISPLLPIFPSWLATIPAALQLVLEGRYIMAIVLSIIHLFLMDYGASEILEDVPGNSAYLTGLSIIGGMTLFPSALEGAIMGPLITTVMIALKDLYAEFVLQEPKDKSKQKAS

SEQ ID NO: 218357 - protein, 316 aa, Glycine max
  Coding DNA Sequence Number=SeqID_101579
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=35%, E-value=9e-38, Identity=42%"; Hit description=Chromo
MSFDVVSGDNNSTAETVIDNPHHLSLNALKESLGVGTIRFVAHINTLPVRVLVDGGMIRELSIQAQGNKFQLPVFLLPISGADLILGDNWLKTLGSHIADHDSLQLKFLHDGKFITLQGDDDESELPLLFHTYESVFETPTSLPPPRSHDQATPLLEGSKPVKVKPYRYLHSQKDEIEKLVQGMLEEGIIQTSARVTTETTKLEAITNWSQPTIIKQLRGFLGLTSYYRRFVKNYASIAQPLTDLLKKNSFQWSNCASQAFVQLKKAMTSAPVLAIPNFREPFIFETDAFGSGIEAVLSQSQHPIAYFSKKLSPRM

SEQ ID NO: 218358 - protein, 418 aa, Glycine max
  Coding DNA Sequence Number=SeqID_101580
  Gene Ontology: Mol. function=ATP-dependent helicase activity; Cellular component=nucleus; Biological process=RNA-mediated posttranscriptional gene silencing
  Homolog annotation: Hit_ID=Q8VY00; Match level="QueryCoverage=80%, HitCoverage=44%, E-value=2e-95, Identity=62%"; Hit description =Putative RNA helicase
  Pfam annotation: Domain name=HA2; Domain location=196-288; Score =98.3; E_value=2.3e-26; Accession=PF04408.13; Description=Helicase associated domain (HA2)
  Pfam annotation: Domain name=Helicase_C; Domain location=78-135; Score=0.1; E_value=0.016; Accession=PF00271.21; Description=Helicase conserved C-terminal domain
  Pfam module annotation: Pfam domain module=HA2::Helicase_C; Domain location=196-288::78-135
MVDEDHERTLSTDILFGLVKGLKWLLTLFLLRDIAHFRPDLKLLISSATLDVEKFSDYFDSVPIFRIPGRRYPVEISYTKAPEADYLDAAIVTSLSNPWARKVVLATNIAETSLTIDGIKYVIDPGFSGRSGRTGPGKCFRLYTAYNYHNDLDDNTVPEIQRTNLANVVLTLKSLGIHDLLNFDFMDPPPAEALLKALELLFALSALNKLGELTKVGRQMAEFPLDPMLSKMIVASENYKCSDDIISIAAMLSVGNSIFYRPKDKQVHADNARLNFHTGNVGDHMALLKVSSMKRARDIHDQLAGFFPHSARLQKNGSYRTVKHSQTVHIHPSSGLAQESIPSQVFQWLLDLEEGDVLGQLIGARDESKGLDEGGDTGNRGNNLGWEFCGQSSIVLSRRREGKAGFEGEKKGLVSNLL

SEQ ID NO: 218359 - protein, 110 aa, Glycine max
  Coding DNA Sequence Number=SeqID_101581
  Gene Ontology: Mol. function=nucleoside-triphosphatase activity
  Homolog annotation: Hit_ID=Q6YUI7; Match level="QueryCoverage=63%, HitCoverage=6%, E-value=7e-17, Identity=62%"; Hit description=RNA helicase-like
  Pfam annotation: Domain name=PWI; Domain location=4-77; Score=-5.4; E_ value=0.029; Accession=PF01480.8; Description=PWI domain
MESDDSLKTWVSDKLMSLLGYSQPTVVQYMIRLSKQVISPAHLVGKLVEFGISSMDTHAFAEEIYSRVPRRSSDKSSVTTASSRRSDNHKKCFRKKTEVQDDQDDEAMCS

SEQ ID NO: 218360 - protein, 150 aa, Glycine max
  Coding DNA Sequence Number=SeqID_101582
  Gene Ontology: Mol. function=nucleoside-triphosphatase activity; Cellular component=integral to membrane; Biological process=transport
  Homolog annotation: Hit_ID=Q1S953; Match level="QueryCoverage=97%, HitCoverage=21%, E-value=3e-69, Identity=85%"; Hit description=AAA ATPase
MAGFKRTVACFFLTLFSILLIAITSQGAGELFGAAIMSVQRAGTAASLILMLFLLTGGYYVQHIPKFMKWLKYLSFMYYGFRLLLKVQYSGDQLYDCESKGGCRTLQSSPTFGIVNLKGGLKEVWILLAMALVFRLLAYLCLRRRIDHSN

SEQ ID NO: 218361 - protein, 143 aa, Glycine max
  Coding DNA Sequence Number=SeqID_101583
  Gene Ontology: Mol. function=ATP-dependent helicase activity; Biological process=RNA-mediated posttranscriptional gene silencing
  Homolog annotation: Hit_ID=Q8VY00; Match level="QueryCoverage=98%, HitCoverage=13%, E-value=4e-44, Identity=61%"; Hit description =Putative RNA helicase
MSLQKGFKARILEEKGGKEIRRTKHCHCIDDIEDEQYLFEGVKLSEAEYRELRYKKEIYELVKKRSEEADNANGYRMPEAYDHEGGVNQEKRFSVAMQHYRDLNAEDKMNPFVEQEAWEEHQIGKATLKFGSKNKKQVSDDYQ

SEQ ID NO: 218362 - protein, 310 aa, Glycine max
  Coding DNA Sequence Number=SeqID_101584
MMTLKDDDKGDEQKAQRSKNNSSESRTSQEFKNQEESLQSRIKIQDSRSQESRSRFKTQDSRMKKRLNQDNDTGSTTTGKQKDKLEGCIERLLLLFHKISRGDGGQKYGFARFNGVVDVGMLEYQLDNMIIGGQKGNRTHVQEQRTTKHPQRMQPPVSYAIVVAKGNNNMEKRWFPRHTILTRSISHLTLQLNIPIEETKWYSNAWVGRLSNLVLFDKMEEEIMWVGGEGIMPKYLGDDMVLLMVLTNTRAEEMCREGAVNGMTLFYCLEKWNSSMRTEYRLVDDEIDKLWRLDRARVLIKTPRNRMDLA

SEQ ID NO: 218363 - protein, 141 aa, Glycine max
  Coding DNA Sequence Number=SeqID_101585
  Homolog annotation: Hit_ID=Q9LSF6; Match level="QueryCoverage=77%, HitCoverage=49%, E-value=4e-23, Identity=52%"; Hit description =Nodulin-lile protein
  Pfam annotation: Domain name=DUF125; Domain location=14-135; Score= -4.6; E_value=0.00063; Accession=PF01988.9; Description=Integral membrane protein DUF125
MTLNPGHERVFMSHFGANSFGVKIEGQNLHESSYLGPQTQNMEETQREKLPNPFQVVLASPLAFSVGALVPPIVAVFIRNQDIRMGVVATVISLALLVFGGVGVVVGKTPVTRSCLRVLVGGWMAMAITFGLTKLTGSADL

SEQ ID NO: 218364 - protein, 184 aa, Glycine max
  Coding DNA Sequence Number=SeqID_101586
  Gene Ontology: Mol. function=calcium-dependent phospholipid binding; Cellular component=plasma membrane; Biological process=cell differentiation
  Homolog annotation: Hit_ID=Q1SAR1; Match level="QueryCoverage=96%, HitCoverage=50%, E-value=2e-66, Identity=69%"; Hit description =Annexin, putative
  Pfam annotation: Domain name=Annexin; Domain location=114-179; Score =89.3; E_value=1.1e-23; Accession=PF00191.10; Description=Annexin
  Pfam annotation: Domain name=Annexin; Domain location=30-96; Score =44.6; E_value=3.2e-10; Accession=PF00191.10; Description=Annexin
  Pfam module annotation: Pfam domain module=Annexin::Annexin; Domain location=114-179::30-96
MAFEEKELLVGLVSSFRYGGSEINAKLAQSEADALHEAIKNKNKSNDEIIRILTTRSKTQLVATFNRYRDDHGIAITKKLSDEGSDEFHKAANLAISCINDHKKYYEKNFYPEPIVQVLRNAMEHLGTAEDALTRVIVTRAEKDLKEIKEVYYKRNSVHLEHAVAKETSGDYKKFLLSLMGKEE

SEQ ID NO: 218365 - protein, 159 aa, Glycine max
  Coding DNA Sequence Number=SeqID_101587
MTPHQKAIWFWLLVNNYNNILNCFAQIKMHDGGVRTLIEVCHVPELKKILYLWVPWIQMVSLAGLKMGLFILEENESLCSFIRSGKTSRWVEPRAKKGFFMGYGDGVKEFQVWSPSERKVFLSRYVIFDELSMLDSKTDEDLGKAEDVTKQVEFESSKV

SEQ ID NO: 218366 - protein, 46 aa, Glycine max
  Coding DNA Sequence Number=SeqID_101588
MNLGDEVAKRGINPHGKVATAAKQKISLRRKVKLGGCDVLHKKRTA

SEQ ID NO: 218367 - protein, 64 aa, Glycine max
  Coding DNA Sequence Number=SeqID_101589
MSESNNKGEMEVLITITPTSSLKVALLDYGQLKDLPDQLRVAYVNLVLVIANGDPLRAAESYGY

SEQ ID NO: 218368 - protein, 66 aa, Glycine max
  Coding DNA Sequence Number=SeqID_101590
MPKSSPNMHVKQEVSTRVKPRLLCKQSIGQNTPNKIDDDGSNSHQRRCPLTLKLLYVDSLLISIVP

SEQ ID NO: 218369 - protein, 62 aa, Glycine max
  Coding DNA Sequence Number=SeqID_101591
MDPTTRKVDGPHKKKLRTHLGVIARDKAEFDILEASDKRMKKKILQIVGERLRQFKSDLTSK

SEQ ID NO: 218370 - protein, 337 aa, Glycine max
  Coding DNA Sequence Number=SeqID_101592
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S954; Match level="QueryCoverage=98%, HitCoverage=95%, E-value=1e-113, Identity=66%"; Hit description=HPr serine phosphorylation site
  Pfam annotation: Domain name=DUF812; Domain location=1-337; Score= -89.0; E_value=7.5e-09; Accession=PF05667.2; Description=Protein of unknown function (DUF812)
MEPQTLEIEVTKDDVSINRANKDESSSRMEGFIKDEFDCVLNEKEPPEGQVDAGGGSFGNEENPFHIGDGPLTVLKQKEKKLVDEVSVRTSELAHLEQELELMNETAEMAFNNQHSIDFYIDQLNEQVQAKRNYLLTLESEWDTVRKPLEERKRSLEESLYSNNPDALEMLQKLREAQQEEQFILSEIMKREEEHLKLSADIEKKQKVASRKSYTDRIKEITKNSRKQDADIERILKDTRVVQLESNSIQESLHRTYAVADEIVFREAKKDPTGLHVYRLLVSIHKGFEQISEKILATDRIRREVAEYETKLAATASRSLDVSELKANLDAIIREKE

SEQ ID NO: 218371 - protein, 343 aa, Glycine max
  Coding DNA Sequence Number=SeqID_101593
  Gene Ontology: Mol. function=nucleoside-triphosphatase activity; Cellular component=integral to membrane; Biological process=transport
  Homolog annotation: Hit_ID=Q1S953; Match level="QueryCoverage=100%, HitCoverage=49%, E-value=1e-152, Identity=79%"; Hit description=AAA ATPase
  Pfam annotation: Domain name=ABC_tran; Domain location=116-304; Score= 156.3; E_value=8.2e-44; Accession=PF00005.17; Description=ABC transporter
MEIGKEDEIMDMSMSPPLVGSTNNDTCHNKDIMSQAYLQNKYSEIDIKIEGSNMEQNRPLPIFLKFENVEYKVRNRKAGSSNLVKTMVSKVSTQLTVEEDRYKKILKGITGSIGPGEILALMGPSGSGKTTLLRVIGGRIVDNVKGKVTYNDVRFTTAVKRRIGFVTQEDVLYPQLTVEETLVFSALLRLPTNMSKQQKYAKVNTTIKELGLERCRHTKIVGGYLKGISGGERKRTCIGYEILVDPSLLLLDEPTSGLDSTAANKLLLTLQGLAKAGRTIITTIHQPSSRIFHMFDKLLLISEGYPVYYGKAKDTMEYFSSLRFTPQIPMNPAEFLLDLATGQ

SEQ ID NO: 218372 - protein, 211 aa, Glycine max
  Coding DNA Sequence Number=SeqID_101594
MKWTKSATTLVAKRTEDDFLGVQSIRSQYPIITSGGLHSQKDEATLHEETIDVHDKEDKDIERYKRDLEESLNKLEHVKEERKRLKELRTCNLQGHHNQEEQKSACVKEKLNYALRKGVSLVQQDSLQQIIEEMIVEMEHLKSEINNEETTLAEHEQKLRQFSTHPDRLEALQSEILNKLSEIEVGGEGHLSDAVKLDCWNGLGDYALIYK

SEQ ID NO: 218373 - protein, 168 aa, Glycine max
  Coding DNA Sequence Number=SeqID_101595
  Homolog annotation: Hit_ID=Q1RZJ4; Match level="QueryCoverage=56%, HitCoverage=1%, E-value=8e-22, Identity=50%"; Hit description =Aldo/keto reductase; Sigma-54 factor, interaction region
MDEGRSCDRIQIVVGESKPLKSLGNDLYTFMLIQAFHSKILIQFVSTGVGTLILKLSILSFKFDGHFTITRQKYESGPLINYRDGGNRSLRAKDDSTTNEPGDGNCDEGDAQDDETVTPDEIGDGENADELTLDKDAAYSHRIAFKPDVLDQTSYTNMDLDVNKDASS

SEQ ID NO: 218374 - protein, 32 aa, Glycine max
  Coding DNA Sequence Number=SeqID_101596
MADVLGSLFFDITLFELTFAKVQEVSLDSLLQ

SEQ ID NO: 218375 - protein, 173 aa, Glycine max
  Coding DNA Sequence Number=SeqID_101597
  Homolog annotation: Hit_ID=Q1T236; Match level="QueryCoverage=34%, HitCoverage=13%, E-value=1e-09, Identity=51%"; Hit description=IMP dehydrogenase/GMP reductase
MAISTVKDLASNDFNTENKELDKLLGVPIVLVVAAAPAPTIKVPTCGWFQVPSLRRIVIPARTAWVPSPQGVAKSLDEIFNGISFDEVKVPRIYPHHLLPYNLESNHLNLSHDSNDLSRLFLIGLEICGERNWKDISQQFVLSKTPSQVASYAQKYFQNKNVPMKVRKRKKHP

SEQ ID NO: 218376 - protein, 316 aa, Glycine max
  Coding DNA Sequence Number=SeqID_101598
  Gene Ontology: Mol. function=transporter activity; Cellular component= intracellular; Biological process=transport
  Homolog annotation: Hit_ID=Q1S959; Match level="QueryCoverage=75%, HitCoverage=78%, E-value=1e-110, Identity=76%"; Hit description =Cellular retinaldehyde binding/alpha-tocopherol transport; Cellular ...
  Homolog annotation: Hit description=retinaldehyde-binding/triple function, N-terminal
  Pfam annotation: Domain name=CRAL_TRIO; Domain location=5-183; Score =18.9; E_value=3.1e-07; Accession=PF00650.10; Description=CRALTRIO domain
MKPIPTDLYKAIRDSQLIGMSGYSKEDLPVIAVGVGLSTYDKASPTATRKHGRYIGTCVKVLDMSGLKFSALNQLRLLTAISTIDDLNYPEKTDTYYIVNAPYVFSACWKVVKPLLQERTRRKIQVLQGCGKEELLRVMDYASLPHFCRKEDSKSSKHHASGNSENCFSFNHAFHQQLYNHIKQQAIIMESISPIRQGSFCVDIPEPDPDDAKIAKTIENEFHKLENQKNGFTNSLTGLLQLMAIESYATKASNCFWPLLSHFYLLITLWSLLEKEGYTCRSYLYPVIRSNIVMFASTRCKILQADLNLISTTTLR

SEQ ID NO: 218377 - protein, 84 aa, Glycine max
  Coding DNA Sequence Number=SeqID_101599
  Gene Ontology: Mol. function=transporter activity; Cellular component= intracellular; Biological process=transport
  Homolog annotation: Hit_ID=O48939; Match level="QueryCoverage=92%, HitCoverage=22%, E-value=2e-20, Identity=60%"; Hit description =Polyphosphoinositide binding protein Ssh1p
  Pfam annotation: Domain name=CRAL_TRIO_N; Domain location=7-75; Score= 15.2; E_value=0.00087; Accession=PF03765.5; Description=CRALTRIO, N -terminus
MGGGNQEAVKQLQTLMENVDDEQLKNTFQIMHQGYQTETLIRFLKARDWSVAKAHKMFKVLQLIDCLNWRVENEIDNVLRDLAN

SEQ ID NO: 218378 - protein, 241 aa, Glycine max
  Coding DNA Sequence Number=SeqID_101600
  Subcellular localization annotation: CTP_CleavageSite=65; ConfidenceScore=5.25e-01
MAFLGETSSQTIVNSRLAFTFPNGSIIHNKCGVYFQSSTSVPMRVPNMCDFATLKSRIHNTLQVNDNQVVDEIHYRRPLEDTSNKIHFQCMQLKDDMDVNTMLMCNDRFSCVGPIELLCTASRTPNGILNLLECTMTPTHDAVLYYNGRRNMPRQNNFIGYAFTRKNPQKFDIPKGCSLDKLKDLIKQVAPKGNPPHRIHESQVVLVESNYWKQFVPIEILALFSKLVMENEDEVVTSLQD

SEQ ID NO: 218379 - protein, 36 aa, Glycine max
  Coding DNA Sequence Number=SeqID_101601
MRLPKKCVPHKGAIGSATAAGALGRARDPGAFSWPV

SEQ ID NO: 218380 - protein, 124 aa, Glycine max
  Coding DNA Sequence Number=SeqID_101602
  Gene Ontology: Mol. function=DNA-directed RNA polymerase activity; Cellular component=nucleus; Biological process=transcription
  Homolog annotation: Hit_ID=Q1S957; Match level="QueryCoverage=76%, HitCoverage=24%, E-value=9e-38, Identity=78%"; Hit description=RNA polymerase, dimerisation
MSSSSSEDESMSEQSNELGLDFILSLDNVPSKLPPHLELFKTRVLCNNDAPVHTDTVQYSGAYAILGVDNSVRLDSFCENFKVEVKRLTDSDIEFDMIGIDPAIANAFRRILIAEVMYLCFPSL

SEQ ID NO: 218381 - protein, 326 aa, Glycine max
  Coding DNA Sequence Number=SeqID_101603
  Homolog annotation: Hit_ID=Q8LFZ9; Match level="QueryCoverage=87%, HitCoverage=65%, E-value=5e-68, Identity=48%"; Hit description =Sucrase-like protein
  Pfam annotation: Domain name=Suc_Fer-like; Domain location=15-172; Score=85.0; E_value=2.3e-22; Accession=PF06999.3; Description =Sucraseferredoxin-like
MEWNDFYYTLNYLKILNNGIQYHLVAFLLINPNVAYGMRRLTHFDVETFVEEVLVKEGNWLPGNPESLKASYVFVCSHGSRDRRCGVFGPILVSRFREEIELHDLLGKVLISSCSHIGGNNYAGNVIIFGSSINREVTGHLYGYVTPDDVPLLFRQHIIQGEIFDSLWRVSPSTAVKLCLVDCLVIGSNPETTSLYMQGGQIGLSEDEQKKKQEQRLQLNGGRNLGGMGAGCCQTDGESCCQDNEDSCCCQNDVLEEMTELSADNKRRENVNVISRINKGKGASLKFSSMPTWLDSWEQEDTYAAFAVVCAAVSVAIAYSCYKQMR

SEQ ID NO: 218382 - protein, 663 aa, Glycine max
  Coding DNA Sequence Number=SeqID_101604
  Gene Ontology: Mol. function=actin binding; Cellular component=proton- transporting two-sector ATPase complex; Biological process=protein modification process
  Homolog annotation: Hit_ID=Q1S960; Match level="QueryCoverage=99%, HitCoverage=100%, E-value=0.0, Identity=61%"; Hit description =Prefoldin
  Pfam annotation: Domain name=DUF827; Domain location=25-555; Score =512.9; E_value=3.5e-151; Accession=PF05701.2; Description=Plant protein of unknown function (DUF827)
  Pfam annotation: Domain name=Filament; Domain location=59-418; Score=- 183.8; E_value=0.09; Accession=PF00038.11; Description=Intermediate filament protein
  Pfam annotation: Domain name=Pox_A_type_inc; Domain location=104-126; Score=12.1; E_value=1.4; Accession=PF04508.3; Description=Viral A -type inclusion protein repeat
  Pfam annotation: Domain name=Pox_A_type_inc; Domain location=345-367; Score=4.3; E_value=19; Accession=PF04508.3; Description=Viral A-type inclusion protein repeat
  Pfam annotation: Domain name=Pox_A_type_inc; Domain location=412-434; Score=0.8; E_value=63; Accession=PF04508.3; Description=Viral A-type inclusion protein repeat
  Pfam module annotation: Pfam domain module=DUF827::Filament::Pox_A _type_inc::Pox_A_type_inc::Pox_A_type_inc; Domain location=25-555::59- 418::104-126::345-367::412-434
MVAKIRQSATESPNPKPEVGEIDTSPPFQSVKDAVSLFGEGAFSGEKPIFKKAKPYSAEVQVSMYLRVKRVLAKETQLHVAQKELNKLREQVKNAETTKAQALVELERAKRTVEDLTQKIKVISDSRELAIEATEAAKSQAKQLTEEKYGVPDGTNVAWKEELEAAVKRYASVMTELDAAKQALSKTRQEYDSSLDAKKSAFKLAAEAGDASKENTERASELSKEISAVKESIEQAKLASIVAQQQQTMILAEKDVLRQSYKATLEQSEKKLLALKKEFSPELAKNLEMQLAETMSEIGTLQKEMENKRTSDLDSVKSVTLELDDAKESLQKVADEESSLRSLVESLKVELENVKREHSELQDKESETESIVGNLHVKLRKCKSELEACMAEESKVRGASEEMILTLSQLTSETENARREAEDMKNRTAELKKEVEVTMLALEEAEKNLKVALEEAEAAKAAEKSALDQITILTERTTAARASTSESGAVITISKEEFDSLSHKVEESDKLADMKVAAAKAQVEAVKASENEALKRLETTQKEIEDIKTATQEALKKAEMAEAAKRAVESELRRWREREQKRAAEAASRILAETQVSTESSPQHYRIQKQNPPRTMVEVKKFEKEKVSVSKKTLLPNISGIFQRKKNQVEGGSPSYLPGENPV

SEQ ID NO: 218383 - protein, 99 aa, Glycine max
  Coding DNA Sequence Number=SeqID_101605
MVRGLATSSVTPSKKTPSGDDESMTPCKKTKEMLGLELAQSDLVQLTSWKILGPSGARPPQGQDDGGGNTTARRDLVKVVQKEEKNIVRRRKMTMRTFE

SEQ ID NO: 218384 - protein, 117 aa, Glycine max
  Coding DNA Sequence Number=SeqID_101606
MCMIRLRLLALNEYGSGVIDILTRSVCHIGWCIVGRQAIWREGWMIHLVEVRWGLGFTLATALVAATATALASNTFFMLIMASIIVAICSFMASMSAFICFCTSTTSPITLALARVR

SEQ ID NO: 218385 - protein, 186 aa, Glycine max
  Coding DNA Sequence Number=SeqID_101607
  Homolog annotation: Hit_ID=Q1T493; Match level="QueryCoverage=97%, HitCoverage=47%, E-value=7e-07, Identity=28%"; Hit description =Nucleic acid-binding, OB-fold, subgroup
MDLKEGCTYVMHNFRVSKNDGKYRVCDHPYKLTFIGVTIVRQCQLDGLPFKNYIFADFLDVIVGQLQSNLLVGSYPCSVSNSLKASKLTINEPVAPIEEFNKKLSELGIEICSVLTRRSQWSSQPSGSAQLSSRETFISKSEAKTISEINNFCEEFVCVTIGTITRIVMNNHSWLLCNLHSIAIRK

SEQ ID NO: 218386 - protein, 282 aa, Glycine max
  Coding DNA Sequence Number=SeqID_101608
  Gene Ontology: Mol. function=nucleic acid binding; Cellular component= intracellular; Biological process=DNA integration
  Homolog annotation: Hit_ID=Q1S9T9; Match level="QueryCoverage=98%, HitCoverage=35%, E-value=4e-69, Identity=55%"; Hit description =Peptidase S8 and S53, subtilisin, kexin, sedolisin; Integrase, catalytic region; Zinc finger, CCHC-type
MVKFPGFRRQGSRQGWWLKDLLRILMSIVNQFNLHLEQLDVKTTLLHGDLEETIYMRQPEGFALDDRKVVERSMMHQSNLVGTPLGQHMKLSKSQGPISNDDKKKMDAVPYTSGVGSIMYGMRNPQGRAVIEGFVDTYFAGCLNTRKSLSGYVFTLFGTAVSWKSNLQLVVALSTTEVEYNALAEGVKEGLWLKGMLHELGIEQETVQIHCDSQSAIHLANHQMYHARTKHIDVKCHFIREVVESGAIKLVKIAFEDNPVDMLTKSLPRDKFEKCLSLVGFV

SEQ ID NO: 218387 - protein, 244 aa, Glycine max
  Coding DNA Sequence Number=SeqID_101609
  Gene Ontology: Mol. function=nucleic acid binding; Cellular component= intracellular; Biological process=DNA integration
  Homolog annotation: Hit_ID=Q1RXN8; Match level="QueryCoverage=97%, HitCoverage=22%, E-value=3e-68, Identity=49%"; Hit description =Peptidase S8 and S53, subtilisin, kexin, sedolisin; Integrase, catalytic region; Zinc finger, CCHC-type
MPLTLMQAEKKSMIDKAKSAIILCLGDKALREVAKEKIAAGIWAKLESLYMNRSLAHRLCLKQLYSFKMAESRTIEEQLAKINKNIDDLENIGVKLEDEDKVVFILNALPKTFEHFRYALLYGKDQLITLEEVVTSIRTKEFQKLQDSKITEEVSSGLAVIKGKRKKGEGYESVGVLVASSDNSQKSWVMDSGCTYHMCLIKDYFEDLEQKEYGTVLLGNDKACKVHGIGIVRLRMFDNKYCKM

SEQ ID NO: 218388 - protein, 127 aa, Glycine max
  Coding DNA Sequence Number=SeqID_101610
  Gene Ontology: Mol. function=nucleic acid binding; Cellular component= oxygen evolving complex; Biological process=DNA integration
  Homolog annotation: Hit_ID=Q1S9T9; Match level="QueryCoverage=98%, HitCoverage=10%, E-value=3e-42, Identity=61%"; Hit description =Peptidase S8 and S53, subtilisin, kexin, sedolisin; Integrase, catalytic region; Zinc finger, CCHC-type
  Pfam annotation: Domain name=rve; Domain location=18-125; Score=11.1; E_value=0.0007; Accession=PF00665.16; Description=Integrase core domain
MGDKLHKLELCDQCVLGKSHRVKFGTDLWAASRIQTHGGGSYFLSIIDDYSRRVWVYILRNKTETFQKFKEWHTQIENHQGTKLKVLRTDNGLEFVSDQYNTFCTHHGSRGTKQLLVLLNKMTLQKG

SEQ ID NO: 218389 - protein, 101 aa, Glycine max
  Coding DNA Sequence Number=SeqID_101611
MSGLSLGVEYICQVDFELVASSRSILGLNVGVGLFSRLNDGVELAPALLARAWFLVSGRFWALLLVSGFEDGMLMLDCLVIETEMTVRCKYWLEEKGQWAR

SEQ ID NO: 218390 - protein, 74 aa, Glycine max
  Coding DNA Sequence Number=SeqID_101612
MNWSMMRALEEEMHVFPYNEVIDPIIHVEIPQQQVVDDEQNEVEDLVPHKRSERPHKPTKPTKFKDYYVYLQEH

SEQ ID NO: 218391 - protein, 56 aa, Glycine max
  Coding DNA Sequence Number=SeqID_101613
GGADKDYKEVPPPPLFKPAGGHINQAVTFNRSYYKVQIIGQLCTYYNLNSHPQGLG

SEQ ID NO: 218392 - protein, 75 aa, Glycine max
  Coding DNA Sequence Number=SeqID_101614
  Subcellular localization annotation: CTP_CleavageSite=50; ConfidenceScore=5.58e-01
MASAQLSAISSSISTASFEGLRPSAVQFASAGRIRIGNLSQRSFRGLVVKAATVVAPKVLLHLDKFIQTCRKVLN

SEQ ID NO: 218393 - protein, 397 aa, Glycine max
  Coding DNA Sequence Number=SeqID_101615
  Pfam annotation: Domain name=Transposase_23; Domain location=47-112; Score=-4.8; E_value=0.0038; Accession=PF03017.5; Description =TNP1ENSPM transposase
IASQHSAPLQPNDIQVLAARVSTKGSCATAETNALAKKPSELNGDNVGLHVTVENSNKLVAVGKRCDSFGTIHNVPYADDVVRVSVVEVIFGDAEVPIPTSEIKFVKEALGSFVPWPTHLVKPILPEEAEKDVSSPLKTVEEEKAAEVIDPLGELVKNLFDIYQRPVEVSWDGAKFGINNVKDGFFITHADVSKIILGDKCLNISILQLWLMFIHDWSASIGYGSLYGFLEPQCIHNASSRRQECENYIGRWLKEAGKQIYIAPYLNQAHWQLVVLCPGDNVVVWFCSLKKKPDAAIKGAVNSAMKSVTKTAEGKPPQHGPQWIEAKSHVQTGNYECGYYVMQWIWCIVSGGLKDDWIHWFSDRSPLTEETMTTLRHKWAAYFIQMKKCEPRKNLIT

SEQ ID NO: 218394 - protein, 105 aa, Glycine max
  Coding DNA Sequence Number=SeqID_101616
MRLEFASIFVDCMYANAFDDSKHLKQVFPILNFQETINFSPTKPLNENWNFQEIKAMLIQKEGRLKKMKDNSIHLTTYDGTSTIKSKSGEKGKGNAQLKVKEGGV

SEQ ID NO: 218395 - protein, 81 aa, Glycine max
  Coding DNA Sequence Number=SeqID_101617
MKREKLLVELEKELQVYRMKVHEYEVEDVDEEKEKEEKKKKKIKEVSHECSLVNKHKPIWMRKPEEMTKEEYSAIMKESHQ

SEQ ID NO: 218396 - protein, 1008 aa, Glycine max
  Coding DNA Sequence Number=SeqID_101618
  Gene Ontology: Mol. function=protein dimerization activity; Cellular component=nucleus; Biological process=regulation of transcription, DNA-dependent
  Homolog annotation: Hit_ID=Q1SGV7; Match level="QueryCoverage=98%, HitCoverage=87%, E-value=0.0, Identity=77%"; Hit description =Transcriptional factor B3; Auxin response factor; Aux/IAA_ARF _dimerisation
  Pfam annotation: Domain name=Auxin_resp; Domain location=244-326; Score=204.7; E_value=2.1e-58; Accession=PF06507.4; Description=Auxin response factor
  Pfam annotation: Domain name=B3; Domain location=117-222; Score =109.5; E_value=1e-29; Accession=PF02362.12; Description=B3 DNA binding domain
  Pfam module annotation: Pfam domain module=Auxin_resp::B3; Domain location=244-326::117-222
MSVPATGERKTINSELWHACAGPLVSLPPVGSVVVYFPQGHSEQVAASMQKEADFIPSYPNLPSKLICMLHNVALHADPETDEVYAQMTLQPVNKYDKEALLASDMGLKQNQQPTEFFCKTLTASDTSTHGGFSVPRRAAEKIFPPLDFSMQPPAQEIVAKDLHDNTWTFRHIYRGQPKRHLLTTGWSVFVSTKRLFAGDSVLFIRDEKQQLLLGIKRANRQQPALSSSVISSDSMHIGILAAAAHAASNNSPFTIFYNPRASPSEFVIPLAKYNKALFNQVSLGMRFRMMFETEESGVRRYMGTITGITDLDPVRWKNSQWRNLQVGWDESTAGERPSRVSIWDIEPVVTPFYICPPPFFRPKFPKQPGMPDDESDIENAFKRAMPWLGDDLGMKDASSSVFPGFSLMQWMSMQQNNQFSAAQSGFIPPSMLSSNALHGNLTTDDPSKLLSFQAPVLSSPNLQFNKPNLANQVNQLQQSPTSWSPQQQQQQQQQKLQSMLQTPLNPLQQQRQQQLPVPQNLPQPQQQQPQMPQQRAQQPQEQQQQSCQQTIMNNGAVASNQIPNQCVQQPVSYSQLQQQQLISGSIPPQQCFPSPNKNTLLMTSLPQDSQFQQQIDQQASLLQRQQLQQQQQQTQLQSSPLQLLQQSLSQRAPQQPQMTQMSQQNSSDQQPQLQMLQKLQQQQQQQQQQQQQKPLSTSSPLLQSQLLQQQNTHQQNQQFPQLPLSQGHQPQQLGNNAFSMEKLLNGNNYSSSSLMQTQQLSVNQPHNTQKSLTNTRAPSTLTDGDAPSCSTSPSTNNCQISPNLMKRNQQVSATLGGPSVVEPTNHLMQELHSKSEMQIKHELPSVRGTDQLKFKGTVADQMEASSGTSYCIDPNNIHQNFPLPNFCMDGDVQSHPRNNLPFASNLDGLTPDTLLSRGYDSQKDFQNLLSNYGGAPRDIETELSTAALSPQPFGVPDMPFKPGCSSDIAINDPGVLNNGLWANQTQRMRTYTKVFHLLIRLKIYRSI

SEQ ID NO: 218397 - protein, 122 aa, Glycine max
  Coding DNA Sequence Number=SeqID_101619
  Subcellular localization annotation: CTP_CleavageSite=61; ConfidenceScore=5.68e-01
MPTCQATRFNLVPQVFHNNNNNSNSNSYSKNSNNTTSPETNKKTQNPLWCLPQSSPITWSRINKKTHPFFPKMPPIVSLASTFSNSLPQHPRTQWNSSKNPKARNFQLKTNEAEGVQEAKTC

SEQ ID NO: 218398 - protein, 67 aa, Glycine max
  Coding DNA Sequence Number=SeqID_101620
MEHGVNLSFNFGLLKMRVAIWADIDWFRIRNEVYIVIEIEFSRVMYLDDFGQNHFNPPDPYDPLNPN

SEQ ID NO: 218399 - protein, 224 aa, Glycine max
  Coding DNA Sequence Number=SeqID_101621
  Gene Ontology: Mol. function=chromatin binding; Cellular component =chromatin; Biological process=chromatin assembly or disassembly
  Homolog annotation: Hit_ID=Q1SAV4; Match level="QueryCoverage=95%, HitCoverage=92%, E-value=2e-26, Identity=48%"; Hit description =Integrase, catalytic region
  Pfam annotation: Domain name=Chromo; Domain location=166-211; Score =8.5; E_value=0.096; Accession=PF00385.14; Description='chromo' (CHRromatin Organisation MOdifier
MGLLCPLPVPCRSWEDLSLDFITSLLAFCGYITILVVIDKFSKGIHLVKWNMLMNELCVSSIDGWTNRDVKFEIGDWVMVKLRPHKKSSVWGQSTEYLKLAKRFYVPFQVIDRIGPTAYKLQLLEEACIHPVFHCSILKPFHHPPSNDNLPSLALLVTFDDDHLIITPLSILYTRKTVDSKLQVLVQCQRLSLDDTSWEDWDQLQSDYHLEDKVLLDGKGNDNN

SEQ ID NO: 218400 - protein, 112 aa, Glycine max
  Coding DNA Sequence Number=SeqID_101622
MSRPTLRRRASRPTLRWEGNTKAHGCVFQGRKTRKVATNVYLRKTLENRKCGSTNFKYERFGSCFYAPGSQTQVDVPSTCTTKDVPSNVLRQSSQAVKPLKLCEWGYKRILK

SEQ ID NO: 218401 - protein, 133 aa, Glycine max
  Coding DNA Sequence Number=SeqID_101623
MIHVVKNVRIPKYLDLEWFFQQGFNISNMLEVQGLPKLVQMKKIFYPELVKVFYSYACVDLEGNLFSIVNGVDMVIDVSMWKEIIGLDMGKVHKFDETPNGYNKMQTYRGMLLDPARNLRNRLGVGGLTIEDR

SEQ ID NO: 218402 - protein, 78 aa, Glycine max
  Coding DNA Sequence Number=SeqID_101624
  Gene Ontology: Cellular component=integral to membrane; Biological process=transport
  Homolog annotation: Hit_ID=Q6YZD2; Match level="QueryCoverage=63%, HitCoverage=23%, E-value=9e-14, Identity=70%"; Hit description =Coated vesicle membrane protein-like
MKVGLSKFATAMVIFSSLNAVLGIRFVIDREDCFSHNVQYEGDRVQASFVVIKIDTSWQYTNDGVDLSRFLILILYAP

SEQ ID NO: 218403 - protein, 108 aa, Glycine max
  Coding DNA Sequence Number=SeqID_101625
  Gene Ontology: Mol. function=DNA binding; Cellular component=nucleus; Biological process=regulation of transcription, DNA-dependent
  Homolog annotation: Hit_ID=Q01CK3; Match level="QueryCoverage=78%, HitCoverage=38%, E-value=4e-11, Identity=41%"; Hit description=[O] KOG0724 Zuotin and related molecular chaperones
  Pfam annotation: Domain name=Myb_DNA-binding; Domain location=42-90; Score=28.7; E_value=2e-05; Accession=PF00249.21; Description=Myb -like DNA-binding domain
MSELLDNFSEFTDFFDHVAAPTAQVPTPERVPGYVSAPRKKDGRWTEEEHRLFLLGLDRCSGKRKWKQISQQYVVSRTSIQVASHAKNTSYTMGSWGPTEREEKKKHQ

SEQ ID NO: 218404 - protein, 217 aa, Glycine max
  Coding DNA Sequence Number=SeqID_101626
MGSTHWSHDSNMLLRVCHLLWVAHAGGLLGVIMLKRGITKGEPWALGASELKYNFRWAAFHVRGIALSSNSCSRYTPLSRLVVILERPSQLGPTFPAQGSFLAIRGRRVESSLLVDGSPTSMRIMAFVPYGPEDDSISYLYLSVSLWIDNGVWEAVPAYEVLPSEFFHLVGPKTVKVVRRSVWHVCKLLTSSASPSKVEGVCLECWPVIASSYRFGG

SEQ ID NO: 218405 - protein, 165 aa, Glycine max
  Coding DNA Sequence Number=SeqID_101627
MTGPFSWDETYQQAFLASKKTTATPSVLSDPGQDVILDAAKCYQMIKKVALAIVTLARRLRPYFWIIKWCFDDNKDDDKKAKRMISRLSQEQFKNQEFQGTSTWVVVTENKRGYISCGSVLVEGTSIRLFKENKGGYIPCGSLLVKDFTRLKINLKDRRSLGDWM

SEQ ID NO: 218406 - protein, 329 aa, Glycine max
  Coding DNA Sequence Number=SeqID_101628
  Gene Ontology: Mol. function=RNA-directed DNA polymerase activity; Biological process=RNA-dependent DNA replication
MADTNTLKQLQNRITEIERRHKEELRKLKADHDHLEARGHEQSSHTLPERTQGGSHPRCIGNNANDLSPSYMHRQAIQIVHRHPFVDRIMVADIPLGWKPLNLERYNGTTDPDEHLDAFLTQVNLYTNDDLILCHLFPTSLKGVTLTWSHCMTSTALASLPHADDESLRKFIDKFGRTVVQIQNLNHEVALHSMLLTLCPRKFIDSLCEKPLDSMDELRQRVKGYIQMEEMSKFRNEVRQAGQKHDKCEAQTKTDAYKSDNRHNLDKCQPLFKGHRYECYTRLMANHATILEEAFNLEIRQLSRSETRRTSRGAEQEPGSRQKESRRPK

SEQ ID NO: 218407 - protein, 314 aa, Glycine max
  Coding DNA Sequence Number=SeqID_101629
MSLSTATPFARERGQPASKVGLTAIAAEICLPTPPAIEAPVATVVTFATPVIPAPSPPPIVDFVQDIPTTTEVVVSAAQAGSAMVPPSTAWLLCLVSAGAEDLDWLCVRLRQKPYQEFGHYGGEWIATPGGGHQVEGYCSNYVAEKLDLGGKVESMATEKDGLAKRIAELESKLQATKEREASLFEKDLDLGLFDPFKDVKEGVLLEEEITAEEEEAVDEGQGAAKQDNNTSHPLMVMRSECEWHLIEGPIMQSGGGSLGGTLTLDGGRCLLPASAPDHTSSIKRCVYYEQDTLYLTMLMRSMVSPEMLNPNSS

SEQ ID NO: 218408 - protein, 125 aa, Glycine max
  Coding DNA Sequence Number=SeqID_101630
  Gene Ontology: Cellular component=integral to membrane; Biological process=transport
  Homolog annotation: Hit_ID=Q6YZD2; Match level="QueryCoverage=96%, HitCoverage=57%, E-value=3e-45, Identity=68%"; Hit description =Coated vesicle membrane protein-like
MTSEIFEFVARDNGPHRFCFTNKSPYHETIDFDVHSNHVHFTDQHAKDEHLTPLLDQITKLEHALFNIQYEQHWLEAQTERQAIVSNALSSRTLHKAILESMALMGASALQVYLLRRLFERKLAI

SEQ ID NO: 218409 - protein, 49 aa, Glycine max
  Coding DNA Sequence Number=SeqID_101631
MGLTESVTGFVERRYVSEGTEHCAVRFSVTRDVEWGMHGHMWCYSKKPA

SEQ ID NO: 218410 - protein, 81 aa, Glycine max; identical to SEQ ID NO: 145413
  Coding DNA Sequence Number=SeqID_101632
  Homolog annotation: Hit_ID=O22633; Match level="QueryCoverage=76%, HitCoverage=79%, E-value=1e-19, Identity=71%"; Hit description=NOI protein
  Pfam annotation: Domain name=NOI; Domain location=12-81; Score=97.8; E_value=3.3e-26; Accession=PF05627.2; Description=Nitrate-induced NOI protein

SEQ ID NO: 218411 - protein, 56 aa, Glycine max
  Coding DNA Sequence Number=SeqID_101633
MEGIQIVSPTRSKGDSDKSLQEHGCTVELCGRRLGDKLSGVVWQFEVEICERHRPM

SEQ ID NO: 218412 - protein, 268 aa, Glycine max
  Coding DNA Sequence Number=SeqID_101634
  Gene Ontology: Mol. function=manganese ion binding; Cellular component=chloroplast; Biological process=isoprenoid biosynthetic process
  Homolog annotation: Hit_ID=Q8VXZ0; Match level="QueryCoverage=93%, HitCoverage=67%, E-value=4e-92, Identity=67%"; Hit description=Nudix hydrolase 20, chloroplast precursor
  Pfam annotation: Domain name=NUDIX; Domain location=100-239; Score =17.5; E_value=0.003; Accession=PF00293.18; Description=NUDIX domain
MGKIYFNSFLPMIVAGFGNVFIFPKDKYNGGLYGDFVSLHPMLKTAEERTSAVGYVVERLGEEHIPGIRNELYPVISSFGAQIFFSLERAAAPYFGIKVYGTQMNGYVELDGQKHLWIGKRSGTKSTYPGMLDELVAGGLPHGINCQQNLAKECEEEAGIPRSISVNAIPVGAVSYKDIDGYRYKRDVLFCYDLKLPKDFIPKNKDGEVDSFKLIPVTQVAEIIRKTQFFKANCALVIIDFLFRHGYITPEYDGYLDLLRSLRIGDCS

SEQ ID NO: 218413 - protein, 554 aa, Glycine max
  Coding DNA Sequence Number=SeqID_101635
  Gene Ontology: Mol. function=poly(A)-specific ribonuclease activity; Cellular component=nucleus; Biological process=mRNA catabolic process, nonsense-mediated decay
  Homolog annotation: Hit_ID=Q9LG26; Match level="QueryCoverage=87%, HitCoverage=69%, E-value=1e-138, Identity=52%"; Hit description =Poly(A)-specific ribonuclease PARN
  Pfam annotation: Domain name=CAF1; Domain location=17-305; Score= -9.5; E_value=3.3e-08; Accession=PF04857.10; Description=CAF1 family ribonuclease
MSGISYLSREQERKALRSLNSTYDSEWSDIGKLKDVRDIPLLSAADILFTARMKNKFSEWRDGLFQEQNQEDQIQGISNDSKFQVTFFEMHPALRLNRFTSHQLKLIQLLIRKHFKDLSYVSVNSEASGSQQLVVYTDLKDELNLLLKKVKEENHRAEEMKIQAAVGFRHVIDLLSSEQKLIVGYNCFLDIAHVYSKFIGPLPGTPEEFVASVSKCFPHIVDTKILLSTNLMFQEKMKRSRKSLASAFTSFCPQIAAGSRSTDLGSLSHVKVNVEVDDSRSCSWSPGGKHEAGYDAFMTGCIFAQLCSDLGIDFKLHDSSKPLALNEKLQKYVNRLYLSWMHRDIIDLNTGNKVADSSLRSLTKRYPKIMFENIVIIWGFSSKLKANEIRECISKVFGPTSVVSVFHLDATAAFVQFSKTELVSDFLLVKDSLERSGGAISVLHPLSKLLEGGNTCGANYDTYREICGSSLSEGLFADQAEAVGIKWKTKLTEYKVASRGKEHENPSVQDNVNTVMKNVERTKPNTIDQLGNAPSCGQVSTFEIEDSYVAEANL

SEQ ID NO: 218414 - protein, 610 aa, Glycine max
  Coding DNA Sequence Number=SeqID_101636
  Gene Ontology: Mol. function=protein serine/threonine kinase activity; Cellular component=cell surface; Biological process =protein amino acid phosphorylation
  Homolog annotation: Hit_ID=Q9FHG4; Match level="QueryCoverage=85%, HitCoverage=75%, E-value=1e-157, Identity=56%"; Hit description =Serine/threonine-specific kinase like protein
  Pfam annotation: Domain name=Lectin_legB; Domain location=6-133; Score=-70.0; E_value=1.2e-05; Accession=PF00139.10; Description =Legume lectin domain
  Pfam annotation: Domain name=Pkinase; Domain location=240-515; Score =167.5; E_value=3.3e-47; Accession=PF00069.15; Description=Protein kinase domain
  Pfam annotation: Domain name=Pkinase_Tyr; Domain location=240-515; Score=116.6; E_value=7.3e-32; Accession=PF07714.7; Description =Protein tyrosine kinase
  Pfam module annotation: Pfam domain module=Lectin_legB::Pkinase::Pkina se_Tyr; Domain location=6-133::240-515::240-515
  Subcellular localization annotation: CTP_CleavageSite=41; ConfidenceScore=5.07e-01
TNTTPTTSSSTFTFFLYSSHNLSLIFHPNDDNHLTLDLTTPNSTLTNIPTTFTDLNTQNNNIPITSWLDYHAHTKKLNVFLNYSSVPSSKPQNPILSVDLDLSHYFKDNLYVGFSGSTLGSTELVQVMSWSFEFESFQKPGSNLHPDNGSRTPASVAVSDIPSPSNSTEGNSYNRGKRFFFGVAVAIAGPAFFCVVLVVLGYVSFLKWRGVRKLQKSFGTVGCCPKEFGYKEVKLATKGFHPSRVIGKGSFGTVYKALFESSGTIAAVKRSRQYSHEGRTEFLAELSVIAGLRHKNLVQLLGWCVEKGELLLVYEFMPNGSLDKVLYQECESGNNSNNVLSWNHRVNIAVGLASVLSYLHQECEQRVIHRDIKTGNILLDGSMNPRLGDFGLAKLMDHDKSPVSTLTAGTMGYLAPEYLQCGMANEKTDVFSYGVVVLEVACGRRPIEREGQKMVNLVDWVWGLHSQGTIIEAADKRLNGDFREGEMKRLLLLGLSCANPDSAQRPSMRRVLQILNNNQGVALVVPKEKPTLTFSSGLPLSLDEIVSDAEEELDSGQVVLSHIILAKFTSLTGVQAITLNFMEPDAIDLRNGHMRQTLKPIMIIDQNAKK

SEQ ID NO: 218415 - protein, 86 aa, Glycine max
  Coding DNA Sequence Number=SeqID_101637
MAQGLCCYLSLQEMKQATKNFDESNVIGVGGFGKVYKGVIDNGFKVAIKRSNPQSRRHQLTKKSDVYSFGVVLFEALYLRKVALDT

SEQ ID NO: 218416 - protein, 103 aa, Glycine max
  Coding DNA Sequence Number=SeqID_101638
  Subcellular localization annotation: CTP_CleavageSite=28; ConfidenceScore=5.35e-01
MTNDNATSSTTMDKLSTSGLLRRLQRTVVEATQTFFSDKELRLRQTASRVRCLLFRLQPPPTKCLRKIRWFHKWGLKSKDELRERPAAILHQWCHPVPHYQFR

SEQ ID NO: 218417 - protein, 77 aa, Glycine max
  Coding DNA Sequence Number=SeqID_101639
MENAELIKERMENKVVNFVGLNKVVSGIKMDEWDEVDFLELWFERTRVEMIGRKESLFPARATHKGCESPLIQPGCS

SEQ ID NO: 218418 - protein, 190 aa, Glycine max
  Coding DNA Sequence Number=SeqID_101640
  Gene Ontology: Mol. function=protein dimerization activity; Cellular component=nucleus; Biological process=regulation of transcription
  Homolog annotation: Hit_ID=Q1S5E6; Match level="QueryCoverage=52%, HitCoverage=13%, E-value=1e-18, Identity=50%"; Hit description=HAT family dimerisation domain, putative
  Pfam annotation: Domain name=hATC; Domain location=79-161; Score =97.5; E_value=4e-26; Accession=PF05699.5; Description=hAT family dimerisation domain
MYGVKKSEDMMIKLDDLIKNLFAEYVIQHPVSIDSSTSSTLASNIASTINANNGDEDEGWDGQFRLKMKKKHGEEKRKEFKRYLEDEIEEDNPGFDVLARWKMKATKYLVLSFMARDILALPVFTVSFESVFNTGGQLLDPFRSCLNPTMVEALIYAQNWLKTELYGLASNTANVGTNTRTTIGTFSIGS

SEQ ID NO: 218419 - protein, 376 aa, Glycine max
  Coding DNA Sequence Number=SeqID_101641
  Gene Ontology: Mol. function=transition metal ion binding; Cellular component=mitochondrion; Biological process=sporulation
  Homolog annotation: Hit_ID=Q017C3; Match level="QueryCoverage=58%, HitCoverage=62%, E-value=1e-38, Identity=39%"; Hit description=[S] KOG2861 Uncharacterized conserved protein
  Pfam annotation: Domain name=DUF155; Domain location=102-325; Score= -60.5; E_value=0.00041; Accession=PF02582.5; Description =Uncharacterised ACR, YagE family COG1723
MGGRWRTLSLIYNRINTSSSSKPHFPSFYRSLSLAAATSEIPDPDPIGFGAPELDPCVKIPVKAYFLSTSINLKGIQADNHRNVVPPSSRSSSNYVALRFCDFNLDSNVKGEIRGSSGSIFCYSANFSFWIWGGRHLIQGHGFHVKASNSRYMVVYQYGSAVLFNIEDHEVESYLELVKKHASGLLQDMRKDDYAIKEKPLQVEDMQGGPDYIVLKSLDTDGIRIIGSVLGQSIALDYFVSQVDGLVEEFAGINRGMEKTGTFTMDKKKLLQLVGKANSNLADVILKVGLFERSEIAWRDAKYAQIYEYLREEYEVAQRFGNLDFKLKFVEHNIHFLQEVLQNRKSDFLEWCIIGLLTIENVLSLYEILGASNTVS

SEQ ID NO: 218420 - protein, 109 aa, Glycine max
  Coding DNA Sequence Number=SeqID_101642
MLLKNLNKLLIALSMLRQHMCSLFLLVKEDVLNRLIGNMLVFFHPDEDMTKSKGKDPLEGLGGPMTRARARKAKEALQQVLSILFEYKPKFQGEKSKVVSCIMAQMEED

SEQ ID NO: 218421 - protein, 380 aa, Glycine max
  Coding DNA Sequence Number=SeqID_101643
  Homolog annotation: Hit_ID=Q9C9F4; Match level="QueryCoverage=27%, HitCoverage=30%, E-value=5e-12, Identity=40%"; Hit description =Putative zinc finger protein At1g68190
  Subcellular localization annotation: CTP_CleavageSite=24; ConfidenceScore=5.11e-01
MTSRDTNTSKFIHKPFDFSQVLLNCFVVKSNNCSHGSAELSCSSFRILYSDQKRQTILQQIIDFKWLQQNEEIDYSAKINRLQEKDSSPSVYQTLKKLDDKFNEQAQNSQDLATNVLEKDCPIMELNPETLPSTFSQLDNLYSSSTIDLPLHGELFWTCKSPLQSNQYSLEENIGLYTSLEYIQSMIMMKNGNREPTIINKTDNMLRIGNSKDIKSNKTSRTSFKTQLWSQNIQDLGICKELVCQDDFNIPDVDLTFQNYEELFGGDQDPIRILLDDQDVSCSSLEKDKSVDKSVIDNPSAMEESSAAASITISQSDLDNKDMNPLSQYCPRSMDPAHAIRPFDSTIPFSVLRFNEESSCTNHDDSALSPYSEGRAYSGS

SEQ ID NO: 218422 - protein, 125 aa, Glycine max
  Coding DNA Sequence Number=SeqID_101644
  Gene Ontology: Mol. function=nucleic acid binding; Cellular component= cytoplasm; Biological process=regulation of mRNA stability
  Homolog annotation: Hit_ID=Q1PFF3; Match level="QueryCoverage=81%, HitCoverage=34%, E-value=2e-45, Identity=80%"; Hit description=Zinc finger family protein
  Pfam annotation: Domain name=zf-CCCH; Domain location=41-67; Score =53.9; E_value=5.5e-13; Accession=PF00642.15; Description=Zinc finger C-x8-C-x5-C-x3-H type (and similar)
  Pfam annotation: Domain name=zf-CCCH; Domain location=79-105; Score =24.5; E_value=0.00037; Accession=PF00642.15; Description=Zinc finger C-x8-C-x5-C-x3-H type (and similar)
  Pfam module annotation: Pfam domain module=zf-CCCH::zf-CCCH; Domain location=41-67::79-105
MVLQVQRFNSRKQKYPQKVYVRGGQKEEEPLEMIVYNQGMFKTELCNKWQETGTCPYGDHCQFAHGIGELRPVIRHPRYKTEVCRMVLAGVVCPYGHRCHFRHALTEQEKAVVSQPKPRSMKLER

SEQ ID NO: 218423 - protein, 237 aa, Glycine max
  Coding DNA Sequence Number=SeqID_101645
  Gene Ontology: Mol. function=protein binding; Cellular component =chloroplast; Biological process=chloroplast fission
  Homolog annotation: Hit_ID=Q45RR9; Match level="QueryCoverage=84%, HitCoverage=86%, E-value=1e-101, Identity=92%"; Hit description =Plastid division regulator MinE
MEISVDHDSPRPPNNFSCLKRCDTAFMFSDFSVELGQVDFHPFLKGACSISEFTPKCPCLTIVRCNKRGYCKPVSAVFGGPKFTSDSVSQEAENFLLDAVKMNFFERLNLAWKIIFPSATSRKTSNARIAKQRLKMILFSDRCEVSDEAKRKIVSNVVRALSDFVEIESQDKVQLSVSADTDLGTIYSVTVPVRRVKPEYQEMDEFGTITNVEYKDTGESSGSVDVRFDFYVADESS

SEQ ID NO: 218424 - protein, 157 aa, Glycine max
  Coding DNA Sequence Number=SeqID_101646
  Gene Ontology: Mol. function=protein binding; Cellular component =kinetochore; Biological process=mitotic spindle checkpoint
  Homolog annotation: Hit_ID=Q9C795; Match level="QueryCoverage=91%, HitCoverage=52%, E-value=1e-31, Identity=44%"; Hit description =Mitotic checkpoint protein, putative
MVPIIRILDAEVDSMSVSGFNVTVAIGASMLVYDLRYFDQPVESKEAFNGTHLRCVSSIPDAEDIKSDALAGFAVGSVDGRVSLQISNPFSSNDISVSGAFATGDNEGYVTIWDAGSRRRLVELPRYPNSVASLSYNHTGQLLAVASSHTYQEAKEM

SEQ ID NO: 218425 - protein, 113 aa, Glycine max
  Coding DNA Sequence Number=SeqID_101647
METFIVSGSSLSFEEEAIIRDNVEEFSEDDLQDEVPDEANQDTKDEFKVDSASSNIFGGVEDLSSFILDRVFWFFKLCTEGFKCCKPVMQVDDTFSTGKCHVTLLNVIAQDEN

SEQ ID NO: 218426 - protein, 104 aa, Glycine max
  Coding DNA Sequence Number=SeqID_101648
  Gene Ontology: Cellular component=nucleus; Biological process=mitotic cell cycle
  Homolog annotation: Hit_ID=Q2HT10; Match level="QueryCoverage=88%, HitCoverage=14%, E-value=3e-27, Identity=64%"; Hit description=Barren
CLGRKANRFSDGSREQSNEYESFPSWDNGSVCGDDAGDYGGDLHSDMEDSNTLITQPRQVNKIEVQYDKTSKQVDVHALKITLWDHVQESVKLPLEVCQDFSIS

SEQ ID NO: 218427 - protein, 72 aa, Glycine max
  Coding DNA Sequence Number=SeqID_101649
EGAGGGGGDGGGEGEADDTVTEEGVAEEGDVAESEGGEDVGGRRRRKRMKMIVDGKYMMMCGKIGRMCEGRD

SEQ ID NO: 218428 - protein, 392 aa, Glycine max
  Coding DNA Sequence Number=SeqID_101650
  Gene Ontology: Mol. function=protein binding; Cellular component =nucleus; Biological process=mitotic cell cycle
  Homolog annotation: Hit_ID=Q2HT10; Match level="QueryCoverage=98%, HitCoverage=55%, E-value=1e-118, Identity=58%"; Hit description =Barren
  Pfam annotation: Domain name=Barren; Domain location=1-391; Score= -83.4; E_value=5.1e-08; Accession=PF05786.4; Description=Barren protein
MGRKQRLRIQSPTSPFVLGSNNDQLERARARDARAAANRRKSLALNQPLQANSHPGLNKQQILDLFQNCIKLASENKINQKNTWELNLIDHLTDIIKAEEEHDAETNFQKASCTLEAGVKIYSLRVDSVHSEAYKVLGGMNRAGQEAEEDTTLDGVNIESRQEESRKETSKKLSPLSTLESSFEALNVKKFDGDLKSYSVSVTCLMRRAAFVVDPLYRQTTAKFDEGGAKGLLMNNLGVYGGCRVLFDSQEVPAKCMASQNQSDISDTIDLSFLKDCIDQMVLDMRVKDEISPSLRTIVNQFDESNRRPTDIQLQGPSSAEDLDNADNNENGFDREEYENCTAWSDDHDDQTVVADLDYNDADPSFSSYPQDNAEQFPSPETDMDDRFENVE

SEQ ID NO: 218429 - protein, 233 aa, Glycine max
  Coding DNA Sequence Number=SeqID_101651
  Gene Ontology: Mol. function=RNA-directed DNA polymerase activity; Cellular component=integral to membrane; Biological process=RNA -dependent DNA replication
  Homolog annotation: Hit_ID=Q1RXD8; Match level="QueryCoverage=65%, HitCoverage=17%, E-value=9e-33, Identity=46%"; Hit description=RNA -directed DNA polymerase
MDRGLFEYTSMVLILVNGSPSNEFKLQRGLRQGNPFAPFHFVIVAEGLSSLMKEVISKNLFSSYRVGIDEVEVNLLQFMDDTINLGEVTLENVITIKCIMRCFELVSSLKVNFSKISFGAVGVESSEVEKFARLLNCSLLTLSFTYLGMSIGANPRRVTTWNSMSKWFDTRFRWKVGEGDKARFWLDNWAGEESFVEEDASGAYSVKSAYKALHEEMVGSQNVKLMPSIWKLN

SEQ ID NO: 218430 - protein, 234 aa, Glycine max
  Coding DNA Sequence Number=SeqID_101652
  Gene Ontology: Mol. function=RNA-directed DNA polymerase activity; Biological process=RNA-dependent DNA replication
KGAAETSGGGGERRELNQFIADMGVEDIPMHGRKFTWFKPNGKAMSRLDRIMVNREWLGRFQKFVEDAWRKLEVQGWGVFVLKEKLKWLKRELKKWNKEHFGNLESRFEEGQKEMNEIELKGEITSLSDLEIMRKKELQKKWKTVLRGINVDGCWVKEPLSNIIMLVANFDEGKVKEVDDAMQFLVEFHSMECFQEILANRLKRVLDGVIDKRQSAFIGGRNLVYSVVVGNGSY

SEQ ID NO: 218431 - protein, 151 aa, Glycine max
  Coding DNA Sequence Number=SeqID_101653
MPHQVMVRSQPANGHRRRGVGEVAGSAAADCTAVCCCCPCTVVNLVVLAVYKLPKGLVEKAAHKRRRRMPKKNNTGDVKNGVVLLQAQRSSSVETLDIAVGPTRLEEFMKKEWEDEEKGKCEKEEEEGLEKEMWARFAGTGFWRSESQRQP

SEQ ID NO: 218432 - protein, 297 aa, Glycine max
  Coding DNA Sequence Number=SeqID_101654
  Gene Ontology: Mol. function=DNA binding; Cellular component=beta -galactosidase complex; Biological process=DNA integration
  Homolog annotation: Hit_ID=Q1SDN3; Match level="QueryCoverage=90%, HitCoverage=32%, E-value=5e-78, Identity=65%"; Hit description =Polynucleotidyl transferase, Ribonuclease H fold
MNHTWTLTPLPPHKQVVGCRWIYKIKYNADGSIELYKARLVAKGYTQVEGLDCLATFSPVAKLTTVQLILALAAIFDWHLKQLDVNNAFLYGELNEEVYMSLPPGMHPAYSNQVCKLQKSIYGLKQASRQWFAKLSSFLIQHGYHQSAPDHSLFLKFSGSSTTVLLIYVDDIVLAGNNLFEIQLITGLLDAAFKIKDLGNIKYFLGLEVARNNSSEAEYRALATTTCELQWLTYLLNDLHVSAKQPALLYCVNQSALQIAANQVFHEPCRHLHEVSLTFNVHNFMFQAGNVESLFPA

SEQ ID NO: 218433 - protein, 67 aa, Glycine max
  Coding DNA Sequence Number=SeqID_101655
  Homolog annotation: Hit_ID=Q1T008; Match level="QueryCoverage=87%, HitCoverage=33%, E-value=7e-22, Identity=80%"; Hit description =Saposin B
VSELRVVELLDGLCEKMQDYTLKIDTNTYEWFKVDSWDNLTTNKQEARAYSKDISSYCGRNTYGIIL

SEQ ID NO: 218434 - protein, 293 aa, Glycine max
  Coding DNA Sequence Number=SeqID_101656
  Gene Ontology: Mol. function=nucleic acid binding; Cellular component= beta-galactosidase complex; Biological process=DNA integration
  Homolog annotation: Hit_ID=Q1S1G2; Match level="QueryCoverage=91%, HitCoverage=18%, E-value=1e-48, Identity=37%"; Hit description =Integrase, catalytic region; Zinc finger, CCHC-type; Peptidase aspartic, catalytic
  Pfam annotation: Domain name=zf-CCHC; Domain location=185-202; Score =8.3; E_value=0.042; Accession=PF00098.13; Description=Zinc knuckle
  Pfam annotation: Domain name=zf-CCHC; Domain location=219-236; Score =11.8; E_value=0.011; Accession=PF00098.13; Description=Zinc knuckle
  Pfam module annotation: Pfam domain module=zf-CCHC::zf-CCHC; Domain location=185-202::219-236
  Subcellular localization annotation: CTP_CleavageSite=51; ConfidenceScore=5.12e-01
MFTTLSAKNKVEFMDGSARQPSSFDRVYSAWKRCNNMVVSWLVHFVSSSIRLSILWMDSVEEIWCDLKSRYSHGDLLRISSLQLEASSIKQGDLFVTDYFTQLRIIWDELENFQPDLICVCTVKYVCKVSSILAQRKLKDRAISHVLLMDPLPPINKIFSYVAQQERQYSAPDSLAEVNATIMNSTCNFCGRTGHTKSTCYCKHGFPYKNGKSTSNHGKACSHCGKNGHTVDTCYKKHGFPPGHRFSNNKSASANSVLTTEVKANEKDVSTFTKHQETRFTPQQYQALLALIQ

SEQ ID NO: 218435 - protein, 61 aa, Glycine max
  Coding DNA Sequence Number=SeqID_101657
MATFKEEWEAVLDDLETKSAHLLVEEIDDVDGNSMDPFIAAAIANERELDLSYEQMRQFKK

SEQ ID NO: 218436 - protein, 292 aa, Glycine max
  Coding DNA Sequence Number=SeqID_101658
  Gene Ontology: Mol. function=hydrolase activity; Cellular component =cytosol; Biological process=carbohydrate biosynthetic process
  Homolog annotation: Hit_ID=Q67V42; Match level="QueryCoverage=98%, HitCoverage=87%, E-value=4e-87, Identity=55%"; Hit description=MutT domain protein-like
  Pfam annotation: Domain name=NUDIX; Domain location=99-256; Score =78.1; E_value=2.7e-20; Accession=PF00293.18; Description=NUDIX domain
MDLSVKILPATNDVHGGVIVDLKEPMDSEDFATLLRSSLLHWKQQGKDGVWIKLPIELVNLAETAVKEGFWYHHAEPNYLMLVYWIPKTGCTIPPNASHRVAVGAIVLNDKKEVLVVKEKRGGFHGIGVWKIPTGLVDAGEEIFEAAIREVKEETGIDTEFVEVLAFRHTHNSFFGKSDISFICMLCPLSFDIKKQELEIEAAQESKNIHDRGYFWFQVLQKIVDKMMWMPFKEFADQPFNQMHEPFKYMIELCLAKVEKVYNGFSPRPVSSYFVKELNYLYLNSHGLDKSS

SEQ ID NO: 218437 - protein, 79 aa, Glycine max
  Coding DNA Sequence Number=SeqID_101659
  Gene Ontology: Mol. function=GTP binding; Cellular component =intracellular
  Homolog annotation: Hit_ID=Q9M7P3; Match level="QueryCoverage=56%, HitCoverage=11%, E-value=2e-12, Identity=77%"; Hit description=GTP -binding protein
MVLRTKQSFFNWYESAFEDPDIIHVDDIVDPVRDLEVITEELRLKDIQFMERKIQDIEKSMKRSNDKQLKIELQCCQRV

SEQ ID NO: 218438 - protein, 106 aa, Glycine max
  Coding DNA Sequence Number=SeqID_101660
MTETLASLVLITITRGERERCKNERKQLQEDEVHLAHSSSSVAAIRALKECIARSRPCSSATSTSPASTWHSSRTSSPLRMSSAASPPLPPRSRLSVTSRSSALSP

SEQ ID NO: 218439 - protein, 332 aa, Glycine max
  Coding DNA Sequence Number=SeqID_101661
  Gene Ontology: Mol. function=protein binding; Biological process =defense response
  Homolog annotation: Hit_ID=Q1T032; Match level="QueryCoverage=53%, HitCoverage=37%, E-value=3e-20, Identity=54%"; Hit description =Disease resistance protein
MMITKDDDKGDDKKLKDQSENNSRYILCGTSRGYIYLGLTENKRGYISCGSVLVEGTSIRFKENKGGYIPCGSLLATQSNTEERQLSDRAIKDWLKKLSDAAYELDDFMDEYAHEELRLECEGVMCCLSEMVLSSFLPSINPVHVFFHYKIPKEMKRVSEKLDEISEEKISVGKGCFHFATIGLSKVATIMGSTPSYKLSELSHNDCWELFKHQAFGPDEKERVKLVAIGKKMVKKCWEMSLVAKALRGSLKLSSLPTQIGKLTSLRSLTRYADGKERKFLLAELGKLKLKGFLDIEHLERVKSVKDAKEFNMLMLQPDTQQLESLDVVGYE

SEQ ID NO: 218440 - protein, 53 aa, Glycine max
  Coding DNA Sequence Number=SeqID_101662
MGQKGFEGSEVKRIERIKKEEERRGNEVGALPNRDRDHSLHCSLFGVLRVTVD

SEQ ID NO: 218441 - protein, 139 aa, Glycine max
  Coding DNA Sequence Number=SeqID_101663
  Gene Ontology: Mol. function=nucleic acid binding; Cellular component= beta-galactosidase complex; Biological process=DNA integration
MGETSVILGIKIIRKGDNILLSQGHYVEKLLRKFGYYDSKSMNTLSPNQNHWDAIARLLGYLRGTMNYGIKYSGFTIVLEGYNNANWIFDTNETKSTSDYVFTLGGVTVAWRLSKQTIIARSTMELEFVALNMVGSEAE

SEQ ID NO: 218442 - protein, 141 aa, Glycine max
  Coding DNA Sequence Number=SeqID_101664
MRIDDVHNPLKNEKKEDDDGVRDWGVQIRVDNRRYDGVAERKGMKEGNQLAAGNINIINVVGGVTPNFMNAVVGEASISVNTETRGEYLLVIVKGEANTITRIERPSWLINGFREAVMDCSLLDIPMEAVSFHPVQKQGHS

SEQ ID NO: 218443 - protein, 100 aa, Glycine max
  Coding DNA Sequence Number=SeqID_101665
MTVKELNEEQQEAHVEEVVTDVEGFPGGPHDTSVLKDFENHIALREHPDLKLSSHGRKMAKFGRPTPEIEGLVVASKLSPLIACSLDTGDRGLMSAFVEC

SEQ ID NO: 218444 - protein, 428 aa, Glycine max
  Coding DNA Sequence Number=SeqID_101666
MSNSNENTAPATTIITTNTTTIHTDGEPIVHVEHYFNINMLEGLGLNIQHTLLLYGILEVVLSMDTIAQVARCIREGRPTMKTGRRPEVDGKKKVQYNLLGDMAKIWSNITQKSFMHKVGSKDSMSDLHKFVLFHLMDEIPFNLPHMNYIKILRNMKTLGGVDDIHNAAFINKLLWEHQVFHVFERLDEDSKHSIISKRTFVARQLHFGVVNLKAMKFDNIRNKLIILVDQDDIQHKRQKKLAKSMGKVSTRNQAQEEEEFVSKEQRTKKIHEGSKPSCLVKSQRTCPQTTPIRRSQRQITEQATKAQRLRDMSEIEDEDPLIIPRKQKEEPVEPIKIPSSAGYSSSDNEATPTPTPQPSSPPPTLGLTNKGRDCLHEVPEKDNGTNQTKSEGVVTPPQWMRYKYVYTPSAKHVALPSNAIVALDTPY

SEQ ID NO: 218445 - protein, 447 aa, Glycine max
  Coding DNA Sequence Number=SeqID_101667
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q7XAS3; Match level="QueryCoverage=99%, HitCoverage=68%, E-value=0.0, Identity=75%"; Hit description=Beta-D -glucosidase
  Pfam annotation: Domain name=Glyco_hydro_3; Domain location=1-145; Score=13.7; E_value=8.1e-10; Accession=PF00933.12; Description =Glycosyl hydrolase family 3 N terminal domain
  Pfam annotation: Domain name=Glyco_hydro_3_C; Domain location=217 -443; Score=178.4; E_value=1.8e-50; Accession=PF01915.12; Description= Glycosyl hydrolase family 3 C terminal domain
  Pfam module annotation: Pfam domain module=Glyco_hydro_3::Glyco_hydro_ 3_C; Domain location=1-145::217-443
MTEIIPGLQGDIPPNSRKGVPFVAGKKKVAACAKHYVGDGGTTKGINENNTVISRHGLLSIHVPAYYNSIIKGVSTIMISYSSWNGQKMHANHNLITDFLKNTLRFRGFVISDWQGIDRITTPSHANYTYSIYAGITAGIDMIMVPYNYTEFIDGLTSQVKNNLIPMSRIDDAVKRILRVKFIMGLFENPLADYSLVKQLGSKKHRKLARKAVRKSLVLLKNGEDADQPLLPLPKKASKILVAGSHADNLGYQCGGWTIEWQGLETNNLTKDSFSTSLAFVNLAKGTTILSAIKNTVDKDTEVVYKENPDLDYVKSNGFSYAIVVVGEKPYAETNGDSMNLTISEPGPDTIMNVCGGVKCVAVIISGRPVVIQPYLHLIDALVAAWLPGSEGHGVTDVLFGDYGFRGKLPRTWFKTVDQLPMNVGDSHYDPLFPFGFGLETKPPKAN

SEQ ID NO: 218446 - protein, 71 aa, Glycine max
  Coding DNA Sequence Number=SeqID_101668
MEVGELGGFCGDGVVKVGELRAKAANEGLERGLDLWGYIALHPPVRGAVVAGYHAVEVLTDAEGLGHVLRR

SEQ ID NO: 218447 - protein, 78 aa, Glycine max
  Coding DNA Sequence Number=SeqID_101669
MRKKMEAKEEKSVVVAEDDKSSGSWTMMEGVILVWTWERWWSKEGEARRRKMQGGGDDVVHAFGRLTWLHTCTTDMSN

SEQ ID NO: 218448 - protein, 118 aa, Glycine max
  Coding DNA Sequence Number=SeqID_101670
LPAISDSGFRHRLQHWTIKAKVHGAYLDGGRANLLNDRCSSRKLPRSTTASYLGNLLNEEEEEAQRRRASNEEEDAGRRSRKKKKQEGDPKEEEAEAQTRGGRERAIAGCTSKTAGCT

SEQ ID NO: 218449 - protein, 142 aa, Glycine max
  Coding DNA Sequence Number=SeqID_101671
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q75Z80; Match level="QueryCoverage=92%, HitCoverage=21%, E-value=3e-54, Identity=75%"; Hit description=Exo-1, 3-beta-glucanase
MAKIPIFSVGIMLLHCWAAMTGAEYLKYKDPKQPLNNRIKDLMNRMTLEEKIGQMTQIDRKVASAEVMNKYYIGSVLSGGGSVPRAQASAKDWIHMVNDFQKGALSTRLGIPMIYGIDAVHGHNNVYKATIFPHNVGLGATR

SEQ ID NO: 218450 - protein, 240 aa, Glycine max
  Coding DNA Sequence Number=SeqID_101672
YNLCGTSRAYIYLGCNTENKRGYISCGSIQVECTSTWLFKENKGEYIPCGSLLLKDFTRLLEISRTGGCLETRRLSVCAPVPRLTWRVDTCLRIPLEVDEFVEPPAWTSVVRVVSVKLFEMDMYLILQAKFGMSGVCGAHAILLHMFHSRSGHKLESWCMGHRYFDFLLPFLLLAIPFLLPSLSSILQATMMDREVISIGSSSSEDTRRGVSDSKSSSSERVRSSCCTGGDTSNPVIIDI

SEQ ID NO: 218451 - protein, 58 aa, Glycine max
  Coding DNA Sequence Number=SeqID_101673
VPSARLSARLALSPIPLTRANREGGAKHLGYTPFETWHRIFRGTGAQHSTVPILGKEP

SEQ ID NO: 218452 - protein, 58 aa, Glycine max
  Coding DNA Sequence Number=SeqID_101674
MVEVGTGASAQRNRNQCSCSRPSYKRNGSQVEGLQIHLALCANSKEIRPTGINSDNAQ

SEQ ID NO: 218453 - protein, 66 aa, Glycine max
  Coding DNA Sequence Number=SeqID_101675
MEEPNIRSWRGAALNTCSRRALARSNHKVEEMMVVVVVEQDMEVVLRVVVDKGIHIWSNSDMLGVE

SEQ ID NO: 218454 - protein, 399 aa, Glycine max
  Coding DNA Sequence Number=SeqID_101676
  Gene Ontology: Mol. function=nucleic acid binding; Cellular component= intracellular; Biological process=DNA integration
MHGGENNVSPVSKVYLTSESMHERLSDVSRSHETVESGDQGTRTCWRQWLGKVGTTTLLEIPKRVEPCNPRPKATSTPKPRLVIPELTKLATFALFISVKDPSTFQEAMKNQETDRLMGGLVEEIEFLHKNHTWELVELYEGKKAIEQMSEQDETFSIRKRRGKVQGSLSNQGVCIVEGDVKTTFLHDDLEEKNYMEQPDGFNKGGPRQLVCMLEMSLYGLKQSPRQWYKQFDSYMLQIDYWRCEYDYCVYEFDMKDLVRAKKILVLEGYIEKVLNRFNMRNVKHGDPSVVRYVNSDYVGDLDDRRSTTWYVFTLRGGPVCWKSIVQSLVAMPTTKAEYMEELGIEQGGVQLHCDSQSAIDLAKSRIHTSKNTVDMLTKVITTKKFKHFLDLLNVVQCK

SEQ ID NO: 218455 - protein, 84 aa, Glycine max
  Coding DNA Sequence Number=SeqID_101677
MKLVVDPWTSRSLVPKVFLKGESMDRGQTASPADVVVVQITKVYHRILVDKNGFHLREGLPCEKDSHLWERLLEYKCEVKFHIE

SEQ ID NO: 218456 - protein, 343 aa, Glycine max
  Coding DNA Sequence Number=SeqID_101678
  Gene Ontology: Mol. function=pyridoxal phosphate binding; Biological process=biosynthetic process
  Homolog annotation: Hit_ID=Q7EZJ0; Match level="QueryCoverage=36%, HitCoverage=11%, E-value=1e-28, Identity=46%"; Hit description =Putative ubiquitin-specific protease
  Pfam annotation: Domain name=MATH; Domain location=17-136; Score =49.3; E_value=1.3e-11; Accession=PF00917.16; Description=MATH domain
MKNKNGKLKFEKFTWRIQNFSKLDCKKLCSDKFLLDHHTWRILVYPKGADVGYLSIYLDAGVVNLPFGWSKFAHFKFSLINLANGKMTKIKETTKMFNATEIAWGFPKFIPLDELCDSSSGFIVNDTCIIEVQILVSKSEQDNQVNQQINKIDNNHDIDKPIKHTDNFLPKETLTTSFGELVDFRGLGKIEQVFVPLLEEVCSRHPSLIDSQQKRSGRFVEWAFTALGRVLHFLKTKKVKDMNGDACNHLQILWEELKMFRFDLTWLEPHVQSALGMKTCIERSVQMKRMGEDVTALEMETKRLKAKMIEAEVNLEIARRNLMKEKEGFEECDLDAELGYGRP

SEQ ID NO: 218457 - protein, 431 aa, Glycine max
  Coding DNA Sequence Number=SeqID_101679
  Gene Ontology: Mol. function=transition metal ion binding; Cellular component=nucleus; Biological process=proteolysis
  Pfam annotation: Domain name=Transposase_21; Domain location=89-280; Score=82.9; E_value=9.8e-22; Accession=PF02992.5; Description =Transposase family tnp2
LSALALINLKARFGWSDKSFTKLLVLLKKILLEDNTLLKDQYKAKKILCPVGMEYQKIHSCPNDCILYENQFVEMCKCPTCGVSQYKVKDEECCDDKATNNDHPTKTIDRLYPYFGDEPRNLRLGLASDKMNPFGNLSTNHSSWLVLLMIYNLPPWLCIKQKYILLCMMIAGQRRLGNDIDVYLIPLIKNLRKLWEDGVDVWDRNLQQSFRLCSMDIVTSSGKTQKKASSDKNIWKKRSISLDHPYWFDLDMRHYINVMHVDKNVCDSLIDTLLNIKGNTNEGLKCRQDLVNKEIESPQEDAVHGHVSQDSDTAMEVDINNSSLSTKDVNVWNSDYDGNAIVQLLLDHFLVKCNPSYICSYKGAYNIVELFLSHDPSQLELCGSNGKNAHLSACTWLYGKLQGLNKQETAKRYGKEKVHEWHKSFDIPPPK

SEQ ID NO: 218458 - protein, 163 aa, Glycine max
  Coding DNA Sequence Number=SeqID_101680
MPQIIAKATQSATPPKIIGALHLELEPDSSPTEPRELSGELAGAVPGEALLDGSVIGEPAGTADEGIPAGESGVGASATGGVPTGELTGATVGGGVAGDGADFAGGAVAGGGVDPDGETAGDCEGGDKVGDFAGGAGWVAGEGGLAVGDEGDDLGEGAGALSA

SEQ ID NO: 218459 - protein, 226 aa, Glycine max
  Coding DNA Sequence Number=SeqID_101681
  Homolog annotation: Hit_ID=Q1SWQ8; Match level="QueryCoverage=66%, HitCoverage=61%, E-value=4e-09, Identity=30%"; Hit description =Nucleic acid-binding, OB-fold; TonB box, N-terminal
  Pfam annotation: Domain name=DUF223; Domain location=13-97; Score= -13.8; E_value=0.056; Accession=PF02721.5; Description=Domain of unknown function DUF223
MWRLNKHNGRQSIEMVLMDHTGTKIGATLWQELFPEFEPKLRCGGAYVIQNMKVVDTHSDYKTTSVKEVDRPEIPPNVHAITSFADIISGVAKPDTLVVIERKTVNPAYRVTIKLRDNSHVEIIMTVWEEYALQLDDAIEKNHFVQKPLVVMLTLVKIKEPKDKYPLSVQNIKHGSKLYVNGDKNEIQQFHDSLCVPFYIGGLDDEGGVSQSQSTQNCQDKFLHNA

SEQ ID NO: 218460 - protein, 436 aa, Glycine max
  Coding DNA Sequence Number=SeqID_101682
  Gene Ontology: Mol. function=helicase activity; Cellular component =membrane; Biological process=protein amino acid phosphorylation
  Homolog annotation: Hit_ID=Q1SN45; Match level="QueryCoverage=99%, HitCoverage=25%, E-value=1e-113, Identity=49%"; Hit description=AAA ATPase
  Pfam annotation: Domain name=DUF889; Domain location=203-435; Score =348.9; E_value=8.4e-102; Accession=PF05970.5; Description=Eukaryotic protein of unknown function (DUF889)
MHLCLTEIENLLQANRKSLRDFPSMPYPLGYAAKMHQNNLIYNELAYNREILAAKFDKCYQSLTDEHASIFNKIMHVVATQSGGVYFLYGYGGTGKTFVWKTLSSAIRSTGGIVLTIASSGIASILLPGGRTTHSKFAILVPATKNSTCNIHQGSDLAELLHITKLIIWDEAPMCHRYSIEALDKSLQDIMHNNNPFGGKVIVFCGDFRQILPVVPRGNRSDIVYATLNSSYIWNHCQILKLTKNMRLQSNPTDHSNLDELKQFSEWLLDIGDGKLAEPNDGYGEITIPYEFLIKDFQDPIQTIVEATYPNLLHNYSNGDFLQKRVVLASTKDVVDKINDYVLSLIPGEEKEYCSAGSVDKSDELLSPSFGVLTAEFLNSLKTSGIPNHKLIIKVDTPIILLRNLDQADGLCNRTRLIVTRLGSSVVEAEIITGLT

SEQ ID NO: 218461 - protein, 293 aa, Glycine max
  Coding DNA Sequence Number=SeqID_101683
  Homolog annotation: Hit_ID=Q6ZBP8; Match level="QueryCoverage=22%, HitCoverage=10%, E-value=6e-27, Identity=81%"; Hit description =Putative cleavage and polyadenylation specific factor
  Pfam annotation: Domain name=RRM_1; Domain location=231-293; Score =44.3; E_value=4.3e-10; Accession=PF00076.12; Description=RNA recognition motif. (a.k.a. RRM, R
MDEGEGGYGESGDPMDQFHRNEAISAVADEGFLGEEEDDDYEDLYNDVNVGEGFLQSLRKNDDSGFRNDEVEEKKPPPPPPVPDAAGVSIPGVGGGGGSGVVESRVSGRVDGFQNQGYRGNEVGAKGGIRIELGNQSGNLSEIEDQGGNDGAAMQGIGQQPHGGVVGIVGNEGLVRQGQGGVGGGGGGGNVNRVGGNGVGNSVSAVTSVNTGGVGGAGGGGGAAGSGGTILFVGDLHWWTTDAELETELSRYGPVKEVKFFDEKASGKSKGYCQVEFFDPSAATACKEGMNGH

SEQ ID NO: 218462 - protein, 261 aa, Glycine max
  Coding DNA Sequence Number=SeqID_101684
  Gene Ontology: Mol. function=helicase activity; Biological process =protein amino acid phosphorylation
  Homolog annotation: Hit_ID=Q1SN45; Match level="QueryCoverage=94%, HitCoverage=14%, E-value=1e-60, Identity=48%"; Hit description=AAA ATPase
  Pfam annotation: Domain name=DUF889; Domain location=30-258; Score =316.0; E_value=6.7e-92; Accession=PF05970.5; Description=Eukaryotic protein of unknown function (DUF889)
MCHRYSIEALDKSLQDIMHNNNPFGGKVIVFCGDFRQILPVVPRGNRSDIVYATLNSSYIWNHCQILKLTKNMRLQSNPTDHSNLDELKQFSEWLLDIGDGKLAEPNDGYGEITIPYEFLIKDFQDPIQTIVEATYPNLLHNYSNGDFLQKRVVLASTKDVVDKINDYVLSLIPGEEKEYCSAGSVDKSDELLSPSFGVLTAEFLNSLKTSGIPNHKLIIKVDTPIILLRNLDQADGLCNRTRLIVTDLVQVLLKRRLLLA

SEQ ID NO: 218463 - protein, 85 aa, Glycine max
  Coding DNA Sequence Number=SeqID_101685
MKTYDANVDGKEVKLAEGLAHVVARTIIDLAHLMVGEGTLRCEGVGEGIEKERKDGFWFGLEEERKGGHFCGTFLCGGIIHHDQA

SEQ ID NO: 218464 - protein, 153 aa, Glycine max
  Coding DNA Sequence Number=SeqID_101686
MTLRSAQMHNSSFFRILPCAQPRSVALSGWLAKPEDWLSKRSCQWWRQDGGNLSSPSLENLCLLTLTANKHMILHQNMGIRKWAQEIQKHNDCPHVLSRGGYDLLEKKLLDEKRRRLQEEAMLTENTTIIDNPHLQFKDMLNGRWPAPSVMAI

SEQ ID NO: 218465 - protein, 67 aa, Glycine max
  Coding DNA Sequence Number=SeqID_101687
MTKLEQKAEMKVAEFRSIEPKEETILQLQIAKITIQGRDVDGQTARTQGRDQNVNARSHNAQKEGTK

SEQ ID NO: 218466 - protein, 53 aa, Glycine max
  Coding DNA Sequence Number=SeqID_101688
MGRKPRGVRGLGLNKGSWIPEEDMKLVATNVRQFTCSESSLSFGSIQNSKINM

SEQ ID NO: 218467 - protein, 140 aa, Glycine max
  Coding DNA Sequence Number=SeqID_101689
MTKNSVLKEHNKTFLNWFKDPIFGDDNASKTLRKLANKPKRNLITWHMDTPLSFPLPHLESAAPSPSTSNKTRKATQLRSLATRLVEAERSVIHVDLATGKVEGPHRKKLRTYLGIVTCDKVDVTYDNWKQVPIAQKDLI

SEQ ID NO: 218468 - protein, 106 aa, Glycine max
  Coding DNA Sequence Number=SeqID_101690
  Gene Ontology: Mol. function=4 iron, 4 sulfur cluster binding; Biological process=metabolic process
  Homolog annotation: Hit_ID=Q6YNR9; Match level="QueryCoverage=86%, HitCoverage=9%, E-value=4e-23, Identity=64%"; Hit description =Putative aconitase
MAGTDSHTTMIDGLGVAGWGVGGIEAEAAMLGQTCVVLTIGGVIPMSMVLPGVVGFKLLGKLRDGVTTTDLVLIVTQMLRKHGVVGKFVDFYGGDNKENHFPFRKH

SEQ ID NO: 218469 - protein, 167 aa, Glycine max
  Coding DNA Sequence Number=SeqID_101691
MTKYAGISSKLHPRGSIQHTDIDSYFCTTSKISHLVFKLLAYPNTSGCIQCHKKTDVNLGNGYCTPAQLRNHQLQPISKMSITLSTMTSRWAPHYPNFAHFSYDGAMYEVQIRQDQGKFFFADGLKTFRKDLGIYESTTINFLAYEQKWIFNLHFTPPLDQQSCDRH

SEQ ID NO: 218470 - protein, 148 aa, Glycine max
  Coding DNA Sequence Number=SeqID_101692
  Gene Ontology: Mol. function=protein serine/threonine kinase activity; Cellular component=integral to membrane; Biological process=protein amino acid phosphorylation
  Homolog annotation: Hit_ID=Q6DU55; Match level="QueryCoverage=99%, HitCoverage=25%, E-value=1e-21, Identity=39%"; Hit description=S -locus-like receptor protein kinase
  Subcellular localization annotation: CTP_CleavageSite=30; ConfidenceScore=5.03e-01
PKVADFGLSKLLNKNNLNNNSSFSMIRGTRGYMAPEWIYTLPITSKVDVSSFGIVLLEMITGKSPTMDIETVDGTEPHDGRLVTWVREKKRRTSWIEQILDPSIEPSCDVNKMEILATVAFDCVEEDKDVRPTMKQVIEMLQSYESDA

SEQ ID NO: 218471 - protein, 274 aa, Glycine max
  Coding DNA Sequence Number=SeqID_101693
  Gene Ontology: Mol. function=nucleic acid binding
MKGIHLNSPTQCSLRQSETSHLKPLKRRIHQKVILQPHDRISDISLEYPQLVGCGMLKFTSVKVVDDDDVKEFGLPNKELGPFSDDEDKILCNQPHEERDEEADLIPSSTTAPTYYIAAHMHNVDFKSNFQDFEYGHTLDREDVQHSMGTLFEGMCFEIKEEVQHVLQQYHLIVKCDDDGCAWTYKTAYILASKKWEIRKLHEPHTCSNPAISQGHVKLSYMLISKSIRMLINNYRSTSVPTLIAHVKSTEGYTMMYRKTWLAKQKTIENIYDN

SEQ ID NO: 218472 - protein, 61 aa, Glycine max
  Coding DNA Sequence Number=SeqID_101694
MGKFKLNCDGAVAVGDVTGCGGIIRDHEGHMVVAFANNLGDVYSWMHIYLEANQVADVLSK

SEQ ID NO: 218473 - protein, 264 aa, Glycine max
  Coding DNA Sequence Number=SeqID_101695
  Gene Ontology: Mol. function=protein serine/threonine kinase activity; Biological process=protein amino acid phosphorylation
  Homolog annotation: Hit_ID=Q5QLR7; Match level="QueryCoverage=99%, HitCoverage=33%, E-value=2e-50, Identity=41%"; Hit description=S -receptor kinase-like
  Pfam annotation: Domain name=B_lectin; Domain location=29-130; Score =24.6; E_value=1.3e-05; Accession=PF01453.15; Description=D-mannose binding lectin
  Pfam annotation: Domain name=S_locus_glycop; Domain location=132-261; Score=-22.9; E_value=0.0018; Accession=PF00954.11; Description=S -locus glycoprotein family
  Pfam module annotation: Pfam domain module=B_lectin::S_locus_glycop; Domain location=29-130::132-261
MFCAGFSQVRENAFSFDIWFNESHTHNNSNTVVWIANREQPVNGKLSKISLLNSGKVVLVNAGQIITWSSNTAPHAPVELHLQDDGNLVLRELQGKICGKFRFHNRYSSSRQTNLSSGFYKLLFDDDNVLRPVYDGSDVSSTYWPHPWLRSWEAGRFNYNSSRVAVLDSLGNFNSSDSYAFSTDDHGRVMPRRLTLDSDGNVRVYSRNEALKKWYVSWHFIFDTCTILGICGANSSSNYDPQKQRRCSCLPGYRVKNHSDWSYG

SEQ ID NO: 218474 - protein, 137 aa, Glycine max
  Coding DNA Sequence Number=SeqID_101696
MEMQKEAEEKQQQKMLESEELFDNIHAHLGPHVNAIEPLLIEANLEEPMERRFLAEHMETNLLIKNTLVASIRQTLVYTYTSTTSTTSNHIMQPHLKVPALMVPTSEVVILTDPVPTPLPSPPKSPRSTPQPSSTEG

SEQ ID NO: 218475 - protein, 446 aa, Glycine max
  Coding DNA Sequence Number=SeqID_101697
  Gene Ontology: Mol. function=sequence-specific DNA binding; Cellular component=nucleus; Biological process=regulation of transcription
  Homolog annotation: Hit_ID=Q5IY47; Match level="QueryCoverage=97%, HitCoverage=96%, E-value=1e-126, Identity=60%"; Hit description=DNA binding protein WRKY2
  Pfam annotation: Domain name=FLYWCH; Domain location=322-390; Score =4.9; E_value=0.021; Accession=PF04500.7; Description=FLYWCH zinc finger domain
  Pfam annotation: Domain name=WRKY; Domain location=165-223; Score =146.1; E_value=9.2e-41; Accession=PF03106.6; Description=WRKY DNA -binding domain
  Pfam annotation: Domain name=WRKY; Domain location=333-392; Score =154.9; E_value=2.1e-43; Accession=PF03106.6; Description=WRKY DNA -binding domain
  Pfam module annotation: Pfam domain module=FLYWCH::WRKY::WRKY; Domain location=322-390::165-223::333-392
MAGGGGGDRPPWKEAAPPRPTITLPPRSGSMETLFNGGFSPGPMTLLSGFLGDGDDGKSFSQLLAGAMASPVAGAVADGVMDSPSLFSPSQALTQVSAQASQANSNMHIQAEHSLTQASAATFNTTQQLIPPLNADSWATMTESADHSHSEQRLQSSLLNVDKPADDGYNWRKYGQKQVKGSEFPRSYYKCTHPNCSVKKKVERSLEGHVTAIIYKGEHNHQRPHPNKRSKDTMTSNANSNIQGSVDSTYQGTTTNSMSKMDPESSQATADHLSGTSESEEVGDHETEVDEKNVEPDPKRRKAEVSQSDPASSHRTVTEPRIIVQTTSEVDLLDDGYRWRKYGQKVVKGNPYPRSYYKCTTQGCNVRKHVERASTDPKAVITTYEGKHNHDVPAAKNNSHTMASNTASQLKSHNTNPEKHNFGSRGMGGNEQQPVARLRLKEEQIT

SEQ ID NO: 218476 - protein, 96 aa, Glycine max
  Coding DNA Sequence Number=SeqID_101698
MSKFVPLDYGHQALPLTKDDVYNVGMMKMRCGLTYQWPSYPPGLYIYCKTTIKFMPNRIAPRLPPLDLMKQKNKVPPHNFDYTLLLHNFYSYNQGL

SEQ ID NO: 218477 - protein, 369 aa, Glycine max
  Coding DNA Sequence Number=SeqID_101699
GLPVRSKFKQDPLSGLIAHIMSLAISLHFHGCLRFQKFLANGLKSFLSNGQHVVDNIKIRGPYYVLRKVERLATKGGSIPKCTPFENRSITTRMTVLLWYGGSLMMKSWERSSYGQCGTVLTSRNFLKLELWSSRSLYVRLWVWCDIPLAEWKLSKVPLDDYPTDVEVLSKKSNKEPKGSWKERVHVQAIEKVHQQLGCELRSDIESDSCTLLTVPGAVVFKELVDLEDPTKGATRYGRGNWWSSGQQRGNTVEEFINFVGHHGQDKESTNDMGLQSEVGFEDHGLHRQGREIRKKEKGKGEGGYYWRYKEAMALTADPITSQVVFRGFKDTKTPLYATGDVTNIAVDPLFMFVFRLDVSGAAITHVIS

SEQ ID NO: 218478 - protein, 543 aa, Glycine max
  Coding DNA Sequence Number=SeqID_101700
  Gene Ontology: Mol. function=nucleic acid binding
  Homolog annotation: Hit_ID=Q9FM71; Match level="QueryCoverage=85%, HitCoverage=66%, E-value=2e-88, Identity=41%"; Hit description =Arabidopsis thaliana genomic DNA, chromosome 5, P1 clone:MDF20
  Pfam annotation: Domain name=RRM_1; Domain location=78-149; Score =81.2; E_value=3.3e-21; Accession=PF00076.12; Description=RNA recognition motif. (a.k.a. RRM, R
  Subcellular localization annotation: CTP_CleavageSite=51; ConfidenceScore=5.12e-01
MQGIGQQPHGGVVGIVGNEGLVRQGQGGVGGGGGGGNVNRVGGNGVGNSVSAVTSVNTGGVGGAGGGGGAAGSGGTILFVGDLHWWTTDAELETELSRYGPVKEVKFFDEKASGKSKGYCQVEFFDPSAATACKEGMNGHVFNGRPCVVAFASPFTVKKMGEAQINRNQQMNQSAVPQGRRGPADAGAKPGGSNISTGGNYQGGEGNRGYGRGGGNWGRGNNPGMGNRGPVNPMRNRGGGMGGRGIMGHGGNGFGQGMGGTPPMLHPQSMMNQGFDPAFGGPMGRMGGYGGFPGAPAPPFSGILPSFPGVGGVGLPGVAPHVNPAFFGRGMPVNGMGMMPGSVMDGPNMGMWSDPNMGGWGGEEPGGGKAGESSYGEEAASDQQYGEVSHDRAGWPMREKDRGSERDWSGSSERRYRDDRDQGYERDASREKDMGHDHEWSERRHRDDRETGRERSRDRERSRDRDRDRDREKDLRERDRHREDRDGYADHHRFRDREAEHDDEWERGRSSRTHSKSRLSQEEEHHSRPRDADYGKRRRLTSE

SEQ ID NO: 218479 - protein, 211 aa, Glycine max
  Coding DNA Sequence Number=SeqID_101701
  Gene Ontology: Mol. function=sequence-specific DNA binding; Cellular component=intracellular; Biological process=regulation of transcription, DNA-dependent
  Homolog annotation: Hit_ID=Q6YNK1; Match level="QueryCoverage=88%, HitCoverage=95%, E-value=7e-55, Identity=59%"; Hit description=HAP3 -like transcriptional-activator
  Pfam annotation: Domain name=CBFD_NFYB_HMF; Domain location=27-92; Score=130.9; E_value=3.5e-36; Accession=PF00808.13; Description =Histone-like transcription factor (CBFNF-Y) and archaeal histone
  Pfam annotation: Domain name=Histone; Domain location=21-95; Score =1.3; E_value=0.091; Accession=PF00125.14; Description=Core histone H2AH2BH3H4
  Pfam module annotation: Pfam domain module=CBFD_NFYB_HMF::Histone; Domain location=27-92::21-95
MADSDNDSGGAHNAGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPPTNATNSAYESPSYAAAPGGIMMHQGHVYGSAGFHQVAGGAIKGGPVYPGPGSNAGRPSKHIWWKDLAKIEHKEILIATRMV

SEQ ID NO: 218480 - protein, 1122 aa, Glycine max
  Coding DNA Sequence Number=SeqID_101702
  Gene Ontology: Mol. function=nucleic acid binding
  Homolog annotation: Hit_ID=Q6K431; Match level="QueryCoverage=7%, HitCoverage=8%, E-value=3e-07, Identity=32%"; Hit description =Trithorax-like
MEGRTENSNDTTCPKKSRSLDLKSLYKSKWTENTAKTNLKRIGNSSGGGDEKRKKKKARKEVSLSSLENGDGSRELKLGLSQRFSSSCSSVLNKISFSVGDDDVQIPKRKRSFVGRKKSELGQASKLVEQPGLKIGYGDQVPKLGSDDLGNGVESFKIKHRKEFDEFKENRISDSNSVQHDVSKNSVQHGKENGDCSFHSVVNSGDSSLSKSRRKNRKRKASALDRTKVSKEAEPLVSSCKISDDLQEDEEENLEENAARMLSSRFDPSCTGFSMKGSNGLSVFRSSSQSIVNRGLNSQLGSESASADTAVRVLRPRKQYRNKGNSRKRRHFYEILLGDVDAYWVLNRRIKIFWPLDQSWYYGLVDNYDEGSKLYHIKYDDRDVEWVNLETERFKLLLLRSEVPGNAKGERALTKRSSFDHQKGSKSRKERQRTEANAGDDRCGDSSLDSEPIISWLAQSSNRLRSFQGIKKQKTSVTVPSTMSSFLYDEPVTAKGHLAKSSLRGVENNFSSCCVSQDKSSDDFKDKSSLQCVTRAKDGKQPMVYFRRRRIFKPAPISPHISERNHASISASGSVAFDHMFGGVENVKNPIDNRVEVGGPLFFTYKAGVSNFFWDMESASFKFGFNFPMRLVLSDFFQSENVWLLYTVLLLRFGTVMAKWPRVCLEMLFVDNVVGLRFLSFEGCLNMAAAFVLFVLRVFHQPACQGKYVDLQFPCTSIGFKFSSVHVIKMPLVFEFYNFSEVKNSKWMYLDSKLKGHCLLSKQLQLSECTYDNIQALQNGSRRFSITSISGPSSVKVTQKSRPGINIIGVSKGSTQADTLPYSDAGERKLPPFGLSFAAAPTFFLCLHLKLLMEQSATCIRFCDQTPIFDQEDPGLMTNGCTSTDDCSNRNSEVILRRGMETLSNSAADDGGSCADSDNPSTCNDQILTRNYQNIGLNGAITSISHDFERLCKTHLPEWQSHYLEQELVSLPSSSLKHQDKANDGSHSFIGDLSIQIPAVDQFEKPDDNGDLCDAEHSPDFSWNINGCGIPSSNPTAHRSSWYQNRNNSLSLGFQSHVWSDKKVDSLCNDLSNGPKKPRTQVSYSVPSAGYEFSSRQRNHHQKGLSHKRVRKASEKSSDVAR

SEQ ID NO: 218481 - protein, 222 aa, Glycine max
  Coding DNA Sequence Number=SeqID_101703
  Gene Ontology: Mol. function=nucleic acid binding
MTKNNAPSNGCLDKVTTLEKPAMFAFCLKPRGLESLNKGLKHRSQKKISVSGNANSNLDQDGFHTFRRRQNALPFGDENQGHSYDSFDDSSLALTSARVFLPRDAGSLKYYPTSNGAGYRNHIPKFHKPRYDSPGSRHHFLAGPKRQGIEQLDASVLEELRQRDAMAEARFKCHLAKLKRDRAKRLLYKVDVAIHKAIATLMTAEAMKASEDSLGEIKAYED

SEQ ID NO: 218482 - protein, 216 aa, Glycine max
  Coding DNA Sequence Number=SeqID_101704
  Gene Ontology: Mol. function=nucleic acid binding
MMWKGGKDWILEFPDRSQWALFKEMHEECYNRNIRSASVRNIPIPGVHLIEENDDNGSEETFIRSCMYFQQVEADAEMALDPCRVLYDMDSEDEQWISNAQNSVKDNSEFSWISEEMFEKTIDVFEKAAYAKKLDHFTPDEIEDLMLNVGPLCVVKIIYDHWQQRRQKKGMALIRHFQSITQQSCTNSEVRHGTAQHPSATEEPIVSHLAVVVVTL

SEQ ID NO: 218483 - protein, 88 aa, Glycine max
  Coding DNA Sequence Number=SeqID_101705
MRKEESRRLMIVMKVQIQRKKKEKGGKQKRSTPTKSASKERTEKVTKGKGKKKEKSSLSDNQLRDAICEILKEVDFNTLKIVKLNNLV

SEQ ID NO: 218484 - protein, 734 aa, Glycine max
  Coding DNA Sequence Number=SeqID_101706
  Homolog annotation: Hit_ID=Q9FM72; Match level="QueryCoverage=55%, HitCoverage=55%, E-value=4e-55, Identity=60%"; Hit description =Arabidopsis thaliana genomic DNA, chromosome 5, P1 clone:MDF20
  Pfam annotation: Domain name=DEK_C; Domain location=652-705; Score =72.8; E_value=1.1e-18; Accession=PF08766.1; Description=DEK C terminal domain
  Pfam annotation: Domain name=Leo1; Domain location=256-568; Score= -121.4; E_value=0.092; Accession=PF04004.4; Description=Leo1-like protein
  Pfam module annotation: Pfam domain module=DEK_C::Leo1; Domain location=652-705::256-568
MSEEEPANEVSKIDSNGKSLQKIILDEITEKEDLETDGGKVLENNGIKELKENIVKEIEDKKTDSVEKVEEDKKVGVVEEAKEDKKEDGVKEAKEDKKEDGVKEAKEDKKEGVEEATEDKKEDGVEEVNEDRKEDGVGEVKEDKEVDGVSCVKEVEEDGEVDGVKKVEDKKGDELKEIEEDKKDDHISENDKMDEDTEIKETMEGEPENGKEESEKPVVDAMEVEGGIKEKEESKENEKVEVVMEEDEKDEDEDKDNIDKSKEEKAEDSKGEKGSKKRGRGKINGEKVKEKRKELKKTEPRTPTIDRPVRERKSVERLVASIDKDATKEFHIQKGRGTPLKDIPNVAFKLSRRKTDDTFKLLHTILFGRRGKAVEIKSNISRFSGFVWRDNEEKQMIKVKEKLDKCNKEKLLEFCDVLDITINKATTRKEDIIAKLIDFLVAPHATTTVLLAEKEKPSKGTKRKRVVKRGSSRSGTTSRRSVKRQKKNEDSTVARRKSASDTDESEEDKKDEENEEENEIGVADKSEDETPEKSESEDKSDSGSESEDIKEKKKPSETSSTKKESAKKSKNEKITVPNKSRSPPKRAPKKPSSNLSKSDEDSDESPKVFSRKKKNEKGGKQKTATPTKSASKEKTEKVTRGKGKKKEKSSPSDNQLRDAICEILKEVNFNTATFTDILKKLAKQFDMDLTPRKASIKSMIQEELTKLADEADDEDREEDAEKDEAPSTGQEVEG

SEQ ID NO: 218485 - protein, 1684 aa, Glycine max
  Coding DNA Sequence Number=SeqID_101707
  Gene Ontology: Mol. function=nucleic acid binding
  Homolog annotation: Hit_ID=Q1RSU0; Match level="QueryCoverage=13%, HitCoverage=23%, E-value=5e-09, Identity=25%"; Hit description=Tudor
GFKSARDSQTLIRQFALVIFDVCGMNQLFGGMSVEIQENVHICMMACIAENSNDTTIPKKSRSLDLKSLYKSKLTENTAKKNLKRIGNSSGGGGEKRKKKKTRKEVSLSSLKNGDGSSELKLGVSQRLSSSSSSSMLNRVSFSVGGDDAQIPKRKRSFVGRKKSERGQASNLVEQLSCKIGYDQVPKLGSADLGSGVESFKIKHKKEFDEFKENRNSDSNSVQHIKEDGDCASHSVVNSGDSSLTKSRRKNRKRKASALDRTKVSKEAEPLVSSCKISDDLQEDEEENLEENAARMLSSRFDPSCTGFSTKCSNGLFFFGSSCQSIVNHGLKSKSGSESASADTAGRILRPRKQYKNKGSSRKRRHFYEILLGDVDAYWVLNRRIKIFWPLDQSWYYGLVDNYDEGSKLYHIKYDDRDVEWVNLHTERFKLLLLRSEVSGNAKGERALTKLRSSDHQKGSKSSKQRQRTEENTEDDRCGGSSMDSEPIISWLARSSHRLRSSFQGIKKQKTSVTIPSTMSSFVYDEPVTAKGHLAKRSLRGAKNNFSSDSVSQNKSDEFRDKPSFPSVTSTKDGKQPIVYVRRRIRKPAPISPHISAENHAITGASGSVAFDQMFGRVEKMKNPIDGRVEVGGPLFFTYKEGVSKFFWDMESASFKFGLNFPMHLVLNDVFQSENLWLLYSVLLLRFGTVMTKWPRVCLEMLFVDNVVGLRFLLFEGCLNTAAAVVFFVLRVFHQPACLGKYVDFQFPCTSIEFKFSGVHVIKKPLVFEFYNFSEVKNSKWMCLDSKLKRHCLLSKQLHLSECTYDNIQALQRSSRFSVTSVSESSSVKVRRKRSWPGNNIMGISKVSTQADTHQYSDAGKWKLPPFALSFAAAPTFFLHLHLKLLMEQSTNRISFCDQTPIFDQEDPGLVTNGCTSTNDFSNRNSEIILRKDMMETLSNGAAGDGGSCADSDHPSTCSEQILIQNYQNIGPNGAGTSISHDSERLSTAHLPEWQCHHLEQELGSLPSSPLIRQDKADDGSHSSIGDLSIQIPAVDQFEKPGDDGDLRNAEHSPDFSWNINGGGLPNSNPTARRSSWYRNRNSSLSLGFQSHVWSDGKADSLCNDFINGPKKPRTQVSYSVPSAGYEFSSKRRNHHQKGFPHKRIRKASEKKSSDVARRLEKNVECLSCGANVLITLGNKGWRDSGAHVVLELFDHNEWRLSVKLLGITRYSYKAHQFLQPGSTNRYTHAMMWKGGKDWILEFPDRSQWALFKEMHEECYNRNIRSASVRNIPIPGVHLIEENDDNGCEATFVRSCMYYRQVETDVEMALDPSCVLYDMDSEDEQWISNAENSVKDNNDLSWISEEMFEKTIDMFEKAAYAKKCDHFTPNEIEELMVNVGPLSVVKIIYDHWQERRQKKGMALIRHFQPPLWERYQKQVREWEVAMTKNNAHSNGCLDKFTTLEKPVMFAFCFKPRGLESLNKGLKHRSQKKISVSGHANCNLDQDGFHTFRRRQNALPFGDEIQGHSYDSFDDSSLALTSPRVFLPCDAGSLKYHPTSNGAGYRNHIPKFHKSRYDSPGSKHHLLAGPKRQGIEQLDASVLEELRLRDAVAEAHFKWHVAKLKRDRAKRLLYKADVAIHKAMAALMTAEAMKASEDSLGLGSVRGEEILLLQTATPSNCLVSTGTFSSFEICSVQSNCSTALH

SEQ ID NO: 218486 - protein, 106 aa, Glycine max
  Coding DNA Sequence Number=SeqID_101708
MKNFQLKRCVRREIGREAAYRIRSREYKDEKFPTKTMREKGNWKRSSLQNQRLQEKNIRTELAVTKCVGVILKNLYFGLQMRISNAVKLPRKILKFGSNGSYGVFV

SEQ ID NO: 218487 - protein, 64 aa, Glycine max
  Coding DNA Sequence Number=SeqID_101709
  Subcellular localization annotation: CTP_CleavageSite=41; ConfidenceScore=5.04e-01
MASHGGEFVLDSSSPQSGISNHLSTFSLPLPLIFKKQRTPLVKKIQGQKALQGATLCGINVRVH

SEQ ID NO: 218488 - protein, 203 aa, Glycine max
  Coding DNA Sequence Number=SeqID_101710
EQQKEELHPSLDVTHTEVNQQSEPDENHEQQAEPHSDYSFPTDSESSNFSIMDGTFELNVQEHRLQEDLQSDYSLPSDSESSDGSIMGGSFEMDHIGNQNEDIISASLDSDDDYEEDEDEEEDSLIEINLPSSHFSDLIEDPKQKLQSKLSDSIFKQQGLMEFLADINDMIEDENLIEIDISMGSINNPDFRLKQELAYFQDE

SEQ ID NO: 218489 - protein, 156 aa, Glycine max
  Coding DNA Sequence Number=SeqID_101711
MFGKLVSVGMTLCWMVHRQCGRPFEAKIYEQLDKDVSRTLHEYQFIPEKPSVRNETYERVAPSIHYSSLDGVPDSRTLLSNGRSFLNGNESAPYGYGIRGQIPGLDLSSMGMNLHLMDTEFEQGRQNHLLPSASGENDGVPRKNPFVDVTADIHNR

SEQ ID NO: 218490 - protein, 70 aa, Glycine max
  Coding DNA Sequence Number=SeqID_101712
  Homolog annotation: Hit_ID=UPI0000162EFD; Match level="QueryCoverage =60%, HitCoverage=2%, E-value=7e-12, Identity=69%"; Hit description =HB-1; transcription factor
  Pfam annotation: Domain name=DDT; Domain location=15-69; Score=26.4; E_value=9.8e-05; Accession=PF02791.7; Description=DDT domain
NFVLPRLKSWPASDENIGNLLMVWRFLITLADVLGIWPFTLDELIQAFHYRVISFFKVPIQGLVCPKIIP

SEQ ID NO: 218491 - protein, 137 aa, Glycine max
  Coding DNA Sequence Number=SeqID_101713
  Gene Ontology: Mol. function=RNA binding; Cellular component =cytoplasmic exosome (RNase complex); Biological process=rRNA processing
  Homolog annotation: Hit_ID=Q5SMR4; Match level="QueryCoverage=79%, HitCoverage=20%, E-value=4e-44, Identity=77%"; Hit description=ALM beta-like
METKSTSSFTNLVDQSVCPGDVVLDLSKMINQTIKLGGGLRQDCDAISVMKAGRLRFSKPHKYWVENSQKRYVPYAEDSVLGIVVDSRSDNFLVDIKGPTLAFLPVLAFEGGTRRNIPRFECTQSKGLKVHFVVLVH

SEQ ID NO: 218492 - protein, 91 aa, Glycine max
  Coding DNA Sequence Number=SeqID_101714
  Homolog annotation: Hit_ID=Q2QN63; Match level="QueryCoverage=84%, HitCoverage=13%, E-value=1e-31, Identity=75%"; Hit description =Expressed protein
  Pfam annotation: Domain name=DUF1336; Domain location=1-71; Score= -53.6; E_value=1.6e-06; Accession=PF07059.3; Description=Protein of unknown function (DUF1336)
MVRLIPGAAGPNYFEIDLDIHRFSYISRKGLDSLRDRVKHGILDVGLTIQAQKQEELPEEVLCCLRLNKIDFVNHGQIPTLVTLDDNSGVH

SEQ ID NO: 218493 - protein, 390 aa, Glycine max
  Coding DNA Sequence Number=SeqID_101715
  Homolog annotation: Hit_ID=Q9LI95; Match level="QueryCoverage=71%, HitCoverage=65%, E-value=8e-58, Identity=39%"; Hit description =Arabidopsis thaliana genomic DNA, chromosome 3, P1 clone:MUO22
  Pfam annotation: Domain name=DUF1336; Domain location=246-380; Score =59.1; E_value=4.5e-16; Accession=PF07059.3; Description=Protein of unknown function (DUF1336)
  Subcellular localization annotation: CTP_CleavageSite=56; ConfidenceScore=5.67e-01
MLAGLVKKITSTTMGSCASNPNRKSSCQKRRKQKSGKRRGNIPTALPDLPLERVSNAGSRVGDFSLSDFVHLDFENGASAPCRRSEVSNMKFHLTQYHSHSQIDANGKYQEEAWFDSVSIIGSDSDDEFSSVHGDCFPFPNNSLGSAPNTQLLQYESASCILDSGRKYEEFYESYLKVDGGNYKSGEKTQENSTKQSTVIMLSVKRTSIDGHDKTESCSSEKFLYRPRAGLQIPGSIQEKPLPSTWSAISPSVFKLRGENFFRHLFRDKQKCPAPESCPYVPIGVDLFACPKKISHIAKHLELPPVKENESLPSLLIVNIQLPTYAASVFLGDANGEGLSLVLYFKLSENFEKEISPNFMGMIKVYLLINSYFIKLSDLQAYNNVTLKRK

SEQ ID NO: 218494 - protein, 78 aa, Glycine max
  Coding DNA Sequence Number=SeqID_101716
NVCIEEDVLAPFLKFFKGSSDSVVEEEEVGGLLEGSKERGDESEEAKKVCAEYPEPKPGHFVVGVVVIDVCSVIQLVS

SEQ ID NO: 218495 - protein, 124 aa, Glycine max
  Coding DNA Sequence Number=SeqID_101717
  Gene Ontology: Mol. function=RNA binding
  Homolog annotation: Hit_ID=Q5ZC75; Match level="QueryCoverage=71%, HitCoverage=20%, E-value=5e-20, Identity=53%"; Hit description=30S ribosomal protein S1-like
MLTKECQCRGGTVVEIGTILFSKVVGRTLASRSLLSTRRLFRRIAWHRLRRIKQLGEPIEVRITKWNTKGLLTRIEGLRAFLPKVELMRRVNSFTELKENAQLKSFLALVSLSVIGRSLYELSY

SEQ ID NO: 218496 - protein, 298 aa, Glycine max
  Coding DNA Sequence Number=SeqID_101718
  Gene Ontology: Mol. function=3-methyl-2-oxobutanoate dehydrogenase (2- methylpropanoyl-transferring) activity; Cellular component =mitochondrial alpha-ketoglutarate dehydrogenase complex; Biological process=branched chain ...
  Gene Ontology: Biological process=family amino acid catabolic process
  Homolog annotation: Hit_ID=Q9LDY2; Match level="QueryCoverage=77%, HitCoverage=78%, E-value=1e-113, Identity=73%"; Hit description =Branched chain alpha-keto acid dehydrogenase E1 beta subunit
  Pfam annotation: Domain name=Transket_pyr; Domain location=66-206; Score=108.3; E_value=2.2e-29; Accession=PF02779.14; Description =Transketolase, pyrimidine binding dom
  Pfam annotation: Domain name=Transketolase_C; Domain location=208 -298; Score=72.9; E_value=1e-18; Accession=PF02780.10; Description =Transketolase, C-terminal domain
  Pfam module annotation: Pfam domain module=Transket_pyr::Transketolase _C; Domain location=66-206::208-298
TIQSKLRKFRVLGTHNNYPQDSEVEEKSLIIKLKFKSVLGGYYFSKGFSTSTSVQKGGGGSEEGLKSLNLCSAINQALHIALDSDPRSYVFGEDVSFGGVFRCTTGLADQFGKKRVFNTPLCEQGIVGFGIGLAAMIVNEAAKFRYRSGNQFNCGGLTVRAPYGAVGHGGHYHSQSPEAFFCHVPGIKWLYRLAVEEVPEDDYMLPLSEAEVIRQGSDVTLVGWGAQLAIMEQACLDAEKEGISCELIDLKTLIPWDKETVESSVNKTGRLLVSHEAPITGGFGAEISASIVERCFSR

SEQ ID NO: 218497 - protein, 120 aa, Glycine max
  Coding DNA Sequence Number=SeqID_101719
QNKAFGVITARPGKLLLHSEATLLAQVSRGYPGQARGHKKCKNDHFALPFEYFLHSFPKCQKNFRIVRQLVSSSSIRLARIKTLANEGPRMKLGYESCHLYLSFIGNKREVKIRTLISFE

SEQ ID NO: 218498 - protein, 112 aa, Glycine max
  Coding DNA Sequence Number=SeqID_101720
MVQYGLVKSCISEETKITIKDHKWSLSVQNPIFNKYPHMNRSRGKDRIWKLTKARRHTGDAIRAPPQLTDETTDTRECTTTAKDGGPTGRRHDRRHDGRHEGGHDNGGNRMK

SEQ ID NO: 218499 - protein, 133 aa, Glycine max
  Coding DNA Sequence Number=SeqID_101721
  Gene Ontology: Mol. function=kinase activity; Cellular component =chloroplast; Biological process=oxidative photosynthetic carbon pathway
  Homolog annotation: Hit_ID=Q5QLG3; Match level="QueryCoverage=62%, HitCoverage=26%, E-value=2e-18, Identity=49%"; Hit description =Phosphoribulokinase/uridine kinase-like
MYLTGFQISFFCQVHVRNKLREANPGNALLELRGNAGSHDLAFSVQTLAALTKLTREGGGMKLKLSRYDKVRMLGLKPLPVDTVKVVDPQAEIAMRETGNLGMIDDETYFVQKNWVLEIGRLLVIDRCLLEIG

SEQ ID NO: 218500 - protein, 63 aa, Glycine max
  Coding DNA Sequence Number=SeqID_101722
MVAITLAKVPQPPFFLGYNSNVTCAYHGGVPGHSIEHLTYTPELISKSVQSEIARSPCLVRVS

SEQ ID NO: 218501 - protein, 95 aa, Glycine max
  Coding DNA Sequence Number=SeqID_101723
MHHQKRKTLDEASLLSSESKIQHDHISTSTPYGSHRPGPQWSHQLSQPTLRRGCEKAKTDGQKVRLLMKKMRGVTTNVYSRKTLEKNQKMKVCGF

SEQ ID NO: 218502 - protein, 206 aa, Glycine max
  Coding DNA Sequence Number=SeqID_101724
  Homolog annotation: Hit_ID=Q1S3Z1; Match level="QueryCoverage=64%, HitCoverage=6%, E-value=2e-10, Identity=47%"; Hit description =Integrase, catalytic region; Zinc finger, CCHC-type
MSIGSNIERNSQRFCRLRRSHWTMSILIVGGPSKVALLGGASFWDEAVNTTCYLVNLISSTIIDFKTLIKVWSNKPIKYSMLKVFGCSTYHHVSEVNTTCYLVNLISSTIIDFKTLIKVWSNKPIKYSMLKVFGCSTYHHVSEENSGMSKDVTKHVEFKSPTIRNFSDQKQFEAPDGTNKDLQMQLQHQNLAPVEGSHWTSQNHPK

SEQ ID NO: 218503 - protein, 125 aa, Glycine max
  Coding DNA Sequence Number=SeqID_101725
  Pfam annotation: Domain name=zf-CCHC; Domain location=97-114; Score =20.5; E_value=0.00041; Accession=PF00098.13; Description=Zinc knuckle
MELYDIDVKIEDEDMLMIMLNFLPPSYKNFISSLSVGKDFIILEEVMFDLYFRELRLKAFGNGDKAFAFRLSITDSAKGQKKKKDKGSKKRKVDPKDICNYCKEPSHQKKDCPKKAKKDYVVVIV

SEQ ID NO: 218504 - protein, 119 aa, Glycine max
  Coding DNA Sequence Number=SeqID_101726
  Gene Ontology: Mol. function=DNA binding; Biological process=DNA integration
MVQEIVSYGYNKSPYDSYVYHIKVEDGSHIYLLLYVDDMLITSQDKSKIHNLKFLLNSEFVMKDMGAAKKILDMEIKRDRAQNKYLKGTTNIELVYQGDTSCVLGGYSNSDYVVDLDAI

SEQ ID NO: 218505 - protein, 97 aa, Glycine max
  Coding DNA Sequence Number=SeqID_101727
MLGAPYPMQLSASDTQCLIHCGDHMTILRRFRPPLQWNVVVLDKGIGDKYVTLLWYKFLQEGDFSNGDELSFYYRHAKKIWEVVIRRAIDRDDSDID

SEQ ID NO: 218506 - protein, 116 aa, Glycine max
  Coding DNA Sequence Number=SeqID_101728
  Gene Ontology: Mol. function=zinc ion binding
  Homolog annotation: Hit_ID=Q9C533; Match level="QueryCoverage=44%, HitCoverage=10%, E-value=3e-21, Identity=84%"; Hit description=DHHC -type zinc finger protein, putative
MRKNGWQLPYHPLQVVAIAVFMALGFAFYVFFAPFVGKKMYQYVVMGLYTPLANAYELGNYFHNSNKFKFLKFKIALNCPCQNPFMAFLIILATITLFGGRLILLNLEHVHGRYLE

SEQ ID NO: 218507 - protein, 437 aa, Glycine max
  Coding DNA Sequence Number=SeqID_101729
  Gene Ontology: Mol. function=zinc ion binding
  Homolog annotation: Hit_ID=UPI000034F516; Match level="QueryCoverage =86%, HitCoverage=54%, E-value=4e-99, Identity=54%"; Hit description =metal ion binding
  Pfam annotation: Domain name=zf-DHHC; Domain location=165-229; Score =101.2; E_value=3e-27; Accession=PF01529.11; Description=DHHC zinc finger domain
MALNCPYHIPFLAFLIILATTTLLCQNWDAFMEDTLNVLLKESDSEFFNGFNILLKGTATSDPADPGVFKSKKYLKIPDSKKLDGLKNSKLGGESTSSMHDGNASTVGPKSADKEELGTEASFKDASIFTEKKNASSPSSSCLLLVCSPCAYICGCSSSSNESSEQQASEDGMFYCSLCEVEVFKYSKHCRVCDKCVDRFDHHCRWLNNCIGKRNYRKFFTLMVAALLLFPCKILDILPSKSQKLNHPKTQLVGSSMPKPEENPRLILQWLTGILVLICCFVEKKKFSVDISSKLGSSFSLVPFVIVVAVCTILAMIATLPLAQLFFFHILLIKKGITTYDYIIALREQEQQGIGGQQSPQMSPVSSLTGMSSASSFTTFHRGAWCTPPRLFLEDQFDVVPPETASVSSLGKKTMRDEPVKKRIPEQSKSVHGPWRG

SEQ ID NO: 218508 - protein, 207 aa, Glycine max
  Coding DNA Sequence Number=SeqID_101730
  Gene Ontology: Mol. function=zinc ion binding
  Homolog annotation: Hit_ID=Q8H055; Match level="QueryCoverage=70%, HitCoverage=24%, E-value=8e-26, Identity=46%"; Hit description =Putative DHHC-type zinc finger protein
MSPRIETNRRRPGKRIRLPADLPVEAMPKFSASNTDKIFSGTSSFALLQLEARSAFQPSQAVSSSAGIVASSPESSLDSPDIHPFRVSTTEAEEARRLAGLSAAATANLKGIPLSRSTSDGYEASGGEDSDRVPTRIVQRSTNWTNLLFSADQEERAFETKSSSSMIILMGIVHSLICEPKGTCSTSTTLNSPLEVELMPLKVLEVG

SEQ ID NO: 218509 - protein, 105 aa, Glycine max
  Coding DNA Sequence Number=SeqID_101731
  Homolog annotation: Hit_ID=Q2HRX8; Match level="QueryCoverage=46%, HitCoverage=6%, E-value=1e-07, Identity=55%"; Hit description=IMP dehydrogenase/GMP reductase
  Pfam annotation: Domain name=DUF1723; Domain location=4-53; Score =33.9; E_value=5.5e-07; Accession=PF08330.1; Description=Protein of unknown function (DUF1723)
MKGYVDRSRLKGLYKAQHNETSSFHLLVGEMTITLDDVSCLLHLPIMGSFLDHTYTTYTRKETKGEWEQHMVAVGEVVPRAAPWACTSDYLPLYFEHSHPHMLLQ

SEQ ID NO: 218510 - protein, 89 aa, Glycine max
  Coding DNA Sequence Number=SeqID_101732
MAQEGLAAGCKSTEEWPPSRKKTIIGGRGGMLPAPRPCGIIGGANIDLFVGGMVAYVFEEVEGVDDGVEGEFGDDDDRGREDHRVASMA

SEQ ID NO: 218511 - protein, 155 aa, Glycine max
  Coding DNA Sequence Number=SeqID_101733
  Homolog annotation: Hit_ID=UPI00001628AD; Match level="QueryCoverage =41%, HitCoverage=6%, E-value=7e-12, Identity=52%"; Hit description =DNA binding / N-acetyltransferase/ RNA binding / protein binding / zinc ion binding
MKLTQLGVEGLILPAVPSVLETWTRSFGIAKMTNLERSQFLDYTFLDFQSAIMCQKLLPSNQSPDPVLLMGKNDHQVIGAIDPVTIVLLSSPNLFLLVWVLASAKTLIILLVLRWSNRVRGINSARMEQPAQSAPLIKKLTGIMTCISASTREGK

SEQ ID NO: 218512 - protein, 134 aa, Glycine max
  Coding DNA Sequence Number=SeqID_101734
  Gene Ontology: Mol. function=protein dimerization activity; Cellular component=nucleus; Biological process=regulation of transcription, DNA-dependent
  Homolog annotation: Hit_ID=Q0GPG6; Match level="QueryCoverage=54%, HitCoverage=15%, E-value=4e-28, Identity=84%"; Hit description=BZIP transcription factor bZIP99
MNVEQKMCKLAKYMERKSRDLNQGTFGEIKEALTRMNNVGPDGNQFGFMPRRSTTKVMYLSNIAYLAKLPTSLEKSPLTNQIEPHRLRLQKVQSSNPGTILVGNTDNQEESAMADASPRTDISTDGDTDDKNQP

SEQ ID NO: 218513 - protein, 126 aa, Glycine max
  Coding DNA Sequence Number=SeqID_101735
  Homolog annotation: Hit_ID=Q0GPG6; Match level="QueryCoverage=26%, HitCoverage=7%, E-value=4e-07, Identity=79%"; Hit description=BZIP transcription factor bZIP99
MDLYPCNWRLIPLFLSPQSIVKNVIQQSHDSMLKEHTLSEGSSCQALADQGRGRYQESGILADQGRECYQESKTLAARKSRVKGNIVSILLSYTEESTIDSFHVSDFGAFDQSYRIGDAVDLSGNV

SEQ ID NO: 218514 - protein, 53 aa, Glycine max
  Coding DNA Sequence Number=SeqID_101736
MWKVISNNNSGTTTRKGGTRKATKVQEVKSENKLGVRERKGLRLVVMSGNLPS

SEQ ID NO: 218515 - protein, 82 aa, Glycine max
  Coding DNA Sequence Number=SeqID_101737
DCEELNYPYTSKEVVIALLMGFWEWTKRMHLWRLNNVKGVMFCNYKATQWLCNFIRDMDLRAFSYYWVEGAEWKTYKGIITS

SEQ ID NO: 218516 - protein, 61 aa, Glycine max
  Coding DNA Sequence Number=SeqID_101738
MIVGCGDIVSKFEPEMVGCAASLSFLFRGCAHRRRWPHYQSLLRGNQTSSTGGMTVAPMRV

SEQ ID NO: 218517 - protein, 79 aa, Glycine max
  Coding DNA Sequence Number=SeqID_101739
  Subcellular localization annotation: CTP_CleavageSite=42; ConfidenceScore=5.15e-01
MEKDGKRDNTHSSTNLQQTARHVPCTKIASQTGYIQCTAISSAQAARPLAIPPVTVTFSPRVAHRGFSPVTLAVCMYFT

SEQ ID NO: 218518 - protein, 462 aa, Glycine max
  Coding DNA Sequence Number=SeqID_101740
MWCVGEWGCIVLQKIKAPLQLLPVTEESVFFLNGVDIPFPLPSLSSILQGIPSLIMSSFLSNSAIGMGGSDSRGSIQHPLKDREVISIGGFSSEDTHHGASNSESSSSKRLRVSCHIGGGTSHLRGRAQPFTASSTGEPVPVTMILPPSTSGGARKSGGGDVRVFRRLQPSHNIRLSSSFPVVVGFEWVRGDVLKYKSSITSMASVATLQCQVKLENPNDSCKIVVQACRSDDFSFLRAMSSNPPFFFMYKFRFEVFLNNMSKKLFEFDSNIFRHFKECFFKVLATDVVTDDLLTLVERVDKAILQQLSASLDVQAILSIPSANDPLAALDGHTYRWGRATVYFALTTREEGQPIVEVGPIDGATKVSPSAPSYVLTKRKQDDSARKFGCKKSRAHLSLHTLRQAARLTSCSGHPSSLQDAPPNPPTIEASTSAIVVDVTSAPLPWNPPSLRLLLHKFPLLS

SEQ ID NO: 218519 - protein, 105 aa, Glycine max
  Coding DNA Sequence Number=SeqID_101741
MSTLCSYGTCEMKICITIQIDNLYDPYGLWIDNPYETCEMRIRMDHTDSQSDIEHVDHVADKVHEEPHEPVTDHERIELKLASHGRKVEKFGRPAHEIEGIVAAT

SEQ ID NO: 218520 - protein, 658 aa, Glycine max
  Coding DNA Sequence Number=SeqID_101742
MEADIPLGWKSLNLERYGRTIDLDEHLNVFLTHANLYTKDDTTSTLLLSASVCNMQLVGHIIWCQPFWLVCDKQMMNLRKFVEKFRRIVVQVCNLNPERTKCYIQMEEMFRFRNEVQQAGQKCDKREGSTKTNSHKSDKRNKPNKCQSLPKGLGRGSTRPNTADTITVLVTTQKIPSPSKTKYKSLYRLGTKKKIKEDRDTTNKDTIDNLHKNKSPPNKSESRKRHLHAIWDIDINYVDTPLPQTLPPITFIDRDISGIIPINQDDPMVVSIIIGNFMVSKVLIGQVDGTTQVMSMDNGSLVRDLTVHRASLDEEFDVDSRDDTFDRSPKPIEELVKLQLEPQPGACPKDAYLFPSIDRLVDRMSEFQVLSFMHTYSGYNQIQMHSLDEEKTTFITKDQQIKRNIEVYVDDMVFKSQSIAQHMANLEKVFEELCKYNMRLNLKKYTSGVNKGSLEVERKTNIPVQTYKQAFLTFKKTIATLPLLSRPRLGVPLLLYLSVADKAVSSTLDGGMVYKTFIVRSPVRTPWHHEDTIHGRLPEIILEGPDYVSLEQSLKLNFKALNNQAKYEMLIACLKLTREVGAKKLRYYTDLESNTRANLLFKLASTKKIGHLKTIIQEMFQNPTIDTGEVMDGEEEEPCKLDDPLQEFSNSRGVANEN

SEQ ID NO: 218521 - protein, 219 aa, Glycine max
  Coding DNA Sequence Number=SeqID_101743
  Homolog annotation: Hit_ID=Q00M75; Match level="QueryCoverage=14%, HitCoverage=5%, E-value=3e-08, Identity=96%"; Hit description=PPR -repeat containing protein
  Pfam annotation: Domain name=VQ; Domain location=116-146; Score=32.5; E_value=1.5e-06; Accession=PF05678.4; Description=VQ motif
MVAGGGLKPLKWVLCLRPNHVLIMDAKERDKKISHGMFYHGRTVSAKCTYQNPELIHVRVDVTKAEVRASPGAAVKLRLGDLLVMGSNPETASLHMQGKTAYNIPPPYLRIAKSLWAMGPVKVKTSASNFRALVQELTGQYSNVAETSIPMEEDNGHSERVHRTHHHHESETQQWRVNVDEGTNLMKPHEYSEFLSRSLMEPFNQQQLLQYDLMSFDMS

SEQ ID NO: 218522 - protein, 131 aa, Glycine max
  Coding DNA Sequence Number=SeqID_101744
MSEVTCKTKSMSTPDNLIEAAQTTLLQAKGLDKLDRLTTPTLVKATTLDIGRHLFVLGVLTDSSPSYSLRLLPSTSNNLPQHGTISFDTGQPFSLASWFKASGLMYCPGSTKYMCHAMWHSETHVNPPCQP

SEQ ID NO: 218523 - protein, 176 aa, Glycine max
  Coding DNA Sequence Number=SeqID_101745
MTAVVHMYDNLNVASKHTTKHLTRYITLLQKCGKALPVMTYCKHLDRLMSDVVCWIPYGDHRAFREFELISLFSGLIRIPHPFMSLPQLGEPPIHPPMVHDDTYIILDPPMLPIHSIAMPQPIAPAVADADIPRHAVAACQKIVQNLEHMINMRMITTRTDAYTLIEHYLRLARCH

SEQ ID NO: 218524 - protein, 152 aa, Glycine max
  Coding DNA Sequence Number=SeqID_101746
MAIMEAMLVMRLNHRSTLCRIISPPWWESNPVLCFHGLPFEEMEGTVLHLKKFLRLIDIVRSSANALDYIRLATFSFSLAEKAKDWLYDLPNQSITNFGQILVATYPSAGGRRGAHRCVFQERKMRGVATNVYLRKTSEKPENVWSKNFNRE

SEQ ID NO: 218525 - protein, 508 aa, Glycine max
  Coding DNA Sequence Number=SeqID_101747
  Gene Ontology: Mol. function=transmembrane receptor activity; Cellular component=membrane; Biological process=defense response
  Homolog annotation: Hit_ID=Q1RVS5; Match level="QueryCoverage=91%, HitCoverage=93%, E-value=5e-97, Identity=45%"; Hit description=TIR; Disease resistance protein
  Pfam annotation: Domain name=NB-ARC; Domain location=139-442; Score= -0.5; E_value=3e-10; Accession=PF00931.13; Description=NB-ARC domain
  Pfam annotation: Domain name=TIR; Domain location=1-119; Score=34.2; E_value=3.2e-08; Accession=PF01582.10; Description=TIR domain
  Pfam module annotation: Pfam domain module=NB-ARC::TIR; Domain location=139-442::1-119
SADDTVAGFTSTLAKSLEDQGFPARVLVDHRDLKKAEIETVRVFIVVLSEHYAICPFRLDKLAEIVDGLGARQRVLPVFYYVPTSDVRYQTGSYEVALGVHEYYVERERLEKWKNTLEKVAGFGGWPLQRTGKTYEYQYIEEIGRKVSEHVACSVELHSRVQKVNELLYSESDDGGVKMVGICGEDGTGKTTVACGVYYSNAAGNRFDYFCFLDKVGECLRNHGFIGLIGMLLSGMIGDSNNNSDIMKFGNTNKGMSILKRKFFEEEKKLFLVLEDIYDEKQLQDIVRLTNCFSSNSKVVITTKDNSLLHRHEIRLYEVERFKTKDAFQLLSLKAFNSKNLKSMYLSILERAETYASGNPFILEVMGSYLRGKSIEECVSALDQYEKVPNKEKQRIVQISFDALEKCHQKMLSCIAFYLNRQDLQVVEEKLYRQFRVSPKDGIKVLLDKSLIKINEHGREHVKQLKQEIQPASNDGSISTDGIGRKYGKIDMNGLEYGIQEIQPASND

SEQ ID NO: 218526 - protein, 174 aa, Glycine max
  Coding DNA Sequence Number=SeqID_101748
  Gene Ontology: Mol. function=protein binding; Biological process =defense response
  Homolog annotation: Hit_ID=Q6R270; Match level="QueryCoverage=79%, HitCoverage=10%, E-value=4e-61, Identity=86%"; Hit description =Disease resistance protein
MARGIIQGCGKELGGALLSAFLRVAFEKLASPQILDFFRGRKLDQKLLNNLEIKLNSIQVLADDAKLKQFRDPHLRNWLLKVKDAVLDTEDLLDEIQYEISKCQVEAEAESQTCTGCTCKVPNFFKSSLVSSFNKEIKSSMEQVLEDLENLDDSTIERDEILTENLHPSKHFPR

SEQ ID NO: 218527 - protein, 105 aa, Glycine max
  Coding DNA Sequence Number=SeqID_101749
MVQALRVDEQLRRVMGSDDCSPDGCSSTCPLCPHPINAPRAHMVFLKEEDHRHERRVAVNERTLEWKGSDFVQPKWMPHSDFVIMNDNGRGHDGDFDFTNWVSVK

SEQ ID NO: 218528 - protein, 160 aa, Glycine max
  Coding DNA Sequence Number=SeqID_101750
  Gene Ontology: Biological process=translation
  Pfam annotation: Domain name=RRF; Domain location=50-160; Score= -73.3; E_value=0.032; Accession=PF01765.9; Description=Ribosome recycling factor
MVIGLYVLEDEGGVGTIEVPPNVGPTIKANAVSQMEAAMAALAIPSEQATYRKGIPRSKNLAALFNNLTFKLNINQLIYCFFTMKMTRLTKEHIQAMTKLVAKSCEDASQSIRRAQQKAMDAIKKLYSSLPKDDIKRLEKEVDDLTKKISKTAEDVCKVK

SEQ ID NO: 218529 - protein, 172 aa, Glycine max
  Coding DNA Sequence Number=SeqID_101751
MMMVVVVVLASIVVEISMLVAVSRGDGNNNADGVNDNGGGDSCASGASQCDDIGGIGGGDDGDGSGDSSSNVDGANDDSGDDGGMMLVAVVVVVVMEVILVTMAMAMTLKSWFNAIHALTSVMMRCIESVKMEKHAIRVPCLKGTYDIYKNLMSAKATITGLVNQGLKLWNC

SEQ ID NO: 218530 - protein, 561 aa, Glycine max
  Coding DNA Sequence Number=SeqID_101752
  Gene Ontology: Mol. function=transmembrane receptor activity; Cellular component=membrane; Biological process=defense response
  Homolog annotation: Hit_ID=Q1RVS5; Match level="QueryCoverage=83%, HitCoverage=98%, E-value=1e-130, Identity=52%"; Hit description=TIR; Disease resistance protein
  Pfam annotation: Domain name=NB-ARC; Domain location=236-507; Score =0.1; E_value=2.7e-10; Accession=PF00931.13; Description=NB-ARC domain
  Pfam annotation: Domain name=TIR; Domain location=85-216; Score =113.2; E_value=7.6e-31; Accession=PF01582.10; Description=TIR domain
  Pfam module annotation: Pfam domain module=NB-ARC::TIR; Domain location=236-507::85-216
PRGASPPSENHPEAAQPPSRIDAPARVSVGEENKRGSAQQGHNELDQNHGVQVDSAALPSSPEHYNHIMQSFRRWVEPKAFRYDVFLSFRGWDIRFSFTGFLYKGLFDHGFRTFMDDREIDKGSQIPQTLREAIEDSRVFIVVLSANFASSSFCLDEVVLILQEFAKGKGRWILPVFYYVDPSHLADSDSYKRALEDQTEWFDSQRIQIWKTALSKLATFSGLRLIRNGSILEYQYIELILKEVSRHVTCPVGLSHRMSKVNKLLFSGSDVGVHMVGICGEARIGKTTVARGVYNFNSDTGFDHYCYFYNVGDILSQSRFVNEGMAILNQKKVFAIFEDINDSKQLKNIIELAYQFGSGSKVIITARNKGLLQSHGIESIYEVERFSKTEAFQLLILKAFNSISVSADYVTIFNRVETYALGHPWTLEVIGSNLSGKSVENCESALLKYESITNRDIRKILEESFNALEKCQQEMLIHIALKLKELELGVVEDELCNYYKVCPKKDIRVLLDKSLIKINEHGQVTLHPSTQDMIRDKITRFEEYGKQEIQPVSKNGSMIGI

SEQ ID NO: 218531 - protein, 710 aa, Glycine max
  Coding DNA Sequence Number=SeqID_101753
  Gene Ontology: Mol. function=transmembrane receptor activity; Cellular component=membrane; Biological process=regulation of transcription, DNA-dependent
  Homolog annotation: Hit_ID=Q9FPK8; Match level="QueryCoverage=71%, HitCoverage=96%, E-value=0.0, Identity=99%"; Hit description =Putative resistance protein
  Pfam annotation: Domain name=NACHT; Domain location=276-427; Score= -0.6; E_value=6.3e-05; Accession=PF05729.3; Description=NACHT domain
  Pfam annotation: Domain name=NB-ARC; Domain location=238-535; Score =126.7; E_value=6.7e-35; Accession=PF00931.13; Description=NB-ARC domain
  Pfam annotation: Domain name=TIR; Domain location=84-219; Score =124.6; E_value=2.7e-34; Accession=PF01582.10; Description=TIR domain
  Pfam module annotation: Pfam domain module=NACHT::NB-ARC::TIR; Domain location=276-427::238-535::84-219
METSTMFLKGRTNNESQLKQMLQQLVKNQLVKQELDGERKNIQNCKSENLGFWYCWVGAESAKACWMAGSERSSSRVWHYEFDVFLSFRGEDTRLGFVGNLYKALTEKGFHTFFREKLVRGEEIAASPSVVEKAIQHSRVFVVVFSQNYASSTRCLEELLSILRFSQDNRRPVLPVFYYVDPSDVGLQTGIYGEALAMHEKRFNSESDKVMKWRKALCEAAALSGWPFKHGDGYEYELIEKIVEGVSKKINRPVGLQYRMLELNGLLDAASLSGVHLIGIYGVGGIGKTTLARALYDSVAVQFDALCFLDEVRENAMKHGLVHLQQTILAETVGEKDIRLPSVKQGITLLKQRLQEKRVLLVLDDINESEQLKALVGSPGWFGPGSRVIITTRDRQLLESHGVEKIYEVENLADGEALELLCWKAFKTDKVYPDFINKIYRALTYASGLPLALEVIGSNLFGREIVEWQYTLDLYEKIHDKDIQKILKISFDALDEHEKDLFLDIACFFKGCKLAQVESIVSGRYGDSLKAIIDVLLEKTLIKIDEHGRVKMHDLIQQMGREIVRQESPKHPDFSKPEEVVQWDGMAFMKMKNLTTLIIRKECFSEDPKKLPNSLRVLEWRGYPSKSLPSDFQPEKLAILKLPSSCFMSLELPNLQLHRCGMVQLPSSIVMSELEELHKAGNKRFCFPGTRIPEWSEHSSDIYLPCWTRA

SEQ ID NO: 218532 - protein, 73 aa, Glycine max
  Coding DNA Sequence Number=SeqID_101754
  Gene Ontology: Mol. function=peptidyl-prolyl cis-trans isomerase activity; Cellular component=nucleus; Biological process=protein folding
  Homolog annotation: Hit_ID=Q1S0T0; Match level="QueryCoverage=49%, HitCoverage=19%, E-value=4e-13, Identity=100%"; Hit description =Peptidyl-prolyl cis-trans isomerase, cyclophilin type
IPEILGGFWGNIGKEFHLDSTGGNVTDGDIEEDDGVLKNIQEIMSNTIKIEKFNGKNSFNLWRIKMRALLKEQ

SEQ ID NO: 218533 - protein, 232 aa, Glycine max
  Coding DNA Sequence Number=SeqID_101755
  Gene Ontology: Cellular component=mitochondrion
  Homolog annotation: Hit_ID=Q1S0T2; Match level="QueryCoverage=67%, HitCoverage=96%, E-value=1e-32, Identity=48%"; Hit description =Complex 1 LYR protein
  Pfam annotation: Domain name=Complex1_LYR; Domain location=90-191; Score=33.3; E_value=8.3e-07; Accession=PF05347.5; Description =Complex 1 protein (LYR family)
MMNQELILTLAYERKTTPSNKRVSHTLHFFHRNKPVPLPQWKKNNKNQKQNRTKRVVVTDSVSERATELLMANAALRNVKVLPNSANMEEARHRVFQFFRTACRSLPSVMEIYNLYDVVSVSELRSSVSSQIRKNIHVTDPKIFVAYCQWSTLNLCLSFLLEAETCCMKILVQVIDMLLFKGMEELKNVVDHSKQRHHIIGQYVVGQQVQDSATKDQGTSTFLKNFYNTNYF

SEQ ID NO: 218534 - protein, 55 aa, Glycine max
  Coding DNA Sequence Number=SeqID_101756
MKYEDVPIHFHSHYQSLQLQLLWAVTRLCGSLTCVLTLAVRWWELRQRHEFPAII

SEQ ID NO: 218535 - protein, 149 aa, Glycine max
  Coding DNA Sequence Number=SeqID_101757
  Gene Ontology: Mol. function=phospholipase D activity; Cellular component=membrane; Biological process=phosphatidylcholine metabolic process
  Homolog annotation: Hit_ID=Q9C888; Match level="QueryCoverage=63%, HitCoverage=12%, E-value=4e-26, Identity=56%"; Hit description =Phospholipase D epsilon
PREPWHDAHACVTGEAAWDVLTNFEQRWTKQCDPSFLVPSSTLANLMPRTSSSTLMERNWKVQVYRSIDHVSVSDLSTKLSVDRSIHEAYVEAIGKNQGNMNKLLLFEGRTINVGEITCTTDVNSHDPRSTEADDGVHDGRTVEGRFLG

SEQ ID NO: 218536 - protein, 67 aa, Glycine max
  Coding DNA Sequence Number=SeqID_101758
MARLSLNGYALHLSRLPTWYCGKCDHKLSPISPRNNKSVSIPQARQAHNIVERQTKSENHPDLASQH

SEQ ID NO: 218537 - protein, 144 aa, Glycine max
  Coding DNA Sequence Number=SeqID_101759
MESKLLLKLDFGIGRWFSNMARGVAHFISYMRFTAMPLFYFEEAPEFGEYFIWWVQPTPPYYRHGVPVEIIKISSSSSSSNVPNYVLRSPYVGGDSEHIVSASLALAPVGEDLEMLKEDSPKVIEEPLDLIMEDGTVVVRGELP

SEQ ID NO: 218538 - protein, 149 aa, Glycine max
  Coding DNA Sequence Number=SeqID_101760
  Subcellular localization annotation: CTP_CleavageSite=31; ConfidenceScore=5.57e-01
MGERMNGKGGSSSLSSSLSMVKCKSEVPTVMFMLRSVNHSGRRNQVLVDFFNGLVIQAGNNVFAEGSELVWYVQENEELKLKVASLMEEAKENAKEITNLRKKNVAQEEECCACSVQVVQLKSKIGRKKNNLAVERNIVKLLGLVVVVL

SEQ ID NO: 218539 - protein, 344 aa, Glycine max
  Coding DNA Sequence Number=SeqID_101761
MPNICDEVEGISLKGISLVDYTIALGSTMLMRIKGILTIHRFPRMISGDEELEAEGNFVVIEVTKFGVGEMEVSKQAISMSLEHSPYVDAFDDSAPDSTSSTFTIISYAGDASEYQNSIPKVDTITIHTEDELTIQKENFFDIPSLESMGLNLNETLFCYANMWQNVVNNNFLHQFMLFHLMECIPFDFPYTIYLNILFITKTLGGNDDIYYVALLNKILWGQGAYLAFNAVDDSNSKTLVNQRKKRLLHSKGKKGNCSTSKSSYASIQGLLNQKGVPKKQVEEERKVTAQPPTPLAPKKDKVIKAHPTRKKHVLAPNMVKKLKTMTMCANPTIFQKLWDPSHH

SEQ ID NO: 218540 - protein, 177 aa, Glycine max
  Coding DNA Sequence Number=SeqID_101762
  Gene Ontology: Mol. function=structural molecule activity
  Homolog annotation: Hit_ID=Q1SPB9; Match level="QueryCoverage=97%, HitCoverage=38%, E-value=2e-22, Identity=33%"; Hit description =Transposase
MVKAGQILLTIKYQDQKNVITIKTDDVLPRVIVADRVLALMNALEVVFPSATNLLCEFHISKNVRTKCKILMTKAKDWEVVLEAWASLERFAQAWTDRVMHLRNTITNRIEGIHARLKRLFHDSTGDLCTCWDAMNNMLMLQHIELTTLFQKSINVVDHKFNTPFYKRLRGFVSTQA

SEQ ID NO: 218541 - protein, 172 aa, Glycine max
  Coding DNA Sequence Number=SeqID_101763
MVVGGGVDSYGSGVWVGGGFGWAPLAWERQGYLDLFMSLGACMKQNRGCKKQIPTSKIPPSMGGGTIMTTITSHRVPQFRNTLNNFSSPSPSSSAPKLNPALSTTNTLSCTCSVSHTQLCTNQPAPSQREVEDAVSSLQEGVMSHGYKRLYDAFQLLQADPTIKVSLLTLVV

SEQ ID NO: 218542 - protein, 501 aa, Glycine max
  Coding DNA Sequence Number=SeqID_101764
  Homolog annotation: Hit_ID=Q1T010; Match level="QueryCoverage=23%, HitCoverage=8%, E-value=1e-18, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MAGSSGYVSGNLPMLDGKNSDDWCEGMNAIFNFKDMEEIVKNGFQELGRSASDEQKKIHKEAKKMDCKAQFLIHQCVDVANFGKTSKAMIIKEAWDILNKAYGGANKTKKAQTIHKSKGVSHWNKKGKGKWMGGRSGEHLESGRSIDQPVDAGKRVCIFRACPIQISVVGAHSSFVVGLFYHEDVGEPGLAWGQIANLWQIMSGWIPDMSDGSHRWEDTVLLQALCIALSLLPLVNLDCYDLSSPGELALIGSGHQVHVASGLDFLACKPRSGLRGGGQYYDVSRTTLVDEDPKHHEVHYDDGDNYRIVLVDGVDALEVPIRKGDKRETSLKGVEVVTIAAVLVYHSLLLFFYLLPCSCSTPLDVLQGPTVFGVVTNTAMISAIFGCVFGVARYVPPGGRGHAVKPASGILRIKSFDKGVEAIYGPRWKSTVPGRHTDAHLDLLSHRIARVRAGHCMWERLKSSAVLHMRQMCDSPRVHSGQALSTLPHGVAPCDAVLELL

SEQ ID NO: 218543 - protein, 89 aa, Glycine max
  Coding DNA Sequence Number=SeqID_101765
  Subcellular localization annotation: CTP_CleavageSite=54; ConfidenceScore=5.06e-01
MSCSNCSSSASILYKNKIITNRTEKSRVQRVCLSDASDFKLRAICKSNRRQGVRKSQGREKRLVVNHKIKGTEIKKFKVQERKTEKQRL

SEQ ID NO: 218544 - protein, 76 aa, Glycine max
  Coding DNA Sequence Number=SeqID_101766
MEWFYMIFHPFMTLAQPGDPPKHPPVEACQAIAERLKRLLNLRIVTEGTKAYIITKDYLRIARGVTEQRNIYVRSR

SEQ ID NO: 218545 - protein, 87 aa, Glycine max
  Coding DNA Sequence Number=SeqID_101767
MDMSVRVTLFCENAQIKWDQDKLKGALKPGVFTSKAYTLKSLSGPLPSDSGPTPKIFFLHANIAHEFYNTYDLTLVFLTCLTHCATI

SEQ ID NO: 218546 - protein, 171 aa, Glycine max
  Coding DNA Sequence Number=SeqID_101768
MEQSMLAIIGQYKEELNQSVAHEQKLVEDFAQVYAEKEARGRVIDALHQEATMWMDRNFIITKKTPRHPYNTRSRKMDNEEGVQEQMKADISALKDQMASISEVMLKLQKTIEDKAMATASSTVREAEPMLQPALNPGETETRQCLVEGIARKLILMACLRTSLPVPPRKI

SEQ ID NO: 218547 - protein, 138 aa, Glycine max
  Coding DNA Sequence Number=SeqID_101769
  Subcellular localization annotation: CTP_CleavageSite=28; ConfidenceScore=5.26e-01
MASPPALPPPPLPSYPPPPPPPASFDASASPKKLRTYLGIVVRDKVDVTYKNWKEASGNRTKRKLLQTVDERWRQFKSDLTRKWALAVDQDGVDDTVCEKYSISNEKWASFARLAENPSWEDVCKKAQAIQKQNTAPH

SEQ ID NO: 218548 - protein, 239 aa, Glycine max
  Coding DNA Sequence Number=SeqID_101770
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=2e-37, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAYIGLHALTFRGLHALAFRRLHILRFRGLHVLDFRGLHTLTFRGLHVFAFRGLHVLTFKGLHVLTFRGLHVLAFRGLHVLTFRGLHALTFRGLDFLPFRRLHVLTFIGLHALTFRGLHVHAFRGLHALAFKGLHALAIIGLHVLTFRGLHVLAFRGLHVLAFRGLHTLAFRGLHALTFRGLHALAFKGLHALAFRGRHALDFRGLHALAFRGLCVLTFSRLHIRTLREFKILCP

SEQ ID NO: 218549 - protein, 112 aa, Glycine max
  Coding DNA Sequence Number=SeqID_101771
MGETHEAPRDHNLADYEPCLGYATERQAVGEKRLKAIEGGRDYAFAGMAELCLVSNVVIPPKFKVQDFDKYKGTTFPKNHLKMYCRKMGAYTKDEKLLMHFFQESLTGEVVT

SEQ ID NO: 218550 - protein, 162 aa, Glycine max
  Coding DNA Sequence Number=SeqID_101772
  Gene Ontology: Mol. function=helicase activity; Biological process =protein amino acid phosphorylation
  Homolog annotation: Hit_ID=Q1SN45; Match level="QueryCoverage=98%, HitCoverage=9%, E-value=1e-33, Identity=44%"; Hit description=AAA ATPase
  Pfam annotation: Domain name=DUF889; Domain location=1-162; Score =90.5; E_value=5.1e-24; Accession=PF05970.5; Description=Eukaryotic protein of unknown function (DUF889)
MRLQGNAQSIDDQETTKFAKWILDIGDEVIGNQNDGYATVEIPEYLLITEYNDPIDAIVKSTFPDLYEHHSNPEFFKCRAILASTNETVEEVNDYILSLIPGEQMEYLSSDYIEKSETIDSWHFQSITTEFLNSLNTSGLPNHRIKLKIGSPIMLLRSLDQT

SEQ ID NO: 218551 - protein, 119 aa, Glycine max; identical to SEQ ID NO: 159668
  Coding DNA Sequence Number=SeqID_101773

SEQ ID NO: 218552 - protein, 48 aa, Glycine max
  Coding DNA Sequence Number=SeqID_101774
MRPPPTSLEPCVVIAECNPPFSRVFHRQGRILLTKRKKEGVETRVVMD

SEQ ID NO: 218553 - protein, 101 aa, Glycine max
  Coding DNA Sequence Number=SeqID_101775
  Subcellular localization annotation: CTP_CleavageSite=50; ConfidenceScore=5.42e-01
MALRSANMHSSSFFQILPRTQPRSVALSGWLAKPTSWLSERVIRQSFLTRDMALGGQRNTQPATLCIKIPQLHHSFDMLWHYICQTFYKHLKNVRPLHLRP

SEQ ID NO: 218554 - protein, 128 aa, Glycine max
  Coding DNA Sequence Number=SeqID_101776
  Gene Ontology: Mol. function=transferase activity, transferring glycosyl groups; Cellular component=nucleus; Biological process =multicellular organismal development
  Homolog annotation: Hit_ID=Q96301; Match level="QueryCoverage=79%, HitCoverage=27%, E-value=3e-48, Identity=47%"; Hit description =Probable UDP-N-acetylglucosamine--peptide N- acetylglucosaminyltransf erase SPINDLY
  Pfam annotation: Domain name=TPR_1; Domain location=22-55; Score =46.2; E_value=1.1e-10; Accession=PF00515.18; Description =Tetratricopeptide repeat
  Pfam annotation: Domain name=TPR_1; Domain location=56-89; Score =25.7; E_value=0.00016; Accession=PF00515.18; Description =Tetratricopeptide repeat
  Pfam annotation: Domain name=TPR_2; Domain location=22-55; Score =36.7; E_value=8.2e-08; Accession=PF07719.7; Description =Tetratricopeptide repeat
  Pfam annotation: Domain name=TPR_2; Domain location=56-89; Score =19.6; E_value=0.011; Accession=PF07719.7; Description=Tetratricopepti de repeat
  Pfam module annotation: Pfam domain module=TPR_1::TPR_1::TPR_2::TPR _2; Domain location=22-55::56-89::22-55::56-89
MLKFDMAIVFYELAFHFNPHCAEACNNLGVIYKDRENLDKAVECYQLALSIKPNFSQSLNNLGVVYTVQGKVDAAASMIEKAIIANPTYAEAYNNLGLFISSLVIIYLFVCGFTALRSYCLSQGCASL

SEQ ID NO: 218555 - protein, 192 aa, Glycine max
  Coding DNA Sequence Number=SeqID_101777
  Gene Ontology: Mol. function=two-component response regulator activity; Cellular component=intracellular; Biological process=two -component signal transduction system (phosphorelay)
  Homolog annotation: Hit_ID=Q4KCH0; Match level="QueryCoverage=94%, HitCoverage=69%, E-value=1e-28, Identity=41%"; Hit description=DNA -binding response regulator, LuxR family
  Pfam annotation: Domain name=Response_reg; Domain location=7-123; Score=56.5; E_value=8.5e-14; Accession=PF00072.14; Description =Response regulator receiver domain
MKESAIWQIAVLDDHPLIGKAMQYRLAQEPQLDLVGAFAQRQQLMAFLQRHPLDILVLDYMLGEDQLDGLQMVKQLRLHYPQLKILVSSAVEKPAIVQLLLKAGVQGFVGKSHDQEVLIDAIHQICRGKRFLTPDMMLELDKFQESDREMHDYLTPRQAGDDITLLLRELSPREIEVIRCYLDGLSITQIGG

SEQ ID NO: 218556 - protein, 104 aa, Glycine max
  Coding DNA Sequence Number=SeqID_101778
  Gene Ontology: Mol. function=mannonate dehydratase activity; Biological process=glucuronate catabolic process
  Homolog annotation: Hit_ID=Q2ZIM9; Match level="QueryCoverage=93%, HitCoverage=26%, E-value=4e-32, Identity=62%"; Hit description =Mannonate dehydratase
  Pfam annotation: Domain name=UxuA; Domain location=7-104; Score= -157.8; E_value=9.5e-10; Accession=PF03786.4; Description=D-mannonate dehydratase (UxuA)
MTVDDIMQLTMRWFGPKEDKVSLEYIRQVPGVRGVVGALYDVPVGETWPQEKIQALVDQVHSSGLTVEVIESVNIHDDLKIGLPSRDRYIANYQQSIRNLAAAG

SEQ ID NO: 218557 - protein, 99 aa, Glycine max
  Coding DNA Sequence Number=SeqID_101779
SYLAHGLKIYPKAHENPRAFPWISGPIYLESSIQYPCGVGLHHLCEPVDTQRLTSSSAPLSSRDGESDDMRGFYFRHPETFKPDDAQDSSLPGSDDRVR

SEQ ID NO: 218558 - protein, 98 aa, Glycine max
  Coding DNA Sequence Number=SeqID_101780
MSNEELKLQDPRCRIQCPDILPENTGVVAQCISQDKMSNEALKLQDPRCRIRYFQESDRSHPASRSCSPESYTAIKTWRLHELCTKSGIEELFCEFGT

SEQ ID NO: 218559 - protein, 83 aa, Glycine max
  Coding DNA Sequence Number=SeqID_101781
MRGIVHEPQVNIGADQKFSPVDVFKQEKEKGGQTLGFQLIDQTSNDSIAVTPKCPHLPNFTTKVACIYIPKDHVNCIDLVDLG

SEQ ID NO: 218560 - protein, 141 aa, Glycine max
  Coding DNA Sequence Number=SeqID_101782
MKELINKTQISPKIVPTSSRWLDDSTKEFYFTYSTAVHLLPRMKVHDHHRYQPHGNSPPPHGDQPEPQGSSKLSDMSPSTTISPYEKLQVYGNTGMEITEFSASKIKKSLGDKFAQVNLLLTLEGIHSPRQAAARLGELLA

SEQ ID NO: 218561 - protein, 59 aa, Glycine max
  Coding DNA Sequence Number=SeqID_101783
MSGHRVRHRGSCSFTSALDFYLALYSNSSILGQDQLQYSRAGCQDIVSDIVDPATSFFI

SEQ ID NO: 218562 - protein, 269 aa, Glycine max
  Coding DNA Sequence Number=SeqID_101784
  Homolog annotation: Hit_ID=Q47522; Match level="QueryCoverage=17%, HitCoverage=59%, E-value=2e-21, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIQSGRIQQTEQILTYIESRGCRYTRYEKHHDEPQHRQSEEIARKVYPSPPLHPERESSDDVTGLQKAGHWQQKHQGMIKLIDTVDLEGGPVGKPVVPAALMNRPTRGERRFAYWALAECILAYYVGTDEGVSEVLHVAGEKRLH

SEQ ID NO: 218563 - protein, 242 aa, Glycine max
  Coding DNA Sequence Number=SeqID_101785
  Gene Ontology: Mol. function=chitin binding; Cellular component =extracellular region; Biological process=chitin metabolic process
  Homolog annotation: Hit_ID=UPI000044A8F0; Match level="QueryCoverage =54%, HitCoverage=99%, E-value=7e-20, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GYPPSHWVLVTLTFIGLHVLTFRGLHALAIRGLHVLTFRGLHALAIKGLHVLTFVGLHALTFRGLHVLAFVGLHALTLRGLHLLANRGLHALTLRGLHVLANRGLHALTLRGIHVLTIRGLHALTSRGLHVLANRGLHALTFRGLRTSSFLLTVPGPPPDIGGGPTVRAQPEREAITQLLCIPGQDFTRAAAKRRVDRTHKTPSGPGKVQQGPRVSSSGFGPLSVLQGARIAPARHPVDPKK

SEQ ID NO: 218564 - protein, 100 aa, Glycine max
  Coding DNA Sequence Number=SeqID_101786
MILHEIRRPNSLKIVPSGVANCRNLPFGGRATQGSQVRLPRKENVRSHHQRLFEENIGKIGKVWSTNFNRERFESCFYARGRVSPSLLRILNCDEEIRPM

SEQ ID NO: 218565 - protein, 97 aa, Glycine max
  Coding DNA Sequence Number=SeqID_101787
MERYLQHLVRQQVANHRGQVQIHECLYRFSLSQQGQGFAGFVCPTPEQFGAEVAWPGDWPDAQAGEEPTGSPGEAEEARMDEDMTDLLSFLGGSEAT

SEQ ID NO: 218566 - protein, 59 aa, Glycine max
  Coding DNA Sequence Number=SeqID_101788
MSDLPLVRMWFHRARASVQAVQNLCASSRDAVHNPCNLKDTADGSGSHHKAQKRARILS

SEQ ID NO: 218567 - protein, 84 aa, Glycine max
  Coding DNA Sequence Number=SeqID_101789
MNKMSCDLHEMLNLLNDYENQIASEKKKGTVMVVGKSSKKKDKVPKRKNLGPKGGMTKPKNKRIKIDQTDAECFFCKEKGTTNN

SEQ ID NO: 218568 - protein, 58 aa, Glycine max
  Coding DNA Sequence Number=SeqID_101790
MPLRDRIASFPPPWKGFDLKIPRFFILMGSFPQHLKVRFENPFPGHLPMKEHGFSPTQ

SEQ ID NO: 218569 - protein, 175 aa, Glycine max
  Coding DNA Sequence Number=SeqID_101791
RTTCPRLERGYTPSPWVLVTLTVERTTRPRLERTTRPHHQRAACPHLQRTTCPRLERATRPHLGYSLPSPLRGLHVLALRGLHVLTIRALHVLAIRGLHVPHFQRGACPHLQRIAHPCHHRTTLPRLRKATRPTVRAQPEREAITQLLCILGQDFTRAAAKRRVRIMRTNMTTLT

SEQ ID NO: 218570 - protein, 206 aa, Glycine max
  Coding DNA Sequence Number=SeqID_101792
  Gene Ontology: Mol. function=protein binding; Cellular component =membrane; Biological process=defense response
  Homolog annotation: Hit_ID=Q1SW19; Match level="QueryCoverage=85%, HitCoverage=20%, E-value=7e-22, Identity=30%"; Hit description =Disease resistance protein
MAETAVAFLLDHLVKLLSEEATILGKVHKEVEEIKNQLERINSYIRDAEKKQLSDDQSSVKSWLKSLRNVAFEMEDVIDHYLLKVEERGQRHGIHGAATELIEKVKTVTHRHDIASDIKKVRKTLDGLYSEGMVLKLEPSSRAPYRATPRLGAHFVKEPQLVGIDRHKQQLTNWLTERGVPIRVVVGPPGIDLGYYKIVIFIDLIL

SEQ ID NO: 218571 - protein, 225 aa, Glycine max
  Coding DNA Sequence Number=SeqID_101793
MVFDTSYSMKQGITWCFDRENEKLPRKGAKGNQLSWASSSSPGQAHSFWANHVEGSFKEFQDSEVYEKEEEREKEEEKGGKSEAEALPNHDRVLMITMMVTKDDDKDDDKKLKDQSKNNSKSRFKVQDLKNQDQDSRLKIQESREGLIKIRYILCGTSRGYIYLGLTENKRGYISCGSVLVEGTSTRVFKENKGGYIPCESLFVKGFLQGWKRNLKDRMSLGDWM

SEQ ID NO: 218572 - protein, 359 aa, Glycine max
  Coding DNA Sequence Number=SeqID_101794
  Gene Ontology: Mol. function=transition metal ion binding; Cellular component=nucleus; Biological process=proteolysis
  Pfam annotation: Domain name=Transposase_21; Domain location=10-148; Score=8.6; E_value=2.4e-15; Accession=PF02992.5; Description =Transposase family tnp2
MNKCPKYGVSRYKVKDDDECCSDKSTKKFPLAKRKYMMLSMRISGPRQSDNNIDVYLSPSIEDLTKLWDEGVTVFDGYRSETFKLRAMLFCTTNDFPRYGNLGGYSVKGHCACPICEEVTTFNGSQEHDNASIPLTSQQVLGWVEGIDTIFGKTQKKVKSKTSIWKKRSMLFDLPYWFDLDVKHCIDVIYVEKNVCDSVINMLLNIQGKTNDGLNTHQDLVEMDIQDHLYPRSDEKAIEFCSEYIKKAKPDEILESHHNERVGVCHQDLVKETNPKMTKDRTISERWRQFKSNLTSKWALTHDKEGVDDKKNRLQREADVASCGACRPWLFFINGFLCFLRYDCSRMEKEKDEWRCHFK

SEQ ID NO: 218573 - protein, 996 aa, Glycine max
  Coding DNA Sequence Number=SeqID_101795
  Gene Ontology: Mol. function=protein binding; Cellular component =integral to membrane; Biological process=defense response to fungus
  Homolog annotation: Hit_ID=Q5VPF0; Match level="QueryCoverage=96%, HitCoverage=96%, E-value=1e-134, Identity=34%"; Hit description =Putative HcrVf3 protein
  Pfam annotation: Domain name=LRRNT_2; Domain location=29-67; Score =54.7; E_value=3e-13; Accession=PF08263.3; Description=Leucine rich repeat N-terminal domain
  Pfam annotation: Domain name=LRR_1; Domain location=112-135; Score =12.1; E_value=1.6; Accession=PF00560.23; Description=Leucine Rich Repeat
  Pfam annotation: Domain name=LRR_1; Domain location=137-159; Score =16.8; E_value=0.079; Accession=PF00560.23; Description=Leucine Rich Repeat
  Pfam annotation: Domain name=LRR_1; Domain location=161-184; Score =2.2; E_value=1.1e+02; Accession=PF00560.23; Description=Leucine Rich Repeat
  Pfam annotation: Domain name=LRR_1; Domain location=186-207; Score =4.8; E_value=36; Accession=PF00560.23; Description=Leucine Rich Repeat
  Pfam annotation: Domain name=LRR_1; Domain location=212-234; Score =4.0; E_value=50; Accession=PF00560.23; Description=Leucine Rich Repeat
  Pfam annotation: Domain name=LRR_1; Domain location=239-261; Score =9.4; E_value=5; Accession=PF00560.23; Description=Leucine Rich Repeat
  Pfam annotation: Domain name=LRR_1; Domain location=263-284; Score =9.4; E_value=5; Accession=PF00560.23; Description=Leucine Rich Repeat
  Pfam annotation: Domain name=LRR_1; Domain location=286-308; Score =12.0; E_value=1.6; Accession=PF00560.23; Description=Leucine Rich Repeat
  Pfam annotation: Domain name=LRR_1; Domain location=310-331; Score =15.1; E_value=0.25; Accession=PF00560.23; Description=Leucine Rich Repeat
  Pfam annotation: Domain name=LRR_1; Domain location=333-354; Score =11.7; E_value=1.8; Accession=PF00560.23; Description=Leucine Rich Repeat
  Pfam annotation: Domain name=LRR_1; Domain location=360-384; Score =6.4; E_value=18; Accession=PF00560.23; Description=Leucine Rich Repeat
  Pfam annotation: Domain name=LRR_1; Domain location=388-410; Score =11.1; E_value=2.3; Accession=PF00560.23; Description=Leucine Rich Repeat
  Pfam annotation: Domain name=LRR_1; Domain location=412-435; Score =0.6; E_value=2.2e+02; Accession=PF00560.23; Description=Leucine Rich Repeat
  Pfam annotation: Domain name=LRR_1; Domain location=437-459; Score =15.1; E_value=0.25; Accession=PF00560.23; Description=Leucine Rich Repeat
  Pfam annotation: Domain name=LRR_1; Domain location=461-483; Score =8.8; E_value=6.6; Accession=PF00560.23; Description=Leucine Rich Repeat
  Pfam annotation: Domain name=LRR_1; Domain location=485-507; Score =17.6; E_value=0.046; Accession=PF00560.23; Description=Leucine Rich Repeat
  Pfam annotation: Domain name=LRR_1; Domain location=509-531; Score =16.4; E_value=0.1; Accession=PF00560.23; Description=Leucine Rich Repeat
  Pfam annotation: Domain name=LRR_1; Domain location=533-551; Score =6.4; E_value=18; Accession=PF00560.23; Description=Leucine Rich Repeat
  Pfam annotation: Domain name=LRR_1; Domain location=556-579; Score =15.6; E_value=0.18; Accession=PF00560.23; Description=Leucine Rich Repeat
  Pfam annotation: Domain name=LRR_1; Domain location=581-603; Score =7.4; E_value=12; Accession=PF00560.23; Description=Leucine Rich Repeat
  Pfam annotation: Domain name=LRR_1; Domain location=605-626; Score =8.0; E_value=8.9; Accession=PF00560.23; Description=Leucine Rich Repeat
  Pfam annotation: Domain name=LRR_1; Domain location=629-651; Score =8.4; E_value=7.7; Accession=PF00560.23; Description=Leucine Rich Repeat
  Pfam annotation: Domain name=LRR_1; Domain location=653-675; Score =13.5; E_value=0.79; Accession=PF00560.23; Description=Leucine Rich Repeat
  Pfam annotation: Domain name=LRR_1; Domain location=677-699; Score =5.0; E_value=33; Accession=PF00560.23; Description=Leucine Rich Repeat
  Pfam annotation: Domain name=LRR_1; Domain location=702-724; Score =11.2; E_value=2.3; Accession=PF00560.23; Description=Leucine Rich Repeat
  Pfam annotation: Domain name=LRR_1; Domain location=726-748; Score =14.9; E_value=0.3; Accession=PF00560.23; Description=Leucine Rich Repeat
  Pfam annotation: Domain name=LRR_1; Domain location=793-815; Score =9.8; E_value=4.1; Accession=PF00560.23; Description=Leucine Rich Repeat
  Pfam annotation: Domain name=LRR_1; Domain location=817-839; Score =13.3; E_value=0.9; Accession=PF00560.23; Description=Leucine Rich Repeat
  Pfam annotation: Domain name=LRR_1; Domain location=841-863; Score =12.7; E_value=1.2; Accession=PF00560.23; Description=Leucine Rich Repeat
  Pfam annotation: Domain name=LRR_1; Domain location=865-886; Score =14.8; E_value=0.31; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1; Domain location=29-67::112-135::137-159::161 -184::186-207::212-234::239-261::263-284::286-308::310-331::333 -354::360-384::388-410::...
  Pfam module annotation: Domain location=412-435::437-459::461 -483::485-507::509-531::533-551::556-579::581-603::605-626::629 -651::653-675::677-699::702-724::726-748::793-815::817-839::841 -863::865-886
MLSLAFAVYFLLTAFSVLSSCGHSSLGCNEEQRQALLRIKGSFKDPSSRLSSWEGGDCCQWKGVVCNNITGHVVKLDLRNPCFPLRHQGDFQPNCNALEAQYVHPSILQLKYLTYLDLSGNNFHNSSIPVFFQTMQHLQVLYLSYSNFSGRIPHNLGNLTKLRHLDFSFNYLLYADEFYWISQLSSLQYLYMSDVYLGKAQNLLQTLNMLPSLVEIELMNCGLNKLHTHQLVRATNLSRLEVLNLAENELQAPFLDAFQNMNSIAEIDLSSNNLNSTPFWLGTCTNLVHLFLDSNALYGSLPSALENLTSLVSLDLSKNNFDSVPSWLGELKGLQYLYLSDNDLKHIEGSLASILGNCCHLHTLDMSRNNLQGDAIGVYIQSGCIRYDLIQLGLSNNEFNDSLPPWLGQLENLSDLLMYESNLVGTLSCDMMTKLVNLESLVLFNNNFTGSLPDCFGQLVKLDTVVLSFNHFHGVIPRSLEQLVSLKYLDLSRNSLNGTIPQNIGQLKNLINLYLSDNNLHGSIPHSLGELLNLQNLDLSLNHLESLVSDIRWPKQLVYLNLTNNHISGSLPPDFSDRLPNATHMLLGNNLISGSIPNSLCKIDTLYNLDLSGNMLSAEIPNCWSASQILNEINLASNKLSGVIPSSLGNLPTLAWLHLNNNSLHGGIPSSLKNLKHLLILDLGENLMSGIIPSWMGSIFSSMQILRLRQNRLNGTIPSQLCQLYALQILDLSKNNLTGSIPLCIGNLTGMVSRNKSFVTQPSEGPRYSEWYEQEVRQVIKGRELDYTRNLRLVVNMDLSNNHLSGSIPEGITLLSALQGLNLSYNHLSGHIPKRIGDMKSLESLDLSHDQLSGTISDSMSSLSSLSHLNLSYNNLSGPIPKGTQLSTLDDPFIYTGNPFLCGPPLQNECYADDFQHGNEDEEGEKDEVEKLWFYFVIALGYGLGFWVVIGSLLMKKSWRRAYFQYIDELTQRMNVSWAIHLENFKERLTGNPVAE

SEQ ID NO: 218574 - protein, 63 aa, Glycine max
  Coding DNA Sequence Number=SeqID_101796
MEKSKVDTLIAISPNTWHASNYWKLKVENGSWKLEVEVIASWKLEVKSGSYWKLKLGVEVIGS

SEQ ID NO: 218575 - protein, 45 aa, Glycine max
  Coding DNA Sequence Number=SeqID_101797
MATTDPWTWRSLVSKVFLTSESMHRGQVVGPTSVAVTLKYRSGIR

SEQ ID NO: 218576 - protein, 714 aa, Glycine max
  Coding DNA Sequence Number=SeqID_101798
  Gene Ontology: Mol. function=protein binding; Cellular component =membrane; Biological process=defense response
  Homolog annotation: Hit_ID=Q1SW19; Match level="QueryCoverage=97%, HitCoverage=72%, E-value=6e-96, Identity=34%"; Hit description =Disease resistance protein
  Pfam annotation: Domain name=LRR_1; Domain location=371-392; Score =7.1; E_value=14; Accession=PF00560.23; Description=Leucine Rich Repeat
  Pfam annotation: Domain name=LRR_1; Domain location=394-415; Score =16.4; E_value=0.1; Accession=PF00560.23; Description=Leucine Rich Repeat
  Pfam annotation: Domain name=LRR_1; Domain location=417-438; Score =10.0; E_value=3.9; Accession=PF00560.23; Description=Leucine Rich Repeat
  Pfam annotation: Domain name=LRR_1; Domain location=476-497; Score =4.3; E_value=45; Accession=PF00560.23; Description=Leucine Rich Repeat
  Pfam annotation: Domain name=LRR_1; Domain location=570-592; Score =5.5; E_value=27; Accession=PF00560.23; Description=Leucine Rich Repeat
  Pfam annotation: Domain name=LRR_1; Domain location=642-664; Score =2.7; E_value=90; Accession=PF00560.23; Description=Leucine Rich Repeat
  Pfam annotation: Domain name=NB-ARC; Domain location=1-241; Score =47.4; E_value=2.6e-13; Accession=PF00931.13; Description=NB-ARC domain
  Pfam module annotation: Pfam domain module=LRR_1::LRR_1::LRR_1::LRR _1::LRR_1::LRR_1::NB-ARC; Domain location=371-392::394-415::417 -438::476-497::570-592::642-664::1-241
MSRSQVDDEQNMLIRQIIENILEKDPGAATLRSETTTLESRIRKLKEYFEDKRYLIVFDDMQDLNFWNVIQYALNQNSSTSSKVIITTRDESVANMIGSDHFVSVYRVEPLSLSDALMLFRHKAFQFEKVEYPELNGLSEEFVEKCNRVPLAILAIASHLATKEKTTTEWRKALIQLGSRLQSNHLLDIVNQVMLESYHDLPSHLRRCILYFGLFPEGYFISCMTLIRLWVAGGLVEEKRDSSEEDTSMEELAKQYLAELVCRCLVHVSKVDFDGRPKTCHVYNLMHKLIARICQEQMFCDQVKMKDKTTPSSSNYSKLDSSDPRGLSIIINSDAAAMKRVKNWKKVRSCFVFDDAKKWLVTEEFFSSFMLLSQLDLSNARLDNLPKQVGNLLNLKYLSLRDTNIKSLPESIGNLERLQTLDLKRTQVHELPKEIKNLVKLCHLLAYFIYNQYSDLDRLQGVKVNEGLKNLTSLQKLSFLDASDGSIIKELEQLKKLRKLGIIKLREVYGDALCKAIENMTHLCSLSIGAMGNDGMLKLESLRNPPSSLQRLYLYGRLEKLPIWIKEIPNLVRLYLKWSSLKEDPLPYLKDLSKLLYLKFYEAYGGDELHFNNGWLKGLKVLHLESLPKLKTIKIAKGAIPYLAELKIGKCQKMVTFPRDIQNLTSLQKLYLYDMQEQFINESRSEDCKIIFNKIPLVEFSNDDHFSTFNNADA

SEQ ID NO: 218577 - protein, 252 aa, Glycine max
  Coding DNA Sequence Number=SeqID_101799
ENGVGQNNGTNIRTNDRKHAKVYPREARNGILDNKIDYLENKMKMVEGELREPAAIEAGLYSVVADHMALTTGLMAYEDITLSYIFMMTDHGHFCNLRGTVLGNMMGDSWDILSPSNVNVTSQDLANRLNAFNLAFDERVNGNHIPYAHNVVAVKYLNCGRDELICGSYNFNGNGSFSSAVFGSHRVRKKEKGEKVVGWGWVVHQRVRVGEHEIKQKGEGGKGEWWGSMRENIKGKEEWCGGSDSEGKWEKG

SEQ ID NO: 218578 - protein, 83 aa, Glycine max
  Coding DNA Sequence Number=SeqID_101800
  Subcellular localization annotation: CTP_CleavageSite=2; ConfidenceScore=5.12e-01
MAMNMKMSYRVMLVLFSLFMFVIPSKLSMRCDRGAPPETPISCIGRPGTRPPKTSASSFEVARPVPPSFNRPRNKGTPYVHYP

SEQ ID NO: 218579 - protein, 109 aa, Glycine max
  Coding DNA Sequence Number=SeqID_101801
  Gene Ontology: Mol. function=nucleic acid binding; Biological process= DNA integration
  Homolog annotation: Hit_ID=Q1S0A6; Match level="QueryCoverage=98%, HitCoverage=24%, E-value=2e-18, Identity=72%"; Hit description=Zinc finger, CCHC-type; Peptidase aspartic, catalytic; Polynucleotidyl transferase, Ribonuclease H fold
MEYFFKHLAPEHPNKTGELNDNIDIFWMWLEHWDFKKKRITQEEKESVTYTDTVKDNRWKDAMKGEIQALETNGTWTVIHLPLGKKALGYKWVYKIKHKSKGSVERFKA

SEQ ID NO: 218580 - protein, 50 aa, Glycine max
  Coding DNA Sequence Number=SeqID_101802
MAQELSRSSFCGEWNGSSLSKSGEEHEEASGAAMRMEKSGYRKTFKSPAF

SEQ ID NO: 218581 - protein, 81 aa, Glycine max
  Coding DNA Sequence Number=SeqID_101803
MQDKIDCNNKNEIREERMQTQFYTGSPTSRACIQYSSNPLEISTIFVKSITTFEPHRDNPSLVFRNPLQQETHSLLTNLIE

SEQ ID NO: 218582 - protein, 169 aa, Glycine max
  Coding DNA Sequence Number=SeqID_101804
  Homolog annotation: Hit_ID=Q2HVF5; Match level="QueryCoverage=54%, HitCoverage=22%, E-value=6e-16, Identity=45%"; Hit description =Cyclin-like F-box; F-box protein interaction domain; Galactose oxidase, central
MREYNRGDSWCKLFTLEESRELRSFKCVRPLGYSSDGNKVLLKHNRKRMCWYDLRKKEVTLVRIQGLPNLNEAMICLGTLVTPYFLPREICRKLQTLGCEHPSICTGKDFTLTFNYRLTCMVMIPPELLRTTKRVESNDGSATVVAPGESVTESLKTNCGHRMVACPCR

SEQ ID NO: 218583 - protein, 162 aa, Glycine max
  Coding DNA Sequence Number=SeqID_101805
MYYYHSWLSSIYSHYKESVYGRIDKGIADTATHIYAGDPANDDSSVTYALPLKIEHTAQSQCFQLQTLSLSLRLGLLIGLVGVERRVVVVAGDEVEELLGGFGKGSVGVERSLRLGEEENEGEKKRSGEKQWPEIGEDVEEPRSEVEHGEDREGHEECHSDV

SEQ ID NO: 218584 - protein, 279 aa, Glycine max
  Coding DNA Sequence Number=SeqID_101806
  Gene Ontology: Mol. function=nucleic acid binding; Cellular component= oxygen evolving complex; Biological process=DNA integration
  Homolog annotation: Hit_ID=Q1SDG1; Match level="QueryCoverage=74%, HitCoverage=19%, E-value=2e-48, Identity=51%"; Hit description =Integrase, catalytic region; Zinc finger, CCHC-type
MGSYLAHGLKIYPKAHENPRAFSNIPSPIFLEFPSHGSGDGSGKLEVNRQIVEKQPSKRSTNSIATSSSSQNPEAEEFTQHEVQEEVRELTGCIMRRNHPESPIIGDPTDHVQTKSSPRTQGHTIVIFEIEPKHIDDAIQDDNWVQAMQEELYHFQNNDVWKLVELPKGNKFVGAKWVLNKKLDKNGKVVKNKARLVTKGYSQLEGIDYKETYATTTRLEAIRILLSFPTYSNIKLYQMDEVYVENLQDLTVKLFPDMLLSSTKSCMDLSKLLKLGTKN

SEQ ID NO: 218585 - protein, 47 aa, Glycine max
  Coding DNA Sequence Number=SeqID_101807
  Homolog annotation: Hit_ID=Q1SDF6; Match level="QueryCoverage=85%, HitCoverage=7%, E-value=1e-12, Identity=85%"; Hit description=Sugar transporter superfamily; Major facilitator superfamily MFS_1
MSFYLVVPVFLSKIAPSRIRAALNILFQLNITLGILFSNLVNYATNK

SEQ ID NO: 218586 - protein, 98 aa, Glycine max
  Coding DNA Sequence Number=SeqID_101808
FSLNNLVDIPSTRTELQEMYLSCSQSTTTRVDKPSTCTTKEEPSNVLRQSSQAVSPLKLCEWGNKRILRREKGDTKEFRRLVLRSFGKGEERHKKNSG

SEQ ID NO: 218587 - protein, 115 aa, Glycine max
  Coding DNA Sequence Number=SeqID_101809
MMLAAWSALTKRIWPTDCLSVKRSFAIGAGAVTSFGYRKDMDGQWLKKDAKPPQDECTPSPPPQRDDSSTLMFFRSYEASTPMLVNALIPWMVVYMPLMLALKEWIPASLSLRRM

SEQ ID NO: 218588 - protein, 89 aa, Glycine max
  Coding DNA Sequence Number=SeqID_101810
MTHHLALVAFPHMDTTIVFHGECSLPASAPDHTSSIKWVHLLGLLTENKRGYISCGSVLVKGTSTRLFKENKGGYIPCESLLVKGFLQG

SEQ ID NO: 218589 - protein, 63 aa, Glycine max
  Coding DNA Sequence Number=SeqID_101811
FYGVPVAPSKIIRPPTNRAFIKKYCGPRQVQGKTPQQPGDGRQRATNALPSPLEFTAAHPQKV

SEQ ID NO: 218590 - protein, 174 aa, Glycine max
  Coding DNA Sequence Number=SeqID_101812
  Gene Ontology: Mol. function=serine O-acetyltransferase activity; Biological process=aromatic amino acid family biosynthetic process
  Homolog annotation: Hit_ID=Q1H3Q2; Match level="QueryCoverage=93%, HitCoverage=51%, E-value=9e-34, Identity=48%"; Hit description =Serine O-acetyltransferase
MEEIAIEHIVQQLASIRESALRQRQRLSQPPKLPARKALGKCVEWLAASLFPNRLGDSDIQAQAINFYVGTTLDKALRELQQQVRLELAFKAPGTPASQFNTQAHAISHAFAEQLPHIRIQLDTDLEAAYQGEPAADSVDEILVSYPGILALIHYRIAQRVAWLGPDHYCALDH

SEQ ID NO: 218591 - protein, 86 aa, Glycine max
  Coding DNA Sequence Number=SeqID_101813
  Subcellular localization annotation: CTP_CleavageSite=32; ConfidenceScore=5.63e-01
MHLLRSSSSRRDSASSSQVKAYSSRFCFFIFVAAIVVGIKWKASSSRFCFFFEFLLLLRGTFLLRVSTSSPIVAGDGGTAIGKLLG

SEQ ID NO: 218592 - protein, 100 aa, Glycine max
  Coding DNA Sequence Number=SeqID_101814
MVIPKFKVPDFDKYKGTTYPMNRLKMYCRKMGAYAKDNKLLIHFFQESLTGVDVTWYANLKPSQVHSWKDLMVAFIRQCQYDSDMAPDSMQLQYMCKKRA

SEQ ID NO: 218593 - protein, 181 aa, Glycine max
  Coding DNA Sequence Number=SeqID_101815
MGEAEEVQEQMKADMEAMKEQMAIMVETMMSMKKIMEANAVTATSTVAKCGRPSFSAKNKHAFPPYGLPPNYTPPNVAYTPSENVNNSTPMSRQPQTDHAHVSQTVEETHEIPHHNLADFEPCLGYATEGQVVGGILLQNTLEGPQFRPQPQPLHSTASKIPSIMEGMGKVGSSRGKAQGR

SEQ ID NO: 218594 - protein, 436 aa, Glycine max
  Coding DNA Sequence Number=SeqID_101816
  Homolog annotation: Hit_ID=UPI00005EFEFD; Match level="QueryCoverage =39%, HitCoverage=83%, E-value=3e-40, Identity=49%"; Hit description =COG4540: Phage P2 baseplate assembly protein gpV
  Pfam annotation: Domain name=GPW_gp25; Domain location=326-425; Score= 85.1; E_value=2.2e-22; Accession=PF04965.4; Description=GPW  gp25 family
  Pfam annotation: Domain name=Phage_base_V; Domain location=158-260; Score=69.8; E_value=8.7e-18; Accession=PF04717.3; Description=Phage -related baseplate assembly prot
  Pfam module annotation: Pfam domain module=GPW_gp25::Phage_base_V; Domain location=326-425::158-260
MASYHDAILSALREIEWIANADDYPEVVTQLETPAVYLSIAGWENAPGSDGQLRVEFEHDLFVVVDRAGTNEITKPQVYIRTAAADLSQWIQGRTFGLEGLEPAEFVRAGPDEFDIAMEDYIVWRVTFSQVAAMGEDPFESKAGPLKKRRVANMVRRGVIHSVKHGPQPFCRVEIGENITTWLPLCQGFAGAHRSDSNPCAVGDPVTVLSESGELNNGRVFPGWNTGAMPAPEGSDAEHITRFSDGAEFRYNRETHAFTLTLPENGTYEIIGKGTLRGPVEITDTLTVKGKTDLQADTAVTGDLSATGDISDGKSTLARGVNAASGKRLAGTAHLRQSVFDILTTPIGSRVLVRDYGSRLLDLVDNPQDESTRVHIIAATAGALARWEPRLQVKSVTVQFSGSGQFDLTIYGINTETGYPITLKELTINGDQFRND

SEQ ID NO: 218595 - protein, 171 aa, Glycine max
  Coding DNA Sequence Number=SeqID_101817
  Gene Ontology: Mol. function=DNA binding; Biological process=DNA integration
MSELDESFADLRLNEDIGPLVEQSTGTNVSDQVTGQPQEQREPIGQILSKNHLESQIIGDPSTKVQTRGSLRQQGFITLILEVETKHINDAMEDKNWVKSMQEELEKFKKNDIWKLVESQILSKNHLESQIIGDPSTKVQTRGSLRQQGFITLILEVETKHINDAMEDKNW

SEQ ID NO: 218596 - protein, 89 aa, Glycine max
  Coding DNA Sequence Number=SeqID_101818
MSPIGCLYPPARSCHRDIALITSLCQFYEVSVAPSKVISPPTNRAFIKKYCAPRQAQGETPQQPRDGRQQAIRASPPPLEFTSAHPQKG

SEQ ID NO: 218597 - protein, 61 aa, Glycine max
  Coding DNA Sequence Number=SeqID_101819
MWKKRSIFFDLPYWFDLHVRHCLDVMHVEKNVCDSLIAKSSTLNNWMTWRMRLPLSLCHLE

SEQ ID NO: 218598 - protein, 329 aa, Glycine max
  Coding DNA Sequence Number=SeqID_101820
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=3e-36, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RAHALAFRGLRILSFRGLHILTVRGLHVLAFIGLHALTFRGLHVLIFSRVQVLTFSRVHVLVFRGLHALTFRGLHALTFRGQHALAFRWLHVLSFRGLHVIAFRGLHTLAFRGLHVHTFRGLHALALRGLHVLAFSGVNVLAFRGLHVIAFRGLHALTLRGLHALTFRGLHVLAFRGLHVLDFKGIHDLTFRGLHVLAFKWLHVLAFRGLHAFSGLHVLTFRGLHVLTFRGVHVFSFRVLHVLAISGVHVFAFRGPHVLTFRGLHALNFRGYHVLSFRGLHVLGFEGLKILSFRGLHVLAFRGLHILSFRGLHALTFRGLHILVFRRVH

SEQ ID NO: 218599 - protein, 258 aa, Glycine max
  Coding DNA Sequence Number=SeqID_101821
  Subcellular localization annotation: CTP_CleavageSite=36; ConfidenceScore=5.32e-01
MTENSAMHSVTMVNSMAVHSPPLKPCARSRPITWCCTMHDPPKTRVDRAKIFQIRRQSSAVANTAAVQFVPAQPVPEDAVEGIGQAQEADDHDEPGDAVAQADIGLAADQNHAGNQQGQQQHRLQQGVGCGAGKRNDGDQDAQQDGTPGVTRFGGHAGCSHACSFHQRPPGVSRPGFHGGRLAEIAGADTTVGPRGNQPNRRCTGACVGVRTVAGNRPCLWASGRDHRPPQVATLTISPAMPARGHAPTPCQDAKRPK

SEQ ID NO: 218600 - protein, 311 aa, Glycine max
  Coding DNA Sequence Number=SeqID_101822
SIGKIIELIEGITILAEDYHNSDSLYKRDRNIRSHKNQGIPTGYMVRVFQWKTFELSNVLQQFVHDVSRMRDAIKKQFHWDETLSENEAEIGIGEQKSILSRSGSAEKLAERQETILNLGKQFKALAAPKDAYLFDNMLADDDTKVKVSKARERGCSPTSIPVLILWTLYQLLENILLLNELKNVQYKHNITAEDASLRACTKVQLPIKDVPNANNPFTFVTADFSTKVQLTDECAACHYHRGGQCQLDSREKFCCTNATLQQNPACGGATRHDAGRATIYFIPSAEVTGVHRRGHTRYFRQRGRELEGER

SEQ ID NO: 218601 - protein, 128 aa, Glycine max
  Coding DNA Sequence Number=SeqID_101823
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q10MX5; Match level="QueryCoverage=86%, HitCoverage=28%, E-value=6e-43, Identity=62%"; Hit description =Expressed protein
  Pfam annotation: Domain name=DUF231; Domain location=52-128; Score= -32.5; E_value=5.3e-05; Accession=PF03005.6; Description=Arabidopsis proteins of unknown function
DYGVTISFYRAPYLVEIDVVQGKRILRLEEVDGNGDAWRSADVLSFNTGHWWDHQGSLQGWDYMELGGKYYQDMDRLAALERGIKTWANWVDSNIDSSRTKVFFLGISPSHTKYGLSLSFSLLHYCTI

SEQ ID NO: 218602 - protein, 74 aa, Glycine max
  Coding DNA Sequence Number=SeqID_101824
MENTKNGSKLKELSDPHNNVHAFICKGWRGNGVVFCLMSLSAMPWELLTGYRVVPVAHTGTTDRLFRLANRHVV

SEQ ID NO: 218603 - protein, 86 aa, Glycine max
  Coding DNA Sequence Number=SeqID_101825
  Gene Ontology: Mol. function=nucleoside-triphosphatase activity; Cellular component=integral to membrane; Biological process=transport
  Homolog annotation: Hit_ID=Q1S953; Match level="QueryCoverage=95%, HitCoverage=12%, E-value=4e-35, Identity=81%"; Hit description=AAA ATPase
MVSKHIPKFMKWLKYLSFMYYGFRLLLKVQYSGDQLYDCESKGGCKTLQSSPTFGIVNLKGGLKEVWILLAMALVFRLLAYLCLRR

SEQ ID NO: 218604 - protein, 98 aa, Glycine max
  Coding DNA Sequence Number=SeqID_101826
  Gene Ontology: Mol. function=nucleoside-triphosphatase activity; Cellular component=protein complex; Biological process=protein catabolic process
  Homolog annotation: Hit_ID=O04019; Match level="QueryCoverage=51%, HitCoverage=12%, E-value=2e-14, Identity=72%"; Hit description=26S protease regulatory subunit 6A homolog
MVEIANRTSESRACFVCYHNLRKHNLGQLKLMLLGEIGPVKNAYFVMVVETIVLPMTHKERFQKFGIGPLKGVPLYGPPGTGKTLIVHACTTQTNAIF

SEQ ID NO: 218605 - protein, 767 aa, Glycine max
  Coding DNA Sequence Number=SeqID_101827
  Homolog annotation: Hit_ID=Q1SA15; Match level="QueryCoverage=11%, HitCoverage=16%, E-value=1e-36, Identity=80%"; Hit description =Homeodomain-related
  Pfam annotation: Domain name=CorA; Domain location=327-689; Score= -11.7; E_value=1.1e-05; Accession=PF01544.9; Description=CorA-like Mg2+ transporter protein
  Pfam annotation: Domain name=FlaC_arch; Domain location=491-622; Score=-14.8; E_value=0.078; Accession=PF05377.2; Description =Flagella accessory protein C (FlaC)
  Pfam annotation: Domain name=Homeobox; Domain location=637-692; Score= 18.5; E_value=5.9e-05; Accession=PF00046.19; Description=Homeobox domain
  Pfam module annotation: Pfam domain module=CorA::FlaC_arch::Homeobox; Domain location=327-689::491-622::637-692
MPFLYFQSLAFLCTRRGPFSKDVTPTEVDCTSIGLATTNCTEKIDIVHNSWKDVSDMLKELASLEEQTRQGTFVPHGREDILNTAIGRPDHGGCVRALGSGVTISQYFGRAPRGSSCSSGSINQVQLAEIIGILQEQWKNDIQVLKHELKEQIILEMSQRGSPISEPIQPNIHVLGARVSTKGSNAEAIVNPSPPNHVAPSKPTMGLYVHCQDSTELVALGKTYDGGSTIYNVAYADDVVRVSVDKVINGDTEVPFLTSEIKYVRQALHTFVAWPTTLVKLASNEHEGTSPSKVTDEAVESVNDVVVDDPLREFIKTLVDIYEKPVELVWDVTKFGIPNAAASFKNLGVGSMYGFLELQAILSSKDRRRQCEEYIQKWLKESNRDVYLGTHLNYTPRWIKVKSHVQSGGYECGYYVMHWMSNIVAGQHKNDWTLVLLRDPTDENVIHVVEELQRWLPRLSATSLQQKGDGKEYLGGQNDVEAAEEDDGPYPALDELTSKISSRNLDRVRKLKSAMTRLTARVQRVRDELEQLLDDDDDMVDLYLSRKVGSSSPVSGSGAANWFAASPTIRSKISRASLATIHLDENDVEELEMLLEESTVVKIANFNNGHDVSIDETLFFYNGGLETDVETFNFQQHPIQHRLTTDVKYGFPPMLKHKYPTEEMKLVLAEELGLTEKQISGWFCHKRLKYKRLMKDEVVANGRQDCSSGVIQDRGSGLGQDSCGSSKHADHRYLDSKEVESHGLYNLGQFATLDSLCGTKIDNNAPH

SEQ ID NO: 218606 - protein, 146 aa, Glycine max
  Coding DNA Sequence Number=SeqID_101828
MVVVFFGGVMILVFEYLHDPVGDHNEVNLTSNVDQPIGENLDDFNNIVFNDPKEETNDVEEFDGEFVNLEEANRISCARKKRRRHSSDYATNTIEENDDNDVEYHSKELESEPESDEEGNVIEKEKFPPFVPQSSMAIQMEYWFII

SEQ ID NO: 218607 - protein, 60 aa, Glycine max
  Coding DNA Sequence Number=SeqID_101829
MEEGIKAVIFIYNKLRFLSQTGKVEEDTKAVIFIYKKLRFLFHTGISIYILMQRLSTFAT

SEQ ID NO: 218608 - protein, 198 aa, Glycine max
  Coding DNA Sequence Number=SeqID_101830
  Homolog annotation: Hit_ID=Q9ZQ71; Match level="QueryCoverage=97%, HitCoverage=97%, E-value=2e-72, Identity=70%"; Hit description =Expressed protein
  Pfam annotation: Domain name=DUF538; Domain location=57-197; Score =206.5; E_value=6.3e-59; Accession=PF04398.3; Description=Protein of unknown function, DUF538
MERALTKVSSMKVGLGSSWITKKAKEEFSNISEDFSSISCVLWLKEREGEMSERTFSNTVEEKAKWIFNKLKGKPQKSLPDLLREYNLPPGLFPQNIICYEFDETKGKLIVYLPSTCEVSFKDSSVLRYATRVKGVLTRGKLSAIDGMKTKVLVWVKVTNVAVEGYKSDKLWFTAGVKKSRTKDAYDTPRDAVRVSEF

SEQ ID NO: 218609 - protein, 333 aa, Glycine max
  Coding DNA Sequence Number=SeqID_101831
  Gene Ontology: Mol. function=chorismate mutase activity; Cellular component=chloroplast; Biological process=aromatic amino acid family biosynthetic process
  Homolog annotation: Hit_ID=Q5JN19; Match level="QueryCoverage=89%, HitCoverage=84%, E-value=2e-58, Identity=45%"; Hit description =Putative chorismate mutase
  Pfam annotation: Domain name=CM_2; Domain location=38-105; Score =25.9; E_value=0.00015; Accession=PF01817.11; Description=Chorismate mutase type II
MDSILLSCRSTLNSFFLYRHTGKKRVDESKTLTLDGIRNSLIRQEDSIIVSLLERAKYSYNADAYDKDAFFMDGFNGSLVEYMVLQTEKLHSQVGRYKSPDEHAFFPECLPEPALPPLQYPQDLLPRLVKAGDDDNCGSVAVCDTLCLQVKEHGCLFFVTFLAHLLRGWSSGARVLPITGHKFVLSLISLERVQIPSFRYNASAPLQALSKRIHYGKFVAEAKFQDAPSEYVAAIEAKDRKLLLDLLTYETVEELVKKRVEIKARQYGQVVKIGETGDIATPVYKIKPSLIANLYGDWVMPLTKEVQLSVRDGLGHLDYFVKLNTGQQWCFSG

SEQ ID NO: 218610 - protein, 76 aa, Glycine max
  Coding DNA Sequence Number=SeqID_101832
  Subcellular localization annotation: CTP_CleavageSite=57; ConfidenceScore=5.23e-01
MLTSLERVQMTTLVSACQSDLGSPNDKVRITVTVRCLRMPPVSWVTVTKGGVVDKSRAFAPTYPQFVMRNSDLRSS

SEQ ID NO: 218611 - protein, 516 aa, Glycine max
  Coding DNA Sequence Number=SeqID_101833
  Gene Ontology: Mol. function=transmembrane receptor protein serine/threonine kinase activity; Cellular component=integral to membrane; Biological process=protein amino acid phosphorylation
  Homolog annotation: Hit_ID=Q9FL28; Match level="QueryCoverage=95%, HitCoverage=63%, E-value=1e-138, Identity=40%"; Hit description =Receptor protein kinase
  Pfam annotation: Domain name=LRRNT_2; Domain location=27-67; Score =58.8; E_value=1.8e-14; Accession=PF08263.3; Description=Leucine rich repeat N-terminal domain
  Pfam annotation: Domain name=LRR_1; Domain location=120-142; Score =14.9; E_value=0.29; Accession=PF00560.23; Description=Leucine Rich Repeat
  Pfam annotation: Domain name=LRR_1; Domain location=144-166; Score =17.1; E_value=0.065; Accession=PF00560.23; Description=Leucine Rich Repeat
  Pfam annotation: Domain name=LRR_1; Domain location=168-190; Score =3.9; E_value=53; Accession=PF00560.23; Description=Leucine Rich Repeat
  Pfam annotation: Domain name=LRR_1; Domain location=216-238; Score =13.1; E_value=0.99; Accession=PF00560.23; Description=Leucine Rich Repeat
  Pfam annotation: Domain name=LRR_1; Domain location=240-262; Score =13.1; E_value=1; Accession=PF00560.23; Description=Leucine Rich Repeat
  Pfam annotation: Domain name=LRR_1; Domain location=264-286; Score =10.8; E_value=2.7; Accession=PF00560.23; Description=Leucine Rich Repeat
  Pfam annotation: Domain name=LRR_1; Domain location=288-310; Score =13.4; E_value=0.86; Accession=PF00560.23; Description=Leucine Rich Repeat
  Pfam annotation: Domain name=LRR_1; Domain location=312-334; Score =11.6; E_value=1.9; Accession=PF00560.23; Description=Leucine Rich Repeat
  Pfam annotation: Domain name=LRR_1; Domain location=336-358; Score =14.8; E_value=0.33; Accession=PF00560.23; Description=Leucine Rich Repeat
  Pfam annotation: Domain name=LRR_1; Domain location=360-382; Score =16.8; E_value=0.078; Accession=PF00560.23; Description=Leucine Rich Repeat
  Pfam annotation: Domain name=LRR_1; Domain location=384-406; Score =11.9; E_value=1.7; Accession=PF00560.23; Description=Leucine Rich Repeat
  Pfam annotation: Domain name=LRR_1; Domain location=408-430; Score =11.2; E_value=2.3; Accession=PF00560.23; Description=Leucine Rich Repeat
  Pfam annotation: Domain name=LRR_1; Domain location=432-454; Score =14.5; E_value=0.39; Accession=PF00560.23; Description=Leucine Rich Repeat
  Pfam annotation: Domain name=LRR_1; Domain location=456-478; Score =7.7; E_value=10; Accession=PF00560.23; Description=Leucine Rich Repeat
  Pfam annotation: Domain name=LRR_1; Domain location=480-502; Score =10.2; E_value=3.4; Accession=PF00560.23; Description=Leucine Rich Repeat
  Pfam annotation: Domain name=LRR_1; Domain location=72-93; Score=0.9; E_value=1.9e+02; Accession=PF00560.23; Description=Leucine Rich Repeat
  Pfam annotation: Domain name=LRR_1; Domain location=96-118; Score =13.9; E_value=0.57; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1; Domain location=27-67::120-142::144 -166::168-190:...
  Pfam module annotation: Domain location=:216-238::240-262::264 -286::288-310::312-334::336-358::360-382::384-406::408-430::432 -454::456-478::480-502::72-93::96-118
MLSLKISLTIGIVLSIVSIVSHAETSLDVEIQALKAFKNSITGDPSGALADWVDSHHHCNWSGIACDPSSSHVISISLVSLQLQGEISPFLGNISGLQVLDLTSNSFTGYIPAQLSFCTHLSTLSLFENSLSGPIPPELGNLKSLQYLDLGNNFLNGSLPDSIFNCTSLLGIAFTFNNLTGRIPSNIGNLVNATQILGYGNNLVGSIPLSIGQLVALRALDFSQNKLSGVIPREIGNLTNLEYLLLFQNSLSGKIPSEIAKCSKLLNLEFYENQFIGSIPPELGNLVRLETLRLYHNNLNSTIPSSIFQLKSLTHLGLSENILEGTISSEIGSLSSLQVLTLHSNAFTGKIPSSITNLTNLTYLSMSQNLLSGELPPNLGVLHNLKFLVLNSNNFHGSIPSSITNITSLVNVSLSFNALTGKIPEGFSRSPNLTFLSLTSNKMTGEIPDDLYNCSNLSTLSLAMNNFSGLIKSGIQNLSKLIRLQLNANSFIGPIPPEIGNLNQLVTLSLSENRFS

SEQ ID NO: 218612 - protein, 80 aa, Glycine max
  Coding DNA Sequence Number=SeqID_101834
MEQLHKKIEDDLEVSRRMLSFNVVNGGWRFIAESQKSVIKIWQIQGLGSLKLHFPDVPVMALTATARHAVREVIRISNHL

SEQ ID NO: 218613 - protein, 571 aa, Glycine max
  Coding DNA Sequence Number=SeqID_101835
  Gene Ontology: Mol. function=transmembrane receptor protein serine/threonine kinase activity; Cellular component=integral to membrane; Biological process=protein amino acid phosphorylation
  Homolog annotation: Hit_ID=Q9FL28; Match level="QueryCoverage=98%, HitCoverage=90%, E-value=1e-150, Identity=40%"; Hit description =Receptor protein kinase
  Pfam annotation: Domain name=LRR_1; Domain location=105-127; Score =13.8; E_value=0.65; Accession=PF00560.23; Description=Leucine Rich Repeat
  Pfam annotation: Domain name=LRR_1; Domain location=129-151; Score =15.5; E_value=0.19; Accession=PF00560.23; Description=Leucine Rich Repeat
  Pfam annotation: Domain name=LRR_1; Domain location=153-176; Score =13.9; E_value=0.57; Accession=PF00560.23; Description=Leucine Rich Repeat
  Pfam annotation: Domain name=LRR_1; Domain location=56-78; Score =11.3; E_value=2.2; Accession=PF00560.23; Description=Leucine Rich Repeat
  Pfam annotation: Domain name=LRR_1; Domain location=6-29; Score=18.5; E_value=0.024; Accession=PF00560.23; Description=Leucine Rich Repeat
  Pfam annotation: Domain name=LRR_1; Domain location=80-103; Score =17.9; E_value=0.038; Accession=PF00560.23; Description=Leucine Rich Repeat
  Pfam annotation: Domain name=Pkinase; Domain location=274-562; Score =104.2; E_value=3.9e-28; Accession=PF00069.15; Description=Protein kinase domain
  Pfam annotation: Domain name=Pkinase_Tyr; Domain location=274-562; Score=29.1; E_value=3e-14; Accession=PF07714.7; Description=Protein tyrosine kinase
  Pfam annotation: Domain name=RIO1; Domain location=287-461; Score= -97.3; E_value=0.085; Accession=PF01163.12; Description=RIO1 family
  Pfam module annotation: Pfam domain module=LRR_1::LRR_1::LRR_1::LRR _1::LRR_1::LRR_1::Pkinase::Pkinase_Tyr::RIO1; Domain location=105 -127::129-151::153-176::56-78::6-29::80-103::274-562::274-562::287-461
MGKLNQLLSLDLSHNQLTGSIPRDVIAHFKDMQMYLNLSYNHLVGSVPTELGMLGMIQAIDISNNNLSGFIPKTLAGCRNLFNLDFSGNNISGPIPAEAFSHMDLLENLNLSRNHLEGEIPEILAELDHLSSLDLSQNDLKGTIPERFANLSNLVHLNLSFNQLEGPVPNSGIFAHINASSMVGNQDLCGAKFLSQCRETKHSLSKKSISIIASLGSLAILLLLVLVILILNRGIKLCNSKERDISANHGPEYSSALPLKRFNPKELEIATGFFSADSIIGSSSLSTVYKGQMEDGQVVAIKRLNLQQFSANTDKIFKREANTLSQMRHRNLVKVLGYAWESGKMKALVLEYMENGNLDSIIHGKGVDQSVTSRWTLSERVRVFISIASALDYLHSGYDFPIVHCDLKPSNILLDREWEAHVSDFGTARILGLHEQAGSTLSSSAALQGTVGYMAPEFAYMRKVTTEADVFSFGIIVMEFLTKRRPTGLSEEDGLPITLHEVVTKALANGIEQLVDIVDPLLTWNVTKNHDEVLAELFKLSLCCTLPDPEHRPNTNEVLSALVKLQTTLSC

SEQ ID NO: 218614 - protein, 135 aa, Glycine max
  Coding DNA Sequence Number=SeqID_101836
  Subcellular localization annotation: CTP_CleavageSite=62; ConfidenceScore=5.17e-01
MKAFWVLPSSFNLVVARIVPHKIAVNLLKHSSQFPKNFQQSIKTLLIFKQIMSLQPMKLKIMMMTLNRPKCRKEVLRLDGWINHFMNGGGEEKQEPLRLAHLLLGKAAFNSDGAFGELDFPSGIQEFLHTDPPCN

SEQ ID NO: 218615 - protein, 296 aa, Glycine max
  Coding DNA Sequence Number=SeqID_101837
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=8e-31, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
HGLTIIRLNALTFRGLYVLALRGLHVLAFTGLYALTFRGLYVLAFRGLYILAFRGLYVLAIRGLHVLTFRGLHAFSFRELHVPTFRGQNVLAFRELHVLAFRGLHRTIRPPLQRATRPRLQWTTRPPLYRTNVLAISGLHVLRFRGQHALAFRGLQVLTFRGLHIFAFRGLHALTLKGLHALVFRGLHPLALRALHVLAFRGLHVLTFKGLHVLAFGGLHVLAFRGLYVLVVRGLHVLAFIGLYAFTFRGLYVLAFRGLHDLAFRGLYLLIFRGLHVLTFRGLQVLAITGLHVLAI

SEQ ID NO: 218616 - protein, 383 aa, Glycine max
  Coding DNA Sequence Number=SeqID_101838
  Gene Ontology: Mol. function=transmembrane receptor protein serine/threonine kinase activity; Cellular component=integral to membrane; Biological process=protein amino acid phosphorylation
  Homolog annotation: Hit_ID=Q9FL28; Match level="QueryCoverage=97%, HitCoverage=91%, E-value=3e-81, Identity=56%"; Hit description =Receptor protein kinase
  Pfam annotation: Domain name=LRRNT_2; Domain location=29-69; Score =54.4; E_value=3.7e-13; Accession=PF08263.3; Description=Leucine rich repeat N-terminal domain
  Pfam annotation: Domain name=Pkinase; Domain location=168-382; Score =48.3; E_value=1.9e-11; Accession=PF00069.15; Description=Protein kinase domain
  Pfam annotation: Domain name=Pkinase_Tyr; Domain location=168-383; Score=-31.8; E_value=1.6e-10; Accession=PF07714.7; Description =Protein tyrosine kinase
  Pfam module annotation: Pfam domain module=LRRNT_2::Pkinase::Pkinase _Tyr; Domain location=29-69::168-382::168-383
MTSQVKFKTFSPCPNNHGFLPNSHAETSLDVEIQALKAFKNSITADPNGALADWLDTHHHCNWSGIACDPSSNHVISISFVSLQLQGEISPFLGNIPGLQKSISIIASLGSLAILLLLVLVILILNRGIKLCNSKERDISANHGPEYSSALPLKRFNPKDLENATGFFSYDSIIGASSLSTVYKGQMEDDQFVAIKRLNLQQFSVNTDKIFKREAKILCQMRHRNLVKVLGYAWESGKMKALVLEYMENGNLDGIIHDKGKDESVISRWTLSERVRVFISIASALDYLHSGYDFPIVHCELKPSNILLDRDWEAHVSDFGTARILGLHLQDGSTLSSSAALQGTLGYMAPEFAYMRKVTTKADVFSFGVIVMEFLTKRRPTGL

SEQ ID NO: 218617 - protein, 787 aa, Glycine max
  Coding DNA Sequence Number=SeqID_101839
  Gene Ontology: Mol. function=transferase activity, transferring glycosyl groups; Cellular component=intracellular; Biological process=glucan biosynthetic process
  Homolog annotation: Hit_ID=Q9XGC1; Match level="QueryCoverage=80%, HitCoverage=77%, E-value=0.0, Identity=71%"; Hit description=Starch synthase, isoform V
  Pfam annotation: Domain name=Glyco_transf_5; Domain location=452-694; Score=374.8; E_value=1.3e-109; Accession=PF08323.2; Description =Starch synthase catalytic domain
  Subcellular localization annotation: CTP_CleavageSite=37; ConfidenceScore=5.34e-01
MASKLRTCFMCWNLSGFNCVNHHNGRNRVVRVSFPASCEMRHRATFSSQHKRQQIKPSAEGGLRQNQDEEDDAAEVSLNNDDSVENLNDATAPLAININGAEQAEQLSGRQLEDLLGMIKNAEKNILLLNEARVRSLEDLEKILAEKEALQGEINVLETRLAETDAQIKVANQEKIHVELLEGQLEKLRMSWPKRKVLKENILNCMTFKMELSDTKNNDERLVALEKERSSLESALKDLESKLSISQDDVSKISTLTVEYKDLWDKVENLQSLLDKATKQADQAVIVLQQNQDLRRKVDKLEESLEEANIYKLSSDKLQKYSELMQQKLKLLEDRLQKTDEEINSYVQLYQQSVKEFQDTLDTLKEESKKGNLEEPVEDMPWEFWSQLLLLIDGWKLEKKISVDDASLLREKVWKRDRRIIDTYIACKKQSEQEAISAFLGLLSSATSPGLHVIHIAAEMAPVAKVGGLGDVVSGLGKALQKKGHLVEIVLPKYDCMQYDRVCDLRALDVLIDSYFDRQLYKNKIWVGTVEGLPVYFIEPHHPDKFFWRGEFYGERDDFRRFSFFSRAALEFLLRAGKKPDIIHCHDWQTAFIAPLYWEIFAPKKGLNSARICFTCHNFEYQGTAAASELESCGLESHRLNRKDRMQDNSSHDRVNSVKGGIVFSNIVTTVSPTYAQEVRTEEGGRGLHSTLSVHSKKLIGIINGIDTDAWNPATDAFLPVQYNATDLQGKAENKQALGRNLGLSSTDVRRPLNDKSKANCTCVLYVTFEMNIPRLFQIALSCEIYL

SEQ ID NO: 218618 - protein, 631 aa, Glycine max
  Coding DNA Sequence Number=SeqID_101840
  Gene Ontology: Mol. function=transferase activity
  Homolog annotation: Hit_ID=Q5ZCH7; Match level="QueryCoverage=79%, HitCoverage=94%, E-value=0.0, Identity=69%"; Hit description=O -acetyltransferase-like
  Pfam annotation: Domain name=Cas1p; Domain location=213-450; Score =520.1; E_value=2.5e-153; Accession=PF07779.2; Description=Cas1p-like protein
MRSNVLVKFAFYLKQEEEKQVATNINGFRFSSAIYDHSLTRFSYQIKCFRLFSFFSDLKDLCGWRWWFRGRSRRGRFVIIATVVILRFGGENSKMRVLVNGIGFSSCVVSFLLGVIPVFVSWIYSEYLEYKKPSSPPKVHSDVCLEELGKDAIKEDDRAILLESGLTRSASAKFHPSSVKLNLIRFLTMDDSFLLENRATLRAMAEFGLILFYFYICDRTNILGDSTKSYSRDLFIFLYLLLIIVSALSSLKKHNDSSTFSGKNILYLNRHQTEEWKGWMQVLFLMYHYFAATEIYNAIRVFIAAYVWMTGFGNFSYYYIRKDFSLPRFAQMMWRLNFFVAFCCIVLNNDYMLYYICPMHTLFTLMVYGALGIYNKYNEVPSVMAAKILACFLVVILVWEIPGFFDIFWSPFALFLGYTDPAKPDLPRMHEWHFRSGLDRYIWIIGMIYAYFHPNVISNTSLCGGHWVEKWMEKLEESEIKRRATIKTSIVSVALFVGYLWYEYIYKLDKVSYNKLHPYTSWIPITWLGKITLETYISQFHIWLRSNMPNGQPKWLLSLIPEYPMLNFMLTTAIYVFVSHRLFELTNTLKTVFIPTKDNRRLLHNFITGVVLCLSLYCIALILLLIPHSTV

SEQ ID NO: 218619 - protein, 371 aa, Glycine max
  Coding DNA Sequence Number=SeqID_101841
  Gene Ontology: Mol. function=sequence-specific DNA binding; Cellular component=nucleus; Biological process=regulation of transcription, DNA-dependent
  Homolog annotation: Hit_ID=Q8VWJ2; Match level="QueryCoverage=68%, HitCoverage=77%, E-value=1e-41, Identity=43%"; Hit description =Probable WRKY transcription factor 28
  Pfam annotation: Domain name=WRKY; Domain location=189-248; Score =149.7; E_value=7.7e-42; Accession=PF03106.6; Description=WRKY DNA -binding domain
MSVEPKELYYQDLVLDHNIINNQHQGTEAGSNTTMYEKHFSSTLIPSVSAAYDSSQAFDPSYMSFTDCLQGSMDYNSLATSFGLSPSSSEVFSSVEGNQKPAEGGGDGGGGGGGSGGSETLATLNSSISSSSSEAGAEEDSGKSKKERQVKTEEGGENSKKGNKEKKKGEKKQKEPRFAFMTKSEVDHLEDGYRWRKYGQKAVKNSPYPRSYYRCTTQKCTVKKRVERSFQDPTTVITTYEGQHNHPVPTSLRGNAAAGMFTPSSLLATPTHPLAAGSNFPQDLFLHMHYPRHHHQYHHIHNNLFATQSMTNATTATTTTTTATIAPSSFYSSYNNINNSLLNNQFLPPEYGLLQDIVPSMLHNKSHHNQN

SEQ ID NO: 218620 - protein, 121 aa, Glycine max
  Coding DNA Sequence Number=SeqID_101842
  Subcellular localization annotation: CTP_CleavageSite=64; ConfidenceScore=5.59e-01
MAKPSSPANLASAIICFFASKKFSHRLKASPGRFARQNPSPHPFRHGPCSWIFQSGVVLAEVLLADSRFTRPDMGFHPTKLNFVPSDADEAPLDVSICLHAFGIVGCGSFSGVKSCEREGA

SEQ ID NO: 218621 - protein, 165 aa, Glycine max
  Coding DNA Sequence Number=SeqID_101843
MAKFDPDIVLEFYANAWPTEEDMRSWVRGQWIPFDADTLSLFLGDPLVLEEGQECEFSQIRNRADEFDEEAIAQLLCIPGQDFARTAAGRRVRILWHGAGFTPFACPTPDQFRAEVAWPGDWPEAQAGEAPVEAPSDAEKARMDEEMTNLLGFLGGSGATSPRDP

SEQ ID NO: 218622 - protein, 330 aa, Glycine max
  Coding DNA Sequence Number=SeqID_101844
  Gene Ontology: Mol. function=binding; Cellular component=membrane; Biological process=multicellular organismal development
  Homolog annotation: Hit_ID=Q62FZ1; Match level="QueryCoverage=79%, HitCoverage=32%, E-value=6e-54, Identity=44%"; Hit description=TPR domain protein
  Pfam annotation: Domain name=TPR_1; Domain location=131-164; Score =37.0; E_value=6.6e-08; Accession=PF00515.18; Description =Tetratricopeptide repeat
  Pfam annotation: Domain name=TPR_1; Domain location=97-130; Score =18.7; E_value=0.021; Accession=PF00515.18; Description =Tetratricopeptide repeat
  Pfam annotation: Domain name=TPR_2; Domain location=131-164; Score =33.0; E_value=1.1e-06; Accession=PF07719.7; Description =Tetratricopeptide repeat
  Pfam annotation: Domain name=TPR_2; Domain location=97-130; Score =23.8; E_value=0.0006; Accession=PF07719.7; Description =Tetratricopeptide repeat
  Pfam module annotation: Pfam domain module=TPR_1::TPR_1::TPR_2::TPR _2; Domain location=131-164::97-130::131-164::97-130
MRQGQHLQALHTLQQEWQMTIPAVMPDTQPSAQQQEALLALFRQQQYTQMEQDLQAFLHQYPAWLGGWKMLSDVLMIQKKDARESAAQALLLNVDDAEEHCYYGLALKAQNDLVAAAEAFKHAIQLKPAYAAAYNNLGIVLKDIGQVEEAIQQFKQALILRPEYAEGFSNLLFCMTHAEQVDNEALLQAHIAYADLYEAPLMAHWQPHANTRDAKRPLRIGFVSADLRAHSVAHFLLPLLPGLAKDASLELFAYANYALEDEVSAEMRQYFRQWRMVSHISDDDLAACIRHDQIDILVDLSGHTAGNRLLTFARKPAPLQASWLGYLNTT

SEQ ID NO: 218623 - protein, 200 aa, Glycine max
  Coding DNA Sequence Number=SeqID_101845
  Gene Ontology: Mol. function=oxygen transporter activity; Cellular component=flagellin-based flagellum; Biological process=flagellum organization and biogenesis
  Homolog annotation: Hit_ID=Q1GZT6; Match level="QueryCoverage=100%, HitCoverage=29%, E-value=2e-42, Identity=47%"; Hit description =Flagellar hook-associated 2-like protein
  Pfam annotation: Domain name=Flagellin_IN; Domain location=143-197; Score=34.5; E_value=3.8e-07; Accession=PF07196.3; Description =Flagellin hook IN motif
  Pfam annotation: Domain name=FliD_N; Domain location=10-108; Score =101.1; E_value=3.2e-27; Accession=PF02465.8; Description=Flagellar hook-associated protein 2 C-
  Pfam module annotation: Pfam domain module=Flagellin_IN::FliD_N; Domain location=143-197::10-108
MASIVSSTGASGLPIDSLVTAQMQLEQQPLTDIQTKISSYNTKLSAYSTLKSGLSTFQTAVTKLATAAQFNAQSVTASDATSISATANGTAVVGNYSVSVSQLATAQKLATSAFSSATDTVGTGKITISFGTYTAAAGSDPASFTANSDKSDITIDITSSNNTLAGIRDAINAKNASVSASIVNDGSGNRLVITSKDTGE

SEQ ID NO: 218624 - protein, 59 aa, Glycine max
  Coding DNA Sequence Number=SeqID_101846
MAGRKFGGEGFREREELQVQGGVVIDYTKMVIDYQRATLPEITACNRLHYYGNRLPVVF

SEQ ID NO: 218625 - protein, 134 aa, Glycine max
  Coding DNA Sequence Number=SeqID_101847
  Gene Ontology: Mol. function=glucan 1,4-alpha-glucosidase activity; Cellular component=integral to membrane; Biological process =polysaccharide metabolic process
  Homolog annotation: Hit_ID=Q4K985; Match level="QueryCoverage=99%, HitCoverage=22%, E-value=8e-51, Identity=71%"; Hit description =Glycosyl hydrolase, family 15
MLLMPLVRFVSSTDPEWIATLDAIKTHLVSDGLVRRYNISETPADALTGGEGAFAACSFWYVECLARAGRVHEAHFEFEKLLSYANPLGLYAEEFTAHGNALGNMPQALTHLALISAAFFLNRKLSGEVTLWQP

SEQ ID NO: 218626 - protein, 161 aa, Glycine max
  Coding DNA Sequence Number=SeqID_101848
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q9T3G4; Match level="QueryCoverage=97%, HitCoverage=33%, E-value=5e-46, Identity=75%"; Hit description =NAD(P)H-quinone oxidoreductase chain 2, chloroplast (EC 1.6.5.-) (NAD(P)H dehydrogenase, chain 2)
  Pfam annotation: Domain name=Oxidored_q1; Domain location=1-114; Score=-71.0; E_value=0.00069; Accession=PF00361.10; Description=NADH- Ubiquinoneplastoquinone (comple
MILGNLIAITQTSMKRMLAYSSIGQIGYVIIGIIVGDSNGGYASMITYMLFYISMNLGTFACIVSFGLRTGTDNIRDYAGLYTKDPYLALSLALCLLSLGGLPPLSGRLIFLSFNRTPYECCFYLLLFKNNQVINDWTKPRITPHVRIIEAPFKIKQFTSN

SEQ ID NO: 218627 - protein, 45 aa, Glycine max
  Coding DNA Sequence Number=SeqID_101849
MSRNFTDCLTMGVKFLEAVKRRLHIIKQWSPDEIRVLFKFSIWDP

SEQ ID NO: 218628 - protein, 70 aa, Glycine max
  Coding DNA Sequence Number=SeqID_101850
MVRTCSNRKERRVFGKGFPGSRKYLRSTRLGQERGLRIIGRFELANGRVEVIKLAYGRVETLGIRVVFDR

SEQ ID NO: 218629 - protein, 49 aa, Glycine max
  Coding DNA Sequence Number=SeqID_101851
MGGTNQLCQLRFGKNILQRMGRENSEGDSQFTGCKLGIGATSPSSTLLG

SEQ ID NO: 218630 - protein, 225 aa, Glycine max
  Coding DNA Sequence Number=SeqID_101852
  Gene Ontology: Mol. function=DNA binding
ALNFAPNHNPHIPQRLKTLMLWQKWEKLDHLEERLKAIEGGEDYAFANLEELFLIPNIITPPKFKVSDFDTYKGTTCPMNHLKMYCRKMGAYTKDEELLIHFFQESLTGVAVTWYTNLEPSRVHSWKDLMVAFIRQCQYNFDMAPDKMQLQNMCKKGHESFKEYAQRWRDLAAQVVPSMTEEEMITMIVDILPVFYYEKWWVTHLQAFRIWSLLNDRSGSEKRQI

SEQ ID NO: 218631 - protein, 74 aa, Glycine max
  Coding DNA Sequence Number=SeqID_101853
MEWKRYFSKLEVEHFQWACPWYHSQDMVFSCGNFPNVSLMRPRGCVAYTPTVAFRQLKWTQGDSHKQQEEVKMA

SEQ ID NO: 218632 - protein, 289 aa, Glycine max
  Coding DNA Sequence Number=SeqID_101854
  Gene Ontology: Mol. function=RNA-directed DNA polymerase activity; Cellular component=intracellular; Biological process=RNA-dependent DNA replication
MSYTELLPHLIQNGMVLPISMNPVGSPYPRGYDANAKMVEFQPNVGNNPLLGHGGWFVNAIEFVEQTMKLRGSSNGDVGCGLHPIAGHAIGESVDFKQILQDLMYKKLVQGVNSPTLSAPGVGSMTQSGRIYTPGKLMVEQKRDEEKGKERVNPEVVWKYGAEEKKRLIPKKQEEIRKEVSDEEANEFLKFIRQSEYAVIDQQNRTPAKISLLSLILNSELHRKMLFKVLNKAHVIHYISKEKFEGIVGNITTSNHLTFTNDEMHVEGAGHNKALHISVKCRDHIWEKC

SEQ ID NO: 218633 - protein, 179 aa, Glycine max
  Coding DNA Sequence Number=SeqID_101855
MDYHLQRGIEHQVDVLLPGASLPNRPTYKSNPQETQYKDAQAKVEYVKRLHDQVKAQIAKKNESYAKQANKNKKKVVHEPGDGSEHLRVNAFQEGGNDENPKTAQIPGPMTKRFANQQILFSKNNYQFFINNKFDLLVKGRRHNPCIMNPWSSKKAAISWYNVHYLKYYLKGNRIDLDR

SEQ ID NO: 218634 - protein, 83 aa, Glycine max
  Coding DNA Sequence Number=SeqID_101856
MAGEIASEVSGLRMQMPVKFRALILIVDDAQDADVGEVSGFDTDCRLCILVVTLSAGEVSVLISGFDVDYQAMMMSTGDVFGL

SEQ ID NO: 218635 - protein, 608 aa, Glycine max
  Coding DNA Sequence Number=SeqID_101857
  Gene Ontology: Mol. function=RNA-directed DNA polymerase activity; Cellular component=intracellular; Biological process=RNA-dependent DNA replication
  Homolog annotation: Hit_ID=Q1SYR3; Match level="QueryCoverage=82%, HitCoverage=34%, E-value=1e-102, Identity=40%"; Hit description =RNase H, putative
  Pfam annotation: Domain name=RnaseH; Domain location=390-518; Score= -19.6; E_value=0.0038; Accession=PF00075.14; Description=RNase H
GLEIANVTYVKEGKTISKFQPSSPSMMVAKVKLENGYHYERGLGRNAQGLGRLPDQIENKDCFRLGYKPSKKDKRRIAHEKKDKRISTDNASIAPHSFEYLENQVDEEIEDDLEPSLELLRLVEQEAKEIRSHEEMTEVINLGIEEEKKEVKIDKLMKGNMPGLDARIMEHKLPLKSECPPVKQKLRWMKPELSLKIREEVMSFWLKNVGATYQRVMMILFHDMMHEEIEVYVDGMVAKSKNEEDHSGKLLEFVVSQRGIEVDPHKLTTTFEPIFKLLCKNQPLEWNTDCQEAFEKIKQYLQNPPILVPLVPKRPLIMYLTVLDGSMDCVLGQHDEFGSKECVIYYLNKKFIGRIARWKVLLLEYEIVYVTQKAVKDIMVVLQEEETPKEGKWIMLFDGASNVLGHEIGAILISPEKQYIPIITSLCFEYTSNVAKYEVCTLGLQATVESKVKKLKVYGDSTLVINQLNGEWETQDAKLIPYQTYIKELMKQFEEISFDHIIQENNQLVDALATLSFMFALSEDEDMPHTKIQCCGKPAYCHLVEEELDGKPWYYDIKKYIKSREYSPSDLENDKRTLRSAKEYQRSSQRLLWYPLKWASHGKKDLES

SEQ ID NO: 218636 - protein, 125 aa, Glycine max
  Coding DNA Sequence Number=SeqID_101858
  Subcellular localization annotation: CTP_CleavageSite=73; ConfidenceScore=5.05e-01
MANPNCQGFHHRGPSGYNQGGNFSQGQGWRSHHGNNFNKDQGGPSIRPSNQGPNMYERTTKLEDTLTQFMQVSLSNHKSTEFAIKNLEVQVDQLAKQLVSNEERETKKREEGDEEKEESKEMGGK

SEQ ID NO: 218637 - protein, 116 aa, Glycine max
  Coding DNA Sequence Number=SeqID_101859
  Gene Ontology: Mol. function=two-component response regulator activity; Cellular component=intracellular; Biological process=two -component signal transduction system (phosphorelay)
  Homolog annotation: Hit_ID=Q5YL08; Match level="QueryCoverage=99%, HitCoverage=55%, E-value=5e-13, Identity=33%"; Hit description =Probable two-component response regulator
  Pfam annotation: Domain name=Response_reg; Domain location=2-115; Score=111.4; E_value=2.7e-30; Accession=PF00072.14; Description =Response regulator receiver domain
MANFVIVDDHPIVRVAIRLVLENAGHRVSAEAGDGDNIISLVKEQSADAAIIDIDLPGIGGIEAVKNLRTVGSLIPVIVMSGKNAEFYAYESKKAGANGFISKKNNLNDLAHAVDA

SEQ ID NO: 218638 - protein, 81 aa, Glycine max
  Coding DNA Sequence Number=SeqID_101860
MTTEGGKVSKPVVLSLQRNLMVFICLAIGFETGLKEVKTCLNVRIQPNPVALIILRHQVKEKIPIASPPFKPLGRIRPGST

SEQ ID NO: 218639 - protein, 52 aa, Glycine max
  Coding DNA Sequence Number=SeqID_101861
MAGRLGFSVRAQPRVRSNRHWHVVLQPVSVVIWPRLISFSRHCAISFTNACR

SEQ ID NO: 218640 - protein, 112 aa, Glycine max
  Coding DNA Sequence Number=SeqID_101862
MVMGGEGGVSRVVWRSFERERCENCVFHPEEHIYNLLISLSELVSLSENPLLTLSVTFALSANPSQHASHVERVAKNYYFLNLNGQNVKKWVMNLLTKFEGDPTVNEFGITV

SEQ ID NO: 218641 - protein, 326 aa, Glycine max
  Coding DNA Sequence Number=SeqID_101863
  Gene Ontology: Mol. function=oxidoreductase activity; Cellular component=mitochondrion; Biological process=metabolic process
  Homolog annotation: Hit_ID=P50165; Match level="QueryCoverage=96%, HitCoverage=95%, E-value=1e-68, Identity=45%"; Hit description =Tropinone reductase homolog
  Pfam annotation: Domain name=adh_short; Domain location=19-188; Score= 59.3; E_value=1.3e-14; Accession=PF00106.15; Description=short chain dehydrogenase
MAKTKLSCIKDERWSLHGMTALVTGATRGIGHAIAEELAEFGAVVHICARKQQDIDRCLEEWSKKEFRITGSACDVLYRDQRENLMKNVASIFHGKLNILINNTGTNTPKNLIDYTAEDVTTIMGTNFESSYHLCQLAHPLLKASGYGSIVFISSIAGLKALPLCSIYGPSKGMFFLCLTRTPRDKFGVAKEHNQSAYKFYSGAMNQLTKNIALEWAKDNIRANTVAPGPVKTLLLDSFVVASTSKHCFKINSTSSFASKQSISKTSKVVKSGNEADKAIEAIVSQAPAGRLGDPEDISAMVAFLCLPAASFITGQIINVDGGCTI

SEQ ID NO: 218642 - protein, 59 aa, Glycine max
  Coding DNA Sequence Number=SeqID_101864
ISDSVHLSSFGKRTREPRLARPQKGMLRQLATPLGTVFSPTGLSKKGALYPGSWESKEW

SEQ ID NO: 218643 - protein, 85 aa, Glycine max
  Coding DNA Sequence Number=SeqID_101865
MHKCDISRTYTHARKKMWHLVNKTKTASLLKQEHVQLGSKAKFFLTGYDQSPITKLGWLVNSGYFGKLIPGAPQPLARACTIMHQ

SEQ ID NO: 218644 - protein, 61 aa, Glycine max
  Coding DNA Sequence Number=SeqID_101866
MGNDKEKMKVHENENGSYLVSASTCWATHDRACSAVQPCTVTVKAPNTASHQSRVQCRTRC

SEQ ID NO: 218645 - protein, 182 aa, Glycine max
  Coding DNA Sequence Number=SeqID_101867
  Gene Ontology: Mol. function=oxidoreductase activity; Cellular component=mitochondrion; Biological process=metabolic process
  Homolog annotation: Hit_ID=P50165; Match level="QueryCoverage=97%, HitCoverage=77%, E-value=3e-48, Identity=49%"; Hit description =Tropinone reductase homolog
  Pfam annotation: Domain name=KR; Domain location=18-175; Score=-87.3; E_value=0.027; Accession=PF08659.1; Description=KR domain
  Pfam annotation: Domain name=adh_short; Domain location=18-158; Score= 68.3; E_value=2.4e-17; Accession=PF00106.15; Description=short chain dehydrogenase
  Pfam module annotation: Pfam domain module=KR::adh_short; Domain location=18-175::18-158
MAETKLSFKDKRWSLHGMTALVTGATRGIGHAIVEELAEFGAAVHICARNQDDIDKCLEEWKGKGLTVTGSVNNAATTITKKIIDYTAEDISTIMGTNFESVYHLTQLAHPLLKESGQGSIVSISSIAGLKALPVFSVYAASKGAMNQFTKNLALEWAKDNIRANAVAPGPVMTKLLDSIMD

SEQ ID NO: 218646 - protein, 137 aa, Glycine max
  Coding DNA Sequence Number=SeqID_101868
  Subcellular localization annotation: CTP_CleavageSite=87; ConfidenceScore=5.44e-01
MSLMLIVMLSPQVFKDGPSSSLCYCLPSPSLSPHFLPSSSSFRLHSIKAFYQNNPAFHTPSPPNPNLVHHCHCLLLHVLPPHNPSFFASHQNTWLADEKLLRHQIDTTTEEIVRLHGHIVELDDGGKTFLGTVMALI

SEQ ID NO: 218647 - protein, 109 aa, Glycine max
  Coding DNA Sequence Number=SeqID_101869
MLQSIHQRQIILLQSLYVVAPPGSIPLVEQFREMDESSKATILEPFVIEEEVEETQRTTDPSTPILEMPEDPTTLVLAMDTSPPATPVLHLTDEQDVQTLDTQDQSQEF

SEQ ID NO: 218648 - protein, 243 aa, Glycine max
  Coding DNA Sequence Number=SeqID_101870
  Gene Ontology: Mol. function=acyltransferase activity; Cellular component=integral to membrane
  Homolog annotation: Hit_ID=Q69X62; Match level="QueryCoverage=98%, HitCoverage=46%, E-value=2e-90, Identity=65%"; Hit description =Putative beta-ketoacyl-CoA synthase
  Pfam annotation: Domain name=ACP_syn_III_C; Domain location=126-210; Score=8.4; E_value=1.9e-06; Accession=PF08541.1; Description=3 -Oxoacyl-[acyl-carrier-protein (ACP)
  Pfam annotation: Domain name=Chal_sti_synt_C; Domain location=69-212; Score=17.0; E_value=6.7e-05; Accession=PF02797.6; Description =Chalcone and stilbene synthases, C-te
  Pfam annotation: Domain name=FAE1_CUT1_RppA; Domain location=1-112; Score=-16.0; E_value=3e-15; Accession=PF08392.2; Description =FAE1Type III polyketide synthase-lik
  Pfam module annotation: Pfam domain module=ACP_syn_III_C::Chal_sti _synt_C::FAE1_CUT1_RppA; Domain location=126-210::69-212::1-112
MYWGNNPSMLLVNCLFRMGGSAALLSSHHSDRHRSKYELFHTLRTHVGANDNSYKCVFQEEDEEKKVGVSLSKELMNVARDALKVHITSLGPVVLPISEKLKFLVNLIERKVLKTKIESYMPNFKLAFKHFCIHTGGRAVLDRMQKSLELEDWHMEPSRMTLYRFGNTSSSSVWYELAYCEAKGRIKKGDRVWQMAFGSGFKCNTAVWVALNTIEPGSVKSPWRDEIHSFPIKIDPLPVKNNK

SEQ ID NO: 218649 - protein, 226 aa, Glycine max
  Coding DNA Sequence Number=SeqID_101871
MTLLLLTVSWSGTMFTHTKDIPFATCMLWALYATALVVRDMENVSGRAIVLLGFAVGGALGLRVGGAFAVIYLILLVIGRVLLDHHQEHTPILSRLLRMVVVLLPAAVLAFVFMAMCWPWSVIEVDNLLEAAKSFSHFDFNMQTIANGVVYNISEVPRSYLFQYLAVKLPESALLGLFALPVLYLCCRQALCIADRPTRMVMYTLLVGTLFPLVFVMDDRPALYNG

SEQ ID NO: 218650 - protein, 224 aa, Glycine max
  Coding DNA Sequence Number=SeqID_101872
  Gene Ontology: Mol. function=chitin binding; Cellular component =extracellular region; Biological process=chitin metabolic process
  Homolog annotation: Hit_ID=UPI000044A8F0; Match level="QueryCoverage =79%, HitCoverage=99%, E-value=9e-27, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGNVHEPQVNIGADQNTLVFRGLHVLANRGLHALTLIGLCVLTFRGLHVLTFRGLHALAIRGLCVLTFRGLHALAIRGLHVLTFRGLHALAIRGLHVLTFVGLHALTFRGLHVLANRGLHALTLRGLHVLANVGLHALTFRGLHVLAFRGLHVLTIRGLHALTSRGLHVLALRGLHVLTIRGLHALTSRGLHVLALRGLLALALGTSYPHLERTKRPRLERTT

SEQ ID NO: 218651 - protein, 103 aa, Glycine max
  Coding DNA Sequence Number=SeqID_101873
MGYFIFLPHGLRDMSRISLGLLALNGYGCRAVYILIGSVCNIGRCMVGSQAIWWEGMLVLNLRKMGATRTSQFFASLPYHIQDGVIYLVEARWGSRVHLSNGT

SEQ ID NO: 218652 - protein, 189 aa, Glycine max
  Coding DNA Sequence Number=SeqID_101874
  Homolog annotation: Hit_ID=Q47522; Match level="QueryCoverage=27%, HitCoverage=64%, E-value=6e-24, Identity=100%"; Hit description=LacZ protein
MDPDVNRYILLNEAKGLVPGYPDSMRKILGTNIAEVHGAIHKRIRGSLLSLIGPIAVKDRLLPEVDEFMSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 218653 - protein, 122 aa, Glycine max
  Coding DNA Sequence Number=SeqID_101875
  Subcellular localization annotation: CTP_CleavageSite=67; ConfidenceScore=5.25e-01
MSQSLAFSKGWTLGYTPSPSEGCTFSPSVDPKKSNRVLKLPALITGLCQFYGVPVAPNKVIRPPTNRAFIKKYCAPRQAKGETPQQPGDGQQQATNAPPPPPEPLSSSTKRLEYCLRHMADK

SEQ ID NO: 218654 - protein, 73 aa, Glycine max
  Coding DNA Sequence Number=SeqID_101876
MSSDGIGEKILDSGHHHEHSSKKALLCFFGEHNQGKLVLDIIVRISFIALTSYLGEKDLQVVVIGDDQSDYTQ

SEQ ID NO: 218655 - protein, 146 aa, Glycine max
  Coding DNA Sequence Number=SeqID_101877
DRTTQPIPEEPQSSESSSIFLEPREPELGASMAYIMAGDQPRRVTLEDYSSSSVPQFFAIKIAGVPEDAVRLSLLSFSLPGEAKRWLHSFKGNSLTTWDEVSKQLLDASVGGKIKLKTPKEAMELIENMAASDHAILRDRTHIPRK

SEQ ID NO: 218656 - protein, 85 aa, Glycine max
  Coding DNA Sequence Number=SeqID_101878
MEGLLMRLRRQPLWTWCSPVWLNMVALILITVPSNSCLFWLNMCGDVAVEILFSGRKTMKGIPAAAKYPENATEVAVVVVEDAVS

SEQ ID NO: 218657 - protein, 94 aa, Glycine max
  Coding DNA Sequence Number=SeqID_101879
  Subcellular localization annotation: CTP_CleavageSite=41; ConfidenceScore=5.35e-01
MRLASSNLSTSFRTSSFITGFNLLCGCLTGLVVTWVLVKKRLSHEVQKVTVELSSSVGLSAHPLLSAASVCLVRQKNLAEHQYQGCAVSARSVR

SEQ ID NO: 218658 - protein, 180 aa, Glycine max
  Coding DNA Sequence Number=SeqID_101880
MEAREPKGLMVKYERLYNICFACGHLDHLLKELVPPTMGLLGGRGETKGHGDPKLIPTPNLPDLVTPNAKRDHTSYSQGEDKGEKERIRWERLAQEAKINEGISIHLNHSLKKLMHELSAHVVFRLVGSNKAPKLELLRAWKPSCSKSFEEAHQLRSYRSSVLDGNQKEIYGVKDFSQNC

SEQ ID NO: 218659 - protein, 144 aa, Glycine max
  Coding DNA Sequence Number=SeqID_101881
  Gene Ontology: Mol. function=DNA binding; Cellular component=nucleus; Biological process=regulation of transcription
  Homolog annotation: Hit_ID=Q1S0M2; Match level="QueryCoverage=95%, HitCoverage=54%, E-value=2e-46, Identity=63%"; Hit description =Homeodomain-related
  Pfam annotation: Domain name=Myb_DNA-binding; Domain location=15-62; Score=47.9; E_value=3.4e-11; Accession=PF00249.21; Description=Myb -like DNA-binding domain
  Pfam annotation: Domain name=Myb_DNA-binding; Domain location=68-113; Score=42.6; E_value=1.3e-09; Accession=PF00249.21; Description=Myb -like DNA-binding domain
  Pfam module annotation: Pfam domain module=Myb_DNA-binding::Myb_DNA -binding; Domain location=15-62::68-113
MVKTPYCDKKSGLKKGTWTPEEDWKLIAHVNAHGHKNWRQLPKLAGLARCGKSCRLRWVNYLRPGIKRGNYTHEEEETIIKLRTSLGNRWSVIASHLPGRSDNEIKNHWHAHLKKRFQHDEASTPKLHLSTVESIQENKLLSGS

SEQ ID NO: 218660 - protein, 150 aa, Glycine max
  Coding DNA Sequence Number=SeqID_101882
  Homolog annotation: Hit_ID=Q1T1F7; Match level="QueryCoverage=86%, HitCoverage=27%, E-value=1e-13, Identity=35%"; Hit description=IMP dehydrogenase/GMP reductase
MKGITGAPYRARCDALTVMDVSWLPYTEHRGVRAFELISSFQGQLRWGPMVVTARPERVVRQFGYIQSIPPPPVSARLSYDDIDDRWMHFEEHVLPMGELCLVPGQVSADYIEWFFRISHPFMIPTQAGDQPRDAPAADPEEYIQLPNPQ

SEQ ID NO: 218661 - protein, 173 aa, Glycine max
  Coding DNA Sequence Number=SeqID_101883
  Homolog annotation: Hit_ID=Q1SKD7; Match level="QueryCoverage=90%, HitCoverage=41%, E-value=1e-14, Identity=31%"; Hit description =Ankyrin
MAPRKLASKRSRKDKAAEGTGSAPEYDSHRFRSAVHQQRFEAIKGWSFLRERRVQLRDDEYTDFQEEIGRRRWAPLVTPMAKFDPEIVLEFYANAWPTEEGVRDMRSWVRGQWIPFDADAISQLLGYPMVLEEGQECEYGQRRNRSDGFDEEAIAQLLYMDDVAPQQHPAHRS

SEQ ID NO: 218662 - protein, 63 aa, Glycine max
  Coding DNA Sequence Number=SeqID_101884
  Subcellular localization annotation: CTP_CleavageSite=52; ConfidenceScore=5.07e-01
MVISRVFLPWKMHREPRAALLLKALSPHRRKSIRSAMSLRALPAPQKRANPRAMLLQPQTAME

SEQ ID NO: 218663 - protein, 48 aa, Glycine max
  Coding DNA Sequence Number=SeqID_101885
MRLPVARQGYLMSQGYSNACDRHEPHRDSKPDNNPKDKVILQLIHAFL

SEQ ID NO: 218664 - protein, 71 aa, Glycine max
  Coding DNA Sequence Number=SeqID_101886
MGVKHFEAVKRRSHANKQWSPDEIRNRTTNIIPIPSTHLPWSTNGADNHKMTKGAEDDVSLCASTGSFAPG

SEQ ID NO: 218665 - protein, 128 aa, Glycine max
  Coding DNA Sequence Number=SeqID_101887
  Gene Ontology: Mol. function=nucleic acid binding; Biological process= DNA integration
MEMARSMLKEKGLPNKFWTGAVYTVVNILNKCPTKTLATRGIFLGYNTQSKGYRVYNLQTKKLTVSQDVEVQEVANEASMLMSPLQQQDSSPESTPSRVRSLVDIYDSCNTTMVDLNAMKNPQRSKGN

SEQ ID NO: 218666 - protein, 67 aa, Glycine max
  Coding DNA Sequence Number=SeqID_101888
MDSTNTKDAWSTLQEEFQGNDKIPVIRQVKTGTWIAVEAITWLMIEASSRKLTTLSKSKFDWEIAPW

SEQ ID NO: 218667 - protein, 186 aa, Glycine max
  Coding DNA Sequence Number=SeqID_101889
  Gene Ontology: Mol. function=RNA-directed DNA polymerase activity; Biological process=RNA-dependent DNA replication
  Homolog annotation: Hit_ID=Q2HW78; Match level="QueryCoverage=65%, HitCoverage=22%, E-value=9e-15, Identity=40%"; Hit description=RNA -directed DNA polymerase
MAGKNERERLLTEAPNNLVQVMANQGDDGEVVACHGLDHLRRNDTPTFKGGYDLKGAKAWLREIKKIFRMKQSTGGRTHAHVWREQTFLEKYFPEHVKNMKEMEFLELKYMTVAKYAARFENLVRNANADHRKEKKPMTHNRAKSYYAPPGQYGNHFGGKRMDGFQPTSRGFQLAGGSSQPTNTVS

SEQ ID NO: 218668 - protein, 56 aa, Glycine max
  Coding DNA Sequence Number=SeqID_101890
MTTILAANVVAIDDGNGGDGDNHGGGSDDNKGHDNKGGGGGAVGRVVVAIIMMVMG

SEQ ID NO: 218669 - protein, 118 aa, Glycine max
  Coding DNA Sequence Number=SeqID_101891
MMKELPNVGNDLKQGSLKLLLPLCVNSFASFFQENALSERNNENGFVLTLKLGFDDLFIQHKFVDSASQAPLELVGLGSSSSMNSFASWKMNGSGMEKEEREEMPLQGEDEYRRSSPP

SEQ ID NO: 218670 - protein, 225 aa, Glycine max
  Coding DNA Sequence Number=SeqID_101892
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=83%, HitCoverage=57%, E-value=7e-35, Identity=43%"; Hit description =Similarity to MADS-box DNA-binding protein
  Pfam annotation: Domain name=SRF-TF; Domain location=9-60; Score =37.0; E_value=6.4e-08; Accession=PF00319.9; Description=SRF-type transcription factor (DNA-binding and dimerisation domain)
MARKKVNLTYISNPVKRKAVFNQRKNGLLKKVDEITTLCDIHACAIIYTPDKPEPEVWPSDQGVEDVIFRFRGVSELARSKRMFCQEKFLKRNIIKARGQLKKLRNENRKKEIGLFMCQYFLGGNHLDNANIIDLNDIRFLVDKKLEEITKKIEMLHVQEVTSATENRGETMIEEKQALMTNVDAMPNLNWSNDNINASGGDSMLTLEDINVQSGWLNQFILSKR

SEQ ID NO: 218671 - protein, 139 aa, Glycine max
  Coding DNA Sequence Number=SeqID_101893
MYHQREKTLDELSVSLSKSETKHDHRFASTSYLPMDPSIGPLITHCVCQSLSNIPSGVTICRNLPFGGRATRDSWVCLPSEKNAGVSTNVYLRKMLEKPKAGLRILRTKVRELFMHGEGISTPYVCHKGWHPLIKCVKS

SEQ ID NO: 218672 - protein, 74 aa, Glycine max
  Coding DNA Sequence Number=SeqID_101894
MANDGTYKFGDPTVMWLRMPPNSWVMVTKGGVVDKSRAFAPTYPQFVMRNSDLQETLGPTKIGENHSKCINLTQ

SEQ ID NO: 218673 - protein, 89 aa, Glycine max
  Coding DNA Sequence Number=SeqID_101895
LRFGGESAGLLADPAVCGVLPDYLPAQVEHEHSLAGGRRGAHCRPESAPAEDPIADRRLSAGFRLGEFGRRGGVGWLGDPPFGAKRAGI

SEQ ID NO: 218674 - protein, 129 aa, Glycine max
  Coding DNA Sequence Number=SeqID_101896
  Gene Ontology: Mol. function=nucleoside-triphosphatase activity; Cellular component=membrane; Biological process=cobalt ion transport
  Homolog annotation: Hit_ID=Q46F51; Match level="QueryCoverage=100%, HitCoverage=53%, E-value=7e-22, Identity=42%"; Hit description=Iron compounds ABC transporter, ATP-binding protein
FTAADLVDIFLRQRRDLQRVQHRLRPGEILPPRPGEPSRMAGAAESDKIEYAIGKMWRLRLRHVGQARLSIIDAADLAPASAGSTQARNISQQRRFAGAVRAQHAEDLAALKLEADVVENGLPPLETKG

SEQ ID NO: 218675 - protein, 140 aa, Glycine max
  Coding DNA Sequence Number=SeqID_101897
  Homolog annotation: Hit_ID=UPI000044A741; Match level="QueryCoverage =52%, HitCoverage=18%, E-value=1e-09, Identity=53%"; Hit description =PREDICTED: similar to Ac1147, partial
MGGGAWPFLVGGAICLVNSVNERDLSLLNSYVEIIAIVGLQRGIPSKRESSARVDYVPALCTHRPSLLPIEWSGEVFGLRRREPAEGSLSMPHNQIDPRTCLFIYRREGGDDHGAPCARPPRPRDKHKPRRFVRQGTHIC

SEQ ID NO: 218676 - protein, 431 aa, Glycine max
  Coding DNA Sequence Number=SeqID_101898
  Gene Ontology: Mol. function=monooxygenase activity; Cellular component=intracellular
  Homolog annotation: Hit_ID=Q4IS94; Match level="QueryCoverage=96%, HitCoverage=90%, E-value=1e-160, Identity=64%"; Hit description =Monooxygenase, DszA family
  Pfam annotation: Domain name=Bac_luciferase; Domain location=25-373; Score=-113.9; E_value=0.095; Accession=PF00296.11; Description =Luciferase-like monooxygenase
MWTHPQDRSVEFNSLAYWLDLARLLERGLFDGLFIADILGVYDVYQQGIGLTARESIQLPVNDPLMLISGMASVTQHLGFGVTANLSYEAPYPFARRQSTLDHLTNGRIGWNIVTGYLDSAARAMGQQQLLAHDRRYDQADEFLDVTYQLWEGSWQDDALLADKQRRLYADAQKIHAINHQGEFYQVQGYHLSSPSPQRTPLLFQAGSSARGVAFAARHAECSFVNASSPAALREQAQRLRHAAVAAGRQADDLRIFMGVSVIVAASEREAQEKHRSYLEFASAEAGIAHFSSSIGVDLAAFGLDEPIHSGDTRAIESVSKAYNGWTRRQLLEQHALGSRYPVIVGNPSHVSDQLIRWIDEGDIDGFNLTRILNPQSYRDFIELVVPELQQRGRFKTAYQPGSLRQKIFQQQDRLPARHPAARWRPAADVR

SEQ ID NO: 218677 - protein, 319 aa, Glycine max
  Coding DNA Sequence Number=SeqID_101899
  Gene Ontology: Mol. function=transcription factor activity; Biological process=regulation of transcription, DNA-dependent
  Homolog annotation: Hit_ID=Q89QT6; Match level="QueryCoverage=48%, HitCoverage=84%, E-value=1e-25, Identity=40%"; Hit description=ECF family sigma factor
  Pfam annotation: Domain name=Sigma70_r2; Domain location=185-253; Score=56.7; E_value=7.7e-14; Accession=PF04542.4; Description=Sigma -70 region 2
GGQQRAGCCAGRLGSAGVCRLAVWHGAAAPLCRKRAQSAVQRHGDIADCGDRAAAGADQARRGAARRYADAGQQTDVDAAGGGRSTRAWQSDLCRFYRIMAVKTALAKTGTLYMVADSTKFNPDVDDVMSEFGQGGLPMYLVYPADGGPPKVLPQRMHTGDSARENWPGLMERAQAGDQCAYTRLLRALVPVIRAQVRRRLSDEALTEDVIQDVLLTLHRVRHTYDPAYPFLPWLTAIVSARAIDALRRRGRQQHCALDDAQAADPASTAEQQQLDTRQELAGYLSQLPLRQREIVEHVHLHEMSLNEAAAHHNLSVSA

SEQ ID NO: 218678 - protein, 81 aa, Glycine max
  Coding DNA Sequence Number=SeqID_101900
MYQSHTVRGEKVASAQDFVGNQRERPTLGRGFLFLVYLVYGKLGFWLKACRTAGHDTCQGLASGLGIKGMSHIIPMIHMQQ

SEQ ID NO: 218679 - protein, 495 aa, Glycine max
  Coding DNA Sequence Number=SeqID_101901
  Gene Ontology: Mol. function=nucleoside-triphosphatase activity; Cellular component=membrane; Biological process=defense response
  Homolog annotation: Hit_ID=Q1SI90; Match level="QueryCoverage=73%, HitCoverage=21%, E-value=1e-48, Identity=33%"; Hit description =Disease resistance protein; AAA ATPase
  Pfam annotation: Domain name=LRR_1; Domain location=343-366; Score =1.7; E_value=1.4e+02; Accession=PF00560.23; Description=Leucine Rich Repeat
  Pfam annotation: Domain name=LRR_1; Domain location=368-389; Score =9.2; E_value=5.3; Accession=PF00560.23; Description=Leucine Rich Repeat
  Pfam annotation: Domain name=LRR_1; Domain location=391-412; Score =2.1; E_value=1.1e+02; Accession=PF00560.23; Description=Leucine Rich Repeat
  Pfam annotation: Domain name=LRR_1; Domain location=414-435; Score =13.6; E_value=0.7; Accession=PF00560.23; Description=Leucine Rich Repeat
  Pfam annotation: Domain name=LRR_1; Domain location=437-460; Score =10.9; E_value=2.5; Accession=PF00560.23; Description=Leucine Rich Repeat
  Pfam annotation: Domain name=NB-ARC; Domain location=3-286; Score= -31.2; E_value=2.7e-08; Accession=PF00931.13; Description=NB-ARC domain
  Pfam module annotation: Pfam domain module=LRR_1::LRR_1::LRR_1::LRR _1::LRR_1::NB-ARC; Domain location=343-366::368-389::391-412::414 -435::437-460::3-286
MVIIANITRNPDIKKIQGQIAEMLGMRLEEETEIVRANRIRKRIKKEKENTLIILDDLWDGLDLNRLGIPSSDDDDDDDRSQTVVKDISDFGYNKMENQELFSVNFKMMKKDMLFADFNKMKKEKLSGDHKGCKILLTSRSKEVICNQMDVSETSTFLVGVIDEKEAETLLKKVAGIHVTNSMFDANAIEIAKMCAGLPIALVSIGRALKNKSYFVWEDVCRQIKRQSFIEAQESIEFSIKLSYDHLKNEELKRIFLQCARMGSDALIMDLVKFCIGLGLLQGVHTIRDARYRVNVLIEELKESSLLVENEWPHEDEYERYTAIFLHYCDINDELHESIYCPRLEVLHIDSKNEFLEIPDDFFKDMIRLRVLVLTGVNLSFLPSSIKCLKKLRMLCLERCTLGKNLSFIGELKKLRILSLSESNIESLPLEFGQLDKLQLFDLSNCSKLRVIPSNIISRMNILEEFYMRDSLVLWDSEQKIQSGNACLSELKHLN

SEQ ID NO: 218680 - protein, 107 aa, Glycine max
  Coding DNA Sequence Number=SeqID_101902
MSQVRFMLNFIPDLGKVHQARTYGNDMKPRHKVLEMLGATMINEYHETSGQEIMTPMLKRQSNGHNFLLIDGFGQGVTREGLVAIIKQLAGNLAPTPLQCHDLKHHT

SEQ ID NO: 218681 - protein, 80 aa, Glycine max
  Coding DNA Sequence Number=SeqID_101903
MGSSVENGCSSTRLKNKRLSSTTEKLGVGVGVELMEGVNRNLFLRHSVHMETVVLGKVRDAGSMDAIVSTATENALQIGG

SEQ ID NO: 218682 - protein, 223 aa, Glycine max
  Coding DNA Sequence Number=SeqID_101904
  Gene Ontology: Mol. function=chromatin binding; Cellular component =chromatin; Biological process=chromatin assembly or disassembly
MEYILRFDGCQCKKYQAMFPVGLLQPLPISELVWDNISIDFITGLPLSQGYDVILVVVNHLSKYAHFISLKHPYLARTMAESFIRDVAKLHRLPKFIISDRDPLFLSKLWSELFFFCKALCCARALLTILKPTVKWSYKLQLPNSANMHSAFPVSQLKCLVNSGFVVASLPPRLTINEPVTPTLEGILVTRVRKHQGKHVEEYLILWQSRQIEEATWEVAASS

SEQ ID NO: 218683 - protein, 85 aa, Glycine max
  Coding DNA Sequence Number=SeqID_101905
  Gene Ontology: Mol. function=RNA-directed DNA polymerase activity; Biological process=RNA-dependent DNA replication
  Homolog annotation: Hit_ID=Q94HV4; Match level="QueryCoverage=98%, HitCoverage=7%, E-value=7e-12, Identity=51%"; Hit description =Putative retroelement
MVNFKKFSFGLSSIDYQGHIISSLGIEMDPSKVKVVLEWPTPLNAKDVFPNPASQEGRFSLGSGSKVCIYHTQTMFGYFPSIGPS

SEQ ID NO: 218684 - protein, 158 aa, Glycine max
  Coding DNA Sequence Number=SeqID_101906
MLQKQLDSIIVGGLKLYVNLPRYERLRGGQLKPGGRRQEQWHGKRPINLNLMHRGDTTKKLSYAEAVTGRSNMDGSTAIHIKPTERTLKWLKDAWVGRLSNPTMFDKAEDELRWDYGLDTSITYLGDDMIIIIGMNDERADQLMKELNQRKPPLLYSL

SEQ ID NO: 218685 - protein, 43 aa, Glycine max
  Coding DNA Sequence Number=SeqID_101907
MGDVLEFDDEVEERRRMDRARVLLKTPWKPFIHHTVKVHVGSE

SEQ ID NO: 218686 - protein, 66 aa, Glycine max
  Coding DNA Sequence Number=SeqID_101908
MEGEGQNQEKDKGTDLGDRMQHAMRALVVDKIATTLEQVVDGVGGDGNDEVVVVGEDDEVAEGGKY

SEQ ID NO: 218687 - protein, 1060 aa, Glycine max
  Coding DNA Sequence Number=SeqID_101909
  Gene Ontology: Mol. function=RNA-directed DNA polymerase activity; Cellular component=chromatin; Biological process=chromatin assembly or disassembly
  Pfam annotation: Domain name=RVP_2; Domain location=160-281; Score= -44.9; E_value=0.0032; Accession=PF08284.2; Description=Retroviral aspartyl protease
  Pfam annotation: Domain name=rve; Domain location=733-875; Score =57.0; E_value=6.4e-14; Accession=PF00665.16; Description=Integrase core domain
  Pfam annotation: Domain name=zf-H2C2; Domain location=674-715; Score =11.2; E_value=0.012; Accession=PF09337.1; Description=His(2)-Cys(2) zinc finger
  Pfam module annotation: Pfam domain module=RVP_2::rve::zf-H2C2; Domain location=160-281::733-875::674-715
GFAVGMNAAIHINPYYGKTSLDVLVAHYNSVLSIGPIIIPSIRREVQVLQPTSLAQAVSYVRLQEEKILDAHRLSSYHTPTPTAGATTTRSSSSKPTPPLLPTPVHASTSIPFKRLTPEELAIRREKGLCFHCAEKFSRGHKCASSLFLLVMEEDESAMETEQRRTPSPTPELLQESPSAILIDGGSTHNFLHNLVVLNLGLKPTETTPLRVTVGNGDEIRYHQLCTAVKVHIQQHSFTIDFHVLPLCGANMVLGVQWLKTLGPVLTDYGALTMKFIANGKLIEFTFFHIRVESTSNNTPQPAHSSPEITTLIAKYASLFQPLGNLPPSRSTDHTINLLPNAAPVNVKPYRYPYFQKQEIKDQALNAIMVCDRFPIPTVDELLDELGGAQWFSKLDLMQGYHQILMNTTDISKTAFRTHQGHYETFQDHLLHLETTFQVLLAGQFSLKLSKCTFAQQQLEYLGHVVSGNSVEPVPEKVQAIQGYATLAAPLTKILCHAQFSWTNKADDAFQNLKNAVTTALVHELPDFNAPFVIEMDTSGTGMGAVLMQRGHPLTYFSKQFCPKLLNSSTYVRELAAIMATVKKSNMVANALSRAMEGQSASLYLLSMHRFVFLDDLRKELDSLSTFIDLSYRIQEDSAAYLDYTLTEGLILHRGRIWLPSNSSFIKLLLEEFHQSPTGGHIGIQKTLHRLQDNFTWASIREDTRNFIASCVTCQHTKYDNRKPVGLLYPLPIPVRPWEDLSMDFITGLPAYRGLHLGMLPTQHTAHTVALLFINMVGRLHGMPKSIVSDRDLLFINKFWRELFALSGTKLRLSSSYHLQSDGQTKVANRIVEQYLRAFVHEKPSTWGRYLLWVEWSYNTSCHSTTGMTPFEVTFGHKPLIFPQYITDTSNIEAEFKVGDLVMVKLKPHRQVSTTGATYSKLGKRYYGLFQITACMGKVAYKLQLPEHSRIHPVFHVSLLKPYIASDTAPVTVDLPPLTFNNHPIVTPLAIVASKLIPFEAGPKHMDKALLDGHGSVTKGTEGLQLTREVQEETRARPNRKKTMPAYLEDYERSHAEWGA

SEQ ID NO: 218688 - protein, 80 aa, Glycine max
  Coding DNA Sequence Number=SeqID_101910
  Subcellular localization annotation: CTP_CleavageSite=41; ConfidenceScore=5.61e-01
MCISSAIAIRKSSSVILMAPSTSSAPLSQLRGSTQVLPAVKSKMERTREGTSCKKLDTLSNFYKTTGTQAQFYRPKKGNG

SEQ ID NO: 218689 - protein, 181 aa, Glycine max
  Coding DNA Sequence Number=SeqID_101911
  Gene Ontology: Mol. function=hydrolase activity, hydrolyzing O -glycosyl compounds; Cellular component=cell wall; Biological process= carbohydrate metabolic process
  Homolog annotation: Hit_ID=Q9SLN9; Match level="QueryCoverage=59%, HitCoverage=35%, E-value=5e-28, Identity=54%"; Hit description=ETAG -A3
  Pfam annotation: Domain name=Glyco_hydro_16; Domain location=1-124; Score=-33.6; E_value=4.9e-05; Accession=PF00722.11; Description =Glycosyl hydrolases family 16
MAIQGLIIIKMSNGDMFQNNHDEIYFEFLGNIRGKDRRIQTNVYGNGSTSIGREERYGLWFDLVEDFHQYNILWTNSKIIYYHTLNHTGRISKILDTWLMQPQLLCLSIWTASELSLPIGEGVNSQQYFDIGGEKYTYLADNGQARHQGHTRTGRQTGARAVGPRTRTTEKVGHKLSTQGV

SEQ ID NO: 218690 - protein, 343 aa, Glycine max
  Coding DNA Sequence Number=SeqID_101912
  Gene Ontology: Mol. function=microtubule motor activity; Cellular component=microtubule associated complex; Biological process =microtubule-based movement
  Homolog annotation: Hit_ID=Q9FZ06; Match level="QueryCoverage=94%, HitCoverage=35%, E-value=1e-137, Identity=77%"; Hit description =Kinesin-like protein
  Pfam annotation: Domain name=Kinesin; Domain location=1-262; Score =256.8; E_value=4.3e-74; Accession=PF00225.13; Description=Kinesin motor domain
MAYGQTGTGKTFTLGQLGEEDTSDRGIMVRSMEDILADISPGTDSVTVSYLQLYMETLQDLLNPANDNIPIVEDPETGDVSLSGATLVEIKDQPSFLELLRVGETHRIAANTKLNTESSRSHAILTVHVKRSVVDSEDVVSTENNDASHLTKPSKPLVRKSKLVVVDLAGSERIHKSGSEGYMLEEAKSINLSLSALGKCINALAENNSHVPFRDSKLTRLLRDSFGGTARTSLIVTIGPSPRYRGETSSTILFGQRAMKVENMLKIKEEFDYKSLSRRLEVQLDNLIAENERQQKTFEEEVGRLNLEAQCRISEVERKFADALEVCYIFYRKVALFCANHCF

SEQ ID NO: 218691 - protein, 1133 aa, Glycine max
  Coding DNA Sequence Number=SeqID_101913
  Gene Ontology: Mol. function=translation elongation factor activity; Cellular component=intracellular; Biological process=translational elongation
  Homolog annotation: Hit_ID=Q2QP54; Match level="QueryCoverage=99%, HitCoverage=99%, E-value=0.0, Identity=53%"; Hit description =Elongation factor TS family protein, expressed
  Pfam annotation: Domain name=EF_TS; Domain location=741-882; Score =223.5; E_value=4.9e-64; Accession=PF00889.9; Description=Elongation factor TS
  Pfam annotation: Domain name=EF_TS; Domain location=982-1123; Score =221.7; E_value=1.7e-63; Accession=PF00889.9; Description=Elongation factor TS
  Pfam annotation: Domain name=S1; Domain location=140-213; Score =100.5; E_value=5.2e-27; Accession=PF00575.13; Description=S1 RNA binding domain
  Pfam annotation: Domain name=S1; Domain location=254-327; Score=27.6; E_value=4.4e-05; Accession=PF00575.13; Description=S1 RNA binding domain
  Pfam annotation: Domain name=UBA; Domain location=688-728; Score =56.3; E_value=9.8e-14; Accession=PF00627.21; Description=UBATS-N domain
  Pfam annotation: Domain name=UBA; Domain location=929-969; Score =59.9; E_value=8.4e-15; Accession=PF00627.21; Description=UBATS-N domain
  Pfam module annotation: Pfam domain module=EF_TS::EF_TS::S1::S1::UBA:: UBA; Domain location=741-882::982-1123::140-213::254-327::688 -728::929-969
  Subcellular localization annotation: CTP_CleavageSite=65; ConfidenceScore=5.78e-01
MNPVIPCSIGNVSIIPVFIYSTRKNNTLTRFNLSRSTVKPGSSSWRFLLPSFVASGAFPQNKGIRSFHKKSSTSISATETDVTVEEPSPVADEDSGEITSNEVGISEDSSSKSDANPDPAKGRRSRPARKSEMPPVKNEDLIPGATFTGKVKSVQPFGAFVDIGAFTDGLVHISMLSDSYVKDVTSVVSVGQEVKVKLIEVNTETQRISLSMRENADTGKQRKDAPVKTEKAGPGKRNSSKPSSKKDNVTKSTKFAIGQQLVGSVKNLARSGAFISLPEGEEGFLPVSEEPDDGFDNVMGNTTLEVGQEVNVRVLRITRGQVTLTMKKEEDTAGLDSTFNHGVVHVATNPFVLAFRKNKDIASFLDEREKTQNEVQKPTTASTSEEIKGTVNQGETVLDVPDVQGEPESSKLTDDDVPSAEDDISENVGTSATNGSSTAIVDDESNLVSNVSSPTTGIDSAIEKEEEVASGSLIPEEDLSTVNPIIEEVTQTDVTNDLKTDTPVEIANENVIETGVDQIVTEDEKQSQTPDAIEEFAAAVLTDSDVVEPSPDKNDTITESDITSSAPALQESADDDVGAITENIDSDTSLGGQSDELSPVGSLTTDATEETDQVPSPESSATEVVKPSVDDPEEEAQKLTPATENENSFTSQVEDKEVAIACEENNSLSNSDGQTGATSGEGLSKATISPALVKQLREETGAGMMDCKKALSETGGDIIKAQEYLRKKGLSSADKKASRVTAEGRIGSYIHDSRIGVLVEVNCETDFVSRGEIFKELVDDIAMQVAACPQVEYLVTEDVPEEIVNKEKEIEMQKEDLLSKPEQIRSKIVEGRIRKRLEELALLEQSYIKDDKVAVKDFIKQTIATIGENIKVKRFVRFNLGEGLEKKSQDFAAEVAAQTAAKPAPMPAKEQPAVPEAKETEPKQSTVAVSASLVKQLREETGAGMMDCKKALAETGGDLEKAQEYLRKKGLSTADKKSSRLAAEGRIGSYIHDSRIGVLIEVNCETDFVGRGEKFKELVDDLAMQVVACPQVQFVSIEDIPETIVNKEKELEMQREDLLSKPENIREKIVEGRILKRLGELALLEQPFIKDDSVLVKDLVKQTVAALGENIKVRRFVRFTLGETSEKETTVPA

SEQ ID NO: 218692 - protein, 182 aa, Glycine max
  Coding DNA Sequence Number=SeqID_101914
  Gene Ontology: Mol. function=methyltransferase activity; Cellular component=cytoplasm; Biological process=metabolic process
  Homolog annotation: Hit_ID=Q5WA78; Match level="QueryCoverage=88%, HitCoverage=63%, E-value=7e-44, Identity=53%"; Hit description =Putative early nodule-specific-like protein ENOD8
  Pfam annotation: Domain name=MTS; Domain location=70-182; Score= -79.2; E_value=0.0073; Accession=PF05175.4; Description =Methyltransferase small domain
  Pfam annotation: Domain name=Methyltransf_11; Domain location=80-168; Score=2.2; E_value=0.033; Accession=PF08241.2; Description =Methyltransferase domain
  Pfam module annotation: Pfam domain module=MTS::Methyltransf_11; Domain location=70-182::80-168
MKLKQLEGLLGGLQQFPQPKVELEQYPTGPHIASRMLFTVFPLSLYLPWIRERWGGYVSFAVHENQAENSFEDVSDKVVADFGCGCALIRHVLGIDIDPESLEIASNNAEELEVDIDFIQSNVMDLGWRGRIVDTVIMNPPFGTRKKGADLDFLSVALKVASQAVYSLHKTSTRDKIYLAIS

SEQ ID NO: 218693 - protein, 69 aa, Glycine max
  Coding DNA Sequence Number=SeqID_101915
MYDKRLDVHIKAAINSAMKKIFTTLEDKAEGPAPQWNEPKSHVQPGAYECGYYVMHWMWCIVSSGSKNE

SEQ ID NO: 218694 - protein, 59 aa, Glycine max
  Coding DNA Sequence Number=SeqID_101916
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=Q9SWS7; Match level="QueryCoverage=98%, HitCoverage=16%, E-value=1e-21, Identity=86%"; Hit description =Chloroplast SRP receptor homolog, alpha subunit CPFTSY
  Pfam annotation: Domain name=SRP54; Domain location=1-59; Score= -108.2; E_value=0.0023; Accession=PF00448.13; Description=SRP54-type protein, GTPase domain
MMVGVNGEGKTTSLGKLAYRLKNEGAKILMAAGDTFRAATSDQLEIWGERTVCEIVVAE

SEQ ID NO: 218695 - protein, 158 aa, Glycine max
  Coding DNA Sequence Number=SeqID_101917
  Homolog annotation: Hit_ID=Q45RR6; Match level="QueryCoverage=32%, HitCoverage=16%, E-value=1e-11, Identity=64%"; Hit description =Plastid division regulator MinD
MESHFIALKVGLALVVDEGLVEATVTVEDIDDGVVHVVLKFEDEVEVAKADGSHREAQAMGGLDFLGVRVFTVPVEERRMGTEEECGVGGGGGVGEKVERGKREEERRRKRKLSKYSVVEKSFFSSVAIALAHDQVLMRNNRGFLCMNKLDINPVVLA

SEQ ID NO: 218696 - protein, 441 aa, Glycine max
  Coding DNA Sequence Number=SeqID_101918
MPTDCKTHFIEHGVNPSCEVGLILYNFNSPLGLDYVQCFNWTKDVDQFLGFLAYLPFNGDNLNQHTIVKGLAEALVMFPKDDYFKCERHCILVATGEPVTRSMLVSLPVVKEGKFISGQFITLDATFLRVAKMFGPGNYLKEDTPITNYGNGQITVLLSRNFKEAHYAVLIPQETALEEDRLTRLLEQDHQIYLDEILEEMLRSSTSTTGEGSLPQNNSDSGRLEELNAWYSPGVGASSFVPTARVDVGASSGGIAGPSASTDAGVVAGAIASSSLYYGSHHQQFPKHHHFEMTEINPTAMGANTWASPALVMHEYNQAILWPKPPTDFIDYVQAWEGCLVGKIHSGTSLNQAKAFRRLTSSVILSHQWSNRLNIALFFSKTAVTYTMTINGGPIDYLFFQVTQFDNLELYEHLMSNDLLFHCHRIWYLFNVPISESKCKS

SEQ ID NO: 218697 - protein, 99 aa, Glycine max
  Coding DNA Sequence Number=SeqID_101919
  Homolog annotation: Hit_ID=Q69LJ8; Match level="QueryCoverage=36%, HitCoverage=19%, E-value=2e-08, Identity=75%"; Hit description =Putative ferredoxin
MRWNKQPHITHKHGLYGRRNMEENPGFGTSSQMSFCTLLIEATLCKIYVTYIDKDGEEKHIKVPVGMPMLEDAHENDIEVEDKSFGFRILLFHLKILVF

SEQ ID NO: 218698 - protein, 90 aa, Glycine max
  Coding DNA Sequence Number=SeqID_101920
  Gene Ontology: Biological process=regulation of signal transduction
  Homolog annotation: Hit_ID=Q8LDQ4; Match level="QueryCoverage=79%, HitCoverage=17%, E-value=1e-20, Identity=62%"; Hit description=PP2A regulatory subunit TAP46
MDDLPLSALFEQARKIHTTTTDSSTDQEVVKKGCEALHRCEDMVNNLGLFSPNETKEDINTTNLKYILQYYHAHMLFIFLKDFVVDLLME

SEQ ID NO: 218699 - protein, 47 aa, Glycine max
  Coding DNA Sequence Number=SeqID_101921
MATRKLLNIVVDGNSALGPYWPKIVSDYLEKIVSIIHHTHDLNYTCH

SEQ ID NO: 218700 - protein, 90 aa, Glycine max
  Coding DNA Sequence Number=SeqID_101922
MSRNFTDCLTMGVKFLEAVKRRLHAIKQWSPDEIRAINSWGFGLNGGGCMNSARQLIHGAPNKMMEDARTMLGNQFVGLRTQWWRMHEQR

SEQ ID NO: 218701 - protein, 63 aa, Glycine max
  Coding DNA Sequence Number=SeqID_101923
MLRNFTDCLTMGVKFLEAVKRRLHAIKQWSLDEIREVTSRKDQEQYWFPWDKPYRYVNSIGSS

SEQ ID NO: 218702 - protein, 207 aa, Glycine max
  Coding DNA Sequence Number=SeqID_101924
  Gene Ontology: Mol. function=sequence-specific DNA binding; Cellular component=nucleus; Biological process=regulation of transcription, DNA-dependent
  Homolog annotation: Hit_ID=O82632; Match level="QueryCoverage=59%, HitCoverage=41%, E-value=9e-23, Identity=45%"; Hit description=GATA transcription factor 11
  Pfam annotation: Domain name=GATA; Domain location=141-176; Score =59.5; E_value=1.1e-14; Accession=PF00320.17; Description=GATA zinc finger
MVIANYGFLEHPLCVPQDSLECLGMMNWEGMDSIDSMFSTPWESEKERLEQPEKDKTERKSFTDVSNNQANHMSLLTRLDDESNLAAEKSQTKILKTKNIAARSLSKCKIDFLNSTQSGRDAKIWEKRCGHKDARIWERRCSHCDAIKTPQWRTGPFGRNTLCNACGIRFKAGKLYPEYRPADSPTFDVSKHSNVHKEIMKMRNHLS

SEQ ID NO: 218703 - protein, 172 aa, Glycine max
  Coding DNA Sequence Number=SeqID_101925
  Pfam annotation: Domain name=Collagen; Domain location=111-169; Score= -47.3; E_value=0.092; Accession=PF01391.8; Description=Collagen triple helix repeat (20 copies)
MDERPNDQNVLFLVTHTNRKGCWVDDCARDTYEKYHEGLRSTQTQMVEATARLVEANQRYPLMEEQMRLMQQQLQMVLDNRTGGNSTGTSQRVPEGRVPPERDTWRDLTRRWDRGGSGGLPGATTSGGLPGATTSGGLPGATSSGGAPGATTNGSLPGASTSGGSQARPSSL

SEQ ID NO: 218704 - protein, 247 aa, Glycine max
  Coding DNA Sequence Number=SeqID_101926
MGRTLFGLSIPANSERSLSSMTRNMLEEKDRYPTVHKYCGFWTLELIDENRRGQCADQLCNKHTFFSYALRREWVVVRHNIVEGRHGKRDECTRNLIEPIPSGNLPPGFDPSTCRSVKFDREADEWIAREHAKEIANNKSMDIVGIRDTEIHNYQINLKGNGSSSITRLTPNTKMGQNSGMQKPEAFLLGSMENEMISDGVLAQDINQASSFWLLRELVFLPLLNSYFSFLKISKLDQVRLAIHLAF

SEQ ID NO: 218705 - protein, 188 aa, Glycine max
  Coding DNA Sequence Number=SeqID_101927
MAGVCNITDDIPLEMVKLVEGLSSDAAASVGACDIASASVGALVASVGYNASASAIAFTNFNASIDSCVAAGANASSNYWSTRSFIICFSGIPHHASSSSNSHLEFQRYPPYQMFGSMHKVYVQLCLNITVAAIIIRDFFGFAHHFSRIFHTSHLHGREVWLEELTCISNSLVKQRCDISWHCNNYEN

SEQ ID NO: 218706 - protein, 172 aa, Glycine max
  Coding DNA Sequence Number=SeqID_101928
MIFDVMRNGKGAGLESMGWYERWGGGDWVGLDSAPHGQRQGWAGMEHQRAIKSGGPKERTTLRGGLSTTVFGRVVGKSWEARGGGSSKSSLAMNKCLHLGGRPTPQVTSSEQVHVVLGKKVLALSKAKNNLVEVFDRGLSSVMLRHGSKPKGRVEFRHSPGGVLVVCAPSWV

SEQ ID NO: 218707 - protein, 106 aa, Glycine max
  Coding DNA Sequence Number=SeqID_101929
  Homolog annotation: Hit_ID=Q1SAV4; Match level="QueryCoverage=72%, HitCoverage=20%, E-value=5e-07, Identity=40%"; Hit description =Integrase, catalytic region
MYILKPYRGPYPSTLDPLPPLNVENHLVIEPFSILDWKWDTTGTPPVQKVLVHNPRPKGVHKLEDWVSLRTSYNLGDKVVLLEGGVDSNPRLKRVDKPPKHLEDYV

SEQ ID NO: 218708 - protein, 142 aa, Glycine max
  Coding DNA Sequence Number=SeqID_101930
  Homolog annotation: Hit_ID=Q1RWW7; Match level="QueryCoverage=44%, HitCoverage=8%, E-value=2e-13, Identity=67%"; Hit description =Transketolase, C-terminal-like
MALLGYGSVVQSCMVAASLLEDHGLHATVVNAALQVSGSFHNSKHWNIAGGFDHCGRKINRRIWPDDLNVATRLEASSSHNEEIQRWCMVLLAVVEQSKHHALSDSTSIENDVNGDGIMVNGGDGARVDGGGKVTSPFTLFT

SEQ ID NO: 218709 - protein, 222 aa, Glycine max
  Coding DNA Sequence Number=SeqID_101931
  Gene Ontology: Mol. function=protein serine/threonine kinase activity; Cellular component=chromosome, pericentric region; Biological process=protein amino acid phosphorylation
  Homolog annotation: Hit_ID=Q1S0R7; Match level="QueryCoverage=64%, HitCoverage=47%, E-value=3e-54, Identity=85%"; Hit description =Protein kinase
MAWFQGRLKIADFGWSVQSRSKRHTMCGTLDYLAPEMVENKAHDYAVDNWTLGTLCYEFLYGAPPFEAESQVDTFKRIMKVDISFPSTPYVSLEAKNLISRASSYPGKNRSFQRNKSAAGKRLFTKALTSEDNGASLDNQECKSYGCLQLLGATQSCSMWGLFRDEHGAALGSFANFLGNSNALEVEMLDAIITIEAASSRNWKFFVAEALVQAVHNHSLVP

SEQ ID NO: 218710 - protein, 86 aa, Glycine max
  Coding DNA Sequence Number=SeqID_101932
MMMMVMTTVTFVEISIMVVVAMVIIEVVVVAMLMVVVDETLLMVVVTKVGDQSGSLCFTRTLQPYGVNIGFKEHSNRVYLPPRPTL

SEQ ID NO: 218711 - protein, 177 aa, Glycine max
  Coding DNA Sequence Number=SeqID_101933
  Gene Ontology: Mol. function=RNA-directed DNA polymerase activity; Cellular component=chromatin; Biological process=chromatin assembly or disassembly
MAPKCTPFEKQSTSTMITENPWEYGRWVMKSSEMSSYILEGMGKGAALTNEKSNVAANMVPSEMGRNPMQHLSNAQMSTNGGGVKFHQQWAIGWPFSIKTAPMALPEKQSLTQMGRKILKGLGLELQSWPFLDARRLAETLFSCVLASSIAISGGAELERLRYKRLSMEQLTEAAFV

SEQ ID NO: 218712 - protein, 42 aa, Glycine max
  Coding DNA Sequence Number=SeqID_101934
MSVTLHTNLGDIKCEIFCDEVPKTSEKTTGVFGRAVAKLILE

SEQ ID NO: 218713 - protein, 180 aa, Glycine max
  Coding DNA Sequence Number=SeqID_101935
  Gene Ontology: Mol. function=binding
  Homolog annotation: Hit_ID=Q8GSH3; Match level="QueryCoverage=93%, HitCoverage=28%, E-value=5e-14, Identity=30%"; Hit description =Selenium-binding protein-like protein
MGNVAILTCKLGLSTDPIVSGALLDMYGKRGDIIESQRVFNKTLERTQFAWTTIIFSYAHHGDFELHENMEMAEKVVGRLIEMDPASSSPYVLMANLYAEKGNWEIEMDPASSCPYVLMANLYAEKGKWEIKMAKKVVGRLIEMDPASSGPYVLMANLYAEKRKWEKVADVQRGMRRRGE

SEQ ID NO: 218714 - protein, 56 aa, Glycine max
  Coding DNA Sequence Number=SeqID_101936
MAEWGPELHMPTWRSAFDRRGANKTNDSNAQCLMKTMQAMPIFRQTESTIEELRMQ

SEQ ID NO: 218715 - protein, 463 aa, Glycine max
  Coding DNA Sequence Number=SeqID_101937
  Homolog annotation: Hit_ID=Q6EPP9; Match level="QueryCoverage=68%, HitCoverage=59%, E-value=4e-23, Identity=48%"; Hit description =Growth-regulating factor 1-like
  Pfam annotation: Domain name=QLQ; Domain location=83-119; Score=11.0; E_value=0.015; Accession=PF08880.1; Description=QLQ
  Pfam annotation: Domain name=WRC; Domain location=135-180; Score =97.2; E_value=4.8e-26; Accession=PF08879.1; Description=WRC
  Pfam annotation: Domain name=WRC; Domain location=352-397; Score =62.4; E_value=1.5e-15; Accession=PF08879.1; Description=WRC
  Pfam module annotation: Pfam domain module=QLQ::WRC::WRC; Domain location=83-119::135-180::352-397
MDSGVVTRLTMLNSLVYKQRVGGGPQKKIDMGHKMVGDVGVVVVDERKRVVVVKEEKENTSSYSVELHLGVDASHSAPQEINHVITEAQRRELHHQVFIFNHLAYNLPPPYHLVQFPSNMSEYSFLGFDHGSMVDPEPHRCRRTDGKKWRCGKNVVPNQKYCERHMHRGRNRSRKPVETSQINSHLATKPSSKSHNKPASRTQFEISNPNLMAIRHSDTSSTPSRSLSVANCSSANNRWKNSASYADYLTSFSSASAVSPGSTLATPVAPKMATFSSVTSIASDRGSCLNICQKDNKSKSCISNNISVKSGGKGRIVGDTNGISTGIGFSPTSVLQVSGCNPSYLNDRTNIESASGRCRRTDGKKWQCKSAVLPGQKYCATHMHRGAKKRLTSHEPAVTIARLPNSSVTTKMQKAHCAIPNTNLSMSVPASEPFIQCNEKSQSTSDTDTTISDTLNECSYASF

SEQ ID NO: 218716 - protein, 378 aa, Glycine max
  Coding DNA Sequence Number=SeqID_101938
  Gene Ontology: Mol. function=signal transducer activity; Cellular component=membrane; Biological process=signal transduction
  Homolog annotation: Hit_ID=UPI00005F72E6; Match level="QueryCoverage =100%, HitCoverage=30%, E-value=1e-102, Identity=50%"; Hit description=COG3523: Uncharacterized protein conserved in bacteria
  Pfam annotation: Domain name=DUF1215; Domain location=160-286; Score =100.6; E_value=4.7e-27; Accession=PF06744.2; Description=Protein of unknown function (DUF1215)
  Subcellular localization annotation: CTP_CleavageSite=62; ConfidenceScore=5.04e-01
DYIRQWEQFLSDIQLNSSADLSQRINTARLLSGNHSPLRQLVVNLSKLLTLNRAQPDEQNAQAQPAAGNSATRTLEALFSSSKASAASGQGATQQAPEQAVAVHFAPILELAQPLQQGSKVLAVDDFLHQIDDLYRYLTAVQDAANSGMPPPSGDAISRLQASAGRLPGSLQNMVSSMAVGASSDAQRRDMDNVRKRITMEVGSFCRQAIAGRYPLVRNARSEVTPDDLARMFAPGSGLMDSFFRDNLASKVDTTNAAWRFTPGIDGKTLPGGEALLRPFQQAQSIRDAFFANGATTPSFRVTLRTVKMDNDILNLTLDVDGQILRYSHGPQAVQMVSWPGPGGTSQVRKQLGLTNGTTSTLVTSGPWALNRFFDRAR

SEQ ID NO: 218717 - protein, 87 aa, Glycine max
  Coding DNA Sequence Number=SeqID_101939
MLADVGRLGKTTDRGLKKKHDRMTPVEHFLTGRLGFFVRAQPKLFFGRHRHVLIYSARKTLTHLGKKSLFSDTDWKKKTIADVVRER

SEQ ID NO: 218718 - protein, 63 aa, Glycine max
  Coding DNA Sequence Number=SeqID_101940
  Gene Ontology: Mol. function=peptidase activity; Biological process =proteolysis
  Homolog annotation: Hit_ID=Q1S463; Match level="QueryCoverage=71%, HitCoverage=11%, E-value=3e-10, Identity=65%"; Hit description =Eukaryotic aspartyl protease
MNHSDIEELLYSLMKNEEHMKLPSDIFDSGNGKGTITDSGTTLAYLPAIVYDELIPKVLARQP

SEQ ID NO: 218719 - protein, 169 aa, Glycine max
  Coding DNA Sequence Number=SeqID_101941
  Subcellular localization annotation: CTP_CleavageSite=20; ConfidenceScore=5.14e-01
MAQSNSSRLGFPAFITTLCRSRGVASDSLVFKRLSPVINLAYIRKNYWNPADLAFTIGGARRARARPVEAPSTSAAPLPARTSAALSTPSFPPLHREDEGLTAQVPQQREDESSESSTLEPLIRRKRVFETQEAAATSEKSLKDTAEPSEPVADTTSIQQAADPSTHEE

SEQ ID NO: 218720 - protein, 105 aa, Glycine max
  Coding DNA Sequence Number=SeqID_101942
  Homolog annotation: Hit_ID=Q1SS89; Match level="QueryCoverage=44%, HitCoverage=5%, E-value=6e-13, Identity=72%"; Hit description =Integrase, catalytic region
MGLVVKGSFVGERRASKGFTQTYGIDYEEAFAPVAKMKSVRLLLSIAANRDWPLFQLDVNWSGSQTTGPRICDRSEEPLPDTILLPLRTTNAILARLSFGLRRLR

SEQ ID NO: 218721 - protein, 427 aa, Glycine max
  Coding DNA Sequence Number=SeqID_101943
  Gene Ontology: Mol. function=nucleoside-triphosphatase activity; Biological process=defense response
  Homolog annotation: Hit_ID=Q1STU5; Match level="QueryCoverage=92%, HitCoverage=78%, E-value=3e-40, Identity=29%"; Hit description =Leucine-rich repeat
MKTFSQGGINAPMFLGFKTSMQDLNFHYQDDLNTTMERLFYQQVEKSTCDIQYLKFGDHLPLEEIWLGVVPIPSDHSFKNLKSLFVVECEYLPNVIPFYLLPFLCNLEEIHVINCKSIKAIFDVQDMRVDMKLPSQHSLPLKKLILSQLPNLEYIWNLMSDEFLSLQSLQEVYIYSCEKLKSLFPTSVANHLVMLDVRDCARLVEILVENEAALKGETKQFIFHCLISITLRKLPELKYFYNGKHSLEWPMLAYLDIYHCDKLKLFTSEHNSGEVADIEDQVGISNHQQAIFIVEKIFPNIEQLSLKKEDAMAISHGLFQAKVIPELEHQAITTEDTMIMRRQFGANAAHLLQNLKLLTLLCYHEDDESNIFSSGLLEKIPNIENLRVACSSFNEIFPSLKPSAGCTKIVSNLKGLYLDFLLKLSSI

SEQ ID NO: 218722 - protein, 824 aa, Glycine max
  Coding DNA Sequence Number=SeqID_101944
  Gene Ontology: Mol. function=nucleoside-triphosphatase activity; Biological process=defense response
  Homolog annotation: Hit_ID=Q1STU5; Match level="QueryCoverage=94%, HitCoverage=95%, E-value=3e-47, Identity=27%"; Hit description =Leucine-rich repeat
  Pfam annotation: Domain name=LRR_1; Domain location=133-153; Score =2.1; E_value=1.2e+02; Accession=PF00560.23; Description=Leucine Rich Repeat
  Pfam annotation: Domain name=LRR_1; Domain location=159-180; Score =1.7; E_value=1.4e+02; Accession=PF00560.23; Description=Leucine Rich Repeat
  Pfam annotation: Domain name=LRR_1; Domain location=218-240; Score =3.8; E_value=55; Accession=PF00560.23; Description=Leucine Rich Repeat
  Pfam annotation: Domain name=LRR_1; Domain location=244-266; Score =2.8; E_value=87; Accession=PF00560.23; Description=Leucine Rich Repeat
  Pfam annotation: Domain name=LRR_1; Domain location=303-325; Score =6.2; E_value=20; Accession=PF00560.23; Description=Leucine Rich Repeat
  Pfam annotation: Domain name=LRR_1; Domain location=43-69; Score=4.7; E_value=37; Accession=PF00560.23; Description=Leucine Rich Repeat
  Pfam annotation: Domain name=LRR_1; Domain location=548-571; Score =5.0; E_value=33; Accession=PF00560.23; Description=Leucine Rich Repeat
  Pfam annotation: Domain name=LRR_1; Domain location=658-685; Score =1.7; E_value=1.4e+02; Accession=PF00560.23; Description=Leucine Rich Repeat
  Pfam annotation: Domain name=LRR_1; Domain location=712-740; Score =2.7; E_value=91; Accession=PF00560.23; Description=Leucine Rich Repeat
  Pfam annotation: Domain name=LRR_1; Domain location=767-788; Score =3.3; E_value=68; Accession=PF00560.23; Description=Leucine Rich Repeat
  Pfam annotation: Domain name=LRR_1; Domain location=791-812; Score =2.1; E_value=1.1e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =133-153::159-180::218-240::244-266::303-325::43-69::548-571::658 -685::712-740::767-788::791-812
MPSCAHSLEDQVQNKNKDIITEVGQSVTDACLSLFNEKVSIPKLEWLELSSINIQKIWSDQSLHCFQNLLTFNVIDCGNLKYLLSFSMARSLVNLQSLFNIDVFPKLKKMEMVFMEKLNTIWQPHIGLHSFHNLDSLIIRQCDKLVTIFPSYMEQRFQSLQSLIIIDCKLVENIFDFENIPETCDRNETNLHYVFLQALPKLVHVWREDTSEILKYNNLQSISINGSPNLKYLFPLFVANELEKLEYLSVSNCGVMKEIVAWDKGSNENVITFKFPHLNCVSLQQLFELVSFYRGPHTLEWPSLKKLGIHNCYKLALLPTEIKNSQAQPIVLATEKVIYNLELMAMSLKEVEWLQKYIVSAHIMHNLQTLTLVVRECSQMTKFSNVQSAPNLQKVHVVVGEKDKWYWEGDLNVTLQKIVTDQSFLSFKVPFNYSKHMRLFDYPQMTGDQHSKPAFSDNLFRNLKKLEFDVAGKRDIVIPSHVLPYLKSLEELNVHSSDAVRVIFDIDDSDANTKKGIVFHLKNLTSKGLSNLECIWNKNPEGIVRFPNLEKVVVDGCGRLVTLFPSSLARNLGNLKALVIWICSSLVAIVGKGNAAMEHGTTEMFEFPCLSLLNLWNMPLLSCFYHGKHHLECPILETLYVVICPKLKLFTSEAVVPKLKALSLNEQNIILLSDAQFPRDLLGKLKILLLWFEDFDNEKDTLPFDFILKVPSLEHLRVQRCFGLTEIFPSQVRHGILAGLKQLFLYDLKELELIGLEQPWVKPYSEKLEVLQLRLCSRLEKLVCFAVSFINLKELVVSDCKMMEYLFTFSTAKSLVQLEILQID

SEQ ID NO: 218723 - protein, 242 aa, Glycine max
  Coding DNA Sequence Number=SeqID_101945
MFCIFLAVRDVQKRDIAFIRAYGFENIDPHAAEKMLSSREKVKTLPVDLKAFDSRDKSKVIEESTFIRRMIKDRIQHSEATVAYVAALGSIPYLYMIGSSMRDGHLPLRLSDFDRNKNCFHLLDAPPTGSKLIRKFGGEITEKSSIVSSNVNNQIGLAISFTMNIQPSDLPVDLSDHTLHIQLDTGFRFDNLPSEEEQENITKEASYVVRLGSLYQEGLHGVIYVWHWNSIKNEYEWSLKIS

SEQ ID NO: 218724 - protein, 188 aa, Glycine max
  Coding DNA Sequence Number=SeqID_101946
MRCIFVHVSSTHEWGAVRSDCLVHFSILNLIWTPMNCVFVHVSSIHEFGAMRSDCLVQFSILNPFSEPMNCIFVHVSSTHEFGAMRSDCLVQFSILNLFRNPMNCIFVHASSTHEFGAMRSDCLVQFSILNLFRNPMNCIFVHASSTHEFGAMHSDCLVQFSILNLFRSPMNCILRSCVLHPRVWSHA

SEQ ID NO: 218725 - protein, 139 aa, Glycine max
  Coding DNA Sequence Number=SeqID_101947
MTGSFFPVHWLLKSTSFIISLCVFCFQDLQTLHRSFLIGAAVIATFGYRKEHDDSWVKKGAQPIDDEGHLPVGEDSSLLQRILDRFDGLQTYVGERFDALELQVDMRFNEMESRITKVEGDVTYIRICFDLPPALPPSS

SEQ ID NO: 218726 - protein, 148 aa, Glycine max
  Coding DNA Sequence Number=SeqID_101948
  Gene Ontology: Mol. function=ribonuclease H activity; Cellular component=intracellular; Biological process=DNA integration
MGEMCEEFKIQHHNSTPYQPKMNGAVEEANKNIKKIIQKMTVSYKDWHEMLPFVLHSYRTSARTSTGATPFSLVYGMEVGTRRFSEGDLVLKKVSEALKDNRGKWAPNYEGPFVVKKAFSGGALVLTNMDGEELPSPVNSDVVKRYYA

SEQ ID NO: 218727 - protein, 162 aa, Glycine max
  Coding DNA Sequence Number=SeqID_101949
MPVGWFYTNKADMTGRLLAGSLAFDCCILHYLIVRILLPRSSNLAQVPLDSEPSVQIKKSFSIGAAVVASFGYHKECDGSWVKKDAQQHDVEGCSPAREDSSLLQSVMDRFDSLQAYVGERFDSFESQVDIRFGEMDSRIMKIEGDITFIRDCFDLPPPPST

SEQ ID NO: 218728 - protein, 259 aa, Glycine max
  Coding DNA Sequence Number=SeqID_101950
  Gene Ontology: Mol. function=RNA-directed DNA polymerase activity; Biological process=RNA-dependent DNA replication
  Subcellular localization annotation: CTP_CleavageSite=20; ConfidenceScore=5.45e-01
MDRLTTMMSALLSAQNSQAAAAAVEQPLVSTTPLSTVTSPPLFLPPGCTWGMPPPVCGSSQPAVSEAPPPFAQQSAPVPQPSTSFPQAAMTYSAPLIHTIQQEVEPIFQAENVVAFDKMEELQERFDGMQREVEALRGRDLFGKDACELCLVPNVTIPHKFKVPDFEKYKGNSCPRSHLVMYARKMSMYTDNHKLLIHFFQDSLTGAALKWYMNLDSASIRTFNDLGEAFIRQYKYNLDMAPDRDQLRAMTQKEKETFK

SEQ ID NO: 218729 - protein, 87 aa, Glycine max
  Coding DNA Sequence Number=SeqID_101951
MASIYHPQLNSLDVKLFGGQEKCARYGGGGRRRQVDTNLPKMEEMASLHARRMWICPVSCSAMVQILEKEYPNFDTGRPDRGFDSNI

SEQ ID NO: 218730 - protein, 327 aa, Glycine max
  Coding DNA Sequence Number=SeqID_101952
  Gene Ontology: Mol. function=RNA-directed DNA polymerase activity; Cellular component=membrane; Biological process=RNA-dependent DNA replication
MRLNPDKCVFGAKGGKFLGFILPHRGIHTNPNKCQAIMEMRSPRNIKETQMLAGRISTLFRFLPRIVERAKQIINLLKKTTNFKWNNECEETFWQSKVTLATPPVLSKPSTDKKLIVYLPISAEAISAVLVKEENSELRLYTSSVECYRIQKLDIRLLVDKKKARKLRTQAARYVMITDELYWQRFSSPLLKCLNKEQQGNLIHRPVKELPITYPWPFGTWGMDILGPFPGAPGQRKFFFGSCQLLYEVGRARTPHNNYCSENFTDQKLNEFMIGLSIKHRVTFVKHPQTNGQAELASKVNLVELKKWLHNAKERWVNELLEVLWAY

SEQ ID NO: 218731 - protein, 95 aa, Glycine max
  Coding DNA Sequence Number=SeqID_101953
MKFPSDTESIITAHADKRTTRESYLASLKLGPLTNNEPHQVMHYVEIVVGAERSKELDLNPRTNNDNREEKDGGRKVSGSMARGLQADGSPTSKK

SEQ ID NO: 218732 - protein, 63 aa, Glycine max
  Coding DNA Sequence Number=SeqID_101954
MEVLIYVVGTIVLLDSQILPIGREGSLYDVGDKRILELLVSAKVGYLQKALQSSSQGLTMSSK

SEQ ID NO: 218733 - protein, 273 aa, Glycine max
  Coding DNA Sequence Number=SeqID_101955
MAFLEPLPQRLLAKPIVNLFKSPDLIKDLDLVLTDLCACLFQESWPKDPPTDALPPPTNTLPPLAENQSKRARVNIKGSIMIRGMLLSNPSAIRALVTTIAQDLQDFSAVSKFKLELKKACVAALKLESKGLENRATNVKDSANLNVKEMERLKTLLALVEKERDAKKEEKTWVEQTSYDDVYEAYTSGFNHCLCQVLFHCEVHDESIFYIEKNVYNGKLVPINDISEDGAPIGKQLTTSPRETQVIEGANEDEDNGDEEGDVHEDACRDKDS

SEQ ID NO: 218734 - protein, 149 aa, Glycine max
  Coding DNA Sequence Number=SeqID_101956
MGFSTKPNIYLVYMPPKLNESFMTETGVRGVEFQGYWSYQSGVGRELDSDSLGSDLVLLMGLSSEGGSIDFFAFLDSLPKQVADNITHSRDKVVDDTTIVIDVTVEPSNHLTRVSQQQRHAKDEHCESLASKMPKSVHKEEGIVVYYYS

SEQ ID NO: 218735 - protein, 97 aa, Glycine max
  Coding DNA Sequence Number=SeqID_101957
  Gene Ontology: Mol. function=RNA-directed DNA polymerase activity; Biological process=DNA integration
MDFEEIVQDKRWRDVMDEEIRSIEKNDTWELISLPKWHKAIGVKWARLVAKAQHKWRIDQMDVKSAFLNGVLEEEVYFEQPLRYNVKEEEDKFLKLK

SEQ ID NO: 218736 - protein, 109 aa, Glycine max
  Coding DNA Sequence Number=SeqID_101958
  Gene Ontology: Mol. function=catalytic activity; Cellular component =cytosol; Biological process=metabolic process
  Homolog annotation: Hit_ID=Q9C522; Match level="QueryCoverage=94%, HitCoverage=15%, E-value=1e-30, Identity=68%"; Hit description=ATP citrate lyase, putative; 3734-7120
MVALKQPMIRVVAIIAGGVPKSNTKQLVAYVGANNKVVIGPTTNGGIQASAFKISDTAGTIDNIIHCKLYRFGSVGFVSKFMTVLREDRFLNYRGVSNELYNTICPHNL

SEQ ID NO: 218737 - protein, 91 aa, Glycine max
  Coding DNA Sequence Number=SeqID_101959
MLHSARGDIAQLVELRSCNWVVAITGWMSNCPGEDQAGPCEQLDALSPFNPLSEMWQKEKESMDRPHRLHPVGTTRSPQGRLRHPGVADRP

SEQ ID NO: 218738 - protein, 183 aa, Glycine max
  Coding DNA Sequence Number=SeqID_101960
  Gene Ontology: Mol. function=DNA binding
  Homolog annotation: Hit_ID=Q1SP03; Match level="QueryCoverage=98%, HitCoverage=32%, E-value=8e-16, Identity=34%"; Hit description=IMP dehydrogenase/GMP reductase
MGTNQNGKRFYQVKVKSLDVTSLKELGRLMGPLQRQAFRKVYGKILDLAATEVFTEAVVSLAQYYDQPLRCFTFGDFQMVPTIEEFEEILGCPLGGRKPYLFSGFLPSLSKIAAVVGDSAKELDRTKQTRNSVVGLPRKYLEGKARDMASQEKWGPFANILALLIFWGCPLPKRRRFGRLSRH

SEQ ID NO: 218739 - protein, 71 aa, Glycine max
  Coding DNA Sequence Number=SeqID_101961
MSVIEFSIQSLNEICMMSIKKCSRPKWRRAKTQVEKDKAPEWRRMKAQVENDEVPEAEALPRLLIVAEGPN

SEQ ID NO: 218740 - protein, 110 aa, Glycine max
  Coding DNA Sequence Number=SeqID_101962
MSFIFQEAKESIDEEDPRPTSSNGAYITVKSAGCAGLDCGVRGGSRGTNEDDTIREFHRGILDSDLGVGGLLERLHEHVELVDDGAHTQCMIEETKGHVTIRVWSLVQTY

SEQ ID NO: 218741 - protein, 108 aa, Glycine max
  Coding DNA Sequence Number=SeqID_101963
MSVVAQALSPSTAVCWKQNPPSHSVSQCHEEPNATKKVISRTLKLFLLGLLLQVIQPIVIALMFLTKTYVCCGYFHGHDKLTYGVDLSKIRWLGVVQVVGTSKVVNPC

SEQ ID NO: 218742 - protein, 62 aa, Glycine max
  Coding DNA Sequence Number=SeqID_101964
MPEVVTLTARRGMPKASASLVFDDCRFKVKKYKKRLALYISHPLKFKPVPFLELVNLIFIAK

SEQ ID NO: 218743 - protein, 407 aa, Glycine max
  Coding DNA Sequence Number=SeqID_101965
  Gene Ontology: Mol. function=ATP-dependent peptidase activity; Cellular component=integral to membrane; Biological process=ATP -dependent proteolysis
  Homolog annotation: Hit_ID=Q8H0X2; Match level="QueryCoverage=84%, HitCoverage=66%, E-value=1e-117, Identity=62%"; Hit description =Expressed protein
  Pfam annotation: Domain name=zf-C3HC4; Domain location=233-270; Score= 43.0; E_value=1e-09; Accession=PF00097.15; Description=Zinc finger, C3HC4 type (RING finger)
MASSLSPSPSSLDQTLRDVDDYVLRFNTRDFWEIDVKRVKENGSEGLSRDTLHYVYELVKNGNVAFRENRMEEAINFYSRANNIKSGDPIILSNRSAAYIRISQYFMHRTPSSSERRPLSGLEPTTLAELGLKDAEKLVELQSNSAKSYLLKANAFLLENSPTLGLYLLDGELLSEGQLEKYEKARDVILSGLQVDPFSNSLRASLQNLESVSSSSRGMSTHGHPERNDDFDCTLCLKLLYEPVTTPCGHSFCCSCLFQSMDRGNKCPLCRTVLFISPRTCSISVTLKNIIQKNFPEEYAERKQEHDSLIKAGVDLLPLFVMDVVIPCQRFPLNIFEPRYRLMVRRIMEGNHRMGMAILDSTGSLAEFACEVEITECEPLPDGRFYIELYLGGLPSVNGILQMMRYC

SEQ ID NO: 218744 - protein, 110 aa, Glycine max
  Coding DNA Sequence Number=SeqID_101966
  Gene Ontology: Mol. function=DNA binding; Biological process=DNA integration
  Homolog annotation: Hit_ID=Q1S326; Match level="QueryCoverage=69%, HitCoverage=27%, E-value=3e-09, Identity=38%"; Hit description =Putative receptor kinase-related
MAPLEDSNTWSLVPLPYGKHCIAKGYTRQAGIDFSDTFSPVAKLTSVRVLIVVAAGSKPITLPMDPNLKLSLVDGDLIKDPSLYKRMIYRLMYNASDYISARYYFCCAQA

SEQ ID NO: 218745 - protein, 101 aa, Glycine max
  Coding DNA Sequence Number=SeqID_101967
MAIPKEEQLQKWVSFAGSHLPSQKFIWSEDFAFSFLVSSFVIHSPLRRFCVLYFGGKDEDSFHGPRFKVAQGCVSTWSSHRASPILISGAKQIRVKVSVSG

SEQ ID NO: 218746 - protein, 94 aa, Glycine max
  Coding DNA Sequence Number=SeqID_101968
  Gene Ontology: Mol. function=transferase activity, transferring glycosyl groups; Cellular component=integral to membrane; Biological process=metabolic process
  Homolog annotation: Hit_ID=Q8S997; Match level="QueryCoverage=93%, HitCoverage=23%, E-value=1e-23, Identity=52%"; Hit description =Glucosyltransferase-12
MELELKTKERGLMVNWAPQEEVLAHPLVGGFFTHSGWNSTLECITKGVPMLCWPLIADQTVNSRLIVEKMVKNLMENQIERLTSSTNEIARKSS

SEQ ID NO: 218747 - protein, 185 aa, Glycine max
  Coding DNA Sequence Number=SeqID_101969
  Gene Ontology: Mol. function=transposase activity; Biological process= transposition, DNA-mediated
MERVLADVLRDQRNLGNKGDEGWKRSALNVAAAVLSTSFNVNVTSDNVKNRIKLWRSWYGIVSDILGQSGFDWDGTKHMITVENENAWNEYCTSHKSAKPFRYKVLQNWDDIVDLCAKDRATGHGAETAMDADEAMSRETNEVEFMGLGATAIDLEEPNSNTKGKRQGSTSSGTHPHQEKDGRKR

SEQ ID NO: 218748 - protein, 74 aa, Glycine max
  Coding DNA Sequence Number=SeqID_101970
MLRNFTDYATMLFLTSEMLWNFTDCATITLRITKQWGLSTSRRSSEGCMPPNNGPRMKLGYDSRQCKEMRNPKN

SEQ ID NO: 218749 - protein, 414 aa, Glycine max
  Coding DNA Sequence Number=SeqID_101971
  Gene Ontology: Mol. function=methyltransferase activity; Biological process=methylation
  Homolog annotation: Hit_ID=Q1H1Y3; Match level="QueryCoverage=57%, HitCoverage=61%, E-value=1e-98, Identity=72%"; Hit description =Putative RNA methylase
  Pfam annotation: Domain name=UPF0020; Domain location=17-224; Score =220.5; E_value=3.7e-63; Accession=PF01170.9; Description=Putative RNA methylase family UPF0020
DSYQLYVDTSGLPLYQRGNRKNSIEAPLRENLAAGILKLTGWQPGQALLDPMCGSGTFLLEAVMMALNIAPGLNRNFGFEKLKNFESDTFRKIRNAAAKAVKPVTFQSIYGSDMDLRAVRVTKQNLEMAGWLEAVQLTHWEFTQVVPPAESGVLVANPPYGVRIGEDETLAALYPQMAATLKQKFSGWNTYFLTNDLRLPKLMRLSPSKKTPLYNGPLECRLFEIKMVAGSNRREKADSPAVDDFVEERDWAQFHSPKNLAMAMIVEAAEVVEHFQWMTEADSRQLDDATKEKVGQELADTFVYLMRIAEVCGIDLIAATNAKIELNAQKYPADKCKGWLTMVANVHSPVTDLLKQQQIAFQVIEIPLSEDKKPIRHLEELLFAQGLDPQSVVRSVVFKGENSGFCLLAVAGGG

SEQ ID NO: 218750 - protein, 167 aa, Glycine max
  Coding DNA Sequence Number=SeqID_101972
MTEGVVKGLPCKPSRFSMCPVVGFGPWLGLGKPLVEILPPGQLRGFCPLLAWLGSAVLGYGPVLSFGLVGPLLPPVISFVARILPTLACAPLAKFVPRWWIIMQNEREPTNGSLFWPNIVEEERDTGLIGEGRIKATRAESQWIVAARPLCHLQYPVAYLSRLRGIL

SEQ ID NO: 218751 - protein, 64 aa, Glycine max
  Coding DNA Sequence Number=SeqID_101973
MMIVSTRQRARFPWLTKGVGNHKTTKGGEDDVSLLASTGSFPLVDKSADNHKGNPACLLTSRVR

SEQ ID NO: 218752 - protein, 208 aa, Glycine max
  Coding DNA Sequence Number=SeqID_101974
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=6e-29, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTDPLNESISCFLIRVDPWVHALTFRGLHALTFRGLHALRFRGLHVLAIRGLHVLAFRGLHALAFRGLHVLAFRALHALTFRGLHVLTFRGLYVLAFRGLHILAIIGLHALTFRGLHVLAFRGLHALAFRGLHILTVIGLHDLTFRRLHALTFKRLHVLTFRWLHALAVIGLHTRTFRGLHALTFRGLHVLAIRGLHALAFRGLHALA

SEQ ID NO: 218753 - protein, 252 aa, Glycine max
  Coding DNA Sequence Number=SeqID_101975
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=2e-39, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
PSEGYTLSPSEDYTSSPLELHALTFRGLHIFAFRGLHVLPFSVVHFLNFQGIHVHAFRGLHVLTFRGLHILAFRGLHTVTFRGLHVLSFKGLHALTFRGLHVLAFRGLHVLTFRGLHALTFRGLHVLAFRGLHVLAFRGLHRLTFRGLHALALKGLQVLAFRGPQVLAFRGVHVLAFRGLHRVTRPHIKRPTRPRFQRTTCPLLQWSTRPHLSRTTHPRLQRTTRAHLQRTTHPRLQRATHRHLKRTTRPHL

SEQ ID NO: 218754 - protein, 204 aa, Glycine max
  Coding DNA Sequence Number=SeqID_101976
  Gene Ontology: Mol. function=pectinesterase activity; Cellular component=cell wall; Biological process=cell wall modification
  Homolog annotation: Hit_ID=Q4PSQ5; Match level="QueryCoverage=98%, HitCoverage=64%, E-value=7e-49, Identity=48%"; Hit description =Pectinesterase family protein
  Pfam annotation: Domain name=Pectinesterase; Domain location=2-192; Score=37.8; E_value=1.5e-24; Accession=PF01095.10; Description =Pectinesterase
NTYNSINRRIEIKPALAARIYGDKSFFLRCNFISYQDTLFDATGRHYFKNCYIEGEIDFIWGYGQSFYENCSINAVGINSTEPGFVTAQGRESPTDPSGFVFEGGSLVGDGKVNLGRAWRAYSRVIFHGTYLSSVVTPEGWNPWNYTGSESNFTYAEVDCKGPGADTSKRVKWIKTLNQSQLNEFSLTSFINMDGGIDNLPIIF

SEQ ID NO: 218755 - protein, 105 aa, Glycine max
  Coding DNA Sequence Number=SeqID_101977
MWYHVSENLIERLGVHDKTNHTLLGSLCIARMLQSYGISTSLKEYSNWVYLPPSLHSKEFTPRPTLRRVRQGLSFLIQVQPRKHFNRQTLCMNCTKHMAPQLFSK

SEQ ID NO: 218756 - protein, 43 aa, Glycine max
  Coding DNA Sequence Number=SeqID_101978
  Homolog annotation: Hit_ID=Q1RV39; Match level="QueryCoverage=81%, HitCoverage=3%, E-value=4e-11, Identity=97%"; Hit description =Calponin-like actin-binding; Kinesin, motor region
MAALSFSVASVVEDVLQQHGTRLKDLDLESRKAEEAVFESRVL

SEQ ID NO: 218757 - protein, 51 aa, Glycine max
  Coding DNA Sequence Number=SeqID_101979
MQKSKRDVYLRAYLNGALKRLDDTPQSKFKVAARWIVVKYFNDANHWNQRD

SEQ ID NO: 218758 - protein, 111 aa, Glycine max
  Coding DNA Sequence Number=SeqID_101980
  Gene Ontology: Cellular component=mitochondrion
  Homolog annotation: Hit_ID=P92535; Match level="QueryCoverage=50%, HitCoverage=48%, E-value=1e-11, Identity=57%"; Hit description =Hypothetical mitochondrial protein AtMg01010
MTPLDPEGDWPGRGARALDNPRTSTGEDSLENLYRLKDDLNENGRDSETFKRLKDKIVPYVPPQPSDPLMEKISRLERAVNKLSRDKYDVADLENLSLYPKVRLPYGFQWP

SEQ ID NO: 218759 - protein, 98 aa, Glycine max
  Coding DNA Sequence Number=SeqID_101981
MAYHASSKANQNSMQNNVIHFGKSYSLEDHQREPELQTYHQKEAERGFNLDNLLMQFKDTIKSIQGAFKSTKIQIGKLVEEVTQAMGRREEEFVEVEA

SEQ ID NO: 218760 - protein, 170 aa, Glycine max
  Coding DNA Sequence Number=SeqID_101982
MGLIWLNEGSCRLLPCLGIGPVSKPCNLTPKLLRSRARKRGGTLPPLTEAELVETLVYLHLPTVVGHLLANQMLWWRYVCGLMFITLRLPRRAVLLDEGLGDRWSDYFTGGDGNSEELAEARDQCRKPQGPVGLIWVQRVPGKTLLSSSVIHVWVKVVILVRMIHTRLLV

SEQ ID NO: 218761 - protein, 154 aa, Glycine max
  Coding DNA Sequence Number=SeqID_101983
  Pfam annotation: Domain name=Transposase_23; Domain location=5-75; Score=13.4; E_value=3.9e-05; Accession=PF03017.5; Description =TNP1ENSPM transposase
NNPDTGDSEKCGLYIEENPPRLVALGRVYEGSTTVHNIPLLHDQVKVGVEQVKDADAPILVPTDEVILVGQALNTFLAWLTHLVKHLSEQGAVGPAKPADRPDHEVDDPLYLMTLTIPQLFLKSLQASDRDKYASGEFRCVWIPRAIVLWAITI

SEQ ID NO: 218762 - protein, 69 aa, Glycine max
  Coding DNA Sequence Number=SeqID_101984
  Subcellular localization annotation: CTP_CleavageSite=37; ConfidenceScore=5.26e-01
MARSIWSSFQLSLIFCPNLPGSFKNNFSPKELSVNPPAMEAYIRKVSLKDSQQALAMSPRYVSALAIMS

SEQ ID NO: 218763 - protein, 148 aa, Glycine max
  Coding DNA Sequence Number=SeqID_101985
  Gene Ontology: Mol. function=D-arabinitol 4-dehydrogenase activity; Biological process=metabolic process
  Homolog annotation: Hit_ID=UPI00005F8F76; Match level="QueryCoverage =95%, HitCoverage=30%, E-value=3e-43, Identity=58%"; Hit description =COG0246: Mannitol-1-phosphate/altronate dehydrogenases
  Pfam annotation: Domain name=Mannitol_dh_C; Domain location=1-127; Score=-53.5; E_value=0.0002; Accession=PF08125.3; Description =Mannitol dehydrogenase C-terminal domai
DVIPSLSPSPLDLADYRDVVLARFSNPYIKDTNQRVGADGLSKIPGMVTPTLRECYQRGAEPTATAVLPALFYLFLQRWASNQLPYAYQDGVLNADALRQQLSGENALQTFLSDRALFAELADDRAFHALVTRSVDAIEQQLLQPATV

SEQ ID NO: 218764 - protein, 196 aa, Glycine max
  Coding DNA Sequence Number=SeqID_101986
  Gene Ontology: Mol. function=oxidoreductase activity; Cellular component=membrane; Biological process=metabolic process
  Homolog annotation: Hit_ID=Q1XP09; Match level="QueryCoverage=97%, HitCoverage=68%, E-value=2e-61, Identity=58%"; Hit description=Short- chain dehydrogenase/reductase SDR
YGQIGTLEELSDEEARENFDVNVFGSLNVIRNVMPYLRNQGSGNIFNIASVGGLFGSFPGWGIYCSTKFAVAGFTEALAEEAKAFGVKATVVYPGYFRTDFLAKGSVRTPKNTIKAYEAARESEQLHLDTINGNQANDPEKAAEVLIAISKEAQPPVHLLLGNDAYDILKNKINMINQDAEQWKSYTLSTAYTELS

SEQ ID NO: 218765 - protein, 160 aa, Glycine max
  Coding DNA Sequence Number=SeqID_101987
  Gene Ontology: Mol. function=protein kinase activity; Biological process=protein amino acid phosphorylation
  Homolog annotation: Hit_ID=Q1SN45; Match level="QueryCoverage=98%, HitCoverage=9%, E-value=5e-20, Identity=31%"; Hit description=AAA ATPase
  Pfam annotation: Domain name=DUF889; Domain location=1-159; Score =70.4; E_value=5.9e-18; Accession=PF05970.5; Description=Eukaryotic protein of unknown function (DUF889)
MRLHNNLESVDEQETATFAKWILDIGDGIIDDENDGYATIQIPAHLLITQYDDPISAIVKSTFPDLDQHHNNPEFFKSKAILASTNETVEQINHYVLSFIPSDHMEYLSSDSVDKSESSENSYFQSITTEFLNSLNTFGLRTHSIKLKIGSPIMLLSGIL

SEQ ID NO: 218766 - protein, 57 aa, Glycine max
  Coding DNA Sequence Number=SeqID_101988
  Homolog annotation: Hit_ID=Q0GPH8; Match level="QueryCoverage=98%, HitCoverage=24%, E-value=3e-13, Identity=57%"; Hit description=BZIP transcription factor bZIP56
  Subcellular localization annotation: CTP_CleavageSite=50; ConfidenceScore=5.01e-01
ESKIKEIEEKQASSSNSSRPTLELPLVSPFSMGSQSGSTRLSLEPPSVIPSSRVASI

SEQ ID NO: 218767 - protein, 185 aa, Glycine max
  Coding DNA Sequence Number=SeqID_101989
MGEVEEVQEQVKANMEALKEQMATMMEGMMSIKDIMEVNAVAIATASTIAECKNKHAFPPYDLPLNYTPPNVAYTSSEDVNNSPPILIESQQPQTDHAHVSQTMGETHEIPHHNLADFEPCLGYATEGQAVGEERLKVVEGSEGYAFSNLKELFLVPNVVTPSKFKVSDFDKYKETTCPKNHLKD

SEQ ID NO: 218768 - protein, 157 aa, Glycine max
  Coding DNA Sequence Number=SeqID_101990
  Gene Ontology: Mol. function=unspecific monooxygenase activity
  Homolog annotation: Hit_ID=O04892; Match level="QueryCoverage=59%, HitCoverage=17%, E-value=3e-28, Identity=79%"; Hit description =Cytochrome P450 like_TBP
MALKRATYTRPSGQGPSPDDLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKRCDGPCGC

SEQ ID NO: 218769 - protein, 673 aa, Glycine max
  Coding DNA Sequence Number=SeqID_101991
  Gene Ontology: Mol. function=protein serine/threonine kinase activity; Cellular component=membrane; Biological process=protein amino acid phosphorylation
  Homolog annotation: Hit_ID=Q9XED4; Match level="QueryCoverage=83%, HitCoverage=87%, E-value=0.0, Identity=59%"; Hit description =Receptor-like protein kinase homolog RK20-1
  Pfam annotation: Domain name=DUF26; Domain location=126-180; Score =93.7; E_value=5.7e-25; Accession=PF01657.8; Description=Domain of unknown function DUF26
  Pfam annotation: Domain name=DUF26; Domain location=239-306; Score =57.3; E_value=5.2e-14; Accession=PF01657.8; Description=Domain of unknown function DUF26
  Pfam annotation: Domain name=Pkinase; Domain location=363-640; Score =144.9; E_value=2.2e-40; Accession=PF00069.15; Description=Protein kinase domain
  Pfam annotation: Domain name=Pkinase_Tyr; Domain location=363-640; Score=114.4; E_value=3.3e-31; Accession=PF07714.7; Description =Protein tyrosine kinase
  Pfam module annotation: Pfam domain module=DUF26::DUF26::Pkinase::Pkin ase_Tyr; Domain location=126-180::239-306::363-640::363-640
MDKINKISDAEKVATPNINPIFEHPKADNCRRWLEKKEEPITNHHCDSRTPGPYVQLFRSEKTKTPQNYPKKLINIPVNNKQESIKKFEFPHLKFCSVSSFYAGGAGPQINYGFYNFSHGQSPDRVNAIGLCRGDVEPDECRSCLNYARSNLTQDCPNQKEAIIQYDNCMLRYSNRTIFGNLEVKPGYCVWNLSNVMDGDESKQALANLMRKLKDVAASGDSRRKYATDNVTTGNFETIYGLMQCTPDLSEIQCNDCLDGAISRIPHCCNITFCGGGVRPSCNIAYCGGVIRPSCNIRFENYRFYNHTTMLDPEIPPSWPASPPFADISPEPEVKEDEVEDEIKIAESLQFNFNTIQVATEDFSDSNKLGQGGFGAVYRLTEIHFQGRLSNGQMIAVKRLSRDSGQGDTEFKNEVLLVAKLQHRNLVRLHGFCLEGNERLLVYEFVPNKSLDYFIFDPNMKAQLDWKSRYKIIRGIARGLLYLHEDSRLRIIHRDLKASNILLDEEMSPKIADFGMARLVLVDQTQANTSRIVGTYGYMAPEYAMHGQFSVKSDVFSFGVLVLEILSGQNNSGIHHGENVEDLLSFAWRSWKEGTAINIVDPSLNNNSRNEMMRCIHIGLLCVQENLADRPTMATIMLMLDRYSLSLPIPAKPAFYMNSRTESLPDMQSWEYN

SEQ ID NO: 218770 - protein, 679 aa, Glycine max
  Coding DNA Sequence Number=SeqID_101992
  Gene Ontology: Mol. function=protein serine/threonine kinase activity; Cellular component=mitochondrion; Biological process =protein amino acid phosphorylation
  Homolog annotation: Hit_ID=Q9XED4; Match level="QueryCoverage=98%, HitCoverage=100%, E-value=1e-166, Identity=47%"; Hit description =Receptor-like protein kinase homolog RK20-1
  Pfam annotation: Domain name=DUF26; Domain location=200-254; Score =85.9; E_value=1.2e-22; Accession=PF01657.8; Description=Domain of unknown function DUF26
  Pfam annotation: Domain name=DUF26; Domain location=80-134; Score =79.7; E_value=8.8e-21; Accession=PF01657.8; Description=Domain of unknown function DUF26
  Pfam annotation: Domain name=Pkinase; Domain location=356-615; Score =137.9; E_value=2.7e-38; Accession=PF00069.15; Description=Protein kinase domain
  Pfam annotation: Domain name=Pkinase_Tyr; Domain location=356-615; Score=86.3; E_value=9.4e-23; Accession=PF07714.7; Description =Protein tyrosine kinase
  Pfam module annotation: Pfam domain module=DUF26::DUF26::Pkinase::Pkin ase_Tyr; Domain location=200-254::80-134::356-615::356-615
MSPVPSMMLFSFISFLAILKSEAQDQLNFVYHECNNHFGNFTPAGVYGSNLNTLLSKVYSHEEIDNGYYNFSYGQNPNKAYAIGFCRGDVKPDKCRRCLDKSAVLLRERCPLQKEAIAWFDACMLRYTNHSIFGVMVTQPNNILCNTNNVSTKVLEQFDQAVDDLLSKLSNMTVDGGGSRRNSEFFAEGDAPVQSSNTTIYALLQCTPDISKQNCTECLQSALSEISTFCDGKMGGQYLGPSCSVRYETYLFFEPIVDAPAPAPQPATDQVTTPIGEEKRNPSRTIIAIVVPMVVVIVLLAIMYNYLGARRRRRNKPIQNEGEGDDDEGELANDIKTDDQLLQFDFATIKFATNDFSDANKLGQGGFGIVYKGTLSDGQEIAIKRLSINSNQGETEFKNEILLTGRLQHRNLVRLLGFCFARRESLGIYVDPNKRVNLNWEIRYKIIRGIARGLLYLHEDSRLNVVHRDLKTSNILLDGELNPKISDFGMARLFEINQTEASTTTIVGTFGYMAPEYIKHGQFSIKSDVFSFGVMILEIVCGQRNSQIRDSEENAQDLLSFAWNNWRGGTVSNIVDPTLKDYSWDEIRRCIHIGLLCVQEDIADRPTMNTVLLMLHSSSFPLAEPSEPAFLMRRKSSLPMIMLSGSEQYSEVTRSSDSGSQYAQGSSIVKTPTTEPYPR

SEQ ID NO: 218771 - protein, 128 aa, Glycine max
  Coding DNA Sequence Number=SeqID_101993
MKGGLKGPKKEQNYIKTNLGNPTSIVATIEFQSPTLIQLNSSPTSSHHLPHPTDPITPQVVAYSTTPLFAVYNMVDHKITIIMRGSSMIPESFIASHPDHTATPNPPSTTLPYQRLRTPNTSRSRINN

SEQ ID NO: 218772 - protein, 46 aa, Glycine max
  Coding DNA Sequence Number=SeqID_101994
MDNSLKVKKRLSFELQKVAVGLSSVVGLSATSARLAQRRIWQSVNI

SEQ ID NO: 218773 - protein, 100 aa, Glycine max
  Coding DNA Sequence Number=SeqID_101995
  Pfam annotation: Domain name=Tryp_alpha_amyl; Domain location=20-97; Score=-0.6; E_value=0.096; Accession=PF00234.12; Description =Protease inhibitorseed storageLTP f
  Subcellular localization annotation: CTP_CleavageSite=45; ConfidenceScore=5.04e-01
MGPKGVAFLLSLNLLFFSMIGSFNPSFPAQNDDPSSQISIISNQCCTAVAALPIIGGAFCFCRAVSLGILPPLATEILAQILFSACGRNNTIFDYNCQQD

SEQ ID NO: 218774 - protein, 321 aa, Glycine max
  Coding DNA Sequence Number=SeqID_101996
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=98%, E-value=1e-46, Identity=31%"; Hit description =UPI00006A17C9 related cluster
  Pfam annotation: Domain name=Cornifin; Domain location=65-259; Score=- 46.8; E_value=0.05; Accession=PF02389.6; Description=Cornifin (SPRR) family
  Pfam annotation: Domain name=Extensin_2; Domain location=56-321; Score=-140.0; E_value=0.079; Accession=PF04554.4; Description =Extensin-like region
  Pfam module annotation: Pfam domain module=Cornifin::Extensin_2; Domain location=65-259::56-321
EDYTSSPLKGYTPSPLEDYTSSSSEDYTSSPVEDYTSFTFQGLHVLTFRGLHDLAFIGLHVLAFKGYTPSPSEGYMPSPSEDYTSSECCTTSPSEHYTSSPSEGWTSSPTEYYTSSPSEYYTSSPSEDYTSLPSEGYTPLPSEDYTSSPSEDYTSSPSEDYTSSPSKDNTSLPSEDYMSSPIEDYTSSPSEDYTSSTSEGYMPSPTEDYTSSPSEGSTPSPSEDYTSSPSEGYKPSPLEDYTSSPLKGYTPSPLEDYTSSPLEGHRPSPLEDYTSSSSEDYTSSPSEDYTSLASKDDMSSPLEDYTSSPLEDYTSSPSEDY

SEQ ID NO: 218775 - protein, 107 aa, Glycine max
  Coding DNA Sequence Number=SeqID_101997
MAFKKTIATLLVLSRLRLEVSLLLYLSVVDETNLLEMTQPTCGSNDFQDYFDDAKESRVKQVPKNQESKSFKNQVSKNQDSRIIKFQDSRTIKIKIQDSRFKNQDKC

SEQ ID NO: 218776 - protein, 366 aa, Glycine max
  Coding DNA Sequence Number=SeqID_101998
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=33%, E-value=7e-94, Identity=51%"; Hit description=Chromo
SGSSDNFLQPRLAQCLKLPVEPIPNLQVLVGNGNALTIEGLIQDLEVKIQGHTLKLPVYLLPVSGADLVLGAAWLATIVPDLSDYSTLTLKFYLGNQFITLHVFDVPSGLPPRRTHNHSIPLVEGAGPVKVKPYRYPHSRKDQIEDGTWRFCTDYRALNAITIKDSFPIPTVDELIDELHGNRHKTAFRTHQGHYEWLAMPFGLTNAPATFQPLMNEIDYLGHTVSGKGVTMDQEKVQAVLNWPYPINLKQLRGFLGLTGYYRKFIKGYVSIATPLSNLLKKENFHWNDHTSMAFDNLKAAITKAPVLALPDFSKAFTLETDASGIGIRAVLSQEQHPIAFFSKKLTPRMQRQSAYIRESYATIEA

SEQ ID NO: 218777 - protein, 208 aa, Glycine max
  Coding DNA Sequence Number=SeqID_101999
  Homolog annotation: Hit_ID=Q1S0F5; Match level="QueryCoverage=56%, HitCoverage=30%, E-value=1e-10, Identity=35%"; Hit description=IMP dehydrogenase/GMP reductase
FSFQNMDGLVDLVAIDAFLAYHHSKESLVVREEQRTDYLLHTRSLCMVGFAPIPTRHKAPMSASKSSLEEKEGVLFSCGDYPNIPLIGMRGCINYNPALAIRQLGYPMKGAPTEESLSPFLVRDFGTQSLKIEWLRVHTRGLDWLSKLKIFNEENFETPEEDEEVQALKSKLGKARLAKDKFKLVATDIRKECAELREENAATARALE

SEQ ID NO: 218778 - protein, 159 aa, Glycine max
  Coding DNA Sequence Number=SeqID_102000
VVVSPAKPPPKPDPEVDDPLYLMTLTIPELFLRPYQVTWDATVFGVFNLDFSLYIKHEDLSEIAHDGQCLSISVLQLWILHFTDTSMRAGNSDIYGFLEPQSIQRSGQSQFKSESYIKSWMQSSKRDVYLGAYLNGPDNYLKGIINRLNQRLLLGGLSS

SEQ ID NO: 218779 - protein, 198 aa, Glycine max
  Coding DNA Sequence Number=SeqID_102001
MHDPTLNSMLTNLGWKDDESEPMTIKEEPVKEATVRCKHIVDLYALDSSLGIPTIALRCKGEIQREILTLKRKELALWRKEEIEEAKEILGQSKTLEGQIEDFGKAWEFGSKSRQRHHRRDTTISNPYSFSSHKHSYVKGCGKDKGLMIDHEEIEGIDDDKGDDKKLKDQSKNNSSESRTVQEFKIRIKKNSRLKKKV

SEQ ID NO: 218780 - protein, 84 aa, Glycine max
  Coding DNA Sequence Number=SeqID_102002
  Homolog annotation: Hit_ID=O22490; Match level="QueryCoverage=44%, HitCoverage=35%, E-value=1e-11, Identity=81%"; Hit description =Cytochrome C
MAAETATTRRTKTPPSPKAFEHVSLCGVVCGSFIWASMASFDEAPPRNSKNGEKIFKTKCAQCHTIDKGVDHKQGIYRHSSPSL

SEQ ID NO: 218781 - protein, 236 aa, Glycine max
  Coding DNA Sequence Number=SeqID_102003
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=4e-41, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=12; ConfidenceScore=5.62e-01
MKERACSPTKARACSPTKARACSPLKVRTCSPLKARACSPLKVRACSPLKVRACSLLKARACSPLKARTCSPLKVRACSPMKVRTCSPLKARACNPLKVRVCSPLKARTCSPLKGRACSPLKVRMCSPQKVRTCSPLKGRTCSPLKARACSPLKGRTCSPLKGRTCTPLKGRACSPVKARMCSPLKARTCSPLKARMCSPMMARACSPLKARTCSPLKVRAFSPLKARTYSPLKAR

SEQ ID NO: 218782 - protein, 680 aa, Glycine max
  Coding DNA Sequence Number=SeqID_102004
  Gene Ontology: Mol. function=zinc ion binding
MEDVYGNVEKTHRFSTTFNTMYILIATVFASLKVRIHKFLEKTRSHPSKPRLCFDAPSLEHCICNLPKRGSLTVITVGGVGESFVAVVLNKEWFYVDKVIRLPGKGSLKSAPRDENEVLNHILGQASDKVPSRQRSFGISSSSSNSNFDEKIRKIVSNDKPNVLRIDLRSTTQDELRKELERQADALEIQLRNSIKKILVKDDLTSELRELGWSDMDLHNEDKKSSNLSLEGEFSSPIGEAFTKTGEQKDNKIDKSQVVALKKKNALMLKRKAISINCSMNNDKELSNMHDHRDGFDFEHLLAIVDDLHGWTEPKNASSKSQTFDKEELLSEIQSLKRKSLNRKRAGNVEEAMKFLKKAKLLERGLNNSGPEDYNTMSQKSTVVRKGVSFEIAGTRSDSIQLDKRNTSATNNVASRVAPKSRLMIQRELLSLKKKALTLRREGKMNEAEKEMQKGAALECQLMEMDKAMNEGSEDDVTDQDMSDPTHLSLLRDLGWNDDNNDVSNSLSKPLKKYDDHFVPFNDASLSKHSTNILVQAPRSKAEIQKELLGLKRKALAFRREGKVEDVEEVLKMAKASEAQIVEMDTAKSKARVEIVVMKDRLFNPLVDEERCSRRQKRRGERRRHPLGNKPWKKELHHQDEPWIRSLEGCFNGGKERGREREMGGARNSRKKKGEKWNFE

SEQ ID NO: 218783 - protein, 328 aa, Glycine max
  Coding DNA Sequence Number=SeqID_102005
MAYYGERDQPGCEVSPITVVVEVTLVWLQEVECPYEPPCPEDVPPTPPAIETPVADATTPATLAPSPPPGVSVQEASFGVVLLSIVVAPLLSAGVATTSVSTLLPPSSLAMMVSPFAVLAAATLPFSSSHPRVSLEHMYTPSDAFHLLTLASPWNICTPLVMLIHCGVQLTSRSRRPRLALCQPLIRTLLGQLGATAHTLWRVEHPKVANATVAFVVAVRLNYQLSSKVGGVLAKLLRTRLDGDELFKCYKDLWVERKDLGGKVESIVAEKEKLTKVVSDLEAWLKELESMLEESELRATKEREANKELEEELLVYKKKAMEQHEKGF

SEQ ID NO: 218784 - protein, 112 aa, Glycine max
  Coding DNA Sequence Number=SeqID_102006
  Gene Ontology: Mol. function=DNA binding; Cellular component =mitochondrion; Biological process=DNA integration
MDRSKTTTGNYNQRVEKFTWKYHICRYDLPYAIVTDNNTQFKHLVTSIEHPQTNGQAEAANRVILKALRTRLDKSKGLWKEELYNMLWAYTIVHPRQQLMKLLTDSHMTQIS

SEQ ID NO: 218785 - protein, 132 aa, Glycine max
  Coding DNA Sequence Number=SeqID_102007
MPLVVGGIYWSRDGNMLLHICHSPWVAYIGVIMAYSYMHASYKVAHTGDIVICSCIYVTRCGWHILESWQCARANMSLAVGGMCCRLSRACMRISHSPWVTCTGDIMLEEGLTKGEPWVLRASELRLWMLLS

SEQ ID NO: 218786 - protein, 340 aa, Glycine max
  Coding DNA Sequence Number=SeqID_102008
MASKKRKSSISRPQEPYDTTRFISEVAWERYEQNMHSRNILLERNVDLYVTQYDEFRKELERQRWHKTLTMQPDGHIDVALVKEFYANLYNPEDKSPRQCRVRGKLIKFDAEKLNAFEEIPVFLEPGVRYSTYSRSTLEAPEEGSYYSRPDLEYAFILQPCPHLSYVAQSNSSWIGFPALITALCIAKGVTRARGASNASTSAPTSTSAPAPTPAPPQITAPSSPSAQSSDVLVSMLQSLHHSLCLVMQSIHDLAQHRPILSMEDFMAQVAWPGVQPSPTGGGEAPIAQEPHLELEDTPDETPEDILAATPLEATEEGDGATDTDYAAKQRKAPGTLGPL

SEQ ID NO: 218787 - protein, 108 aa, Glycine max
  Coding DNA Sequence Number=SeqID_102009
MAKLGRQCARTDNNQNFNLEIKATNHHHNSISSRHHIGNLENKKSLTRLLLGIDLEHIEEAKEHHLDEDALIPHGVAPYRACRPWIFFINGVLYFLKINGSRMEKVER

SEQ ID NO: 218788 - protein, 56 aa, Glycine max
  Coding DNA Sequence Number=SeqID_102010
MRGTMHEPQANLRVDQKFSPEKENPRGFTLAHWRKKLIRPGARGKCPKTIVIIGYI

SEQ ID NO: 218789 - protein, 78 aa, Glycine max
  Coding DNA Sequence Number=SeqID_102011
MVEWVGVMKENLGFGRMKVGDGKNKCLMEEGEESIVAIGMEKDFRRIVEMLVWLAVEFLKYGCNNNGFGGYNDCGGHQ

SEQ ID NO: 218790 - protein, 149 aa, Glycine max
  Coding DNA Sequence Number=SeqID_102012
MFSHSGVSSLSSFSIPLPFIFQEAKESIDEEDPRPTSSNGACIISSQLPLVRSLQISIFYFCQLQCFKGSWTFQLPKARLLSETGRAKREKRQRPRWAGWLHAGVSQPAKQVVYLALWMSLAKRICLVERVISYLNLLFFGLKLSWIQH

SEQ ID NO: 218791 - protein, 82 aa, Glycine max
  Coding DNA Sequence Number=SeqID_102013
MNANKIEELTVKLAFQSTFVVDKEGGRQGLGLFSHENLECNIMSHSTNFVRAKWAISSFGRGVKGKKMQWKRGWIVPWLHYN

SEQ ID NO: 218792 - protein, 942 aa, Glycine max
  Coding DNA Sequence Number=SeqID_102014
  Gene Ontology: Mol. function=RNA-directed DNA polymerase activity; Cellular component=chromatin; Biological process=chromatin assembly or disassembly
  Pfam annotation: Domain name=rve; Domain location=577-733; Score =91.8; E_value=2.1e-24; Accession=PF00665.16; Description=Integrase core domain
  Pfam module annotation: Pfam domain module=RVT_1::rve; Domain location=280-500::577-733
  Subcellular localization annotation: CTP_CleavageSite=60; ConfidenceScore=5.68e-01
MPPLAPPQPPSVTPFASPRGSSLPSLLPLPPRPALPSTPTVRRLTPEELASRHEHGLCFLCDEKFHMGHRCAPRVHLLIADEDDPVETVGSNIDPHDPIPSLIDIPDPPTQISLNSFPGHVAPETLRLVGNIADNPILVLIDGNGQHLECHTVCEAITIDLQMQSFIVDLYVLSIAGANVILGWSSFKGIMKLMLPDAPEPVLTEPVDPTIQHLLHHFSVLFQDPNTLPPTRETDHQIHLLPHATPVNVRPYKYPYYQKQEIETQVEAMLQRGIIQPSTSPFSSLVLLVKKSDDTWRFCMDYRALNALTIKDRFPIPTINELLDELGGARCFSKLDLLQGLAGFYHHFIHGYATIAAPLVKATTIEPFQWTSSTKIAFETLKQALTSAPVLALPDFRLPFTVETDASAIEMGAVLLQQGHPIAFLNKPFSLKMLRASTYVRELFAITVAVKKWRQYLLGHNFTILTNHQSLKELMTHNQAANALSRLPESDSQAFLILSVPCLTFMDELHTQLSADLTFQQQMKNVQEHPDHYPESPLLANSGSPYGQFPCNSRYVDCQVTKYKTKKLAGLLCPLPVPSRPWEDLSLDFIGGLPPYHGNTMILVVVDRFSKGIHLGMLPQSHSALTVARLFLDMVVKIHGMPRSLVSDCDPLFVSHLWQELFRSSGTQLRMSSTYHPQSDGQTKVLNRVVEQYLRAFVHRKPTSWGRLLPWVEWSHNTSWMTNTDTSPYEITFGRKPFNIPEYIVGSSKIDAVEELLTEREATFQMIPKIGPVAYRLELPEGARLHLVFYCSNLKPFRGELESTKPPPLPLNFQDNQPIISPLTILSYRRASSDPHSPWEALVQWHGLSPKETSWEDWKQLCQDYHLEDKVILQGPKDDTGWLRYKGCGMLQQDTLSKWMWRFLNEKDALWVNIIKAKRKEGEDILCEPKTSSWWKEIWKVC

SEQ ID NO: 218793 - protein, 375 aa, Glycine max
  Coding DNA Sequence Number=SeqID_102015
  Gene Ontology: Mol. function=protein binding
  Homolog annotation: Hit_ID=Q1SJP5; Match level="QueryCoverage=90%, HitCoverage=93%, E-value=5e-65, Identity=42%"; Hit description =Cyclin-like F-box; Serine/threonine protein phosphatase, BSU1
  Pfam annotation: Domain name=Kelch_1; Domain location=117-159; Score =1.1; E_value=2.8; Accession=PF01344.15; Description=Kelch motif
  Pfam annotation: Domain name=Kelch_1; Domain location=161-209; Score =37.9; E_value=3.5e-08; Accession=PF01344.15; Description=Kelch motif
  Pfam annotation: Domain name=Kelch_1; Domain location=211-257; Score =35.1; E_value=2.5e-07; Accession=PF01344.15; Description=Kelch motif
  Pfam annotation: Domain name=Kelch_2; Domain location=106-159; Score =2.0; E_value=21; Accession=PF07646.5; Description=Kelch motif
  Pfam annotation: Domain name=Kelch_2; Domain location=161-209; Score =22.5; E_value=0.0015; Accession=PF07646.5; Description=Kelch motif
  Pfam annotation: Domain name=Kelch_2; Domain location=211-257; Score =8.2; E_value=3.2; Accession=PF07646.5; Description=Kelch motif
  Pfam annotation: Domain name=Kelch_2; Domain location=262-302; Score =12.9; E_value=0.76; Accession=PF07646.5; Description=Kelch motif
  Pfam module annotation: Pfam domain module=Kelch_1::Kelch_1::Kelch _1::Kelch_2::Kelch_2::Kelch_2::Kelch_2; Domain location=117-159::161 -209::211-257::106-159::161-209::211-257::262-302
MRVRELSPSDGNGSSTNEDEPLPQDADYINVLSLSDELETSILARFPRSQHWKLCFLNKRFLALSRSGEIYKIRRELGFKEPSVFMLVSGESNWWGMEWPFMSSKKLPPIQSDYNFEFGDKESFCAGSHLLVSGKEIDGAVIWRFNSIKNEWRKGPSMINPRCLFASATCSAIAFVAGGLDAGTYTQVLDSAEKYNSESRCWEPLPRMNKKRKFCSGCFMDNKFYVLGGQDEHGKDLTCGEFFDGKANSWNLIPDMWKDIVSQSPPLLAVVNNELYTLDASSNELKVYVKGTNTWKTLGVVPVRADAQGGWGVAFKSLGDELLVIGAPSMPHIVHALSMYTCCPDPDDEKLRWRQIGCGSIQLNHFIRNCAVMGT

SEQ ID NO: 218794 - protein, 241 aa, Glycine max
  Coding DNA Sequence Number=SeqID_102016
  Gene Ontology: Mol. function=transferase activity; Biological process= RNA-dependent DNA replication
  Homolog annotation: Hit_ID=Q1SI60; Match level="QueryCoverage=89%, HitCoverage=61%, E-value=5e-15, Identity=34%"; Hit description =Immunoglobulin-like
MGIILLYFGVANEIKSSSSSDIYKYPSLEGSWVVVSSGAVIRVVKGLSKVVFAIIMSLEKHLVERFAMIAWSIWQCRNGKLYMWVDKMGTPRQNCKRNSLETPHRRCVGMIPRQLSLASKEVLVDWKHVDIPIREGEALVVLASIKWLMDLDTWLAFVEINCKQVVDALKCNSGDFFEFGSIISQCKVLLCMVPNFQVSFVRRQAILEAHALARASRNYACLTSFCIIPYCIVGNIINETS

SEQ ID NO: 218795 - protein, 72 aa, Glycine max
  Coding DNA Sequence Number=SeqID_102017
MSLSLLLLLLLLLLFFFFFFFFFFFFLLRYQGNYKQLGLNPELGLNPELGLDLKRVDNFILSNLILSRFYFI

SEQ ID NO: 218796 - protein, 90 aa, Glycine max
  Coding DNA Sequence Number=SeqID_102018
MEVIKGNNSKSTFKMNAYKVKAYYEGFQQVQNIVHLSNLWATYPSHVRLVTLNKSMAMEWRRGKGDWRCHFKEKMSQEQAHHYRKPWIRA

SEQ ID NO: 218797 - protein, 93 aa, Glycine max
  Coding DNA Sequence Number=SeqID_102019
MPSYAKHLKVVLSNKGKLENFGTVGLNKECSAMKLDITDLDPTNITLHLVDRLVVYPRRAIEDMLVKVDKFIIPVDFEILDVEADEDVPIIFE

SEQ ID NO: 218798 - protein, 105 aa, Glycine max
  Coding DNA Sequence Number=SeqID_102020
MTYNRYTRGQSKQFKGTYGKCRVVITRLRALFLVSAGDSHATLGILDLSGAASMVGESVMSCYVWDLTFVFLVAQGMEYSLPHYHIQKQLMSAVSPPSFYIDAIG

SEQ ID NO: 218799 - protein, 126 aa, Glycine max
  Coding DNA Sequence Number=SeqID_102021
  Gene Ontology: Mol. function=RNA-directed DNA polymerase activity; Cellular component=chromatin; Biological process=RNA-dependent DNA replication
MRWLEFLKDYDFELSYHPIKANVVVDALSRKSLHISALMIQKLNLIEQFRDMSLVCELTPKTVRLGMLKVTNGLVDEIIKGREWEYLEYSPRSHQDVSRPQKDVMAVWYEEGGSQVYVCMSSVLES

SEQ ID NO: 218800 - protein, 112 aa, Glycine max
  Coding DNA Sequence Number=SeqID_102022
  Homolog annotation: Hit_ID=Q0ZCB6; Match level="QueryCoverage=48%, HitCoverage=10%, E-value=4e-13, Identity=69%"; Hit description =Integrase
MCNASDYAVGAVMGQRKNKNFHVIHYASKEFDLEIKDKKGSENYVADHLSRLTIDEVKKRLSHEVLKVTIELSSSQLSSARLSARLALRSNPLTHAKRKGGTKCNVTNSEPI

SEQ ID NO: 218801 - protein, 187 aa, Glycine max
  Coding DNA Sequence Number=SeqID_102023
  Gene Ontology: Mol. function=structural constituent of ribosome; Cellular component=ribonucleoprotein complex; Biological process =translation
  Homolog annotation: Hit_ID=Q41912; Match level="QueryCoverage=72%, HitCoverage=94%, E-value=4e-61, Identity=85%"; Hit description=50S ribosomal protein L2
  Pfam annotation: Domain name=Ribosomal_L2_C; Domain location=43-164; Score=215.4; E_value=1.3e-61; Accession=PF03947.8; Description =Ribosomal Proteins L2, C-terminal domain
MEKTKLFQAPTEPEAPFVSKFQRGEDGYHHLLPESRMLCKKLVQVGEEARQIHNIEITLGKGGQLARAAGAVAKLIAKEGKSATLKLPSGEVRLISKNCSATVGQVGNVGVNQKNLGRAGSKCWLGKRPVVRGVVMNPVDHPHGVGEGRAPIGRKKPATPWGFPALGRRSRKRKKYSDNLILRRRTK

SEQ ID NO: 218802 - protein, 93 aa, Glycine max
  Coding DNA Sequence Number=SeqID_102024
  Subcellular localization annotation: CTP_CleavageSite=30; ConfidenceScore=5.07e-01
MLEPLPQLPFTPIYRKKALGGLVARPGEPRLTPKVTGSPRRVDSFSLKSFGGSGELEASLGELWSKKLKEKTLMPPFCVEQRKSTSKDQKING

SEQ ID NO: 218803 - protein, 247 aa, Glycine max
  Coding DNA Sequence Number=SeqID_102025
MKTDMEAMKKKMTTMMEAMISMRKVMEVNMATIIVASQGGKALESAGSPYFVQVHSKHSFQSYGLPPNYTPPNVAHTPNENVDNSAPIPIESQQPQSGHAHVSQPMGEAHNVPRGHALANFKPHLGHATEGQAFCGEPLPNTLGGPQYRPQSQPLHFAVGRVPPGMVKRERFDHIKERLRAIEGGGDYAFADMVELCLVPDIAIHPKFKVPDFDKYKGTTCPKNHLKIYNRKMGAYSKNDKLLMHFF

SEQ ID NO: 218804 - protein, 32 aa, Glycine max
  Coding DNA Sequence Number=SeqID_102026
MRGTMDEPQANLGADKKFSPGSTHVIKLQWDR

SEQ ID NO: 218805 - protein, 91 aa, Glycine max
  Coding DNA Sequence Number=SeqID_102027
AKGHFGAVAARPGELKLSAEAMSLPRRVGFFTMKLFGGPAEPEASLAFNTVSQLPRIKRSMNDSPRTKLGYDNMLQINSKSTNHNFPHTMC

SEQ ID NO: 218806 - protein, 88 aa, Glycine max
  Coding DNA Sequence Number=SeqID_102028
  Gene Ontology: Mol. function=RNA-directed DNA polymerase activity; Biological process=RNA-dependent DNA replication
  Homolog annotation: Hit_ID=Q1SAS4; Match level="QueryCoverage=97%, HitCoverage=5%, E-value=2e-24, Identity=46%"; Hit description=RNase H, putative
MEAVLPFEVEVPSQKILAESGLEESEWAQTRYDQLNLFEDNRGKWALNYEGPFIMKRAFSRRALVLTNMDGEELPSPVNSDVVKRYYA

SEQ ID NO: 218807 - protein, 223 aa, Glycine max
  Coding DNA Sequence Number=SeqID_102029
  Pfam annotation: Domain name=Transposase_23; Domain location=37-107; Score=-4.3; E_value=0.0034; Accession=PF03017.5; Description =TNP1ENSPM transposase
MQSHGLTLPPELEVGPSAAHVSTKESCVDHSGNDPGTGDSEKCELYVEENPPCLVALGRLYEGSTTIHNIPLLHDQVKVGVEEVRDADSPIPVPTKEVQLVGQALNTVVGPAKPADRPDHDVNDRLYQMTLTIPQLFLKSLQVMWDATMFGVFNDNFPLYIKPEDLIEIAHGDQYLSISVIQLWILHVNETKSYIKNWMQKSKMYLRASLLEWCTLANACHFA

SEQ ID NO: 218808 - protein, 60 aa, Glycine max
  Coding DNA Sequence Number=SeqID_102030
MDKDVREVLRAGPKYCLIVTPTPAARTRPGYSGRPMAIVSTSLHPWATKEPCEACSSKES

SEQ ID NO: 218809 - protein, 84 aa, Glycine max
  Coding DNA Sequence Number=SeqID_102031
MDALLLFYYEKIVGYMPSNFADLVFAGERIEAGLRKGKFNYVASVNPSNGGPKRSGERKKEGEPHVVAAVPAWPNFPLTPYNPM

SEQ ID NO: 218810 - protein, 76 aa, Glycine max
  Coding DNA Sequence Number=SeqID_102032
  Subcellular localization annotation: CTP_CleavageSite=60; ConfidenceScore=5.03e-01
MRVHCYQASRRPDMIIDSPPLLMFPWTRINRPNSLKTLPSGVANCHNLPFGGRVTQRLTGASSKEGECAKSPSTFI

SEQ ID NO: 218811 - protein, 76 aa, Glycine max
  Coding DNA Sequence Number=SeqID_102033
MTLFCTCFLIEQKDHTHDLGSTGFSRRWDGISPVENDFERQSQRKNHLKMGFPLPAVIYLAENLFGPKILVLSFFY

SEQ ID NO: 218812 - protein, 271 aa, Glycine max
  Coding DNA Sequence Number=SeqID_102034
MAACNRLQHPVIDYQKAYYSCNRLPSLVIDYNSSSSINTHEIRVVAQSWPSLTPPPYLNLPTFVSHSILHQITSRKAQSSSFSLLFHYHGIRSTKTSSNGRAIEEEKGIILHRRYASHHRHGPSGAPTAPIHPSLSSPRSSTLFSSDYQRLRYLSQFSSRIILDPKYLDVDFFNDETFDCYQVFQNSGLVDFMSLKLPHYPELVKVFYFNLKIQDGIITSEVLCIPMVIDQSLFFSLTHLPCQGAPFEGTIVDDWKFDYSGHDARRMVCTD

SEQ ID NO: 218813 - protein, 100 aa, Glycine max
  Coding DNA Sequence Number=SeqID_102035
MKASEVTTTISKEEREREKEHGSWPCCCRWYRYSPPQSGERENEEDEGAMLLPQLAHRHALKSSITHTRWKMKVKEEERKGIRQRWKMEKPLAQKRERLA

SEQ ID NO: 218814 - protein, 107 aa, Glycine max
  Coding DNA Sequence Number=SeqID_102036
  Homolog annotation: Hit_ID=Q9LF79; Match level="QueryCoverage=37%, HitCoverage=3%, E-value=5e-09, Identity=67%"; Hit description =Calcium-transporting ATPase 8, plasma membrane-type (EC 3.6.3.8) (Ca(2+)-ATPase isoform 8)
MDMMVVYQEGAYERLCRWVQAECRKLGDTDNPEVSELSKTAVHYLKEKSVLFKYCAEQFFLGLKFGHLPREHDTAALQQYGGVVGLSNLLKTNPEKGIHGDDADLLK

SEQ ID NO: 218815 - protein, 373 aa, Glycine max
  Coding DNA Sequence Number=SeqID_102037
MTSARRTSESSLQRARRPERRWDRSFSALVIVAVLGVCVSRHKDVIRSSPPKPAGVDACDFANLFEDMWEEKDAEALLRVIEKRGGADESVRQKFMQDLFSVFHSHGVKFWLEEGTLIQMVRNVTGMPDEPATLPFGDIDVGIRDTELFASGPLAQAMVVLKLHRFRIIRCHRPIFTLERDGDYVDVMVFASSAPACQVREPNSVHKCSDGIAPYVLHTHQQQWNFLKGGLVSLPGSSLLETVDYLEAMFGTTWYQHDVPNWRRTQSPNPGGGGSSANWERTDSRLKSKPKRFTLDRLGAVPDPKMCAAPCLYTFQSVLAHGKRLVRIDDYPYPDKTPIALQRKWLEQAIMPFERSGVPYLLGVSPHRLAYDD

SEQ ID NO: 218816 - protein, 224 aa, Glycine max
  Coding DNA Sequence Number=SeqID_102038
  Gene Ontology: Mol. function=binding; Cellular component=membrane
  Homolog annotation: Hit_ID=Q0YPD9; Match level="QueryCoverage=75%, HitCoverage=39%, E-value=5e-15, Identity=33%"; Hit description=TPR repeat
MRGASATLFALALVFFRRIHAAEREAVRATRFNARNFCEQTSTRELEPWNNHKKVLSFSLFAPSSEGEEADFPWFLNGVVQNAKDAKLYYPDWVVRVYVIGLDIKTEGILLRQSNIELVRCELTLPLNSSSSRKMLTRFLVYDDPKVSVAVVRDADSRLSPRELFAVNAWISSDFCFHVMRDHASHDVAVLGGMFGMKRGALRDASMSQLITRALIENPPHIRG

SEQ ID NO: 218817 - protein, 377 aa, Glycine max
  Coding DNA Sequence Number=SeqID_102039
  Gene Ontology: Mol. function=alpha-amylase activity; Biological process=carbohydrate metabolic process
  Homolog annotation: Hit_ID=Q6PYY8; Match level="QueryCoverage=71%, HitCoverage=26%, E-value=5e-63, Identity=45%"; Hit description=AAMYI
  Subcellular localization annotation: CTP_CleavageSite=51; ConfidenceScore=5.24e-01
MRGRTGACGAVIPTSGRLARGGGGDARRTRAAFGRRDTRASGAGGVDRCVRSMSLPRSAIGGERERERARETRTRARAPATRRTKSFTGELVSTTRSTISTTTTTRALSGSEAGAMTLELDVAHGPAKEEFYAESFTVSQRARVEDDIRIRVETNGVRYRVSVETDLASNDLLLHWGVAETKERWDEWKNPPEKIRPKLTREIVGVCQTKFTSGPAQRFGSSKLQTTIEGDVIDGFYAINFVLYDKKLDQWIHNKQGGFWHVHLPQPPQPETVTRTVTRTEEYEDEIEEEEEYEEEVEEEEEEETASTPMVNLDLHAQASVDAPVKEEAISSSSLSTTTTPSNTWRRLLTPPVDPKPFTGASDDIDSLMQSLMAERQ

SEQ ID NO: 218818 - protein, 161 aa, Glycine max
  Coding DNA Sequence Number=SeqID_102040
  Gene Ontology: Mol. function=phosphotransferase activity, alcohol group as acceptor; Cellular component=cytoplasm; Biological process =metabolic process
  Homolog annotation: Hit_ID=Q2R8T7; Match level="QueryCoverage=93%, HitCoverage=40%, E-value=2e-12, Identity=32%"; Hit description=GHMP kinases putative ATP-binding protein, expressed
RAVVENLDTSNLPPLFLVWLERGNASHSGRVHSRVKKRFEDGERSIVDAVQRLSALTERAAACVRQSSNAVASALPELMNLNFTIRRELFDDDELGVLNLEMVRVLRDECGYGVKFAGSGGACVVAGAGVDDAGAELLARACRARGWKHERIAIHPPHHAT

SEQ ID NO: 218819 - protein, 261 aa, Glycine max
  Coding DNA Sequence Number=SeqID_102041
NALASKRAASVENERLGVERRANVHDLRNLRTTPSHHDISQSSRLPRALEVILRRRASTRRRAPRASDDSPPARPRERPRSVLAPVTIQRASSRARPLPVLAASTPRASSSLDEDARPPKRWAVADRRPLFFPPVSPRLARAFHLERDARTALKSDDLERARERCPAACAGREDRALDGNSPSRFIPQRLTKGRDESALEKQCLHFFKKPFAQGGSMASRESSMENRESSGVVYWEPLEGREESVRGGGDRGRFVTRSRRS

SEQ ID NO: 218820 - protein, 716 aa, Glycine max
  Coding DNA Sequence Number=SeqID_102042
  Gene Ontology: Mol. function=DNA photolyase activity; Cellular component=mitochondrion; Biological process=protein-chromophore linkage
  Homolog annotation: Hit_ID=Q5IFN2; Match level="QueryCoverage=70%, HitCoverage=92%, E-value=0.0, Identity=78%"; Hit description =Cryptochrome DASH, chloroplast/mitochondrial precursor
  Pfam annotation: Domain name=DNA_photolyase; Domain location=170-363; Score=57.7; E_value=3.8e-14; Accession=PF00875.8; Description=DNA photolyase
  Pfam annotation: Domain name=FAD_binding_7; Domain location=411-676; Score=136.4; E_value=7.7e-38; Accession=PF03441.4; Description=FAD binding domain of DNA photolyase
  Pfam module annotation: Pfam domain module=DNA_photolyase::FAD _binding_7; Domain location=170-363::411-676
MKRAMLDGAVPGEAGAFDTLKPTHIEVKETKKRPPPSENALARRQFVTGFGNKRERQEATESSKRDKERRKNHNSHNPTRTRSDARPRLARRVKSIVAIHFSFRRALCGVAPAVFTPRECAIVATSSYTFSTSPVLELGRQRGRGARGVREIARSMTSDTSAPAASPGRTRIIIWFRNDLRLLDNAVVTRAAELFKRSGKTAEVVPVYVFDKTFFQTTKRGTERFSAGRAKFVLECVEDLKKSLRERGSDLLVRSGNTVDVIRELTLTGANERTVVLTQEEVTSEETNMDRVVERMIKDRARSGAAAATMERLWGSTLYHIDDIPFDVEGGLKDLPDVFTPFRKKVETKSSTRESMPAPGKNALGSMPPDVAGLEWVPTPSDLPFVSAETTKACEEWIKDGPHGSSVFDFKGGESHALARVKYYLWDSDLLASYFETRNGMLGGDYSTKLAPWLALGCVSPRYVANEIRRYESERVENKSTYWVIFELIWRDFFKFFALKHGNKIFHLHGTTHRRASWKDDEKIINAWKTGTTGYPLIDANMRELAATGFMSNRGRQNVASWLALDAGIDWRYGADWFEQHLLDYDPASNWGNWCAAAGMTGGRINRFNIAKQTKDYDPTGEYIKTWVPELTQIPAAYIADPNQAPRELRDRIGLDYPNKISLPRRDFTELGSPPGPNKRGGGGGGRGGRGRGGRGRGGKPRGSSAPRSIHEAVYG

SEQ ID NO: 218821 - protein, 446 aa, Glycine max
  Coding DNA Sequence Number=SeqID_102043
  Gene Ontology: Mol. function=transferase activity, transferring glycosyl groups; Biological process=response to oxidative stress
  Homolog annotation: Hit_ID=Q9M2R0; Match level="QueryCoverage=99%, HitCoverage=57%, E-value=0.0, Identity=86%"; Hit description =Anthranilate phosphoribosyltransferase-like protein
  Pfam annotation: Domain name=C2; Domain location=37-128; Score=76.3; E_value=9.9e-20; Accession=PF00168.20; Description=C2 domain
  Pfam annotation: Domain name=PRT_C; Domain location=291-446; Score =423.6; E_value=2.7e-124; Accession=PF08372.1; Description=Plant phosphoribosyltransferase C-terminal
  Pfam module annotation: Pfam domain module=C2::PRT_C; Domain location= 37-128::291-446
MRICLEGGYHVLDESTHYSSDLRPTAKQLWMPGIGVLELGILNAQGLMPMKTKDGRGTTDAYCVAKYGQKWVRTRTIIDSFAPRWNEQYTWEVFDPCTVITIGVFDNCHLHGGDKAGGARDAKIGKVRVRLSTLETDRVYTHSYPLLVLHPNGVKKMGEIHLAMRFTCSSFVNMMHMYSRPLLPRMHYIHPLTVSQLDSLRHQATQIVSMRLSRAEPPLRKEVVEYMLDVGSHMWSMRRSKANFFRIMGVLSGLIAVGKWFDQICNWRSPITTILIHILFIILVMYPELILPTIFLYLFLIGIWYYRWRPRHPPHMDTRLSHADSAHPDELDEEFDTFPTSRPNDLVRMRYDRLRSIAGRIQTVVGDLATQGERLQSLLSWRDPRATSLFVIFCLVAATVLYVTPFQVVALFTGIYVLRHPRFRYMLPSVPLNFFRRLPARTDCML

SEQ ID NO: 218822 - protein, 62 aa, Glycine max
  Coding DNA Sequence Number=SeqID_102044
  Subcellular localization annotation: CTP_CleavageSite=21; ConfidenceScore=5.31e-01
MNKTFMMKAWWRLSTRKDSLSAQVVRHKYKCVSVTPFSSPSGSGRVWNKLDFTFGRWPRRHF

SEQ ID NO: 218823 - protein, 137 aa, Glycine max
  Coding DNA Sequence Number=SeqID_102045
  Homolog annotation: Hit_ID=Q2UZS6; Match level="QueryCoverage=47%, HitCoverage=13%, E-value=5e-17, Identity=62%"; Hit description=Auxin influx carrier-like protein 1
MALTPFEGLLGVKFLLGLSFFVQAPGEIPYRRVYYDPQKRKNMSWIRGTALTYSELVCATTVFVPSFHNYRIWSFLGLGMTTYTAWYMNIAAIAHGQVHPKSKAKLTKKDERIVSNFLPTWTEQELSHIHNIFKLIN

SEQ ID NO: 218824 - protein, 72 aa, Glycine max
  Coding DNA Sequence Number=SeqID_102046
MSSRTRCMLLSSFVMGSRKVYITFLTTHMGHCVPECASGSNLARLGELGGNQLPRFVKKWVSGASETPVMLP

SEQ ID NO: 218825 - protein, 225 aa, Glycine max
  Coding DNA Sequence Number=SeqID_102047
  Homolog annotation: Hit_ID=Q014C9; Match level="QueryCoverage=96%, HitCoverage=31%, E-value=3e-50, Identity=50%"; Hit description=[P] KOG1161 Protein involved in vacuolar polyphosphate accumulation
  Pfam annotation: Domain name=DUF202; Domain location=80-210; Score= -22.1; E_value=0.051; Accession=PF02656.6; Description=Domain of unknown function DUF
PHAVYKLPHWFDEGFEERRAKAVDEPTSRFASSGSFADLLRTTITNALGFRKHGVAKEERRSASDGEPDVEAPDSRRLQTRHVPVKVEPKTFFANERTLLQWLSMAILLLFLGLGLMTLETAGSSVSGGTPNVSAAVFGGGHSHASAVCGVIIAPIAVVFMIYALWTFIVRAKRIARREPSTRYDDVFGPVALVVILCVVATASIALSAASVDWNRHAYARPTRS

SEQ ID NO: 218826 - protein, 75 aa, Glycine max
  Coding DNA Sequence Number=SeqID_102048
  Gene Ontology: Mol. function=DNA binding; Biological process=DNA integration
MDSAEISNREIKRILGKIVQPRRKDWSTMLDDALWAHRTAYKAPIGMSPYRVVFGKLGLMSGKLRSKWIGPFVCY

SEQ ID NO: 218827 - protein, 133 aa, Glycine max
  Coding DNA Sequence Number=SeqID_102049
  Homolog annotation: Hit_ID=Q1RWU8; Match level="QueryCoverage=81%, HitCoverage=20%, E-value=2e-07, Identity=27%"; Hit description=Di -trans-poly-cis-decaprenylcistransferase
MWKIMAKEWEEIDKLWRKKEMHNLAKELVNLLAPKDYSWRNTAIARDRTVSMGRSQQEGKSKEIKGEQEGARKPTYTPLLMAACNGITEIVEVIIHFHPHSIEHVSDDEQNILYMAVKHRQKKIYQILKKLKM

SEQ ID NO: 218828 - protein, 145 aa, Glycine max
  Coding DNA Sequence Number=SeqID_102050
MVASNKIAKVRLGFILYQTARQAWKIPLRLKGSSQCGVSTKNNGSPWWPPVVVGGGEEAWDVREGFWKTEGERNEKKCFSRTKRHIADRNGKIMKICPLNLQTKFREDPMVIECRRVLLPRQLQAASLRIFSREASMRSFLERLL

SEQ ID NO: 218829 - protein, 126 aa, Glycine max
  Coding DNA Sequence Number=SeqID_102051
  Subcellular localization annotation: CTP_CleavageSite=73; ConfidenceScore=5.82e-01
MAESSKKRKGSSASASASRAHRSGATSASTAPIPPSLSSSPVFSSNEQQKRYSNLFSSRSIIDPNFIDMEFFSAETFDCIQAFQNLGLLPFMSLQLPIYPELVKAFYCNLEIQDNTLISEIFGIKM

SEQ ID NO: 218830 - protein, 42 aa, Glycine max
  Coding DNA Sequence Number=SeqID_102052
MSEIRRFGGLGMEERRERKGVAQGFLENVIFIEQDAWPSVLV

SEQ ID NO: 218831 - protein, 125 aa, Glycine max
  Coding DNA Sequence Number=SeqID_102053
QSNTSRLGFPTLITALCGARGVVSDSLTFERLSPVINLAYIRKNCWNPEDLTIFIRGARRARARLTELPSTSIAPTPASTSVAPSVPAKTNSQCFKAMLQSIHQGQIILLQSLQMMAPPDSIPIV

SEQ ID NO: 218832 - protein, 80 aa, Glycine max
  Coding DNA Sequence Number=SeqID_102054
  Subcellular localization annotation: CTP_CleavageSite=48; ConfidenceScore=5.18e-01
MWPHKPTQALINTVSRAWNISRVSRPSRDGHSSDRDRGGCGMMNFRTSLEEVEPYSQDRQTCDLSFITTFSYFLILLFPL

SEQ ID NO: 218833 - protein, 52 aa, Glycine max
  Coding DNA Sequence Number=SeqID_102055
MSDPSFLGDPTVPSSEGKDRNSHPGSRFMKFYAKLVMHAHMWTLKHQVFMVM

SEQ ID NO: 218834 - protein, 83 aa, Glycine max
  Coding DNA Sequence Number=SeqID_102056
MEEAVEIMDTLGKMKPIARPLWILFSSKFPTKEIMKIGMMMIKEPKTNLLEKEKLLLLAVWDIKYFKFSNTFSFILHEFYKHE

SEQ ID NO: 218835 - protein, 131 aa, Glycine max
  Coding DNA Sequence Number=SeqID_102057
  Subcellular localization annotation: CTP_CleavageSite=53; ConfidenceScore=5.06e-01
MEEEISLQEKNITMKIIYFSTLSSVASSQHNTSADQMTSMNTKGSTPLPTHIVSTMTSNKGIKLILIPGHEEECKKVWETHVLLLASLNSKNICFGGPYRPELDYEAISGWFTTYEDENPITTRKPLGVTS

SEQ ID NO: 218836 - protein, 96 aa, Glycine max
  Coding DNA Sequence Number=SeqID_102058
MASNHSRAQKKAKTSKRKQEKCSQVSLNRLGTWFADESKKNDFKMIYAVKNVRIPSIGSIQACADGRNFLSGASENLLYLCMCRFGRRIISNWVSI

SEQ ID NO: 218837 - protein, 172 aa, Glycine max
  Coding DNA Sequence Number=SeqID_102059
MPTQGQFNRIPSYWQSPELGEFKLNCDEAVTSGGESACAGVLLDDKVSQPTLRREGDAGLTGASSKGGRRVESPPTFIRGKRRKNRNVWSMNFKCERFRSCFYTRGRTNNARRMTKNGKNLDEIAHGNVSEALRKHLGLNFLHENMFFSPKTAEMHSVGVKNPLEQPALAYL

SEQ ID NO: 218838 - protein, 126 aa, Glycine max
  Coding DNA Sequence Number=SeqID_102060
MGSFLKYFREGALLDVKRMHAAPKPPVELASLVSVKKSPVLMAIYVPVGTASQTGEFQVHDEFGYNSVVFQWKGSKKAIQIKRGISFSALKKKIGDKENILPCKFVMRKTLKRCWKVLNNNNKYQF

SEQ ID NO: 218839 - protein, 123 aa, Glycine max
  Coding DNA Sequence Number=SeqID_102061
MKLFLYTASLPFLSLPIFVKGTDLRLVVVEVAFQRLPFLPVNNHETSALSIGYPSSFQPVVNPVDICSTTPSFGTVMLCGGLGRWSVGVDQGSSWFAPANLVGLKSSSPVRLSADSISSDESL

SEQ ID NO: 218840 - protein, 96 aa, Glycine max
  Coding DNA Sequence Number=SeqID_102062
MKTEQHPPQRSSLVIASMYDEGLQPHPQLYEFMTQPHYHQEDYGYNLYFFNASGEDFMSNLIVVGMNYGRTLDHLLYIAMGVRCNSIPLFDIHHIA

SEQ ID NO: 218841 - protein, 304 aa, Glycine max
  Coding DNA Sequence Number=SeqID_102063
  Homolog annotation: Hit_ID=Q0KIN0; Match level="QueryCoverage=43%, HitCoverage=7%, E-value=7e-17, Identity=37%"; Hit description =Integrase core domain containing protein
MVHGLGAIRSPAKRPDADCSLWKKADAQLVVLLWHSIDPTLMVYFYNYNTCHAIWTKARDLYSNDVQCLYDAIHNLSTLSMIDNLPSYCSRVQSAIGALKTLIISDDQKIRKLDNVCMVYVLHDLHKEFEFVHNQILMNPSVSTSEEFMGRLLRIPFQETISGIGSSTGGESSNLVARRGGRGQGRDSYTGRESACSGGGGHPQCSYCKPCLSHSPFVGSWIDSGASDHIADRRTGRMIDIGYESHGLYYFHSSTVVACTTIESPSLLHHHLGHPSLNTLKAMVPSLSELQSLESESCQLGKHV

SEQ ID NO: 218842 - protein, 113 aa, Glycine max
  Coding DNA Sequence Number=SeqID_102064
MDMDYYNMLPFAFYQDMGMHRSAAAKFDKTSSKGKVKALTYIWKTLGRSLNDPKDTKGFFLQTSVQGAGNREPNINKFEQGLNLKQSVGFDGSMNSNNIQQRSMRGNLKINVR

SEQ ID NO: 218843 - protein, 424 aa, Glycine max
  Coding DNA Sequence Number=SeqID_102065
MERESFGEDIADTETEKSDYSEDEYDDSFIDDDEEASHDSREKGRKGSLRRLRKKYQSVESDDDGRHEEKIIADDSMDDQTQEIKDDEDILPISSLYKNKASQRVLDEEMDASVDRQAGDASNKNGEDGGNSIVETNLKADHDLVDSQTLREAQPSNHLVDPCIVLDVGDIKNLKKKKKRKGKEIDSSSNDHSIKLDSGIGGEPKMEKMTQDFVAGNKQQQHDDDKDANISGNVALPSADTGPKKNRTKKKKKEQVNKSDNGYQEGIIQEDKAKRDAAESQNLIHKVFAEKELHENLTNEKSVDNGAHEFPDGNLSDDRKVKKRKKMSKSPGNGEVANSDMPVSVEQSGETEMMEEDRNKREDAKPSQVRTLANGLVIQELEKGRQDGKIAALGKKVRSYHHGLGSINTSVERVDVTNTSRTRF

SEQ ID NO: 218844 - protein, 206 aa, Glycine max
  Coding DNA Sequence Number=SeqID_102066
  Gene Ontology: Mol. function=nucleic acid binding; Cellular component= oxygen evolving complex; Biological process=DNA integration
  Homolog annotation: Hit_ID=Q0KIN0; Match level="QueryCoverage=98%, HitCoverage=12%, E-value=9e-62, Identity=60%"; Hit description =Integrase core domain containing protein
MTRLIVLKPDWWQKATLRSLIRTTMTHSHCGQDGLCQTVILPCSHVIGLSSNTIKNVFLHGDLEEEVHMEEPPGFVAQGEASTMICRLCRPLYGLKQSPRAWFDKFCTVVQQFGSVRSDDHSIFYLHSPQGCIYLVYADDIAITGGDQHGIAQLKQYLSRIEVAQSKDGVVISQRKYVLDILEETGFMNAKPMDTPIDPSVKLVPD

SEQ ID NO: 218845 - protein, 192 aa, Glycine max
  Coding DNA Sequence Number=SeqID_102067
  Gene Ontology: Mol. function=DNA binding; Biological process=DNA integration
  Homolog annotation: Hit_ID=Q53NL0; Match level="QueryCoverage=34%, HitCoverage=6%, E-value=2e-13, Identity=53%"; Hit description =Integrase core domain, putative
MAVEWRKKRERRRHFKEKMSLEEAHHHRRPWIRAWRKNEINEGRGREEHEILCSKRALKSEIWFSPLIQDQVQDFPLSVLRCHEASYGPKIYPKAHENPRAFFCIFGPIFLESSIQFPWGVGLNHTMNEKMQSMSLNVVWELVELLENYKAIGCKWVFKTKMDSNDNIERFKARLVEKDFTQKEGVDFKEMF

SEQ ID NO: 218846 - protein, 105 aa, Glycine max
  Coding DNA Sequence Number=SeqID_102068
MAFMREMSPHVMQDGGSSQYWIIIMILQRILLGETAVYAMMLVFPPEFYPLKTILFGNLSQDIVEPLMDALEEDYKDGNEINESRQFIGGVLDLEKRINRLDTLT

SEQ ID NO: 218847 - protein, 44 aa, Glycine max
  Coding DNA Sequence Number=SeqID_102069
QATVARGGHRWSWVVEKGGVRISLNELVLLSGSSRFALRATIRA

SEQ ID NO: 218848 - protein, 143 aa, Glycine max
  Coding DNA Sequence Number=SeqID_102070
MHKRLTIEKREKRRVTVKTSNGRSKLLGIPTLNIQIHILRMINVSEFAGKGDLGLDVGGAAAAAGGGGGGGEWLRGGAEEALEDGHDEEHGDENGGGDETEGDGVDGAVEVGPMLVSVDVQRRTDWWPRIGDGVVFDQHCCCS

SEQ ID NO: 218849 - protein, 261 aa, Glycine max
  Coding DNA Sequence Number=SeqID_102071
  Homolog annotation: Hit_ID=Q1W1G0; Match level="QueryCoverage=99%, HitCoverage=99%, E-value=7e-11, Identity=26%"; Hit description=CK25
MGCCVSSHKTPTSSSLAKFHDPPKPLIKPSESSSAEEAVKELLLETPKWNPTTFAKSKPQKPHQNTNFHRFKDEKSKVEKRALTLSIYKAEDTTSAEVCSLSETVSTDTSIANQIEETRKRVDTSQPKLQKNRSFPGERRERTVVHGARNNSVGSVKLVQCRDQTAKKIGNGGTRRRRDPTENSLRRSRSPATVSGAGEARPVTGRSPSVKKLDRSTTRIRTGTAENGCRKRENPTTAGKWYSAGESLENPLVSLECFIFT

SEQ ID NO: 218850 - protein, 113 aa, Glycine max
  Coding DNA Sequence Number=SeqID_102072
MEGDTRWNGRMQVDYDEGRDGLVMQQEGKGGVNGMGDWFHPLKHKRQIGHLPSILWNDMAMQKGMSQGSKFKIQPKRAATYFRAFGIRQYLPPVKFKSVMVLITLGVSLDGKI

SEQ ID NO: 218851 - protein, 721 aa, Glycine max
  Coding DNA Sequence Number=SeqID_102073
  Gene Ontology: Mol. function=protein-tyrosine kinase activity; Cellular component=integral to membrane; Biological process=protein amino acid phosphorylation
  Homolog annotation: Hit_ID=Q6R2K3; Match level="QueryCoverage=98%, HitCoverage=96%, E-value=1e-163, Identity=44%"; Hit description =Strubbelig receptor family 3
  Pfam annotation: Domain name=LRRNT_2; Domain location=30-70; Score =18.8; E_value=0.0095; Accession=PF08263.3; Description=Leucine rich repeat N-terminal domain
  Pfam annotation: Domain name=LRR_1; Domain location=118-140; Score =15.0; E_value=0.27; Accession=PF00560.23; Description=Leucine Rich Repeat
  Pfam annotation: Domain name=LRR_1; Domain location=142-164; Score =9.7; E_value=4.3; Accession=PF00560.23; Description=Leucine Rich Repeat
  Pfam annotation: Domain name=LRR_1; Domain location=166-188; Score =12.0; E_value=1.6; Accession=PF00560.23; Description=Leucine Rich Repeat
  Pfam annotation: Domain name=LRR_1; Domain location=73-92; Score=6.1; E_value=21; Accession=PF00560.23; Description=Leucine Rich Repeat
  Pfam annotation: Domain name=LRR_1; Domain location=96-115; Score =6.2; E_value=20; Accession=PF00560.23; Description=Leucine Rich Repeat
  Pfam annotation: Domain name=Pkinase; Domain location=432-717; Score =47.2; E_value=2.3e-11; Accession=PF00069.15; Description=Protein kinase domain
  Pfam annotation: Domain name=Pkinase_Tyr; Domain location=432-717; Score=83.8; E_value=5.3e-22; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=30-70::118 -140::142-164::166-188::73-92::96-115::432-717::432-717
MGCANSELNLQIFILSMLIFTASLCVGDTDPLDVAAINSLYVALGSPPLEGWKAIGGDPCLEQWEGVSCVFSNITALRLGGMNLSGQLGSNLDFPSIIDMDLSNNQIGGTIPSTLSPTLRNLSLSANHLNGSIPDALSSLTQLSDLSLKDNHLNGQIPNVFLQLTGLMNMDLSGNNLSGQLPPSMGNLSSLIILTSLFRICIFLRNHILFTDIEISQMTVVYIPSNKNIENNIFSGPIPPELLSIPNFRKDGNPFNTTIIPSPPAASPEPAAMAPSPEKSPWKVTHNPSDTIKAPIPAIAGRSFKTTKLVWIVGAGFLIFIALGVCLLMLWCFKRRQENKKYKKHNTNVYTRSLHKRTSSDSPFEATTDKEKGWSSKLPPLQPAPPHHIPIIPGENLIINQAISTTATKRQIVTNSIKVYTVASLQQYTNSFSQENYIGEGMLGPVYRAELPDGKLLAVRKLNATASMGQNHEQFLQLAFSISKIQHANIVKLMGYCAEYSQRLLVHEYCSNGTLHDALHTDDKLQIKLSWDNRIWVSLGAARALEYLHEHCQPPIVHQNFRSANVLLNDNLEVRVSDCGLGSLLSSGSASQGCAFVRQQQLKLVGCHLTANGYSAPEFEYGSYTLQSDVFSFGVVMLELLTGRKSYDSSLPRGEQFLVRWAVPQLHDIDALSKMVDPSLNGEYPKKSLSRFADIISSCIQHEPEFRPVMSEIVQDLLRMM

SEQ ID NO: 218852 - protein, 442 aa, Glycine max
  Coding DNA Sequence Number=SeqID_102074
  Gene Ontology: Mol. function=protein heterodimerization activity; Cellular component=microtubule; Biological process=cell division
  Homolog annotation: Hit_ID=Q5ZCG1; Match level="QueryCoverage=94%, HitCoverage=53%, E-value=1e-111, Identity=46%"; Hit description =Katanin p80 (WD40-containing) subunit B 1-like protein
  Pfam annotation: Domain name=WD40; Domain location=1-36; Score=5.4; E_ value=8.5; Accession=PF00400.22; Description=WD domain, G-beta repeat
  Pfam annotation: Domain name=WD40; Domain location=124-162; Score =42.5; E_value=1.4e-09; Accession=PF00400.22; Description=WD domain, G-beta repeat
  Pfam annotation: Domain name=WD40; Domain location=166-203; Score =13.1; E_value=1; Accession=PF00400.22; Description=WD domain, G-beta repeat
  Pfam annotation: Domain name=WD40; Domain location=40-78; Score=44.5; E_value=3.7e-10; Accession=PF00400.22; Description=WD domain, G-beta repeat
  Pfam annotation: Domain name=WD40; Domain location=82-120; Score =51.0; E_value=3.9e-12; Accession=PF00400.22; Description=WD domain, G-beta repeat
  Pfam annotation: Domain name=eIF2A; Domain location=2-140; Score= -100.2; E_value=0.092; Accession=PF08662.1; Description=Eukaryotic translation initiation fact
  Pfam module annotation: Pfam domain module=WD40::WD40::WD40::WD40::WD4 0::eIF2A; Domain location=1-36::124-162::166-203::40-78::82-120::2-140
MQSLCGHTSSVESVTFDSAEVLVLSGASSGVIKLWDLEEAKMVRTLTGHKSNCTAVEFHPFGEFFASGSSDTNLNIWDIRKKGCIQTYKGHSQGISTIKFSPDGRWVVSGGFDNVVKVWDLTGGKLLHDFKFHKGHIRSLDFHPLEFLMATGSADRTVKFWDLETFELIGSTRHEVLGVRSIAFHPDGRTLFAGLEDSLKVYSWEPVICHDVVDMGWTTLGDLCIHDEKLLGCSFYSNSVGVWVSDISLKRYDCRITTYMAAIMLIASFKCEAAISVVLHVNNECHDYMPSILLIEPYSGGLETEKKESTEQELGLQGRQMEKVEASVGLTFGLCSMSPDNDSKEIKNIYIDSSGGNPDTLLRSRSYNSPKVDLPEESKEMLNWSPATRAREKQNEALRKSYIVPNVVHRDILNGKDSATFSKTKAGMLLKPVHVQGAPTDI

SEQ ID NO: 218853 - protein, 38 aa, Glycine max
  Coding DNA Sequence Number=SeqID_102075
HVKVSLDMLLKLVAVFGPTVRSTISAPPSVGVDLHAEQ

SEQ ID NO: 218854 - protein, 595 aa, Glycine max
  Coding DNA Sequence Number=SeqID_102076
  Gene Ontology: Mol. function=protein serine/threonine kinase activity; Cellular component=integral to plasma membrane; Biological process=protein amino acid phosphorylation
  Homolog annotation: Hit_ID=Q9XI96; Match level="QueryCoverage=50%, HitCoverage=50%, E-value=1e-115, Identity=61%"; Hit description =Similar to somatic embryogenesis receptor-like kinase
  Pfam annotation: Domain name=Extensin_2; Domain location=1-281; Score= -114.4; E_value=0.0074; Accession=PF04554.4; Description=Extensin -like region
  Pfam annotation: Domain name=GRP; Domain location=156-300; Score= -27.7; E_value=0.052; Accession=PF07172.2; Description=Glycine rich protein family
  Pfam annotation: Domain name=Pkinase; Domain location=283-486; Score =8.3; E_value=4.7e-09; Accession=PF00069.15; Description=Protein kinase domain
  Pfam annotation: Domain name=Pkinase_Tyr; Domain location=283-505; Score=13.7; E_value=2.6e-13; Accession=PF07714.7; Description =Protein tyrosine kinase
  Pfam module annotation: Pfam domain module=Extensin_2::GRP::Pkinase::P kinase_Tyr; Domain location=1-281::156-300::283-486::283-505
  Subcellular localization annotation: CTP_CleavageSite=69; ConfidenceScore=5.81e-01
MASNSDKDSPTPPSPDSSSSQSPPSSPPPSQDSSSPPPSSQDNSSPPPSSPPPSSPPPSSSPPPSPPPPSSNDQKSPPPPSDSSSSPPSPPPPPPPDKDSGSHRSPPPPPHSRHEFSPPPPPNHRLSPPKSSSSGSSDGLKDSESHSLSMPVIIGIAAGAGILLLLLLVVVCACSRRKKRSQPSVSYYANQPSDDGYYKRPRGGQNQYGYNNNGEHVLNIPPPPGAGWGAAPQPPQMISSDMSNSSFSGSHGPVLPPPHPTVALGFNQSSFTYDELSAATGGFSQRNLLGQGGFGYVHKGVLPNGKEIAVKSLKSTGGQGKGRPVMDWNTRLKIAIGSAKGLAYLHEDCHPRIIHRDIKGANILLENNFEAKVADFGLAKISQDTNTHVSTRVMGTFGYMAPEYASSGKLTDKSDVFSFGIMLLELITGRRPVNNTGEYEDTLVDWARPLCTKAMENGTFEGLVDPRLEDNYDKQQMASMVACAAFSVRHSAKRRPRMSQIVRVLEGDVSLDALNHEGVKPGQSSMFSSASREYGAEAYGADMMRFRKLALDSGVGSSEYGGTSEYGLNPSSSSSEQSSAEYARRTTGGGRMHTP

SEQ ID NO: 218855 - protein, 75 aa, Glycine max
  Coding DNA Sequence Number=SeqID_102077
MKPNELAPAPFLPEASRKNKEMRLGFASWRFILCTLVVFLILQDSVARKIATTSGNEVQLKEVSYDLQKLATEGL

SEQ ID NO: 218856 - protein, 122 aa, Glycine max
  Coding DNA Sequence Number=SeqID_102078
MSSGSDASSYEEHIPKIETMLIHTKNEVIVHIEHFFDIQNLEGIYYIALLNKILWDQGVYLVFNGLDDATKNEIMVKRTMIARQQNFGPLKIKSMRLTMKITWREVPQVDEEEKNIMRKVIC

SEQ ID NO: 218857 - protein, 294 aa, Glycine max
  Coding DNA Sequence Number=SeqID_102079
  Homolog annotation: Hit_ID=Q2QVB3; Match level="QueryCoverage=51%, HitCoverage=35%, E-value=3e-30, Identity=43%"; Hit description =Expressed protein
MDNFFRAAGMKNARDLEDHEHDLTLSLRCGSPKRTTHSSSPSLPQINISLMELQMPYPNYLVPSSNHNINPLFESCSNHNSTNPSLASSSNHNIDPLLVVSPSSAPGAAAPTPVLTRRSRRASSQRRRRSQGKSETIPAPFPWATDRRATVHNRKYLLENNVLVITGRVQCRRCEQEFEMTLDLEEKVNELRKFIQKESRSMHDRAPAAWVNPVTPKCVHCGRENCIKPILVYTKKRSINWLFLLLGQMLGFCTLNQLRYFCKHTNNHRTGAKDRLLYCAYMTLSKQLVPEWFD

SEQ ID NO: 218858 - protein, 61 aa, Glycine max
  Coding DNA Sequence Number=SeqID_102080
  Homolog annotation: Hit_ID=Q8H9E9; Match level="QueryCoverage=64%, HitCoverage=9%, E-value=2e-09, Identity=70%"; Hit description =Resistant specific protein-2
MEGEFKLQLFATWTPLSGTETTCPFVCSKLSREPHLYNISSRPGVLARKARLDEKLCMYLR

SEQ ID NO: 218859 - protein, 198 aa, Glycine max
  Coding DNA Sequence Number=SeqID_102081
  Homolog annotation: Hit_ID=Q2QMP3; Match level="QueryCoverage=73%, HitCoverage=49%, E-value=1e-27, Identity=45%"; Hit description =Expressed protein
  Pfam annotation: Domain name=PIG-X; Domain location=39-195; Score= -47.2; E_value=0.0012; Accession=PF08320.2; Description=PIG-X  PBN1
MGYQVPVNKFLMQSYYDRYTILHDSDFDNFMSQAIPSGSSCGFVLRLSDLKRTLIGEVFSDVAVFGDTNLELPSFLSNRSAVEIHLLVDPNILQEPTDIKMELPLHARYQPLNESGYSTVEFGAPDMLVRCGTKGKVENHYCFFKLEKDDANLYGPHTVWRIPSGIKAHADLVSAATFIAALLSTLAIVVASLYYSNS

SEQ ID NO: 218860 - protein, 73 aa, Glycine max
  Coding DNA Sequence Number=SeqID_102082
MVKKYHDKKLLKKDFQLGQQVLLFNSKDPRRTWVVNEQRLKQYHAMNALSVPASLSQMIALSQPFRAKHIHPC

SEQ ID NO: 218861 - protein, 77 aa, Glycine max
  Coding DNA Sequence Number=SeqID_102083
MGIMWLVSRLLHDAISFIQKLKGSLFVTIGVNEMMNMARNSLNCCKAELAWASMSEPEMRRGEAILHPKIFPNIQKV

SEQ ID NO: 218862 - protein, 99 aa, Glycine max
  Coding DNA Sequence Number=SeqID_102084
MTKACQKGVRKCICLYVLGRSRNSGGQDMRVRLIKGEKSITGSSTQSFNLWPSFLLQIVKGEHFRGREVRGYEWDFENSGFCDDVYMLKLPMETVRDEG

SEQ ID NO: 218863 - protein, 116 aa, Glycine max
  Coding DNA Sequence Number=SeqID_102085
MAHSFNKDALHAQELPFSHLTDPRRDADEAPLDVSICLHAFGIVGCGSFSGVKSCEREDPFHPGLFVGDAGGFQSPTREPLNVGGLVPPHCSLKSVVSDDACPGACFVQRDATTLS

SEQ ID NO: 218864 - protein, 127 aa, Glycine max
  Coding DNA Sequence Number=SeqID_102086
MTLLLSNILPSDRDADLPPAKVSVGMSRHDIGKDRAHKTPNGPGEVQQVIGFPALITGLCQSYRVPVPPTRDRTRKTNSGPGEVQQGLKVSSSNYEPLSVLQSARRPQQGHQAPINRAFIEKYCAPR

SEQ ID NO: 218865 - protein, 66 aa, Glycine max
  Coding DNA Sequence Number=SeqID_102087
MEDVQLFELQEQGGTQEDPDNCQFFQWVEEENQLSNSSSVSRETMVVADLRLQIEALQKKMRKGIL

SEQ ID NO: 218866 - protein, 195 aa, Glycine max
  Coding DNA Sequence Number=SeqID_102088
VAHLDSIAESGLQKPSNGIADTYLYLFLSAGVLPADTLIREMELGICFETSSLRATNCHYSEAYGDPVPRKALSLGKTNHPAPPLESFIFMTYLPCPPLQASPAPALFSRFQKKELIDESPGSFCPIRGNQLHSMPASLSAARRSTALPSSNSAFSFSRLSDSPPGVRNRQEIRGTYLTARKWNQSRLLQDSFDL

SEQ ID NO: 218867 - protein, 207 aa, Glycine max
  Coding DNA Sequence Number=SeqID_102089
  Gene Ontology: Mol. function=sequence-specific DNA binding; Cellular component=intracellular; Biological process=regulation of transcription, DNA-dependent
  Homolog annotation: Hit_ID=Q8ZJX2; Match level="QueryCoverage=73%, HitCoverage=72%, E-value=1e-36, Identity=52%"; Hit description =Putative LuxR/UhpA family transcriptional regulator
  Pfam annotation: Domain name=GerE; Domain location=99-156; Score =30.5; E_value=3.5e-06; Accession=PF00196.10; Description=Bacterial regulatory proteins, luxR family
MDTEGLCCHCMELTLLQLRRADVIIADISGEYRNPRVSRPLYPVAVELLMRPESTLLSEMEPIEGVVAAIRAGRERAERISQTLLTPEPQGVEEEDESFIALTHSERKVLRLLGKGWGINQIATLLKKSNKTISAQKNSAMRRLSLRSNADMYAWINTLRRRFIRSIFSRSSIHFPMREKNGVTAWHICGTSRSRIAISSALSWSLM

SEQ ID NO: 218868 - protein, 95 aa, Glycine max
  Coding DNA Sequence Number=SeqID_102090
MSFADFDSSSKDIDASSPSLMSPHSVLSKAWVPPRVDMVDLVSEDEGEDLEEDISYEEDLSMDEEDPVIEPKIMEEDSPYDSSEESYKETFLHLT

SEQ ID NO: 218869 - protein, 99 aa, Glycine max
  Coding DNA Sequence Number=SeqID_102091
  Pfam annotation: Domain name=zf-GRF; Domain location=20-65; Score =39.6; E_value=1.1e-08; Accession=PF06839.3; Description=GRF zinc finger
  Subcellular localization annotation: CTP_CleavageSite=30; ConfidenceScore=5.35e-01
MSQRSNASSSRTRVSSQVVLLCGCGRRAVRRVAGTNINRGRTFFTCSINKDEVGYCGYFIWVDQLIEALGVDDSLGTFSMEQRRQFGREEDKTMWKGSS

SEQ ID NO: 218870 - protein, 84 aa, Glycine max
  Coding DNA Sequence Number=SeqID_102092
MGDFISRLSFPENTETFSSLTSYPELRRSEFLMGGYVGARASLLSTTPPFVAMTQELVARGDTLRLSASFCHPEAAGPMTSRDQ

SEQ ID NO: 218871 - protein, 90 aa, Glycine max
  Coding DNA Sequence Number=SeqID_102093
MMSSRKRKSIGARPIAQYDTRIFHSFEAWTRYIDNVIGRHILDKRKVEIYNIELDEFKAELERRNFHKRLTNLADSSIDLALVKELYANL

SEQ ID NO: 218872 - protein, 54 aa, Glycine max
  Coding DNA Sequence Number=SeqID_102094
MDNHEHANHRDTAQAKIKNKRIRQHKVNDQAQNIDFNIRDSSEDERSESTQGTN

SEQ ID NO: 218873 - protein, 152 aa, Glycine max
  Coding DNA Sequence Number=SeqID_102095
SFCLCFVLLGCDSLCCVNVVLLGCCGSLGGLMGTRGWWVYARIVDVENLLCTIARPPPSTTCDGVVPGDMSRGSGDLGDVRRAPGSQQIKGKQDHKARRLVVAGQLLENEVRKLRKPLVIDYQGIVMAAQLIRDRVEMECLEGAWETLKGNT

SEQ ID NO: 218874 - protein, 50 aa, Glycine max
  Coding DNA Sequence Number=SeqID_102096
  Homolog annotation: Hit_ID=Q9SD67; Match level="QueryCoverage=90%, HitCoverage=5%, E-value=2e-11, Identity=71%"; Hit description=FtsH metalloprotease-like protein
GVEEKTAKLKGSEKALVARHEASHVVVGTAVANLLAGQPHVEAIFIKYDL

SEQ ID NO: 218875 - protein, 63 aa, Glycine max
  Coding DNA Sequence Number=SeqID_102097
MASYAEEKDSIDEEDPRPTSSTWSYITYHYCMKRGHTCYKCYVRRFDVPKGVPKSKRLTMVLG

SEQ ID NO: 218876 - protein, 65 aa, Glycine max
  Coding DNA Sequence Number=SeqID_102098
MYLHWICQVEQYMKILKGYTKTLHHLEASIVERYIAEEAIEFCSEYIKKVKAIGDSESRDDERVG

SEQ ID NO: 218877 - protein, 47 aa, Glycine max
  Coding DNA Sequence Number=SeqID_102099
MKDGFVGQRRLLYEDTGLLRSMLLYGNCCGGGSCSYGHEGCGDDGCG

SEQ ID NO: 218878 - protein, 217 aa, Glycine max
  Coding DNA Sequence Number=SeqID_102100
MMEKLRLVRSAQQSKSAYQNIQDNELSLSISKLPPTDKLNLTALVPVVNEGVTEAATIKDIVDLLDGGSLGDIKLDPSANNLLSNSNAGLMLDRYKAPCVGITGTYVSTGAGPDFTKDNAFSETGGIWRVKNTLMLSRVPSTANGAVIVDITLGKIPCDSSGIPLQYTLSVGTTSKKVGGVWRQHSVMILAIVGAPIKLMDVVTGVLEDYKEGVAWG

SEQ ID NO: 218879 - protein, 158 aa, Glycine max
  Coding DNA Sequence Number=SeqID_102101
  Gene Ontology: Mol. function=RNA-directed DNA polymerase activity; Biological process=RNA-dependent DNA replication
VSTPYHPQTNGQAEISNREIKRILEKIMQPSRKDWSTMLNYALWAHRTAYKAPIGMSPYRVVFGKAYPLEAYENAKFYKEKTKKFHDSMIIKKDFRVRQKVLLYNSKLGLTSVEIKSDSTNKSFKVNGHRLKPFLTNPSLVDVVVEETSLLHPTLPPP

SEQ ID NO: 218880 - protein, 67 aa, Glycine max
  Coding DNA Sequence Number=SeqID_102102
MNTKGAEPLPLSLPRPFIAKIGEELAAQFRSNMLAQVSSTRPGELNSPRRASCFMLKLPNGPRWAQG

SEQ ID NO: 218881 - protein, 236 aa, Glycine max
  Coding DNA Sequence Number=SeqID_102103
MYVHPREAYASTCDASKKDTTGEGSSAAPQADMDFDRHRDDEFPDFQGEIGRRCWALLVTPMAKFDLEIIMEFYTNDWPTEEERASSASTARGGVRPLALMRRLSPSCYAYQGKTSLRPSQGDGNCTYETPCEPGEVQQGPRVPALITSLCQFYRVTVAPDRVIRQAQGQEPQQPGDGQQQAAKDAPMPPPELERCIRHVADQQAANHRGQFEAAIAWPGDLPDFFAGTSEGGDKA

SEQ ID NO: 218882 - protein, 106 aa, Glycine max
  Coding DNA Sequence Number=SeqID_102104
  Gene Ontology: Mol. function=RNA-directed DNA polymerase activity; Biological process=RNA-dependent DNA replication
  Homolog annotation: Hit_ID=Q1SMK1; Match level="QueryCoverage=99%, HitCoverage=7%, E-value=1e-34, Identity=55%"; Hit description =Integrase, catalytic region; Peptidase aspartic, active site; Ribonuclease H
MTMLDESIGCMLGQHDDSEKRERVVYYLSKKFTASHCLRQYMLSHTTWLVSKMDPVKYIFKKPALTRRIARWRVLMFEFNIAYVTQKAIKGSALAEYLAQQPLNDY

SEQ ID NO: 218883 - protein, 110 aa, Glycine max
  Coding DNA Sequence Number=SeqID_102105
  Gene Ontology: Mol. function=DNA binding; Biological process=DNA integration
  Homolog annotation: Hit_ID=Q1SKC8; Match level="QueryCoverage=97%, HitCoverage=26%, E-value=9e-39, Identity=73%"; Hit description =Integrase, catalytic region
MVGPTSAMCSCKKVLGHYNVRHKAASPYNPQTNGQAEVSNMELKSNLEKTVVSSRKDWMMKLDDALWAYKTAFKTPIGLSPFQMVYGKACHLPVEMKHKDYGALKFLNFD

SEQ ID NO: 218884 - protein, 182 aa, Glycine max
  Coding DNA Sequence Number=SeqID_102106
  Gene Ontology: Mol. function=hydrolase activity; Cellular component =microtubule; Biological process=cell division
  Homolog annotation: Hit_ID=Q84XF3; Match level="QueryCoverage=51%, HitCoverage=21%, E-value=7e-33, Identity=59%"; Hit description =Dynamin-related protein 1B
  Pfam annotation: Domain name=Dynamin_N; Domain location=10-138; Score= 39.9; E_value=8.4e-09; Accession=PF00350.13; Description=Dynamin family
MSLVKECPSQSSSRKSLVLESVIGKDFLPRASGIVTRRPLVLQLHKIDEGREYVEFMHLPRKKFIDFVVNVTLVDLPGITKVAVDGQPDTIMQDIENMVWAFIEKICDFVSKACKPIINYNSLKSKLKLITDVVCHISSSETDAIFPRKRPITRAMSRRLHEDWARAVEEGLRVPMNLRVDF

SEQ ID NO: 218885 - protein, 117 aa, Glycine max
  Coding DNA Sequence Number=SeqID_102107
  Gene Ontology: Mol. function=solute:hydrogen antiporter activity; Cellular component=integral to membrane; Biological process =regulation of pH
  Homolog annotation: Hit_ID=Q75L14; Match level="QueryCoverage=76%, HitCoverage=13%, E-value=8e-20, Identity=67%"; Hit description =Putative Na+/H+ antiporter
  Subcellular localization annotation: CTP_CleavageSite=62; ConfidenceScore=5.37e-01
MMRMSTGNAMMERATPMKTRNCRNLALSAPSTILRRMTATLMPHMKGREIPTGTMQNAFRLLQRMEWRSSSRPTRKREKKKAYAGYRFKRGHESKEARESGGRNERAFKGARLGISN

SEQ ID NO: 218886 - protein, 62 aa, Glycine max
  Coding DNA Sequence Number=SeqID_102108
MFGHKYYILGRLSSEVGWSYYDTIRYLSYPNFIRGQLFVGMRIFAGHVELLKANFRVIRKIS

SEQ ID NO: 218887 - protein, 289 aa, Glycine max
  Coding DNA Sequence Number=SeqID_102109
  Gene Ontology: Mol. function=RNA-directed DNA polymerase activity; Cellular component=intracellular; Biological process=RNA-dependent DNA replication
MEGFGGSGSTSHDGKGDDHLIVDTLPVFYYEKLVGYMPSSFVDLVFTGERIEVGLKRGKFDYVALASTSNRRSGPTGAKRKEWDAHALFGPRRKLLQLSTHPARTSAPPQRALAQTPAPAQPRPVGNSNPSISSNSGMNPLIKKLPEWYNPNATCAYHGGTPGPSIEQCMTLNHKVQSLIDARWLTFQEYGLNVKMNLLANHGGSRVNAIEACELQRLKQMKDVITSRRFIFEALHEAGIVSFDGHKGDSCLMHPGASHDMETCSTVEELLQQMMDQGQFEIGGASEEE

SEQ ID NO: 218888 - protein, 54 aa, Glycine max
  Coding DNA Sequence Number=SeqID_102110
MECEPRLVLVLVDAEDEHGLPGQRNAWMRKYVVVQILHRLHLTWDWTWLTINAA

SEQ ID NO: 218889 - protein, 213 aa, Glycine max
  Coding DNA Sequence Number=SeqID_102111
  Gene Ontology: Mol. function=solute:hydrogen antiporter activity; Cellular component=integral to membrane; Biological process =regulation of pH
  Homolog annotation: Hit_ID=Q2HVU5; Match level="QueryCoverage=90%, HitCoverage=24%, E-value=7e-57, Identity=58%"; Hit description =Na+/H+ antiporter-like protein
MAAAAFNDVVAWILLALAGDGGGHKIPLVFVWVLLSGLGFVVFMIVVIQPVMKVVSCKGENDTVDEIYVCLTLAGVLVYDFVTDLIGIHSIFGAFEFGLTVPKNGSFVRRLMERIEDFVLGLLLLLYFASSRLKTDVTTIHSGAVWGLLCLVIFTACATKILGTFMVAMFCMIPARESLTLAVLMNTKGMVDIDFEKEPIGTGKDGMHHQAIQ

SEQ ID NO: 218890 - protein, 89 aa, Glycine max
  Coding DNA Sequence Number=SeqID_102112
METCPMLSQSTLQPLVALSTTEANLIPPSTIVPTYHMLAQMHNVDLESNFQDFEYSHTLDRIEVQHLAGTTLFEGMHFETKEEVQHALQ

SEQ ID NO: 218891 - protein, 232 aa, Glycine max
  Coding DNA Sequence Number=SeqID_102113
  Gene Ontology: Mol. function=nucleic acid binding; Cellular component= intracellular; Biological process=DNA integration
MHSLILLSLSDEILYEFYEELVEVGLWLKLEKLFRMKTICNDLLLKRKFFGLRMREGMSLEEHLDELNYILMELSNIDVKMEDEDLTMILLASLPPYYENFVSSLSVGKDSITLEKKKKKGKGDNKSKVDPKDICNYRKEHGCWKHWFVTYERKFGGKVLMGNDATCNFIGGVMHIKGKGKFMHQTTFPKVVHTTKAMLDYVHSNYWGLSRVPSLGGARYFLSIIDDYSRMK

SEQ ID NO: 218892 - protein, 209 aa, Glycine max
  Coding DNA Sequence Number=SeqID_102114
  Gene Ontology: Mol. function=exonuclease activity; Cellular component= intracellular; Biological process=DNA integration
MGFGDGGKGFRVYSPSERKVILSRNFIFDELSMLHSKSDEDLYKTKNVTKQFEAPYKTDQDLQMHPQHRNSTPVKGMDWMSENHPKQPKTTTPRKSQRQIKAPKRYGFDIVSYALQLPKVKQVVRCKWIFKKKSRSSIEEFIHYKAHLVVKGYSQKEGVDYNETFSLVARHTSICVLLDLVATLDVELEQLDVKTTFIHGRLKEDILMQ

SEQ ID NO: 218893 - protein, 202 aa, Glycine max
  Coding DNA Sequence Number=SeqID_102115
MACQPPKPRKVLSGLLLSSCPRWTRLWHVRCIEDKRYVLSIVVRMCCAHAVLLHVSLTEWARTRVVVCGSFLLAVTRRRILAVVPSTMSPPLRRGRGSSGGDVRVSPFLLRSHSIRFPSSTLVVASYEWVKLASPEDSCKIVVQACGSDEFPFIGWRWVVRPSILGIMGDFAWKQLLKQVGPTGRTVPSSVAAPVVGEGGCW

SEQ ID NO: 218894 - protein, 148 aa, Glycine max
  Coding DNA Sequence Number=SeqID_102116
  Gene Ontology: Mol. function=nucleic acid binding; Biological process= DNA integration
MKEEQKEKVEKEKNQKNEKEKEKVDEEKKKSKSEFQERKRERLLQLKKLEITLPFGEALQQMPLYAKFLKDMLTKKNQYIHSDIIVVEGNRSTVIQHNLPPKHKDPGSVTIPCSIGEVAMEIEIMPTRMTLQLADRSITRPYGVIDDI

SEQ ID NO: 218895 - protein, 179 aa, Glycine max
  Coding DNA Sequence Number=SeqID_102117
MAKGQGKLRLWRLSGGPARTTFVAREHPPLAIKDDIVAGLPFEASGGHPVWFLLFFGHNLLNIYVGSLKGLLDDSLEVSGLLATLFLWSGICWQPVLGQAASSEVELEGLLLGNIVRAFEDDSCPASFYAGYTVNVKVPPVWDGHYPFCEFQLSQNPFDWVVHFDYRLMTLEVGPESSS

SEQ ID NO: 218896 - protein, 319 aa, Glycine max
  Coding DNA Sequence Number=SeqID_102118
MPSKKICIFVKQVGDAPMLMIGVVARIYVEFIIQACLVDSQGSDWRPFMHAHDLSAISHYGVRLGKLPTLTVTISLIRVGNFIFKWGMETVASSSLNVFMSIKSLACKAKEWICVKDISGTALVDDDLGHHQVRNDDGDNHRVILDDGVDTLEVHIRDRRETLLKWCIKKIDVDVSNGMKMAFLGLARLSSSIGKFACNGVVAHTVVAGVSVYLDLLVYLFFYLLCGSFVAPLGVLLVLLLLGGCPAYEVSLGRLSVNLFDHKAKSMECNATSSQGSRGHATRSASYVVRVETFDEGSPESGRHLGAHLDLWSHHTAQG

SEQ ID NO: 218897 - protein, 155 aa, Glycine max
  Coding DNA Sequence Number=SeqID_102119
  Subcellular localization annotation: CTP_CleavageSite=22; ConfidenceScore=5.08e-01
RPLSEQDVLPAPNAVEAPIVVVATPVTPAPSPPPAVPVQEVTHVVVVNVPATSVGPIMVSLSIVVAPLLSTSVATASAPIVSPPPSSTPPIPTFVVLAMGVERYGFCQSLSPEKFGDSGGEWTMVLRGFAQGRVLGGRGLQMEGYYLHRLESAAP

SEQ ID NO: 218898 - protein, 214 aa, Glycine max
  Coding DNA Sequence Number=SeqID_102120
MVVLQKVLSPIWWGFLLLCGASPLMLMRSIFNLPLVEDLANQSGDRLLDLLSFSSDGYEDMTSTYLKVLPNSLVVVRFVELRPLTTAIEYIPRVDLRFWRSVYQRQTLVPMEMELSNRYGSPRVNLGFVEPWTEDVFALGFVKLVELCRGLPRAGLGFCEPVRITKCEAWVCRVCSTFAMLLHIWHSSWVACTGDVMACSCIYVTLRGWHILKT

SEQ ID NO: 218899 - protein, 61 aa, Glycine max
  Coding DNA Sequence Number=SeqID_102121
MGNYGQRGGEIHLKTPHLLTVRQSQLTESSSGPCLLDSTSLRFYGKRNSPTYSRRTIVHPK

SEQ ID NO: 218900 - protein, 385 aa, Glycine max
  Coding DNA Sequence Number=SeqID_102122
  Gene Ontology: Mol. function=RNA-directed DNA polymerase activity; Biological process=RNA-dependent DNA replication
MVSIRSGLIRDTLFEDSHPHLTTMIDIDTLQQLQNRIAKMERCHKKELRKLKADHDQLEARIRCPQGEYHSTHTFLEHTQGESHPQCTINTLDDLSLSHMHRPTGSTKIDLHKSDKRQPLPKGPRYKRCTPLVTNHTIILEEAFSLEVPIKLPPTKPHKPGLDTTKYCIRLLSPKGQDKRAYTSWVPSLLCQKTGQPPSRSKTKRTPRGATKEPQSKFSYGGGQSSQSQKCHLHAIRDIDINFFDAPFQQSLPPITDMDFKGINPIIQDDPMVVSIIIANLMVSKRLKVSPDTIHLHADPLLGFASERLETRGFMDLMTTFDQGKLSKSFIVRYLLVDADTSYFTLIDMKTFNELEATVSIPHLKMKFPTLIREIVTVKADQKQA

SEQ ID NO: 218901 - protein, 214 aa, Glycine max
  Coding DNA Sequence Number=SeqID_102123
MVGAKCSHQNPKIGHVRVDVAKVGSQTSNMGFESKYMRMRASMRELKGEQHEDLALKLKEELEEVLLIEDIMLKSHRLVDYEFPYVMLAPRFIDYFNVDVSNEIVDFTKASSEITERHLKKLGMRFVDHEWIMAEEPATGNMNEDVEVEAPQEPTYQWSPFESLMIQKMDAMLHLRQEHSAEVHSSLENITTRLENIDTRLTPSNLLNPDEDEA

SEQ ID NO: 218902 - protein, 73 aa, Glycine max
  Coding DNA Sequence Number=SeqID_102124
  Subcellular localization annotation: CTP_CleavageSite=36; ConfidenceScore=5.22e-01
MDVAQLSPRFVLHFVKRAASARAYYSDKRNKQNGVNVMLGRQPTGVGSVPQCWPRVVALSCSISMVPRQKWHQ

SEQ ID NO: 218903 - protein, 288 aa, Glycine max
  Coding DNA Sequence Number=SeqID_102125
  Pfam annotation: Domain name=DUF1723; Domain location=1-45; Score =25.3; E_value=0.00022; Accession=PF08330.1; Description=Protein of unknown function (DUF1723)
MLLRILGFWSTTINGFVLPKAMVAPTLLDVADILNLSIHGKELLSLYGTCYVLSTTIGIKFSKDNSEYSKFMLPNAKKNGVISLSEPNDFILMWFCWNFIYMSLVLCLASIVSLSQLLHSTMTWLWVLSFSPHCMGTFSIFSTTSKTIVLRTILIMPTSRNNKLVVEAYYPYSFVRQFGLIQSIPKILSCPTRLPINLCTSCQLNEILAVLEDIEDKLHPFVLKHLAFSPNNVEFFTEWWGVILATLSLGLAANFITRLIDEMSDDELPSPTTVKCSQKRIIDSNSVV

SEQ ID NO: 218904 - protein, 133 aa, Glycine max
  Coding DNA Sequence Number=SeqID_102126
MVRTTAPQTIDLNMIVAAICTHLGVQLKPVNKPVYKKPYLERIDKIVFLPRGYKILYIATFSGEDRKSTMEHDKEGSGDDLPTNQMASELVKWKPYSCPTLQSFKGKEAEGNEPYLFDISRVEQIFDYLVKDQ

SEQ ID NO: 218905 - protein, 55 aa, Glycine max
  Coding DNA Sequence Number=SeqID_102127
MVWRVISSSVNPNESWCCTRSIGVIEAYTQHQGCSSNDKGGSATTKYRELVDSQR

SEQ ID NO: 218906 - protein, 69 aa, Glycine max
  Coding DNA Sequence Number=SeqID_102128
  Gene Ontology: Mol. function=catalytic activity; Cellular component =cytoplasm; Biological process=purine ribonucleotide biosynthetic process
  Homolog annotation: Hit_ID=Q1S5H7; Match level="QueryCoverage=81%, HitCoverage=14%, E-value=2e-20, Identity=85%"; Hit description=Lyase, putative
  Pfam annotation: Domain name=ASL_C; Domain location=13-69; Score =29.2; E_value=3.2e-10; Accession=PF08328.2; Description =Adenylosuccinate lyase C-terminal
MWDKGTKTTNSNRDLTNSTILRNMGVGIGHFLLAYKITLQGIGKLQVNEARLSEDLNQCWEVLVEPIQN

SEQ ID NO: 218907 - protein, 155 aa, Glycine max
  Coding DNA Sequence Number=SeqID_102129
MENLLATPTRSRPMKKECLSDASFFSYACSVFRHLINNTMIRGYLQCRSPLHAVSCYLTMFGIRDDPYVVSAFIEFYFVSREVDTARVLFDKTANKDVVLGTAMVEGSGKMGNVESARQRCRTREHSRTSLHSVLTARAHLGALTLRLLVHSYAR

SEQ ID NO: 218908 - protein, 181 aa, Glycine max
  Coding DNA Sequence Number=SeqID_102130
  Gene Ontology: Mol. function=acetylglucosaminyltransferase activity; Cellular component=membrane; Biological process=electron transport
  Homolog annotation: Hit_ID=Q69XJ6; Match level="QueryCoverage=91%, HitCoverage=99%, E-value=8e-68, Identity=69%"; Hit description =Glycosylation enzyme-like protein
MKAFRERELRGSAWMMLSRPFIEYCIWGWDNLPRIVLMYYANFLSSPEGYFHTVICNAEEFRNTTVNHDLHFISWDNPPKQHPHFLTVNDYQRMVDSNAPFARKFGRNEPVLDKIDTELLGQNADGYVPGRWFSQANSSITKQYSGIRNITDLRPGPGAERLGHLINGLLSAENFQANRCF

SEQ ID NO: 218909 - protein, 117 aa, Glycine max
  Coding DNA Sequence Number=SeqID_102131
  Subcellular localization annotation: CTP_CleavageSite=13; ConfidenceScore=5.04e-01
MPLRGRIASNSFMAMAGVCNITVVPLFLNLKSKSTHISLYSDQPNAGTCKNPFSPIHELEPQIPLPSRNLPLTAAPSVMQSYPARALDRRLQVDWAIDPREGPRVLMSLRVDFEPMG

SEQ ID NO: 218910 - protein, 62 aa, Glycine max
  Coding DNA Sequence Number=SeqID_102132
  Gene Ontology: Mol. function=acetylglucosaminyltransferase activity; Cellular component=membrane
  Homolog annotation: Hit_ID=Q9FLD7; Match level="QueryCoverage=96%, HitCoverage=13%, E-value=9e-23, Identity=78%"; Hit description =Glycosylation enzyme-like protein
MVTNTLHAAAILLNQAGDWDWFINLSASDYPLVTQDDLLHTLSSIPRHLNFIEHTSDIGWKV

SEQ ID NO: 218911 - protein, 117 aa, Glycine max
  Coding DNA Sequence Number=SeqID_102133
GNEDGEEDEEGGDEEREDEWEEPFFLGLVLVLLVVLVGFHRVGGSVGVRRGKRKRGVTAQGSIYVGVKLAVGCVWANQDWRNMPLKFLVGVAVTMIMMRVSEWPIIINKKVFPLFKK

SEQ ID NO: 218912 - protein, 165 aa, Glycine max
  Coding DNA Sequence Number=SeqID_102134
  Gene Ontology: Mol. function=RNA-directed DNA polymerase activity; Biological process=RNA-dependent DNA replication
  Homolog annotation: Hit_ID=Q94HP1; Match level="QueryCoverage=72%, HitCoverage=15%, E-value=4e-16, Identity=34%"; Hit description =Putative retroelement
MLLLGSPHCHQIQYILGHDSKECSVNISLEERLRFRFFNSKEDGKSTVFNPPIDDMRCHIKPLHLAAMVEDQLINKILIDGEVVFNILPRSMLHKFGRIVKDLIPHNIVVSDFCGKPSDSEGMICLDVSVGSKRRPMMFLVISSQANFSICYWERKGFTELELFL

SEQ ID NO: 218913 - protein, 150 aa, Glycine max
  Coding DNA Sequence Number=SeqID_102135
  Subcellular localization annotation: CTP_CleavageSite=46; ConfidenceScore=5.07e-01
MMTCLTACNTNQCSSQQSSSPFWLHPFVFFIGLFERFFRHRDEVLPQEQASSARVLGDKNGVSGRRCSSASSCGRKVKGSSAGARGRRWNTFFRWLHFRFVTLAEEHLPQTAFSARRRSCGTFFRRLSSCGRTYQTSSAGCILLYIGYFS

SEQ ID NO: 218914 - protein, 66 aa, Glycine max
  Coding DNA Sequence Number=SeqID_102136
MSQVLSAAKIAKKMKLKFTKAWTAYLRFPLPIDVYKEVAMRSNVGAEGGKKHKWWNCNMGCKMLVE

SEQ ID NO: 218915 - protein, 130 aa, Glycine max
  Coding DNA Sequence Number=SeqID_102137
MTIINKIGITYNTMKKLVVQRRVEGAAVGNLYELHERVQHEFLEHLISLWQSEDVDEGLKELFELGTEPGEVDELEWIHGTTQYAQVAAVDEAPTVQTVHTSLLSRGFGGEEWGAVLYEARVSNLVNIIK

SEQ ID NO: 218916 - protein, 121 aa, Glycine max
  Coding DNA Sequence Number=SeqID_102138
MTLGAQLKNCLFTTHILRRLCGTVLECYAVTIFHHISAAKGPQSSDLKLPWLEVWFRNALSLPSLLNTSENRDVRKEIDSAYISESKSASVLPHAAQSFSIGYIQELKLEVLFLVLPLRWL

SEQ ID NO: 218917 - protein, 100 aa, Glycine max
  Coding DNA Sequence Number=SeqID_102139
  Homolog annotation: Hit_ID=Q6YS10; Match level="QueryCoverage=65%, HitCoverage=14%, E-value=7e-07, Identity=42%"; Hit description =Transducin / WD-40 repeat protein-like
MYSVLSGRFKIYTSCYHGILRLVDAEKEIFDLVFESDESIFALSQPTNVTNCLYLAEGSGGLTIWDNMIGITWRMQLLLIIRIRLADGFLLSGAVFGGVS

SEQ ID NO: 218918 - protein, 111 aa, Glycine max
  Coding DNA Sequence Number=SeqID_102140
NLQDSGTLKRVAWGLDVGTKVFQEPVHREFISTSTPEWTRYDYQHTPSETYRALPTNVIVSLETPKWMLPVHPNLVRLQPHWLIPSTQQCMCPSMEEKPVEAWEKMKKKGT

SEQ ID NO: 218919 - protein, 114 aa, Glycine max
  Coding DNA Sequence Number=SeqID_102141
  Gene Ontology: Mol. function=nucleic acid binding; Cellular component= ribonucleoprotein complex; Biological process=mRNA catabolic process, nonsense-mediated decay
  Homolog annotation: Hit_ID=O22791; Match level="QueryCoverage=67%, HitCoverage=19%, E-value=2e-24, Identity=65%"; Hit description =Putative RNA-binding protein
  Pfam annotation: Domain name=RRM_1; Domain location=8-77; Score=74.6; E_value=3.1e-19; Accession=PF00076.12; Description=RNA recognition motif. (a.k.a. RRM, R
MDSDQGKLFIGGISWDTTEDKLKEHFGNYDDVLSTSVMREKNTGKPRGFGFVVFADPNILDRVMEDKHVIDGRTRKVKLRNTTLIYKSQCTADITGNHKGLNCSRGLFMEVGLI

SEQ ID NO: 218920 - protein, 51 aa, Glycine max
  Coding DNA Sequence Number=SeqID_102142
MASAAEPLPYSSRRRDESQFNLREWAVKARISREVTNSRSLTCLKIIKHPL

SEQ ID NO: 218921 - protein, 236 aa, Glycine max
  Coding DNA Sequence Number=SeqID_102143
  Gene Ontology: Mol. function=DNA binding
  Homolog annotation: Hit_ID=Q1S0F5; Match level="QueryCoverage=88%, HitCoverage=42%, E-value=6e-18, Identity=28%"; Hit description=IMP dehydrogenase/GMP reductase
MAPTLFAHTVSYWALYPVPTATMLDIKEDDISRNLFKSLELASLQKLGQRMDQVQHQDFRKAYGKIWDLAMIEVSIEAITSPAQYYAQSLRCFTFGDFQLAPTIEKFEGILGCQLGGRKSYLFSGFYPYMARVAKVVKISAQELNRLKQNRNGVVGITRQRLEEKAKALADQGEWTSFIDVLALLVFGIAHFPNVEGLVDLAAIDAFLAYHHSKESPVVAIFANAYDTFDWRCEKR

SEQ ID NO: 218922 - protein, 362 aa, Glycine max
  Coding DNA Sequence Number=SeqID_102144
  Gene Ontology: Mol. function=heat shock protein binding; Cellular component=integral to membrane; Biological process=protein folding
  Homolog annotation: Hit_ID=Q9M2L3; Match level="QueryCoverage=100%, HitCoverage=98%, E-value=1e-100, Identity=51%"; Hit description=DnaJ- like protein
  Pfam annotation: Domain name=DUF1977; Domain location=269-361; Score =117.7; E_value=3.2e-32; Accession=PF09320.1; Description=Domain of unknown function (DUF1977)
  Pfam annotation: Domain name=DnaJ; Domain location=116-177; Score =110.7; E_value=4.3e-30; Accession=PF00226.21; Description=DnaJ domain
  Pfam module annotation: Pfam domain module=DUF1977::DnaJ; Domain location=269-361::116-177
MDGNKDDALKCLSIGKEALESGDRSRALKFVTKARRLDPTLPVDDLLSTIDADAGDQPAAAEAAESTKSPDQPSIRRRAAGAAAAAPKGPSSASSSSASYTEEQVSIIREIKRKKNFYEILGLEKTCTIEDVRKSYRKLSLKVHPDKNKAHGAEEAFKAVSKAFQCLSNEESKRKYDVSGEDEAIYEQRTARPAARGYNGYYEADIDAEEIFRNFFFGGMAPAANFGGFSFGPAGFNGFNGHRHAAEHGSGGFNVRTLIQLLPVLLILLLNFLPSSEPLYSLSKSYPYEHRFTTPKGVNYYVKSTNFVQEYPLRSEERSKIEERVEREYFSILRQNCHFELQRRQWGYIRETPHCDMLRKFE

SEQ ID NO: 218923 - protein, 139 aa, Glycine max
  Coding DNA Sequence Number=SeqID_102145
  Homolog annotation: Hit_ID=Q8LJZ1; Match level="QueryCoverage=50%, HitCoverage=9%, E-value=1e-10, Identity=52%"; Hit description=TNP2 -like protein
  Pfam annotation: Domain name=Transposase_21; Domain location=5-132; Score=-97.4; E_value=2.7e-06; Accession=PF02992.5; Description =Transposase family tnp2
  Subcellular localization annotation: CTP_CleavageSite=21; ConfidenceScore=5.24e-01
MTNVVMMQPQQQSSNKGVLVSSNNSKTIGHLYPNFREEARNLRLGLASDRMNDSAGPRQSRNDIDFYLTPLIEDLRKLWEMCKIFKRRAKGSLLGHFSAPGPTRKLRDEVTSSSGRARLLLEEASSSVSCFTTSTPHFL

SEQ ID NO: 218924 - protein, 33 aa, Glycine max
  Coding DNA Sequence Number=SeqID_102146
MPLGPLDDLGEKQLARLGEQVASGVSHQFAWAS

SEQ ID NO: 218925 - protein, 172 aa, Glycine max
  Coding DNA Sequence Number=SeqID_102147
MARFKRTEQRVKELVVLFPSVRRGWCTMYPYVAIAPDCHRHDFVRPSRPGRIGGSDWAQWSGVLTLATTISGGGHGASIKDAHLDKSPDTVNHCRGTHYVSLVGLGGSLCVITEVAPCGACGPWIFFINGVLCFLKINGSEMEKKKDDWRLHFKEKMSQEQAHHHRKPWIRA

SEQ ID NO: 218926 - protein, 123 aa, Glycine max
  Coding DNA Sequence Number=SeqID_102148
  Subcellular localization annotation: CTP_CleavageSite=27; ConfidenceScore=5.42e-01
MHALLGSFNSGNWSDSKVLHSAGLSCCAFTRNRGTGQRGKGNFCKTKQLHPFLSRRLISLTYYHLIHHHQGNPPLKFLKPSPWQKSMTRGLPLRITQVVQYHNFSPALHVLKCKLTTSIIHIP

SEQ ID NO: 218927 - protein, 70 aa, Glycine max
  Coding DNA Sequence Number=SeqID_102149
MSSTSQGPKKGRMSSSKAHGPKIYPKAHENPKAFSCIFGPIFLESSKGIGMEDWCHPLKNLSQEARGKPP

SEQ ID NO: 218928 - protein, 68 aa, Glycine max
  Coding DNA Sequence Number=SeqID_102150
  Subcellular localization annotation: CTP_CleavageSite=52; ConfidenceScore=5.20e-01
MESKDHVEQKLSQMILDKKFAGTATATATSPSPSPFRHSPSLSPFFLPPPPRPTSTQDFMGLHLDSVL

SEQ ID NO: 218929 - protein, 345 aa, Glycine max
  Coding DNA Sequence Number=SeqID_102151
  Subcellular localization annotation: CTP_CleavageSite=84; ConfidenceScore=5.02e-01
IGSALSAGSGAKPESLTKALSVVVALSPKCLLEGVKTSEYLLGFAMNVLSAPAVLSLFIATIASRKRKAPSAPTQVRFDRLRFTSQEAWERYIDVIVPKKLLPKRNMDEELTDFGDGNIVVAIVKEFYANLYDPEDKSPKHVRVRGHLIKFNEDTLNTFLKTHVIVEEGESLCAYSRFALLKPDPQELAASLCIPGRGFELNADGQPLKILRKNMTTLAQTWSARGVQSDSRSLGSLSPAINLAYIKKNYWNLDDPTITFRGPKKARGKRYEAPSTTPSEAPAPSSSTVPTPSTTQTPVIPPAPTQIPLPAPVSASPADFTFTPQMLHSMLQSIHRGQSIIMQSL

SEQ ID NO: 218930 - protein, 78 aa, Glycine max
  Coding DNA Sequence Number=SeqID_102152
MENPPAAQQHHYSANISPSHYPLPSHPQNSSPNQPQGLPAYHTPNAQTPPLAQTKTPIKEGILQQKAYRIHPNSSVLC

SEQ ID NO: 218931 - protein, 244 aa, Glycine max
  Coding DNA Sequence Number=SeqID_102153
  Gene Ontology: Mol. function=heme oxygenase (decyclizing) activity; Biological process=heme oxidation
  Homolog annotation: Hit_ID=Q94FX1; Match level="QueryCoverage=86%, HitCoverage=72%, E-value=5e-95, Identity=85%"; Hit description=Heme oxygenase 1
  Subcellular localization annotation: CTP_CleavageSite=58; ConfidenceScore=5.75e-01
MASSLSTIALFLPQSLYIKPRLAPRPLPPPQFRSLFLTSPAGARTATVMPRRAAVIVSAATAETPKKKGESKGFVEEMRFVAMRLHTRDQAREGEKEVKQPEEKAVTKWDPSVEGYLKFLVDSKLVYDTLEKIVQEAPHPSWFRFLFAGLCLLVLDCVANIGCGKTGLQDAEFRNTGLERSASLAEDLEWFKEQGYTIPEPSSPGLTYAQYLKELSVKDPQAFICHFYNIYFAHSAGGRMIGKK

SEQ ID NO: 218932 - protein, 147 aa, Glycine max
  Coding DNA Sequence Number=SeqID_102154
  Homolog annotation: Hit_ID=Q2HRE1; Match level="QueryCoverage=76%, HitCoverage=39%, E-value=4e-14, Identity=50%"; Hit description =Lipopolysaccharide-modifying protein
  Pfam annotation: Domain name=DUF821; Domain location=1-141; Score= -201.8; E_value=1e-08; Accession=PF05686.3; Description=Arabidopsis thaliana protein of unknown function (DUF821)
IGFENHKRGSTNQTCQVNALIDIRCTLKVLFGQSVKNTFCHVTLPLYVYDYMFHLLNSYAKLFRYKPSISANATELCVESMVCGAEGSVKKFMMESLVKVPANTDPCTMPAPFDPPTLYATLERKESSIQQVESWEKSYWDNQTITS

SEQ ID NO: 218933 - protein, 130 aa, Glycine max
  Coding DNA Sequence Number=SeqID_102155
MDDEVQYEAPPSARLSTRFLLGLTEKRPAMIRTSLGGFARSMHNRLIRPLMISCLRFFVQSTLIDQWPSYPLGLHIRCTTSIKLVPYQIALRFPPLDLRKKKGKVPPHSKHMPHQGPKDNVAFENDDGTQ

SEQ ID NO: 218934 - protein, 131 aa, Glycine max
  Coding DNA Sequence Number=SeqID_102156
MGGCFKGLEGSTRKGIERIERKQEEREKEEEERRGNEAEMLTNRDRDQSLRHFLFCVLCSVVGVIFAKARLCLAKAKWLPKALFALRANLAIIVRTKNQSYDEPSSKKRMQPSKGKPSKKHPPRTHNLKKP

SEQ ID NO: 218935 - protein, 105 aa, Glycine max
  Coding DNA Sequence Number=SeqID_102157
MERRFLAEHMETNLLIKNTLDSSLKSFNDSILFNMNLLMQQRLPPSVQPPPRPPTAVMQPHPKVLAPVVPALEAAISVNPMLVPMPLPPKAPPPISQPLSTKGWQ

SEQ ID NO: 218936 - protein, 339 aa, Glycine max
  Coding DNA Sequence Number=SeqID_102158
MAKLATGQGTNERIINFKQAPTESLFDAWERYKALLRSCPCHGYNQFLQISMFMQGITNDCRRMINASTRGNYLNKTTTQVNTIIEDLVTSERTIETNRSNPQKGFQNIHGNYNQVGDNKPQQRPNLWDHTTKLEEALTKLTDVVITNHKNIEAAIKSMETQIGQLTKQLQTSLIGFFAAIKENPKGHCKAIIFTIECDEGDAQHKGGHNIREAIATNNCAINTVMDSLRGFSLHVTTGATGPYHCPSQEEYATYGGGQVAQEEAMEEDAMHDGGGDESHSTLARACDIGTKKAKVANETDIEEVGDVREVVVVVKGEDTHFDACVEESQPMEEKNAID

SEQ ID NO: 218937 - protein, 94 aa, Glycine max
  Coding DNA Sequence Number=SeqID_102159
TTSISSFVPHGREDILNIVIGRSEHPGRVCVAGSSITISQYYGRASRGSNSSSTSITQQQLAEIIGSLKEEWRNEIIGNLKEEVGNEIEEENKQ

SEQ ID NO: 218938 - protein, 241 aa, Glycine max
  Coding DNA Sequence Number=SeqID_102160
  Gene Ontology: Mol. function=RNA-directed DNA polymerase activity; Cellular component=mitochondrion; Biological process=RNA-dependent DNA replication
MVAKSQSIAQHVVDLEEVFGELRKYDMCLNLEKSNPNKCTAILEMHSPTNIQEVHKLNRRLASLSRFLPKLAKKAKLFYKPLKKTEPFQTCEQAFLAFKKTIATLLVLSQPKPRVPLLLYLSVADEVVSSTLIQEERKHQLPIYFTSCILHDAEKCYQTIEKVVLSLMTQPLLPESSSGSQNKLPHQVEFAGNETTTSNWWNLYIDNVSNIKGSVARIILKGPNNITLEQALKLNFRASNN

SEQ ID NO: 218939 - protein, 108 aa, Glycine max
  Coding DNA Sequence Number=SeqID_102161
MGVFERGLASEARLSGWMWPKWAPELHTSALMMTFVERIGGGTCKTKDLDAQEEKKPEENKVEEKKAEEEEKKPEKSKDDKESKEESASPEIVQGTTFAMLGHFKHDL

SEQ ID NO: 218940 - protein, 475 aa, Glycine max
  Coding DNA Sequence Number=SeqID_102162
  Gene Ontology: Mol. function=RNA-directed DNA polymerase activity; Cellular component=chromatin; Biological process=RNA-dependent DNA replication
MDIFGCTTIQIQNLNPEVALHSILLALRLNKFADSLCKKPPGSMDELRERAKDYIQMEEMSRFMNEVRQAGHKHDKRDGITKMDLHMLDKRHKPDKRLPLSKGLRYKCYAPLTVNHTTISEEAFNLEVPIWLSPRKPPRPGSEAIKYCRYHRNIGHNTEDYWALKDKIKELIRVRYLAQFVKRPNNHQAFQRLEVSPDTVHPHTSPLLDFASERVETRGYVDLMTTFSQGKLSRSFIIRYLLVDADTSYFALVGRKTLNELGAIVSTPYLKMKLPTLTREIVTVKSLKVAPHPPTKELTKPHPIVTEGTQVMSVDKWSQIRALTVYQASLGDEFDIDPQEDTSDRGLKPLKELIKLQLGHQLGQCTWLNRDLTSREHRRIADVLHRIMDLFAWQPSDMPRIHPSIICHKLKKRKIGEELCKAIKEEIDKLLNANFIQEVRVCPKDTYPLPSINRLVDGASGFQVLSFLDAYSEYN

SEQ ID NO: 218941 - protein, 203 aa, Glycine max
  Coding DNA Sequence Number=SeqID_102163
  Gene Ontology: Mol. function=protein dimerization activity; Cellular component=nucleus; Biological process=regulation of transcription, DNA-dependent
  Homolog annotation: Hit_ID=Q7XE06; Match level="QueryCoverage=98%, HitCoverage=29%, E-value=2e-37, Identity=40%"; Hit description=HAT family dimerisation domain containing protein
MWKSSHQAVEYMVVTGHFIDVDPEWKLQKRVLSFVKVPTPRQGIDVADAIFKCLKAWGIEVKMFSVSVDNASYNDSCLKNLKENLLLRTKLVLNGDLFHVRCCTHILNLLVQVGLGKIKAIIQNVRESVKCINHNDARWKVFNDVFEQKHLKERKLILDCPTRWNSTFQMLLTALKFKIDFSAYGERDPLYTYALSNEDWEKV

SEQ ID NO: 218942 - protein, 140 aa, Glycine max
  Coding DNA Sequence Number=SeqID_102164
MLPFDFRCVTETYGLCINIFWFSGMSWNFTNCLMMGAKHLTRTKERSHVIKQRSPDEIRILQTLRYFWGSKILNIDKDQGSPSRREVRTKRKNPVIELKELVKGRAHRVDPKVRLEIPMRGSIKIPKDNLEVINKLHGHT

SEQ ID NO: 218943 - protein, 57 aa, Glycine max
  Coding DNA Sequence Number=SeqID_102165
MENMQALAVLRSLSAKGCPTSVSQFHYGEIPFCQSEMTYSGYLEFEISICQGEIPLR

SEQ ID NO: 218944 - protein, 59 aa, Glycine max
  Coding DNA Sequence Number=SeqID_102166
  Gene Ontology: Mol. function=heme oxygenase (decyclizing) activity; Biological process=heme oxidation
  Homolog annotation: Hit_ID=Q94FX1; Match level="QueryCoverage=60%, HitCoverage=14%, E-value=3e-13, Identity=100%"; Hit description=Heme oxygenase 1
VAEKLLNNKALEFYKWDDDLPRLLQNVRDKLNKVAEGGGEDGGGGSIGAKVGDGRSKDA

SEQ ID NO: 218945 - protein, 364 aa, Glycine max
  Coding DNA Sequence Number=SeqID_102167
  Gene Ontology: Mol. function=2,4-dichlorophenol 6-monooxygenase activity; Biological process=aromatic compound metabolic process
  Homolog annotation: Hit_ID=Q3SQ60; Match level="QueryCoverage=95%, HitCoverage=84%, E-value=1e-102, Identity=52%"; Hit description =Monooxygenase, FAD-binding precursor
MNLIEAGTDEYSGLTFKMPRRFAAKTQADDAAEQARQPAAVADAGDQARTARCAAFARLALAHFDLQKLDGPGGEFAPALHAQQMLQLQPMLAQRRDQGVGGGHRVLNRQVDAHAADRRHDVRGVADAQHPRFGPAIQTIDADAQQLHLIPLDDLLQAIVLEWRHLGEVQQKFLQAAAADRVEAAFIDRVAALPVVAAVDHDEVLLRPGMAHRPGRIARLLAELHPQDVARGAEGAAAERRLLAHHRVAAVGADHQLAAHADRAFRRVGQHAAYLAAVVEQLMNLRRGEQPEMGERGGLLRQKVEELPLRHKGDKFAARRQASEIRQLNVAPGDFGVQGFGALVRQRQQFVEQAQLVHDFQRRR

SEQ ID NO: 218946 - protein, 342 aa, Glycine max
  Coding DNA Sequence Number=SeqID_102168
MSVCHHLCYSKTYQEEGNQGQPKIGDKEWAAAFTGNKEDSASSSSSSSSPSSYSERATPREPLTNAQRFRLAFINDNPTPETPYSESILYEPVARETIIVQAPTWTKHDCEHTPTEAFKALPINKGPFARSGTPKIEFQKKVHMWMPITKLLLVHPVDLNLSQEECSSLGKLHEQMYLKDHAIAHPLGLHILRATDIKMVADKVSPCLQKLIRTPDVYDARTLWNQIVWMDSKKAFTTGYDGSDNTEHHDVIQVLRPVRKYHFDDACVYFKKDDEEEAVAIVVKEDVASVQAKVSAKVVDDTIVHGVIIDLTNTGVMDETLEASNATINGEVERNALELASK

SEQ ID NO: 218947 - protein, 190 aa, Glycine max
  Coding DNA Sequence Number=SeqID_102169
  Gene Ontology: Mol. function=transcription factor activity; Cellular component=intracellular; Biological process=regulation of transcription, DNA-dependent
  Homolog annotation: Hit_ID=Q6D597; Match level="QueryCoverage=91%, HitCoverage=65%, E-value=3e-65, Identity=72%"; Hit description=GntR -family transcriptional regulator
  Pfam annotation: Domain name=FCD; Domain location=41-165; Score=49.0; E_value=1.6e-11; Accession=PF07729.2; Description=FCD domain
MAASRTPVRQALFRLEREGYVEVLFRSGWQVRPFDFAYFEELYDLRIVLEQEAVKRLCEWPAGETPAALAALNRFWTEAPRLADGQAVSQHDEQFHQALVAAAGNGEMARIHRELTEKIRIIRRLDFTQQARVDATYREHAAILQAILQRQSGAAQALLGEHIAVSKAEVRKITLHMLHQARAQQLARSA

SEQ ID NO: 218948 - protein, 95 aa, Glycine max
  Coding DNA Sequence Number=SeqID_102170
MRWYRRETKVYVNPKHARRGLLGEIAETLHFMVSPVGRRVCTFDDLLPCIEKITLLSDEEDRILEAHEDAPPSQPQFEHQQFNILQRSAETRGLA

SEQ ID NO: 218949 - protein, 52 aa, Glycine max
  Coding DNA Sequence Number=SeqID_102171
MLSGTEALSTLQISSQRSQWSDHGQGVTAATKTATPFENSYWKSGDIKTSTL

SEQ ID NO: 218950 - protein, 148 aa, Glycine max
  Coding DNA Sequence Number=SeqID_102172
MTQELVARGDTLRLFAPRHSVTPSVIDEQRPMWSSAPFPEMSSSSDGDFSSLTSYLELQAAGPMIRGDTLRLFAPFCHPEAAGPMTSRDKIWSFCTLVSSRGGGPDDTRRYLTVIRTLLSSRGGGPDDKQRQNLVILHPCVIQRRRAR

SEQ ID NO: 218951 - protein, 1845 aa, Glycine max
  Coding DNA Sequence Number=SeqID_102173
  Gene Ontology: Mol. function=phosphotransferase activity, alcohol group as acceptor
  Homolog annotation: Hit_ID=Q1SXT4; Match level="QueryCoverage=59%, HitCoverage=98%, E-value=0.0, Identity=87%"; Hit description=Protein kinase-like
  Pfam annotation: Domain name=PI3Ka; Domain location=1318-1487; Score =34.5; E_value=2.5e-09; Accession=PF00613.10; Description =Phosphoinositide 3-kinase family, accessory domain (PIK domain)
  Pfam annotation: Domain name=PI3_PI4_kinase; Domain location=1583 -1793; Score=152.0; E_value=1.6e-42; Accession=PF00454.17; Description=Phosphatidylinositol 3- and 4-kinase
  Pfam module annotation: Pfam domain module=PI3Ka::PI3_PI4_kinase; Domain location=1318-1487::1583-1793
MEALIELCDLIAQNPSLFSDKLSWICDKCPPPEYLSAGSPRVSRSQLNAVLAVARFLSNCPDSADLRPKSVVLEFLRSVPHSFTQSFWPHPFSLDSVASFFLDFIGYVSKAAQSSPDFAEELAAFAGEVVISAIGEQRSGIARAFLAALSQNFLPISSFDANRLVTCLIDQFAAPTVGPVPGMPREQLAAENSSAQSSPISVNHQSLTNYNDSPGNENASGSSSSVASKAADDVSTASSRGMVNGGNHVWRTGADQLAQNLGLNDGGLGAFSSGQQVVLFEEESVEFLERQEIAFKLIAHVLEKAHVEPALLEQVRLIGKKQIQSMSVFLKIRKRDWHEQGSLLKARINTKLSVYKAAVNLKIKSLSALDSDSRSVKRLVYEAVAILIDAAEACLLSGWRKLRLCEELFSSLLLGVAHIAIARGGQPLRILLIRLKPIVLNVCAQPDTWSNTHGGMFESVMKVSCQIIESCWNKERAPVDTYIMGLATSIRERNDYEEQDNQEKPAVPFVQLNVIHLFAELSAAVNKSELVDVLLPLFIESLEEGDASTPSLLRLRLLDAVSRMASLGFEKSYRETVVLMTRSYLNKLSSVGSAESKTEATEATTERVETLPAGFLLIASGLTSDRLRSDFRHRLLSLCSDVGLAAEAKSGRSGADFLGPLLPAVAAICSDFDPTLNVEPSLLKLFRNLWFYVALFGLAPPVQKTPVTTKSVSSTLNSVGSMGAISLQAVNGPYMWNVDWSSAVQRISQGTPPLVVSSVKWLEDELELNALHNPGSRQGSGNEKAALAQRAALSAALGGRVDVTAMTTISGVKATYLLAVAFLEIIRFSSNGGILTGGTTMDAARSAFTCVFEYLKTPNLMPAVFQCLAAIVHRAFETAVSWLDKLCKANTWQRAQPTIDVVLLLSEIRIGTGKNDNWPIQTANIPAVTAAAAAASGANLKASESFNLDVISSGKCNQAAATVKCNHAGEIAGMRRLYNSIGGFQSSTAPSGLGLGAGLQRIISGAFPQQPQAEDDSFNGMLLNKFVRLLQQFVNIAEKGGEVVRSEFRDTCSQATVLLLSNLVNTFLSSGSKSNVEGFSQLLRLLCWCPAYISTHDAMETGVFIWTWLVSAAPELGALVLAELVDAWLWTIDTKRGLFASEARYSGPAAKLRPHLSPGEPELQPETDPVEQIIAHRLWLGFLIDRFEPEWYDTNYTNFAQCEAQSVSLFVQYLTNMKGDTVQVGSKGNGQENGNPLADVSDHHHPVWGQMENYAAGREKRRQLLLMLCQHEADRLDVWAQPTNTKESSSRPKISADKWIEYTRTAFSVDPRLALSLASRFPTNAFVKTEVTQLVQANIVDVRNIPEALPYFITPKAVDDNSVLLQQLPHWAPCSITQALEFLSPAYKGHPRVMAYILRVLESYPPERVTFFMPQLVQSLRHDEGKLVEGYLLRAAQRSDIFAHILIWHLQGETVPETGKDPNSGKNGSFLELLPAVRQRIIDGFNPKALDIFKREFDFFDKVTSISGVLFPLPKEERRAGIRRELEKIEMDGEDLYLPTAPNKLVRGIRVDSGIPLQSAAKVPIMITFNVIDRDGDENDVKPQACIFKVGDDCRQDVLALQVIALLRDLFEAVGLNLYLFPYGVLPTGPERGIIEVVPNTRSRSQMGETTDGGLFEIFQQDYGPVGSASFEAARQNFIISSAGYAVASLLLQPKDRHNGNLLFDNVGRLVHIDFGFILETSPGGNMRFESAHFKLSHEMTQLLDPSGVMKSDTWNQFLSLCVKGYLAARRRMDGIITTVSLMLDSGLPCFSRGDPIGNLRKRFHPEMSEREAANFMTHVCKDAYNKWTTAGYDLIQYLQQGIEK

SEQ ID NO: 218952 - protein, 103 aa, Glycine max
  Coding DNA Sequence Number=SeqID_102174
  Homolog annotation: Hit_ID=Q6UAL3; Match level="QueryCoverage=39%, HitCoverage=2%, E-value=1e-09, Identity=75%"; Hit description=Myosin heavy chain class XI E1 protein
DIRGVAVDGVEGEPVNLTEPVAEAIGAAFAAWFRLFLICSKMINEEESQSILVSGESGVGKTESTEMLMHCLAFLGGRAATEESFAPDDLNINYGSKQDDDGP

SEQ ID NO: 218953 - protein, 219 aa, Glycine max
  Coding DNA Sequence Number=SeqID_102175
  Gene Ontology: Mol. function=acyltransferase activity; Cellular component=integral to membrane
  Homolog annotation: Hit_ID=Q9FG87; Match level="QueryCoverage=79%, HitCoverage=33%, E-value=7e-55, Identity=56%"; Hit description=3 -ketoacyl-CoA synthase 19
  Pfam annotation: Domain name=FAE1_CUT1_RppA; Domain location=49-218; Score=146.8; E_value=5.7e-41; Accession=PF08392.2; Description =FAE1Type III polyketide synthase-lik
  Subcellular localization annotation: CTP_CleavageSite=41; ConfidenceScore=5.19e-01
MLKHFNFNMNIFFTLLIVVTLASFYVPQLKPRPSITIAFCMVATLVYQFIMRTPNKIYLVDFACFKPSLACLCSKEMLLDRANRVGFLSEENYKLVNKILDRSGLGPWTYVPEGLLEIPPRLTFEEARKETDTVLFGAVDELLEKTGVEAKDIGVLVVNCCLFNPTPSLSDSIVNRYKLRGNILAYNLSGMGCSAGVLAVDFAKQLLQYSKISLKDKLN

SEQ ID NO: 218954 - protein, 226 aa, Glycine max
  Coding DNA Sequence Number=SeqID_102176
MVNVCFALVNALPEASMRFMMQDELANDTQRFFNKYVEARYHASLKREIYSERKNPSVYSEPLVKEFYANIVLNDGYMERKALEQEAMIVEVEDLLCLTNINFRSKGGGANNRLHKIDDDSLLAPCFPTLKSLSINERLEKMHKEEEVLVAIGWPTPPREQALEGQRGGEATNGAGVRAEDVSDASGVEDGIDEESTTIEEEIDAKDSTEGVPQESIIEEEFTNIE

SEQ ID NO: 218955 - protein, 123 aa, Glycine max
  Coding DNA Sequence Number=SeqID_102177
MDQTLAFVEIHWSNSEFLGLIIGIWLGTQACYMHKPYTLRSNTSNELLQTYDESLGEAWQRLRDFLRQTSTHGFDEALQINIFLGGLRAQIKLMLDVSVCGKISLKTARKVIEIIENMDANAI

SEQ ID NO: 218956 - protein, 119 aa, Glycine max
  Coding DNA Sequence Number=SeqID_102178
MASSWRRTFGNMRSFVSNSMGGLRGGSNLASWVVAGTLAYFLWIKPSQDLKREQQEKAALAAAESDPYRYVETRKPIPDPQVRFPLQLLYSYSYSLQHLQVTGLIYGNKNKDKPTKPED

SEQ ID NO: 218957 - protein, 131 aa, Glycine max
  Coding DNA Sequence Number=SeqID_102179
  Gene Ontology: Mol. function=nucleic acid binding; Cellular component= nucleus; Biological process=type I hypersensitivity
  Homolog annotation: Hit_ID=Q1SXU5; Match level="QueryCoverage=87%, HitCoverage=41%, E-value=1e-51, Identity=86%"; Hit description=RNA -binding region RNP-1
  Pfam annotation: Domain name=RRM_1; Domain location=34-104; Score =72.5; E_value=1.3e-18; Accession=PF00076.12; Description=RNA recognition motif. (a.k.a. RRM, R
  Subcellular localization annotation: CTP_CleavageSite=36; ConfidenceScore=5.54e-01
MAYQAMQGPSSGSSSSSGFQLLNSPFGDTTYTKVFVGGLAWETQSETMRRYFDQFGEILEAVVITDKNTGRSKGYGFVTFRDPEAARRACADPSPVIDGRRANCNLASLGRPRPPLPYGILFCLIRFHHYE

SEQ ID NO: 218958 - protein, 227 aa, Glycine max
  Coding DNA Sequence Number=SeqID_102180
  Gene Ontology: Mol. function=nucleic acid binding; Cellular component= mitochondrion; Biological process=DNA integration
  Homolog annotation: Hit_ID=Q1RVR8; Match level="QueryCoverage=98%, HitCoverage=17%, E-value=2e-65, Identity=54%"; Hit description =Glycoside hydrolase, family 1; Integrase, catalytic region; Zinc finger, CCHC-type
MVLLSINQPKNIDEELSEDSKVIAMEEELSQFINNKTVIGTKWMFKNKLNEEGELFKHKDRLVAQKYNPHERIPYEETFELVARVKAIRILLAYKVYVKQPPRFEDKEKPHHVYKLVKALYGLKQAPRAWYERLSSFLVHNGFTRGIMDTTLFRKAEKGKLLIVQIYIDDIIFGATSKRMCKDFSELMKERRLETHPPREVHTGPIEEVQNGGSQTYGYPYASFHNH

SEQ ID NO: 218959 - protein, 185 aa, Glycine max
  Coding DNA Sequence Number=SeqID_102181
  Gene Ontology: Mol. function=nucleic acid binding
  Homolog annotation: Hit_ID=Q1SXU5; Match level="QueryCoverage=98%, HitCoverage=64%, E-value=3e-83, Identity=80%"; Hit description=RNA -binding region RNP-1
MCNGLHQHKHSSLPCYSGRIRPASPYVGSLQPARGAYVGGFGYQQPVSYSYQQGLVYPPYGYTSYGPEYIYPQSLYNPYMGQQYLQIYGVPGAVNTTTIYPYGQVGQAITSGHGYSAMQGYTVPGHQIVPYGGSNVNAITTSPMPAIQASYPSGIAAPVPGQPQFIVPAPSPQFMQGSGPDQTAG

SEQ ID NO: 218960 - protein, 96 aa, Glycine max
  Coding DNA Sequence Number=SeqID_102182
  Gene Ontology: Mol. function=DNA binding; Biological process=DNA integration
METRLVLSLATLQPIVALSTIEAEYMALAKAVKEGIWLKGLISNLRFPQEKVIIFCNSLSAIYLANDQVHHERTKHIDIIYHFIRSEKRSKFRKFI

SEQ ID NO: 218961 - protein, 54 aa, Glycine max
  Coding DNA Sequence Number=SeqID_102183
MEGAVKALDLKMISILEPLNPSHAWLFIGKGHLAQGILAQVSWLLKAEGISSPR

SEQ ID NO: 218962 - protein, 292 aa, Glycine max
  Coding DNA Sequence Number=SeqID_102184
  Gene Ontology: Mol. function=nucleic acid binding; Cellular component= intracellular; Biological process=DNA integration
MVNTIKMENFIGKHSFNVLYEVFEELTVVGIWHKLEKLFMMKSICNKLLLKSLFWPLYERSMPLKEHFNEIKFVLMELHNIDVKMENKDLAMILLASLHPSYENFVSFLGVGNDSITLDEVKSSLYSRELRLKASGNGQEASTFVLLGTNYAKGLKKQKTKCGKKSKKKSGGNVFMVVMLLLKKYLVSMGAMDSMGFLVGLKVFGCLTYYHVTEGKLEPKAKKGFFMGYEDGVNEFLVSSLSKRKVILSRDVIFDKHSMLHSKSNEDLGKAEDVTKQVEFESSTIRNISDQK

SEQ ID NO: 218963 - protein, 252 aa, Glycine max
  Coding DNA Sequence Number=SeqID_102185
  Gene Ontology: Cellular component=chloroplast
  Homolog annotation: Hit_ID=Q9S720; Match level="QueryCoverage=54%, HitCoverage=63%, E-value=7e-47, Identity=61%"; Hit description =Unknown thylakoid lumen protein, chloroplast precursor
READLKGMASISRFCCVHMRASLCNFTAQKGPSPPTTLDLEHHKTTPCLLSSIEEGRAVNRRQLILHTPVAVAAFAVPNALALNDVSEDVRVYTDDENKFKIEIPQEWQVGTGDGESSGFKSITAFYPTVASNSNVSVVITGLGPDFTRMESFGKVDEFAQTLVSGLDRSWRKPPGVAAKLIDCKSSDAIGMASNGWYNRLYTVTGQYVEEETDKYASKVQKVHMMNMVMTRKKFSHSPSSSFLFHNGFVSA

SEQ ID NO: 218964 - protein, 484 aa, Glycine max
  Coding DNA Sequence Number=SeqID_102186
  Gene Ontology: Mol. function=DNA binding; Cellular component=nucleus; Biological process=regulation of transcription
  Homolog annotation: Hit_ID=Q1SXU6; Match level="QueryCoverage=89%, HitCoverage=89%, E-value=1e-168, Identity=67%"; Hit description =SWIRM; Lambda integrase-like, N-terminal; Homeodomain-related
  Pfam annotation: Domain name=Myb_DNA-binding; Domain location=236 -281; Score=44.4; E_value=3.8e-10; Accession=PF00249.21; Description =Myb-like DNA-binding domain
  Pfam annotation: Domain name=SWIRM; Domain location=59-145; Score =123.4; E_value=6.6e-34; Accession=PF04433.7; Description=SWIRM domain
  Pfam module annotation: Pfam domain module=Myb_DNA-binding::SWIRM; Domain location=236-281::59-145
  Subcellular localization annotation: CTP_CleavageSite=3; ConfidenceScore=5.08e-01
MATAATEPLPSTTETPPAPPPPKQPPPPAPQPPAAAAAAAVKPEAPLPDSKTSAEANVIVVPSYSRWFSWDSIDECEARHLPEFFESASKSPRVYKYYRNSIVKYFRYNPTRKITFTDVRKTLVGDVGSIRRVFDFLETWGLINYHPSSSLTKPLKWDDKETKSDSASNSTESSSAPVKENTKRLCSGCKVVCTIACFACDKYDLTLCARCYVRGNYRVGVNSSDFRRVEISEETKTDWSEKEITNLLEAISHYGDDWKRVSQHVPGRTEKECVAHFLKLPFANQFQHYQQHPAVNGTDDGCNLLKMVTNADAESELDTVASAEPSKRMRLTPLADASNPIMAQAAFLSALAGSEVAQAAAQAALTTLSEVYKATKINYRAFPRNTLLQDAGITSNGGNTSDSFQGSRLHANIQLEKEELDVEKAISEIIEVQMKNIQDKLVHFEDLDLLMEKEGQQMEQMKNMFFLDQLTLLFHKSSAPKTGE

SEQ ID NO: 218965 - protein, 193 aa, Glycine max
  Coding DNA Sequence Number=SeqID_102187
MGHHQDRPLFQPFTTSYKNFKVRFFKVIILSSLGDNHLFDVKWKPLLEDLEAILKFIGMDALDFRNVCQEVGVNVVNASVVSPVNKIPPPCRTLIDVLAPPVKNKDIRKKGKRRDTKEDTRPSKKLHQQTLHHFNTLLAVDNAKLKDSVKKLEDREALWAQKLKREKDSMSSLKVEITRDLINDNVSYFVLLV

SEQ ID NO: 218966 - protein, 114 aa, Glycine max
  Coding DNA Sequence Number=SeqID_102188
  Pfam annotation: Domain name=HTH_1; Domain location=38-71; Score =13.4; E_value=0.057; Accession=PF00126.17; Description=Bacterial regulatory helix-turn-helix protein, lysR family
ACQYSYCDEEDCDLMFQLLTKKLSRLKLKHGVERSPNPVSNELENVEVDVEDPLILRTKGSGRTSTTVRGRVMRIQNCNKYGLNRHNKRSCTSVPSSQTVANGSNSEGIVAEDT

SEQ ID NO: 218967 - protein, 36 aa, Glycine max
  Coding DNA Sequence Number=SeqID_102189
MSRFIMLPRVPMSLIKKYGYACARGEKMLEQWRPVI

SEQ ID NO: 218968 - protein, 131 aa, Glycine max
  Coding DNA Sequence Number=SeqID_102190
MVYYATQSDIRVKTFARQNLPESSLLNSECLISFPALCEDPEERLWPFVFVMASVFNNERLNIINIYRTSKSKVMVVRIHVGIRFPLSSTMIYYGAQSDRLVKTSARRNLPESSLFIYGCLNRFPAICGDP

SEQ ID NO: 218969 - protein, 274 aa, Glycine max
  Coding DNA Sequence Number=SeqID_102191
  Homolog annotation: Hit_ID=Q47522; Match level="QueryCoverage=18%, HitCoverage=70%, E-value=4e-14, Identity=70%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSPSFMLGRSEIDDSSYFQAEVFLREGGQNYDVMDWTQEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 218970 - protein, 78 aa, Glycine max
  Coding DNA Sequence Number=SeqID_102192
  Homolog annotation: Hit_ID=Q94LS3; Match level="QueryCoverage=68%, HitCoverage=3%, E-value=9e-09, Identity=53%"; Hit description =Putative helicase
MLDEHNTHAKSFRMIRDRLAHSEVHNVRLKLIANREKDARTYNVPTISEVATLIADIELTYFIVLHQVAKKEREIILQ

SEQ ID NO: 218971 - protein, 119 aa, Glycine max
  Coding DNA Sequence Number=SeqID_102193
MLVIDYKTCVIDYMFSKLFKKNLKGVETFWYKAAGKDLNHGLKQLFDDIGALEMVDIARCEGHGTEGNGGNDENVEENIPDANVGSTTGSSGATKDADVTITLNDSEEETNEREGFVGK

SEQ ID NO: 218972 - protein, 155 aa, Glycine max
  Coding DNA Sequence Number=SeqID_102194
MYLQCMFLDICPNIINYKYNINQRASLDTRLKDVNKVFNHQGSHHICLNTHLKFFLPQMFFMDPHKDDLPPSSFYYRDMGHENEEEDNDNNNNNDDDNGCDHVPQQQYTIILEQEEVEVIEQEDNKHMQIQSKKKRDINTYQEELVIGHHLIIKF

SEQ ID NO: 218973 - protein, 91 aa, Glycine max
  Coding DNA Sequence Number=SeqID_102195
  Subcellular localization annotation: CTP_CleavageSite=46; ConfidenceScore=5.18e-01
MVSVALMATYCSPAVKHALSLSPNYFSTNIPQFASYQKWCMEVEPYATTSKSTIRNNTFNIGYLGHSTSALKPMLKVTMLNVSSLTSVFKN

SEQ ID NO: 218974 - protein, 377 aa, Glycine max
  Coding DNA Sequence Number=SeqID_102196
  Gene Ontology: Mol. function=DNA binding
  Homolog annotation: Hit_ID=Q9AYM0; Match level="QueryCoverage=48%, HitCoverage=47%, E-value=8e-37, Identity=47%"; Hit description =Putative AT-Hook DNA-binding protein
  Pfam annotation: Domain name=AT_hook; Domain location=111-123; Score =14.5; E_value=0.071; Accession=PF02178.9; Description=AT hook motif
  Pfam annotation: Domain name=AT_hook; Domain location=164-176; Score =12.5; E_value=0.16; Accession=PF02178.9; Description=AT hook motif
  Pfam annotation: Domain name=DUF296; Domain location=192-308; Score =190.6; E_value=3.7e-54; Accession=PF03479.5; Description=Domain of unknown function (DUF296)
  Pfam module annotation: Pfam domain module=AT_hook::AT_hook::DUF296; Domain location=111-123::164-176::192-308
VVIVVESAAPDTDSFDQNISMSGSDMASREQFTVGMHKPQPQPQQQQPQLHQNNMRMDYAAADGTAVFAPPTVTVNINGGESSPAVPPGLGLAQPQPQPQPMMVNSSEPIKRKRGRPRKYGPHGGMALALNTTTPPGGAAVPVGQSGGAFPPAPLSDSASAGIVKRRGRPRGSVNKNKKNNSSKYSGPGSWFTPHVITVKAGEDLSARIMTISQSSSRNICILTANGAISNVTLRQPASSGGTVTYEGRFEILSLGGSFFLAGTERAGGLSVSLSGPDGRVLGGGVAGLLVAASPVQIVLASFVSDVRKHFKHAKQMQNAKVSIAAGQSSSPSRGTLSESSGGVGSGSPLNQSTGACNNTMNNCTTPTQSFQGMPWK

SEQ ID NO: 218975 - protein, 63 aa, Glycine max
  Coding DNA Sequence Number=SeqID_102197
  Subcellular localization annotation: CTP_CleavageSite=39; ConfidenceScore=5.03e-01
MRMLSTWAIKGKGNTTTTTFRDRLHPSIGQGQDQGGSSNAMPRQNLYENTSNLEETLTQFMQE

SEQ ID NO: 218976 - protein, 76 aa, Glycine max
  Coding DNA Sequence Number=SeqID_102198
MQLAGAIGEFGVEVTAGTGLASDASDFRGVLKVAGMQRPFPRVQTEQRAEEQGIARQTGDLLEVHKSPTPTAISVA

SEQ ID NO: 218977 - protein, 361 aa, Glycine max
  Coding DNA Sequence Number=SeqID_102199
  Subcellular localization annotation: CTP_CleavageSite=22; ConfidenceScore=5.03e-01
MASVWTLHFRSLSLRPCLYISRSNSSTATRNCISIRNGISNWRSGTQQLKHDSINSITKFHHQLVNSVAIPPFLLNRNGGGNFPIWVCVAVVVLVVAVRVRVVSRKKERPGSVADLVRRGQLRSDRRGISRPLKYEDPFNNPFVKVGKSDSTVEMCGKVYRLAPVTLTQEQQATHQKRRLRAYQWKRPTIFLREGDLVPPDVDPDTVRWIPANHPFATTATDLDEDLAQNNVYQKHGVPFRIQAEHEALQKKLEALQNDQKLNKLVIDPINAKEFERPFNSHARLNDQADKSSVNNQEQKHNKLVIDPIDAKEIERPFNSDTRLNDQAEKSSVNNQASASDSPRVDSGPNHFDSTSSEDSS

SEQ ID NO: 218978 - protein, 827 aa, Glycine max
  Coding DNA Sequence Number=SeqID_102200
  Gene Ontology: Mol. function=sugar porter activity; Cellular component=integral to membrane; Biological process=carbohydrate transport
  Homolog annotation: Hit_ID=Q1T029; Match level="QueryCoverage=95%, HitCoverage=100%, E-value=0.0, Identity=69%"; Hit description=Sugar transporter superfamily; Major facilitator superfamily MFS_1
  Pfam annotation: Domain name=MFS_1; Domain location=47-773; Score =96.8; E_value=6.3e-26; Accession=PF07690.6; Description=Major Facilitator Superfamily
  Pfam annotation: Domain name=Sugar_tr; Domain location=42-814; Score =170.2; E_value=5.2e-48; Accession=PF00083.14; Description=Sugar (and other) transporter
  Pfam module annotation: Pfam domain module=MFS_1::Sugar_tr; Domain location=47-773::42-814
MGIYVMQERLEVSEKGKTGSTCKNSQAPLQLHHISEMKGAVLVAIAASIGNFLQGWDNATIAGAIVYIKKDLALQTTMEGLVVAMSLIGATVITTCSGPIADWLGRRPMMIISSVLYFLGGLVMLWSPNVYVLCLARLLDGFGIGLAVTLVPVYISETAPSEIRGSLNTLPQFSGSGGMFLSYCMVFGMSLSPAPSWRLMLGVLSIPSLLYFALTIFFLPESPRWLVSKGRMLEAKKVLQRLRGREDVSDFLGPKQLLIVAYLLLANLCLLLSVIPALPKFLLIQIYRPGMGFILSSRALVQGEMALLVEGLGIGGDTSIEEYIIGPADEVADGHEHATEKDKIRLYGSQAGLSWLAKPVTGQSSIGLASRHGSIINQSMPLMDPLVTLFGSIHEKLPETGAGGSMRSTLFPNFGSMFSTAEPHAKNEQWDEESLQREGEDYMSDAAGGDSDDNLHSPLISRQTTSLEKDLPPPPPSHGSILGSMRRHSSLMQGSGEQGGSTGIGGGWQLAWKWTDKGEDGKQQGGFKRIYLHEEGVSASRRGSIVSIPGEGEFVQAAALVSQPALYSKELIDGHPVGPAMVHPSETASKGPSWKALLEPGVKHALVVGVGIQILQQFSGINGVLYYTPQILEEAGVEVLLSDIGIGSESASFLISAFTTFLMLPCIGVAMKLMDVSGRRQLLLTTIPVLIGSLIILVIGSLVNFGNVAHAAISTVCVVVYFCCFVMGYGPIPNILCSEIFPTRVRGLCIAICALVFWIGDIIITYSLPVMLGSLGLGGVFAIYAVVCFISWIFVFLKVPETKGMPLEVISEFFSVGAKQAASAKNE

SEQ ID NO: 218979 - protein, 331 aa, Glycine max
  Coding DNA Sequence Number=SeqID_102201
  Gene Ontology: Mol. function=dolichyl-diphosphooligosaccharide -protein glycotransferase activity; Cellular component=endoplasmic reticulum; Biological process=protein amino acid glycosylation
  Homolog annotation: Hit_ID=Q1T021; Match level="QueryCoverage=94%, HitCoverage=45%, E-value=1e-119, Identity=71%"; Hit description =Ribophorin I
  Pfam annotation: Domain name=Ribophorin_I; Domain location=1-174; Score=-224.3; E_value=0.01; Accession=PF04597.5; Description =Ribophorin I
PYPMWGRRRTAFTIGYGLPLRDFLSGSDGQRFLNISCGAPISELVIDTLFVKVVLPEGSKDISVSVPFPVKQSQETKLSHLDIVGRPVVVLEKNNVVPEHNEHFQDKIRNEAIRERVGVAPIVEKMVENRLRWFGHVERRPVYYKFNSLSMLREPLMLISGFLFLFVACIVYTHADISISKSSASYLAKLQWDEVQATIQQVHGIIGRCLTAHDKLEASLHDLSRTGDTQACKATRKSVDSSLKELSKELKQPLAILQSSPQAAQILPKVEELVTKERELQDKLLVKHSTIVDAYEKKAGREIENRIASQQQKITALRREIDDLMDLIDEI

SEQ ID NO: 218980 - protein, 523 aa, Glycine max
  Coding DNA Sequence Number=SeqID_102202
  Gene Ontology: Mol. function=calmodulin binding; Cellular component =integral to membrane; Biological process=cell death
  Homolog annotation: Hit_ID=Q1T019; Match level="QueryCoverage=99%, HitCoverage=100%, E-value=1e-178, Identity=64%"; Hit description=Mlo- related protein
  Pfam annotation: Domain name=Mlo; Domain location=8-508; Score=721.3; E_value=6.6e-214; Accession=PF03094.6; Description=Mlo family
MAGGGEGGDTRQLDLTPTWAVAAVCAIIVIISILLEKIIHKFAKMFEERKQHALLEALEKIKAELMVLGFISLLLTFGQNYISKMCIPSKYAKTMLPCVPPEERHGAGHHTEEAGGGEAKDGGHRRRLLSYERRFLASGGGGQSCKPGYTPLISVTGLHQLHIFIFFLAVFHVIYSAITMTLGRAKIRGWKAWEADHIVDQDALNDPRRFRLTHETSFVRDHNSIWTKTPVSFYLVCFFRQFFRSVRRADYLTMRHGFVTVSSFGNATSVICLHCLSLSLTKRSLEDDFKVVVGISNLASWSDVVKRMACCFLGVFSSTTGEQIYLQCQLRVILAVGTKLQGIITRMALDISERHAVVQGIPLVQVSDKYFWFAWPQLVLYLIHYVLFQYEFGWASCFYEDDSLMIVRVALGLGAQVVCSYVTLPLYALVTQMGSTMKKSIFDEQTSKALKQWHKNALKKKPSKGRTETQTLGATGGPRDHSPEQSPRRPSGAGDTEMAEQSATIVTAVDHEPYDNRDLLSGP

SEQ ID NO: 218981 - protein, 295 aa, Glycine max
  Coding DNA Sequence Number=SeqID_102203
  Gene Ontology: Mol. function=dolichyl-diphosphooligosaccharide -protein glycotransferase activity; Cellular component=endoplasmic reticulum; Biological process=protein amino acid glycosylation
  Homolog annotation: Hit_ID=Q1T021; Match level="QueryCoverage=89%, HitCoverage=42%, E-value=9e-90, Identity=68%"; Hit description =Ribophorin I
  Pfam annotation: Domain name=Ribophorin_I; Domain location=31-295; Score=102.7; E_value=1.1e-27; Accession=PF04597.5; Description =Ribophorin I
  Subcellular localization annotation: CTP_CleavageSite=56; ConfidenceScore=5.04e-01
MKRGIMSSNLFLFPILFSFAFLSSPVLSASDLILAKVDRRIDLTSQIVRITTSLKVQNTGSDVVSEILLSFPENQTSNLAYLKAALGEGKGKAKPSSGVGLPVEVVHLKDVPPALTIYSVSLPKGLGKGDILTLDVLAVFTHSLQPFPEKINQADIQLLLFQESARYLSPYAVKVQSLTVKLPDARIESYTKLGNAKLQGSELKYGPYENLPPFSYLPIVVHFENNQPFAVAKELVREIEISHWGQYTDHRALQYYPCWCSEQGEFSRSPCFFDSELFDVLLVGHVIIVCFLLQA

SEQ ID NO: 218982 - protein, 270 aa, Glycine max
  Coding DNA Sequence Number=SeqID_102204
  Gene Ontology: Mol. function=chitin binding; Cellular component =extracellular region; Biological process=chitin metabolic process
  Homolog annotation: Hit_ID=UPI0000612705; Match level="QueryCoverage =97%, HitCoverage=92%, E-value=2e-31, Identity=26%"; Hit description =UPI0000612705 related cluster
RLHVLTLRGLHALAIRGLHVLGFRVLHALTFRGLHVIPFRGLHVLVFTGLHALILRGLHVLVFRGLHDLTFRGVHVLAFRGLHAFTFRGQHVLPLRGLHAVAFKGLHVLIFRGLHVLALEDYTSPPSEGYTLSPSLGYMFSPSEGCTTSPLEDNTSSPSEGYMPSPSEDYKSLPSEDYTSSPQEGYTPSPLEGYMPSPSEDYTSSPSVGYTPSPSKDYTSSPSEDYTSSASEVCTPSPSEGYTISPAEEYTSSPSEGYTPSPSEDNTSSP

SEQ ID NO: 218983 - protein, 295 aa, Glycine max
  Coding DNA Sequence Number=SeqID_102205
  Gene Ontology: Mol. function=calmodulin binding; Cellular component =integral to membrane; Biological process=cell death
  Homolog annotation: Hit_ID=Q1T017; Match level="QueryCoverage=99%, HitCoverage=60%, E-value=1e-122, Identity=72%"; Hit description=Mlo -related protein
  Pfam annotation: Domain name=Mlo; Domain location=1-243; Score=120.4; E_value=5.1e-33; Accession=PF03094.6; Description=Mlo family
MQAHFAPDSKFDFQKYIKRSMEDDFKVVVGISIPLWVFAIVFMLVNVYKWYTLTWLSLAPLVILLLVGTKLELIIMEMAQQIQDRATIVRGVPIVEPNNKYFWFNRPQWIIFLIHFTLFENAFQIAFFLWTWYEFKITSCFHENLPLILTRVVLGIALQVVCSYITFPLYSLVTQMGSHMKKTIFEEQTAKALKKWQKAAKDKRKLRKAGIDIPSGTMSGETTPSQGTSPLHLLHKYKPSHTDTDSVLYSPRSYQSDTDLSETEGSSHQLNEITQTRQASRNGETHNIDFSFVKP

SEQ ID NO: 218984 - protein, 194 aa, Glycine max
  Coding DNA Sequence Number=SeqID_102206
  Gene Ontology: Cellular component=chloroplast thylakoid membrane
MLLFNITRLLASALWQKLWLQLDSSIICVCFFLTERLLLQKLLLASSINKVDHSLVKIKPYNFSLNLNRQGTMQTSLTRRPLTIQATYSDGGRPSSASVFVGGFLLGGLIVGTLGCVYAPQISKALAGADRKELMRKLPKFIYDEEKALEKTRKVLAEKIEQLNAAIDDVSAQLRSEEASNGVAVNSDEIEAAT

SEQ ID NO: 218985 - protein, 264 aa, Glycine max
  Coding DNA Sequence Number=SeqID_102207
  Gene Ontology: Mol. function=calmodulin binding; Cellular component =integral to membrane; Biological process=cell death
  Homolog annotation: Hit_ID=Q93XC8; Match level="QueryCoverage=95%, HitCoverage=45%, E-value=1e-81, Identity=61%"; Hit description=Seven transmembrane protein MLO2
  Pfam annotation: Domain name=Mlo; Domain location=7-264; Score=164.4; E_value=3e-46; Accession=PF03094.6; Description=Mlo family
MAGGAATAERSLKETPTWAVAAVCSVFIIISVLIEHGIHSLGKWFQKRHKKAMNEALEKIKSELMLLGFISLLITFGTKYIAKICIPVSAGDIMLPCKKVEVSDSDDDSNDRRKLLSFDDNVVEWRRVLAAASGGDYCSQKGKVPLISQSGVHQLHIFIFVLAVFHIFYSVMTMVLARAKMKKWKAWEAETSSLEYQFTNDPARFRLAHQTSFVRRHSGWSRMPGIRWIVAFFRQFFGSVTKVDYMTMRHGFINVGANAYMYSI

SEQ ID NO: 218986 - protein, 182 aa, Glycine max
  Coding DNA Sequence Number=SeqID_102208
  Homolog annotation: Hit_ID=Q0KBC4; Match level="QueryCoverage=87%, HitCoverage=78%, E-value=5e-13, Identity=31%"; Hit description =Uncharacterized conserved protein
MKARAQPALAFQADAGVGQVAVGGAMFVGQGGPERGQVLIVGLPTRLQAQPSAARELQVVAVGQQQVEWGVGASHRCQSVDMHGGGVAAAQERVADIGDHGHASTGTDAGPAAAGAQVAPPDDGGLILPGGQRRGRAGVELITVAGHHQPPARVVHPAKSEQAHGLIVHGLRSLAPLPARPG

SEQ ID NO: 218987 - protein, 108 aa, Glycine max
  Coding DNA Sequence Number=SeqID_102209
MRSVLKRELLGNIDKQRRWQSRTLVLAILITNHPCFSTLGNHPSYAINAYYQMHGRNYWNCDFKSSEDHEQALQRAGILARNVMNHDNSERERIQNFLLSALFVSVEF

SEQ ID NO: 218988 - protein, 169 aa, Glycine max
  Coding DNA Sequence Number=SeqID_102210
MLGVVVQPPPIVQQQPTPMDDIVCILFSAYLIEILQLTIEVFLRKQEDGIVGTNLGVEGVDPRPMSKANEIIVVVALFKEMDEDKLRKKEKEYGVKERNKDVMKPNARPPHCLILARPTIKPPLVVPINPNVKIRHVRERIVAKAFNNFQSVFDDVTTYPSTGGRRGAH

SEQ ID NO: 218989 - protein, 933 aa, Glycine max
  Coding DNA Sequence Number=SeqID_102211
  Gene Ontology: Mol. function=metabotropic glutamate, GABA-B-like receptor activity; Cellular component=membrane; Biological process =ion transport
  Homolog annotation: Hit_ID=Q1T013; Match level="QueryCoverage=98%, HitCoverage=99%, E-value=0.0, Identity=75%"; Hit description =Ionotropic glutamate receptor; Extracellular ligand-binding receptor
  Pfam annotation: Domain name=ANF_receptor; Domain location=51-409; Score=320.6; E_value=2.8e-93; Accession=PF01094.18; Description =Receptor family ligand binding region
  Pfam annotation: Domain name=Lig_chan; Domain location=590-854; Score= 341.2; E_value=1.7e-99; Accession=PF00060.17; Description=Ligand -gated ion channel
  Pfam annotation: Domain name=SBP_bac_3; Domain location=477-813; Score=-34.3; E_value=8.4e-06; Accession=PF00497.10; Description =Bacterial extracellular solute-binding proteins, family 3
  Pfam module annotation: Pfam domain module=ANF_receptor::Lig _chan::SBP_bac_3; Domain location=51-409::590-854::477-813
  Subcellular localization annotation: CTP_CleavageSite=24; ConfidenceScore=5.23e-01
MNLFWVVCWVVSCLGVSSVTPFVAAANLSSSRPAFVHIGAIFSMDSVLGKVAKITLEEAVKDVNADKTILHGTQLVLSMQNSNHSGFVGMVQALRFMETDVIAIIGPQSSVTAHIISHVANELRVPLVSFAATDPTLSSLQFPFFVRTTQSDLYQMKAVAEIIDYYGWKEVIAIYVDDDYGRNGVAALDDELASRRCRISFKEGIKSGTKVDRGEITSLLVKVALMQSRVIVLHAQTDSGFMIFNLARYLGMTDNGYVWIVTDWLSSFLDSSSLPSETMDVLQGVLVLRQHTPDSDRKRAFLSRWKKLTGGSLGLHSYGLYAYDSVWLVARAIDAFFSQGGIVSCTNYTSLGGDKGGDLNLDAMSIFDNGTLLLKNILQSDFVGLSGQMKFEPDRSLVHPAYDVLNVVGNGLRRVGYWSNYSGLSIVSPEIFYAKPPNRSSANQKLYSVIWPGETLSKPRGWVFPNNGRQLRIGVPIRVSYREFVAPVQGTEMFKGFCVDVFTAAVNLLPYAVPYRFVPFGDGHKNPSYTQLVNLITTGYFDGAIGDIAIVTNRTRIVDFTQPYAASGLVVVAPFKKINSGGWSFLQPFTPLMWIVTGCLFLFIGIVVWILEHRINDEFRGPPRQQIITMLWFSLSTLFFSHRENTMSSLGRLVMLIWLFVVLILTSSYTASLTSILTVQQLYSPISGIESLKASDEPIGFPVGSFAEHYLIQDLGIAKSRLIPLGSPEEYAKALQLGPKRGGVAAIVDERPYVEIFLSSQCTFRIVGQEFTRSGWGFAFPRDSPLAVDMSTAILQLSETGDLQRIHDKWMTRSSCSLENAEIDSDRLQLKSFWGLFLICGIACFIALVLHFMQLMFQLWQSPPSEPASSASSISGRFQRFLTLIDEKEDPSKSKGRKRNGDERSLEDQLGRQPKRKMEMQTKWGATYQKWDE

SEQ ID NO: 218990 - protein, 295 aa, Glycine max
  Coding DNA Sequence Number=SeqID_102212
  Gene Ontology: Mol. function=glyceraldehyde-3-phosphate dehydrogenase (NADP+) (phosphorylating) activity; Cellular component=chloroplast; Biological process=reductive pentose-phosphate cycle
  Homolog annotation: Hit_ID=P12859; Match level="QueryCoverage=99%, HitCoverage=59%, E-value=1e-119, Identity=74%"; Hit description =Glyceraldehyde-3-phosphate dehydrogenase B, chloroplast precursor
  Pfam annotation: Domain name=Gp_dh_C; Domain location=63-220; Score =347.2; E_value=2.7e-101; Accession=PF02800.10; Description =Glyceraldehyde 3-phosphate dehydrogen
  Pfam annotation: Domain name=Gp_dh_N; Domain location=1-58; Score= -56.5; E_value=9e-05; Accession=PF00044.14; Description =Glyceraldehyde 3-phosphate dehydrogen
  Pfam module annotation: Pfam domain module=Gp_dh_C::Gp_dh_N; Domain location=63-220::1-58
GTGVFVDGPGAGKHIQAGAKKVIITAPAKGADIPTYVVGVNEGDYTHEISNIISNASCTTNCLAPFVKILDAEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYSIQLVELKLLVIMDHAIDGYCVGDCSQRVVDLAHLVASKWPGAPKAGSGDPLEDFCETNPADEECKVYE

SEQ ID NO: 218991 - protein, 95 aa, Glycine max
  Coding DNA Sequence Number=SeqID_102213
MPADVGQEKMTDRGLKKKHDRMTPIEHFQIDIVQPTLRNFFHKRWPIIFLYGKGRLGFFVRAQPKLCFGRHRHVLVYSARNTLTHLGKTTIILRY

SEQ ID NO: 218992 - protein, 179 aa, Glycine max
  Coding DNA Sequence Number=SeqID_102214
MDKPIPNKPKKCLLCKSEEHSRTNYLYKQGTSTINLAGNSHNHHNCHDLPSLNNLCHRCCPFLHLTCIETVDNFFSSDGNNEEKEESMEEKLDLQFFVKGIEVGHRNMAALFFLVNFFSDVYGWMILVFLVTYSWVLGIIFISIVNELLGRFSSVTILAWEGSRRKREKRQEERDQKEG

SEQ ID NO: 218993 - protein, 56 aa, Glycine max
  Coding DNA Sequence Number=SeqID_102215
MTRDSLLVTVAEDNRDLLSTVLYGAAGRVVHSRHGPMGGRFRTREGSIVIVSDWWG

SEQ ID NO: 218994 - protein, 798 aa, Glycine max
  Coding DNA Sequence Number=SeqID_102216
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=Q8S3L6; Match level="QueryCoverage=97%, HitCoverage=91%, E-value=0.0, Identity=78%"; Hit description =Putative trehalose synthase
  Pfam annotation: Domain name=Glyco_transf_20; Domain location=1-484; Score=829.3; E_value=2e-246; Accession=PF00982.11; Description =Glycosyltransferase family 20
  Pfam annotation: Domain name=Hydrolase_3; Domain location=532-777; Score=-83.0; E_value=0.026; Accession=PF08282.2; Description =haloacid dehalogenase-like hydrolase
  Pfam annotation: Domain name=Trehalose_PPase; Domain location=533 -768; Score=329.9; E_value=4.4e-96; Accession=PF02358.7; Description =Trehalose-phosphatase
  Pfam module annotation: Pfam domain module=Glyco_transf_20::Hydrolase_ 3::Trehalose_PPase; Domain location=1-484::532-777::533-768
MIIVANQLPLKAKRKEDNKGWSFSWNEDSLLLQLKDGLPDDMEVLYVGSLRVDIDPAEQDDVSQYLLDKFKCVPTFLPADVLAKFYDGFCKRQLWPLFHYMLPFSTDKSHRFDRSLWEAYVLANKLFFQKVVEIINPEDDYIWIHDYHLMVLPTFIRRRFNRVKMGFFLHSPFPSSEIYRTLPVREEILKALLNSDIIGFHTFDYARHFLSCCSRMLGLEYQSKRGYLGLEYYGRTISIKIMPVGIHMGRIESVMRMADEECKVRELKQKFEGKTILLGIDDMDIFKGINLKILAMEQMLRQHPKWQGRAVLVQIVNPARGKGIHLEEIHAEIQESCNRINRVFGRPGYEPIVFIDRAVPIAEKVAYYCIAECVIVTAVRDGMNLTPYEYIACRQGISGSESCSNVNDPKKSMLVISEFIGCSPSLSGAIRVNPWNVEATSEAMNEAISTGDGEKQLRHEKHYRYVSTHDVAYWSRSFLQDMERACTDLLRKRCWGIGLSFGFRVVALDPNFKKLSIDAMVSAYKRAKNRAILLDYDGTVMPQNSINKSPSKEVLSILESLSEDPKNVVFIVSGRGRNSLSDWFNSCEKLGIAAEHGYFLRWSHNREWENCGKSSDFGWMQIAEPVMKLYTEATDGSSIERKESALVWQYRDADLGFGSAQAKEMLDHLESVLANEPVAVKSGQFIVEVKPQDVSKGLVAEKIFSSMDGKGKQADFVLCVGDDRSDEDMFEIVSSAISRNILATNASVFACTVGQKPSKAKYYLDDTTEVTSMLESLAEESDASPYIEETGDSSRRQV

SEQ ID NO: 218995 - protein, 71 aa, Glycine max
  Coding DNA Sequence Number=SeqID_102217
MFVITFNTSSYAYNLPPLSYYYRSSLPTQMYDMGYEDEEEDDDNNNNKDDDDDDDDNDHDHDGDIHDHQQQ

SEQ ID NO: 218996 - protein, 79 aa, Glycine max
  Coding DNA Sequence Number=SeqID_102218
MKKVGCEKEGPLVVKEVVFVLHLIGLHIKNLMPHGLGFLNVILQGAGYPNLISIVISKLHIMQSKILQHTIHELGNICA

SEQ ID NO: 218997 - protein, 118 aa, Glycine max
  Coding DNA Sequence Number=SeqID_102219
  Homolog annotation: Hit_ID=Q1RUD8; Match level="QueryCoverage=73%, HitCoverage=18%, E-value=5e-09, Identity=35%"; Hit description=IMP dehydrogenase/GMP reductase
MGTNQTGKRFYQVKIKDLDITSIKELGRLMGPLQMQAFRKAYGKILELTIAKIFIEAIASLTQYYDHPLRCFTFGDFQLVSTVEEFEEILGCPLGGRKLYLFSRFLPSLRKIAVVVRD

SEQ ID NO: 218998 - protein, 258 aa, Glycine max
  Coding DNA Sequence Number=SeqID_102220
DVRKKAQAIQKQNTASHVLSRGGYDYLEQKQNTAQSGNVDGVIDPPSPVRCHVKWKMARTKKIGEMTTEAPKEIAEKIDSFEEQATQGSFVPHGRQDVLTAAIGCLEHPGRVCAAGAGVTIKQYFGSAPRTSRSSSSLPPEELQQLTQQIRDQLEESITEKVARQLMASFSQMQSQIQSQMQSQGLALPPEPLVGPSGPRVSTKGSCVDPSGNDPETGDSDRFGLYIKADPARLVALGRVYEGSTIVHNTPLLPGQVM

SEQ ID NO: 218999 - protein, 198 aa, Glycine max
  Coding DNA Sequence Number=SeqID_102221
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q336W3; Match level="QueryCoverage=66%, HitCoverage=40%, E-value=8e-44, Identity=63%"; Hit description =Protein phosphatase 2C containing protein, expressed
MPVGMDFPPPFTMLEAKDSAFVVDDQKSGDLNDIKPMTKGKPPRHASTLRHSISNTRLLAISDLSLDVGVTGSKSSSEENTEFLPILRSGSCAERGPKQYMEDEHICIDNLIQHIGPASTIPLPGAFYGVFDGHGGTDAALFIRNNILRFIVEDSHFPTCVGEAITSAFVKADYAFADSSSLDISSGTTALTALVFGR

SEQ ID NO: 219000 - protein, 199 aa, Glycine max
  Coding DNA Sequence Number=SeqID_102222
MMEAMMSVRRMIEVNAAIVVATSTAIELDPTHPPGFNQVNHLASDMVFSKHSFPPYGLPPNYTPPNVAHTPNETVDNSTPIPIESQHPQSGQYRQKPQPLHFVVGIAKVERERFDHIEERLRAIEGGRDYAFANMAELCLVPNVVIPLMLKVLDFDKYKETTCPKNHLKMYNRKMGAYSKNEKLLMHFFQESLTKAVVT

SEQ ID NO: 219001 - protein, 112 aa, Glycine max
  Coding DNA Sequence Number=SeqID_102223
  Subcellular localization annotation: CTP_CleavageSite=62; ConfidenceScore=5.32e-01
MKEMPLQVNGGGDGQVRDAPSCITARVEVTMSPTSCTCPPAMPTLTSPRSSNTKNKAPTPPTATEPVRRCGRQPPPLSEARYGQIAFSLCRSIHCFSLFVFLLAIGVRKFQR

SEQ ID NO: 219002 - protein, 173 aa, Glycine max
  Coding DNA Sequence Number=SeqID_102224
MVMRGFLCICFMSFRTVLWIMKDYKAQSSWTWTKSFVMSTSYFPVRYPFFPDMLHKKCVTEDKTAKDIIQTQGFVLGNALDTSGTLGISGILDSSSFDNSGTLGSSAQELLVEVAAQVWEVRALLALTTSILEDCVLQQLLCDCLQTIMLEPQMKKTLSTNYVVCGTFIDKTV

SEQ ID NO: 219003 - protein, 812 aa, Glycine max
  Coding DNA Sequence Number=SeqID_102225
  Gene Ontology: Mol. function=ubiquitin-protein ligase activity; Cellular component=ubiquitin ligase complex; Biological process =protein ubiquitination
  Homolog annotation: Hit_ID=Q2QU07; Match level="QueryCoverage=97%, HitCoverage=98%, E-value=0.0, Identity=65%"; Hit description =Armadillo/beta-catenin repeat family protein, putative, expressed
  Pfam annotation: Domain name=Arm; Domain location=138-178; Score =23.4; E_value=0.00079; Accession=PF00514.13; Description =Armadillobeta-catenin-like repeat
  Pfam annotation: Domain name=Arm; Domain location=180-220; Score =11.6; E_value=0.43; Accession=PF00514.13; Description=Armadillobeta -catenin-like repeat
  Pfam annotation: Domain name=Arm; Domain location=265-305; Score=6.2; E_value=2.1; Accession=PF00514.13; Description=Armadillobeta-catenin -like repeat
  Pfam annotation: Domain name=Arm; Domain location=306-345; Score=8.2; E_value=1.1; Accession=PF00514.13; Description=Armadillobeta-catenin -like repeat
  Pfam annotation: Domain name=Arm; Domain location=346-391; Score=1.0; E_value=9.3; Accession=PF00514.13; Description=Armadillobeta-catenin -like repeat
  Pfam annotation: Domain name=Arm; Domain location=489-529; Score=7.1; E_value=1.6; Accession=PF00514.13; Description=Armadillobeta-catenin -like repeat
  Pfam annotation: Domain name=Arm; Domain location=589-630; Score =16.4; E_value=0.11; Accession=PF00514.13; Description=Armadillobeta -catenin-like repeat
  Pfam annotation: Domain name=Arm; Domain location=672-712; Score=6.0; E_value=2.1; Accession=PF00514.13; Description=Armadillobeta-catenin -like repeat
  Pfam annotation: Domain name=Arm; Domain location=717-758; Score =11.4; E_value=0.46; Accession=PF00514.13; Description=Armadillobeta -catenin-like repeat
  Pfam annotation: Domain name=HEAT; Domain location=143-180; Score =14.1; E_value=0.52; Accession=PF02985.12; Description=HEAT repeat
  Pfam annotation: Domain name=HEAT; Domain location=185-222; Score =2.7; E_value=20; Accession=PF02985.12; Description=HEAT repeat
  Pfam annotation: Domain name=HEAT; Domain location=311-347; Score =4.7; E_value=11; Accession=PF02985.12; Description=HEAT repeat
  Pfam annotation: Domain name=HEAT; Domain location=458-488; Score =0.9; E_value=34; Accession=PF02985.12; Description=HEAT repeat
  Pfam annotation: Domain name=HEAT; Domain location=594-632; Score =1.9; E_value=25; Accession=PF02985.12; Description=HEAT repeat
  Pfam annotation: Domain name=HEAT; Domain location=683-714; Score =9.3; E_value=3.1; Accession=PF02985.12; Description=HEAT repeat
  Pfam annotation: Domain name=HEAT; Domain location=767-802; Score =0.9; E_value=33; Accession=PF02985.12; Description=HEAT repeat
  Pfam annotation: Domain name=U-box; Domain location=30-106; Score =43.8; E_value=5.8e-10; Accession=PF04564.6; Description=U-box domain
  Pfam module annotation: Pfam domain module=Arm::Arm::Arm::Arm::Arm::Ar m::Arm::Arm::Arm::HEAT::HEAT::HEAT::HEAT::HEAT::HEAT::HEAT::U-box; Domain location=138-178::180-220::265-305::306-345::346-391::489 -529::589-630::...
  Pfam module annotation: Domain location=672-712::717-758::143 -180::185-222::311-347::458-488::594-632::683-714::767-802::30-106
MAASWDGSSDPGSQSDDSFLERLHIEPLYDAFVCPLTKQVMRDPVTLENGQTFEREAIEKWFKECRESGRRLLCPLTLQELRSTELNPSMALRNTIEEWTARNEAAQLDMARRSLNMGSPENETLQALKYVQHICRRSRSNKYTVRNAGLIPMIVDMLKSSSRKVRCRALETLRVVVEEDDENKELLAEGDTVRTVVKFLSHELSKEREEAVSLLYELSKSATLCEKIGSINGAILILVGMTSSKSEDLLTVEKADKTLENLEKCESNVRQMAENGRLQPLLTQLLEGPPETKLSMATYLGELVLNNDVKVLVAGTVGSSLINIMKSGNMQSREAALRALNQISSCDPSAKILIEAGILSPLVNDLFAVGPNQLPTRLKEISATILASVVNSGEDFYSIPFGPDHQTLVSEDIVRNLLHLISNTGPAIECKLLQVLVGLTISPTTVLSVVAAIKSSGATISLVQFIEAPQKDLRVASIKLLQNLSPHMGQELADALRGSVGQLGSLIKVISENTGITEEQAAAVGLLADLPERDLGLTRQLLDEGAFVMVISRVIAIRQGEIRGTRFMTPFLEGLVKIVARVTYVLAEEPDAIALCRDHNLAALFIDLLQSNGLDNVQMVSATALENLSQESKNLTRLPEMPSLGFCASVFSCFSKQPVITGLCRLHRGICSLKETFCLYEGQAVLKLVGLLDHTNVIVVEAALAALATLIDDGVDIEQGVAILCEAEGVKPILDVLLEKRTETLRRRAVWAVERLLRTDDIAYEVSGDQNVSTALVDAFQHGDYRTRQTAERALKHVDKIPNFSGIFPNMG

SEQ ID NO: 219004 - protein, 211 aa, Glycine max
  Coding DNA Sequence Number=SeqID_102226
  Gene Ontology: Mol. function=amino acid transporter activity; Cellular component=membrane; Biological process=amino acid transport
  Homolog annotation: Hit_ID=Q1SQ57; Match level="QueryCoverage=98%, HitCoverage=34%, E-value=6e-49, Identity=50%"; Hit description=Amino acid permease-associated region
MVAISVLILRYIPPDEVLLLPSLQEPIVSASTQYSWCSLEANEEDAKTHVGASGSKKPTVFKEDVPIDCPLIAKDPVIGKYVHEGNRRKHFMFGITSSVRFALCGVGGCLLLSGFVFLTCMDQDDARHNFGHSGGFTCPFVPLLPVACILINSYLLVNLGAATWARVSIWLAIGVIVYVFYGRTHSTLKDAVCVPATQVVDIYHTSTSCLA

SEQ ID NO: 219005 - protein, 157 aa, Glycine max
  Coding DNA Sequence Number=SeqID_102227
MEGVAMHWFYIWNQKNPNSDWDSFSIALIKRFRDRYGNHFFERLSILKQDKTETKTCIEERETSIVFLKERTNNEEVFRKEEPKSCGLHHHSCKVSILELKHGLLKSSEKILKVKREESVEAQSFEIKIKKIIEGIKEIKQMLQLLIKKKGINVESK

SEQ ID NO: 219006 - protein, 97 aa, Glycine max
  Coding DNA Sequence Number=SeqID_102228
MGEVSESTMTKRKKKGRPSLLDLQKRSLKKEQQNHHQQRHNSTNVVPHDDDEDERKEKKHKLLVGLNSHLHHPTLLPNSQPFNSDPKRRKIIDPLQT

SEQ ID NO: 219007 - protein, 286 aa, Glycine max
  Coding DNA Sequence Number=SeqID_102229
  Gene Ontology: Mol. function=sequence-specific DNA binding; Cellular component=nucleus; Biological process=regulation of transcription, DNA-dependent
  Homolog annotation: Hit_ID=Q9ZRZ4; Match level="QueryCoverage=65%, HitCoverage=71%, E-value=5e-62, Identity=64%"; Hit description=HB2 homeodomain protein
  Pfam annotation: Domain name=Homeobox; Domain location=77-138; Score =73.2; E_value=8.3e-19; Accession=PF00046.19; Description=Homeobox domain
MEAETSNGGGIGGLYVKVMTDDQMELLRQQISVYATICEQLVEMHKAVTTQQDLAGLRLGNLYCDPLMACSGHKITARQRWTPTPLQLQILERIFDEGNGTPSKQKIKDITIELGQHGQISETNVYNWFQNRRARSKRKQLTPAPNVVEPEVESPKEKKTRAEGFQVQPYENSSPHRIKDMYIQSPDIDKELKRCFAVLTVDNRYCVTCYNFTSLNIISSPNYSKQFKEHLPTWRDLINSNTATLCSKLFQKNRKESTFLKLAVECTEKRLNRSSKSSAYRHEIEA

SEQ ID NO: 219008 - protein, 137 aa, Glycine max
  Coding DNA Sequence Number=SeqID_102230
  Homolog annotation: Hit_ID=Q47522; Match level="QueryCoverage=26%, HitCoverage=45%, E-value=2e-14, Identity=97%"; Hit description=LacZ protein
RVPFAIQAAQLLGRAIGAGLFAITPAGERGMCCKAIKLGAREPHQPQVISTWLTFLILQRAHTRKCLLRALRRAKPPGFNILGHSGSSVEGEELKPALVGKPVVPAALMNRPTRGERRFAYWALAECILAYYVGTDE

SEQ ID NO: 219009 - protein, 112 aa, Glycine max
  Coding DNA Sequence Number=SeqID_102231
  Homolog annotation: Hit_ID=Q1STQ3; Match level="QueryCoverage=44%, HitCoverage=31%, E-value=1e-10, Identity=57%"; Hit description =Bromodomain
  Pfam annotation: Domain name=Bromodomain; Domain location=46-109; Score=18.3; E_value=4.2e-05; Accession=PF00439.15; Description =Bromodomain
DVKVPKATDSKQHGSQGESGPTTPLPDKKLLLFILDRLQNWLFDVLYCSQPSCRKDTHGVFSEPVDPEELPDYLDIIKHPMDFGTVRKKLDGGLYTDLEHFEVGAAIFRAAF

SEQ ID NO: 219010 - protein, 104 aa, Glycine max
  Coding DNA Sequence Number=SeqID_102232
  Homolog annotation: Hit_ID=UPI000034EE59; Match level="QueryCoverage =70%, HitCoverage=8%, E-value=4e-13, Identity=53%"; Hit description =transcription factor
MTRMTRDFGDTMQKDAVPAVSADIIFASLRFPNYKIGVNNQIMETKDSPKVLSMKEVVARETAQLLDQQKRLSVHDLASKFEKGLAAAGEGRATVKGKMGLLHF

SEQ ID NO: 219011 - protein, 329 aa, Glycine max
  Coding DNA Sequence Number=SeqID_102233
  Gene Ontology: Mol. function=protein serine/threonine kinase activity; Cellular component=membrane; Biological process=protein amino acid phosphorylation
  Homolog annotation: Hit_ID=Q9LZ05; Match level="QueryCoverage=79%, HitCoverage=73%, E-value=1e-105, Identity=66%"; Hit description =Protein kinase-like
  Pfam annotation: Domain name=APH; Domain location=79-257; Score=-0.7; E_value=0.0062; Accession=PF01636.13; Description=Phosphotransferase enzyme family
  Pfam annotation: Domain name=Pkinase; Domain location=77-320; Score =141.7; E_value=1.9e-39; Accession=PF00069.15; Description=Protein kinase domain
  Pfam annotation: Domain name=Pkinase_Tyr; Domain location=77-320; Score=137.3; E_value=4.2e-38; Accession=PF07714.7; Description =Protein tyrosine kinase
  Pfam module annotation: Pfam domain module=APH::Pkinase::Pkinase_Tyr; Domain location=79-257::77-320::77-320
MSCFSCFVSRRKDVRRVEIDNGSRSATATATSSSESERKRESSEGKGKKSVSSSSNKGSTAAASFGFRELAEATRGFKEVNLLGEGGFGRVYKGRLATGEYVAVKQLSHDGRQGFQEFVTEVLMLSLLHNSNLVKLIGYCTDGDQRLLVYEYMPMGSLEDHLFDPHPDKEPLSWSTRMKIAVGAARGLEYLHCKADPPVIYRDLKSANILLDNEFNPKLSDFGLAKLGPVGDNTHVSTRVMGTYGYCAPEYAMSGKLTLKSDIYSFGVVLLELITGRRAIDTNRRPGEQNLVSWAMAITAMCIQEQPKFRPLIGDIVVALEYLASHSNP

SEQ ID NO: 219012 - protein, 324 aa, Glycine max
  Coding DNA Sequence Number=SeqID_102234
  Gene Ontology: Mol. function=protein serine/threonine kinase activity; Cellular component=chloroplast; Biological process=protein amino acid phosphorylation
  Homolog annotation: Hit_ID=P46573; Match level="QueryCoverage=79%, HitCoverage=74%, E-value=2e-83, Identity=53%"; Hit description =Protein kinase APK1B, chloroplast precursor
  Pfam annotation: Domain name=Pkinase; Domain location=71-305; Score =95.1; E_value=2.1e-25; Accession=PF00069.15; Description=Protein kinase domain
  Pfam annotation: Domain name=Pkinase_Tyr; Domain location=71-305; Score=59.9; E_value=3.8e-16; Accession=PF07714.7; Description =Protein tyrosine kinase
  Pfam module annotation: Pfam domain module=Pkinase::Pkinase_Tyr; Domain location=71-305::71-305
MGNCFRKTAADDNKIHKNEYKTPTTNNPRPSPPERLVKETVEERGERPQNNSVPKLIKYTLDELRSATRNFRPDTVLGEGGFGRVFKGWIDKNTFKPSRVGVGIPVAVKKSNPDSLQGLEEWQSEVQLLGKFSHPNLVKLIGYCWEESQFLLVYEYMQKGSLESHLFRRGPKPLSWDIRLKIAIGAARGLAFLHTSEKSVIYRDFKSSNILLDGDFNAKLSDFGLAKFGPVNGKSHVTTRIMGTYGYAAPEYMATEMLTGRAALDTNQPTGMQNLVECTMSSLHAKKRLKEPKKRPSMEEVLETLEKVEAIKYKPNVKKRSAVR

SEQ ID NO: 219013 - protein, 104 aa, Glycine max
  Coding DNA Sequence Number=SeqID_102235
NRPMAYTHIPVKVENPDLAPYTSEPYNAQWNAPGLLRDKHTLRSSRILGEMEVDEPRLGWSSSLEVRNDIVGFGGKLGRIGMTVTAWVSPSSSPSLFAPVFSFV

SEQ ID NO: 219014 - protein, 42 aa, Glycine max
  Coding DNA Sequence Number=SeqID_102236
MENDELRSEDSEEEESHSTASTHDNTLCMLICPVPVNSHISS

SEQ ID NO: 219015 - protein, 228 aa, Glycine max
  Coding DNA Sequence Number=SeqID_102237
  Gene Ontology: Cellular component=integral to membrane; Biological process=peroxisome organization and biogenesis
  Homolog annotation: Hit_ID=Q94DE5; Match level="QueryCoverage=73%, HitCoverage=38%, E-value=5e-50, Identity=57%"; Hit description =Putative betaine/proline transporter
MKLYEFVVIFGYFMLILAQMPHINLVSLVMCLSYSACATAASIYIGKSSNGPEKYYSLIGDTTNRLFGIFNAIPIVANTYGCGIVPEIQATLAPPVEGKMLKGLCVCYVVVALSFFSVAISGYWAFGYQAAGLIFSNFVDYYSKPLAPKWLIYLPNICTIAQLLANGVNQAQNLVQNPNHALIHQITIRINLHGNHERRNIRKLLKLLHPHPHFCLCAVAPRKPHRKS

SEQ ID NO: 219016 - protein, 136 aa, Glycine max
  Coding DNA Sequence Number=SeqID_102238
  Gene Ontology: Mol. function=iron-sulfur cluster binding; Cellular component=integral to membrane; Biological process=electron transport
  Homolog annotation: Hit_ID=Q1SPP3; Match level="QueryCoverage=85%, HitCoverage=30%, E-value=8e-39, Identity=87%"; Hit description=4Fe -4S ferredoxin, iron-sulfur binding; Heat shock protein DnaJ
MVLSNSTSFIEKTVMNLPRVGCKNCANVACDVFGIEEEFGRARVYSQCGKPELVQQAIDSCPVDCIHWTSAAQLSLLEDEMRRVERVNVALMLSGMGSAGTDVFRMYLCVVSSNMIQPTNNDRQVPDGKRGRQKSW

SEQ ID NO: 219017 - protein, 95 aa, Glycine max
  Coding DNA Sequence Number=SeqID_102239
  Subcellular localization annotation: CTP_CleavageSite=32; ConfidenceScore=5.21e-01
MPIRVATWGVATCTQQYCRGTQQTVNEPFCPSTKPVSGRPSFLKNFGRRNSKKLPEDLLPEEEVGLPEGRVPDFFRKKGLPGRPPSSSGRRFFRK

SEQ ID NO: 219018 - protein, 292 aa, Glycine max
  Coding DNA Sequence Number=SeqID_102240
  Homolog annotation: Hit_ID=Q9ZQY0; Match level="QueryCoverage=15%, HitCoverage=11%, E-value=4e-11, Identity=77%"; Hit description =Pyruvate dehydrogenase E1 alpha subunit
  Pfam annotation: Domain name=DUF1685; Domain location=103-189; Score=- 18.9; E_value=0.022; Accession=PF07939.2; Description=Protein of unknown function (DUF1685)
MAAEHVLRLLDSFWFEASILSSKIPPTNPISHNHKVVEEVLPLDDAKLLLVPTPTLEVRSYSDQNLDSTTCVLCDYSPSPNSVLTPQRLRTIPSEREIREFSSGNHGKEGMSNKRKQKGFGHGRRPRQVRTSRSLSELEFKELKGFMDLGFVFSEEDKDSKLASLIPGLQRLGREDDEVQCDDQSVVSDNNKPYLSEAWDVLDQRELRNPLLNWRVPARGNEIDMKDNLRFWAHTVASISKILISSHADEDSLLAVIEVTKVANELDLVEGVHGDLHVPHQGHIMEEELQGE

SEQ ID NO: 219019 - protein, 989 aa, Glycine max
  Coding DNA Sequence Number=SeqID_102241
  Pfam annotation: Domain name=Exo_endo_phos; Domain location=660-902; Score=50.0; E_value=7.7e-12; Accession=PF03372.13; Description =EndonucleaseExonucleasephosphatase family
MREREGERENESEWTTVVRRKGKQREGERLRVDPKTNYNNHKLGQFQRYHHHNWRDKDDITTFYFTSFHEHITEEDLWAQFKKWGDMREIFINKHRNKGGRRFGFARFKGVLDKYRLEKQLDNILDGLKMYVNVPKYGRGKGRVKEGTSKPGILKEGHSREVEVVRHRAGQYRNPQKSYAKVVSTIQTDAGKMKHPKLPQQRYVESHSSIHLQVAVGEKKWFTDAWVGRLKKLRALERIEDDIPWELAVNVVPKYLGDDLVLLLGLADDKAEHIIAEETQNGTSPFHSLERWNPTLRPGHRLDLGNIHKIAAAIGKLVEVDDDVEEMRRMDRARILIRTPWKPFFHHAVSVTIGEELHQVVIVEEGASNDGWHFSSGRRPSYSSEELDSDDIDGESVISPHSSWYDLRRQPNNPYDDPEAVVDNDGGPHIGTGIPIGRATNPPEANHSVDSGGNPLKAAHVQLTSRRRRPDGDTDPVATNNPRPPLSKGSTVTENPVDNDQGSWEDKGKGPETAIKNGETNADEAQKRKLQGEIESMTETTVHPEATIKEIVVEELPPPIETLGSPQHIRPSPILQVTDHQLLTPPPIIQNLPNVEDGPNNGVGLPQYTTTNSSNQNNVGPMYPSAEGNKQWKIEEPLTQWELAKLMGVSTDSEQTTIIHKIIDMETRDKKEAEDLGLGRGVKWAFVRRLVRKHKVDILCIQETKKEQIDKPTCQALWGDMDVVWEFQPAVNTAGGLLCIWNEQVFKVERRVKGTGYILLEGVWTHENQRIFIVNIYSPCDSQNKRELWESLMQLRQQIPEGMWCLLGDFNSIRHPSERQGVSHRGVEAATINEFNEWISEMELTEIPSVGRQFTWFKPNGVSKSKIDRFLASHEWLLKWPDCNTFVLDRNFSDHCPILLNATNTDWGPKPFKKIKNLKETLKLWNKMHYGDTLNKVHKIEAELNSLEDTSSTRQLSTQELETHKKLQEELWAAAHSHESLMRQKARVR

SEQ ID NO: 219020 - protein, 389 aa, Glycine max
  Coding DNA Sequence Number=SeqID_102242
  Gene Ontology: Mol. function=RNA-directed DNA polymerase activity; Cellular component=exocyst; Biological process=RNA-dependent DNA replication
  Homolog annotation: Hit_ID=Q1RXD8; Match level="QueryCoverage=95%, HitCoverage=42%, E-value=6e-98, Identity=47%"; Hit description=RNA -directed DNA polymerase
MANGSWVDDPRRVKEEIYTFFENRFVEPKQHRPILDGTRFFGIDQQQNDMLVASFTEEEIRAAVWNCGSEKSPRPDGLNFKFIKQFWELLKPEFSRFIAEFHANGVFPRGTNASFIALIPKVKDTLHLNEYRPISLIGCIYKIVAKLLAHRLKKVLPNIIDERQLAFITGRQLLHSVLIANEAVEEAKRRNKPCLVFKVDYEKAYDSVSWNFLSYMMKRLGFCLKWIRLIEGCLKSASMSVLVNGSPTNEFYPHRGLRQGDPLAPLLFNVVAEGLTGLMREALDKSLYSNFMVGKNKILVNILQYADDTIFLGEATMQNVKTIKSMLRVFELASDLKINFAKSSFGVIGKPDHWQKEAAEYLNCRNLTLPFLYLGIPIGDNPRRRFPQK

SEQ ID NO: 219021 - protein, 349 aa, Glycine max
  Coding DNA Sequence Number=SeqID_102243
  Gene Ontology: Mol. function=RNA-directed DNA polymerase activity; Biological process=RNA-dependent DNA replication
  Subcellular localization annotation: CTP_CleavageSite=27; ConfidenceScore=5.11e-01
AEGVIMVAEGNNFLVKRKNKQKPSQTRSAPQQQRKEGDTNVNHITTTSSRRSISPITFTDVDFTGVDPEQDDPIVITVGIINWDVRKVLIDEGSSIGGQVHTHGVVELETTFGIGDLSRTTSLKALGVIVSMPHLTMKFPNPNGGILTVKADQMEARECYAKSLLIKPYILTSTKLAKVVDVNNVEGALPSWANFDPRRDEEDRRPTPIEDAADMLDIDLNFICHKFFIFSKAKLVAQRQGKLDEERRQVMKKESEKLLKVGFIREVKYSTWLSNVAMVKKPNRKWRVWIKMYPPDESKATFIMEDAKLYYKVMPFGLKNVGTTYPRLIDKVFKDLLGKNIEVYVDDMV

SEQ ID NO: 219022 - protein, 161 aa, Glycine max
  Coding DNA Sequence Number=SeqID_102244
MASSVIIDEENFEAPEEDEEVQALKTELGKARLAKEKFKLVTIDVQKTCAGLREENETTARALEQETKRARKEEHGRDKFRGALWGSNSELELRREERDQSRSKRNLSQRLCETETNMLAIISKYQEELNLATAHKHKVTDEYAQVYVEKEARGRVIGSLH

SEQ ID NO: 219023 - protein, 95 aa, Glycine max
  Coding DNA Sequence Number=SeqID_102245
MATMMEAMMSMKKIMEVNVAAVAATSAVAGVDPIPPSGLNQIIHPTSDMVGQGGKEFGSTGAPHYVRIQNKHAFLPYGLPFNYTPPNVVHTPNEN

SEQ ID NO: 219024 - protein, 70 aa, Glycine max
  Coding DNA Sequence Number=SeqID_102246
MNAKLEDSASVEEFLSVWVSTENNDGLWWLMVVVGDGEKAWVVGNDFGRKKGEEMAFFLSYTKAKAEMLK

SEQ ID NO: 219025 - protein, 112 aa, Glycine max
  Coding DNA Sequence Number=SeqID_102247
MGIAPTKTPSGPEEVQQGPGVSSSGNACRPQQGHQVPPTNRAFIKKFCVSRQAQGETPQQPGDGRQRATDAPPSPLEFTSAHPQKGLSIAYTTWPTNRRPSPKPKVSKVLGQ

SEQ ID NO: 219026 - protein, 172 aa, Glycine max
  Coding DNA Sequence Number=SeqID_102248
  Gene Ontology: Mol. function=RNA-directed DNA polymerase activity; Biological process=RNA-dependent DNA replication
MGKLDHLEERLRAIEGGEDYAFANLEELFLIPNIITPPKFKVLDFNKYKGTTCPKNHLKMYCRKMGAYAKNEELLIHSFQESLTGVAVTWYTNLELSRVHSWKDLMVAFIRQYQYNFDMAPDRMQQHNMCKKGAQIFQRIRLKVERPGSSSGISMTEKKNDNDSRHITSILL

SEQ ID NO: 219027 - protein, 113 aa, Glycine max
  Coding DNA Sequence Number=SeqID_102249
MVKFFDSIVNSTRVVSKASSALVVVLSVIASNVMKDDPLVAEKMNQQENWDFDFWIGSFILNFTALNTYFLIVLCWRSQAMVVFMLLSATGPPIKRRAGLRIKQAGRGSYRGS

SEQ ID NO: 219028 - protein, 640 aa, Glycine max
  Coding DNA Sequence Number=SeqID_102250
  Gene Ontology: Mol. function=transcription regulator activity; Cellular component=nucleus; Biological process=regulation of transcription
  Homolog annotation: Hit_ID=Q2VWB7; Match level="QueryCoverage=99%, HitCoverage=91%, E-value=2e-64, Identity=31%"; Hit description=Prf interactor 30137
NLTWENGYQKRDEVEESMWGDLSLKSPDELYSSNGENADYSARLLMIEMSHHKYSLGEGVVGKIALSRDHCWVSYEDILTGRFDTDLIPECPDEWLLQFACGIKTIVLVPVLPLGVLQFGSFEAVAEDKEFVTNIMDKFHFTHHLEANITPLNLGTDCQDLSFSDLMHNLMDSLDESYSVTKSILKTEVSTSTAALNSNVSRLNPTMLSFIQDDCCFSRENLLKSLKIENEIGSSSSEMPTVPRHIDKVGTKPNHMEEEIWSWSHLLNNVGVFGEMSNGLDSFSVINTTQKQLGGTETVHDAKNVNDFAFPSESELHKALGSVGYGETGEFMSKCIPVEETYSNSTLVINKKEHDHIKGLEFPKDVDLEDLLDAVVGNLCGATDDTSSISNSVRSLTTMPTEFTGSVQPENYSEESTLIVDNSDVKNDLMPAVMVKGKDQFSNHYTSSFDGNACLLIDEARQEKANSHMQPVGGPKLSSTSKKRTRVGNNQKSRPRDRQLIMDRMKELRELVPEGGRCSIDNLLERTIKHMLYLRKITSQAEKLKRIANRAVPECKRQKVNASHPGRSCAFDFESQLSWPIVIEDLECSGHMLIEMICNEHGLFLEIAQVIRKLDVTILKGILENRSSNSWACFIVEVAI

SEQ ID NO: 219029 - protein, 131 aa, Glycine max
  Coding DNA Sequence Number=SeqID_102251
MATSDPIFSFSGTPTIATAKLNWKNYLSWSALVELWFLGQGYHDHLEKNVNAVPNDKKPEWEKQSNHDMIAHMGKAWAAVEELRMFLVADSLEEVNRKLDKFYMVLILRSLHSDFDHVCDQVLAGDQVPSD

SEQ ID NO: 219030 - protein, 495 aa, Glycine max
  Coding DNA Sequence Number=SeqID_102252
  Gene Ontology: Mol. function=heat shock protein binding; Cellular component=integral to membrane; Biological process=protein folding
  Homolog annotation: Hit_ID=O23230; Match level="QueryCoverage=70%, HitCoverage=22%, E-value=1e-16, Identity=27%"; Hit description =Trichohyalin like protein
MEFTVATTTFTKKLSNGSGYGVSGRSAYDGVFATPIKLHTPKFSSQFDDYREIFCAAAGTSIPILELPELNNRKNNDVRYSKFDYSNVFGGLENLGAAAVPFPELVAEPKKKNSFRARSKVKGENQSSREDQTNCSKEIPVASWSSNDTRRINMSYHKVNQGSENGTNGTTHIAQLRAVPAYTQLIEEVNPVKMNRANKSIPVAQDTTCSGSHGNEGKKEAAHSTKSFTGASPDNSKKQSSNNGVKVTSRSDSIDLFFDACEISNGSNGTHYVKVPLSETTEGNSEAMKSMPTKCQASKSSSSEGVAGADSPSYLDDMVDLNSEVAASVAALRKAMDEAQVRMKVAKELMRRKKEGFPDRVKQKSNIELKAERKKEAKVTYKTKKIDTRQTFREMDAFQNASSEVGKSTMRIEQVRPDLGAKETSVAKVAVQKAQKKLKSTQVKYEKEVEQKEANHKGKILELKQAENNKKELYVKNTDKNATDKPEGPDQTIEI

SEQ ID NO: 219031 - protein, 552 aa, Glycine max
  Coding DNA Sequence Number=SeqID_102253
  Homolog annotation: Hit_ID=Q9LRY2; Match level="QueryCoverage=52%, HitCoverage=58%, E-value=1e-110, Identity=61%"; Hit description =Arabidopsis thaliana genomic DNA, chromosome 3, TAC clone:K7P8
TILQRLELAWALNPLTALKLVCNLRGVRGTGKSDRQSFYPAALWLHRRHPKTLAANVSSLAEFGYFKDLPEILYLLLEGSDARKVQKEAWQNRKRGAHNNKKKNPRTQKMQKVKTKSLAQRVNVEKEKESSEKEIAHVAREEKRVALAKKLVERYAKDPDFRFLHDRVSDYFAECLRKDHEFLKSGLVTKVSLAAKWCPSVDSSFDRHTLLCETIGKRVFPRDEYKEYEGVEEAYYAYRVRDRLRKEVLVPLRKVLELPEVFIGANRWDLIPYNRVASVAMKFYKEKFLKHDKERFEAYLEDVKSGKSTIAAGALLPHQIIGSLNDGDGGDVAELQWKRIVDDLLKKGKMKNCLAVCDVSGSMSGVPMEVSVALGLLVSELCEEPWKGKVVTFSENPQLHLIEGDDLGSKTEFIRNMEWGMNTDFQKVFDLLLEVAVSGNLKPDQMIKRLFVFSDMEFDQASANPWETDYQAITRKFGEKGFGDAVPQIVFWNLRDSKATPVPATQKGVALLSGFSKNLLTLFLDKEGELSPEEAMEAAISGPEYQKLVVLD

SEQ ID NO: 219032 - protein, 98 aa, Glycine max
  Coding DNA Sequence Number=SeqID_102254
MALVDTLTSSAHLLTLANLLGEDFTNLHATLIFLMDRSISFNPSPTRGLTTFFSLPLLVQIQVVVLVLVVVEFHILVVVKEFMSPVVIDFEYDMERES

SEQ ID NO: 219033 - protein, 203 aa, Glycine max
  Coding DNA Sequence Number=SeqID_102255
MSRVVSESESDNEKEIARVRTRVRDDSKSESENSVATSPKRVRESNNETTNEVATINGWEEEDEAEPKRSSFWLYNGYYYSWTKFGVAFVCRLVMRAMVVELPCNMSLRVNKLSLLPRRCLCSLVRTSNYLLSRNSSWICLYTKNEVTLSKKGKKNEEKERVLKQAQPNTRAKRVKKAGAKRSVKLEDAESVTRAKPSYALSA

SEQ ID NO: 219034 - protein, 47 aa, Glycine max
  Coding DNA Sequence Number=SeqID_102256
MAQLENELRTLGGDKGITVVVAQARNTIKKKMIHGTTPTHLYIVTSL

SEQ ID NO: 219035 - protein, 184 aa, Glycine max
  Coding DNA Sequence Number=SeqID_102257
  Gene Ontology: Mol. function=protein serine/threonine kinase activity; Biological process=protein amino acid phosphorylation
  Pfam annotation: Domain name=DUF150; Domain location=1-137; Score= -40.1; E_value=0.036; Accession=PF02576.8; Description=Uncharacterised BCR, YhbC family COG0779
MEELECYNQKYKTRLDEVGALGEIPVDLALEYLTKHNFASKVSSPGAERLLKVPDDISRFKDMTMRVCYTENIESNCPERDGVFLLDSIENDSEMCVWKFADVKENRDPLKKGRPLSRKQKDWRLKLPFNLHTMVCTVCLVVLSPGPMCNKTEGTKKASTFFLIICGDLSLKNAYLKRIQTCIV

SEQ ID NO: 219036 - protein, 75 aa, Glycine max
  Coding DNA Sequence Number=SeqID_102258
MEFIRFGVIRATAIGTIVGLLTLPLIENLGLLALPQIFEDTESLSSFTSVFKLRNIKTPKWPNPLQEKGGEMASS

SEQ ID NO: 219037 - protein, 230 aa, Glycine max
  Coding DNA Sequence Number=SeqID_102259
  Gene Ontology: Mol. function=transporter activity; Cellular component= integral to membrane; Biological process=transport
  Homolog annotation: Hit_ID=Q13Y54; Match level="QueryCoverage=86%, HitCoverage=46%, E-value=2e-86, Identity=75%"; Hit description=Major facilitator superfamily (MFS) 2-ketogluconate transporter
  Pfam annotation: Domain name=MFS_1; Domain location=28-226; Score =29.2; E_value=1.4e-05; Accession=PF07690.6; Description=Major Facilitator Superfamily
MRPPQPEESPMKSQTIAPKRWWYIMPIVFITYSLAYLDRANFSFASAAGINEDLGITKGMSSLLGALFFLGYFFFQIPGAVYAERRSVKKLIFWCLILWGGCASLTGIVSNIPMLAAIRFVLGVVEAAVMPAMLIYISNWFTKSERSRANTFLILGNPVTVLWMSVVSGYLINSFGWREMFIIEGFPAVIWAIAWWFMVQDKPAQAKWMSDEEKAALQAQLQKEQENIKA

SEQ ID NO: 219038 - protein, 300 aa, Glycine max
  Coding DNA Sequence Number=SeqID_102260
  Gene Ontology: Mol. function=2-dehydro-3-deoxygluconokinase activity; Cellular component=cytoplasm; Biological process=D-ribose metabolic process
  Homolog annotation: Hit_ID=Q39FZ3; Match level="QueryCoverage=98%, HitCoverage=90%, E-value=7e-99, Identity=62%"; Hit description=Sugar kinase, ribokinase family
  Pfam annotation: Domain name=PfkB; Domain location=1-294; Score =205.3; E_value=1.4e-58; Accession=PF00294.14; Description=pfkB family carbohydrate kinase
MAMFIAGQTGDLAAADQFTKRIAGAELNVAIGLARLGLQVGWVSRVGDDSFGRFTLQQLAKEHVDHRCVTIDNRYRTGFQLKARVDDGSDPEVEYFRKGSAASHLSPDDFDENYFGSARHLHLSGVAAALSDSSLALAKHAAKEMRARGKTISFDPNLRPVLWRSEEEMRKQLNLLAEYADWVLPGEKEGLILTGYRQPEAIADFYLDKGVRAVVIKTGSDGAWYKTAAGEQGQIAPIHVENVVDTVGAGDGFAVGLISALLEGKSLPQAILRGNKIGSLAIQVAGDSEGLPTRAALGDY

SEQ ID NO: 219039 - protein, 62 aa, Glycine max
  Coding DNA Sequence Number=SeqID_102261
  Subcellular localization annotation: CTP_CleavageSite=39; ConfidenceScore=5.46e-01
MVFGASLASVKFLKTLDRGVNSNSSLGPSRTFSKLGCLRRKQLGGKLLHVFEKWFPGLPLLP

SEQ ID NO: 219040 - protein, 306 aa, Glycine max
  Coding DNA Sequence Number=SeqID_102262
MSCFRISDIVETRRVSKVPSKSGQRKKLKASTIEVNIEKYVPICSQIHKKPSNPPPSDVSHIAYWLNEGVVDISSSQEQEDDSDQDRDLNVTSKTPIDLIPEETKETEIEREAEAMEEEIKLLKEEVNESEDIGNNAFKSSKSHVPSTKDEQKASQSESFLNKTISGGAAQSRPTKGDPSNIAHTSSEAIIRVNLETKGYTEQVNAIIEIVITFNEDQLDENLNDEIKEFLNLLNKACKLKQRENAANETIAQANTNTQSGILELEKNQKSVNKAQEDNKQSQTAFVEFLKKKLDLKANVLELHNQ

SEQ ID NO: 219041 - protein, 158 aa, Glycine max
  Coding DNA Sequence Number=SeqID_102263
  Gene Ontology: Mol. function=double-stranded RNA binding; Cellular component=intracellular
  Homolog annotation: Hit_ID=Q5YDB5; Match level="QueryCoverage=67%, HitCoverage=19%, E-value=2e-17, Identity=48%"; Hit description=C -terminal domain phosphatase-like 2
MTHILRRLLITALECDTGSSTRFTTTTRGGGGEQRGDSPRFNAEQEEEVLVLLTLIVANTTKYFEDRIEALRGWLFHEIDPLRVQGMSSELKRYLEERLLLKQYAESDTMEEAPPLSGSHEKLVQPVVRLQERNIVLTRINPEALSLGFWELVKFDER

SEQ ID NO: 219042 - protein, 386 aa, Glycine max
  Coding DNA Sequence Number=SeqID_102264
MLKVIAKNLCTMVCKDVELEGRELQVINSARGLLCIWRKGIFEIDPVFSGNGFLGIKGLWKEEDFNFAKRMEEMRNSNNYLTREKDFEEFNMLIRDIDIEDTPMVGRKYNWYRSTEHSKNGLYRFLCQNGGCMNGQWINELDTLDAADGLQEDGLKRRGRLMKEFWKHGKFPKGGNPSFIPLIPKKNNPQGLDDFIPISLIRRVIAKVLSRGGRGFKDKKGISAYCLKWTLRKRLGFYERWITWIRGCLESATMSVQGLRMIIRKALSCGFYSGYKMGADEVEISLMQFADDTLFLDNPDHANVLCMSFDDNKDDDKKLKSQDHFMITKMMTFKNEFKIESRTLQGSRGNLISRIKNQDSRFKNNQDQDSRLKDSRIKRRLNQDKY

SEQ ID NO: 219043 - protein, 226 aa, Glycine max
  Coding DNA Sequence Number=SeqID_102265
AFEDGARENFGVEDPLSMPKIGVSRMLSLLDVSMLGKRDKENSNMEHDFGKVGEHHKEGTTTLRNWVTQVPVEMISFIKSITYDDIVTLANSLTQGECFIHVVEGKGIKKAKVPCEGMKLVGLGLGCGGGSTEVSPKRLANRSLTKRMNGFPIVWKKLQVSRRDKGERNISLTEKEGGSKQNNILDFQQGLRLSSIASCNNSKESFLLKDNVVEARKTWEIGKSLV

SEQ ID NO: 219044 - protein, 394 aa, Glycine max
  Coding DNA Sequence Number=SeqID_102266
  Gene Ontology: Mol. function=serine-type endopeptidase activity; Cellular component=integral to membrane; Biological process=beta -lactam antibiotic catabolic process
  Homolog annotation: Hit_ID=Q53MA5; Match level="QueryCoverage=74%, HitCoverage=78%, E-value=4e-90, Identity=54%"; Hit description =Rhomboid family, putative
  Pfam annotation: Domain name=Rhomboid; Domain location=120-264; Score= 178.9; E_value=1.2e-50; Accession=PF01694.12; Description=Rhomboid family
MAMEGELQPSQVQLRVNSRQWRNEVNVHSMEIDPSFTSKVEHREVKHFKEWFPWLIPFFVIANVIVFIITMYVNDCSKTLATCIAPFLGRFSFQPFNENPLLGPSLITLRKMGALDANKVVHRHQGWRLITCMWLHGGVFHLVANMFGLLVVGIQLEKEFGFVLIGLLFVISGFGGSLLSALFIGEKVSVGASGALFGLLGGMLSELLTNWSLYEKKLGALFTFVFVIAINLAVGVLPHVDNFAHIGGFLSGFLLGFVFLIRPQFGWIKQRNAPQPYSPTLIKPKFNKYQCISWILALILLIVGFTTGLIALLRGIDANDYCSWCHYLSCVPTSRWNCNPPKSSSCVVVSICAEICSSELSVNRADWQPAELDMLKQWKIQYILYAKSDRSPDL

SEQ ID NO: 219045 - protein, 173 aa, Glycine max
  Coding DNA Sequence Number=SeqID_102267
  Gene Ontology: Mol. function=transferase activity; Cellular component= intracellular; Biological process=translation
  Homolog annotation: Hit_ID=Q7PC91; Match level="QueryCoverage=98%, HitCoverage=42%, E-value=3e-44, Identity=51%"; Hit description =Putative transposase
MDEYVCIGETTAVECLQKFAKGVNEVFGTKYLRRPNDNNNERLLKIGDACEFPAWKCQSQRGDHNKATIMLEAVASHDLQIWHAYFGVVGSNNDVNVFNQSDVFNEDLQGQPPKPWYLSIMGYICKNHPKATRRKKKIICPTSRSSKKRCRKSFWNASIMICNYMWPDTILEN

SEQ ID NO: 219046 - protein, 89 aa, Glycine max
  Coding DNA Sequence Number=SeqID_102268
MLTWEWVWSCEVTETMSYTCCTLVHFVPIENPDIVIATVDHMLSCYIPWGFTSHLELCYYEDIHVYLGLEDLVIILVDFGGVQWIGQHS

SEQ ID NO: 219047 - protein, 88 aa, Glycine max
  Coding DNA Sequence Number=SeqID_102269
MSFQKDFSEFFSLVIDYRFLDSKSSPLSFIGLKVLAFIFHMTQSPRFYLVEASFMMMNQVDSSSFDDDKDDDKKPKRMISRLSQQDQD

SEQ ID NO: 219048 - protein, 153 aa, Glycine max
  Coding DNA Sequence Number=SeqID_102270
  Gene Ontology: Mol. function=6-phosphogluconolactonase activity; Cellular component=microtubule; Biological process=carbohydrate metabolic process
  Homolog annotation: Hit_ID=Q8LD77; Match level="QueryCoverage=84%, HitCoverage=40%, E-value=2e-38, Identity=61%"; Hit description=6 -phosphogluconolactonase-like protein
MGIGLRNVQPKWEDNPTVDESSIVASMNNKNVEVFSKEHLAVSLAKYVADLSNKFIKERGYFAIALSAGSIKYLRKLVEPHYSNTIQWSKWHIFWVDEKVVPKTHVDSNYKLAYDGFISKVPIPPYNVNTIDDALPADGAADVYETTLKRLVA

SEQ ID NO: 219049 - protein, 60 aa, Glycine max
  Coding DNA Sequence Number=SeqID_102271
MVVTGAGKADAVYSALEEAPSDYKLPAQLVSPREGELKWFLDKGAASRWRTKFHNKTKTK

SEQ ID NO: 219050 - protein, 151 aa, Glycine max
  Coding DNA Sequence Number=SeqID_102272
MKMHVIIVWYGWLTIVVCGSHRNLSMSFGVDQNPILVGIARLERCALLGIYSSNDSVIERHEIGCNYIVECGKYKLKKVAWGIVLEVYQSSQDRELRIVLGLILHLSSFSTVRNRTPQRQEYKSSMRNVLSSQSLKFRMALQSGTWGMLPD

SEQ ID NO: 219051 - protein, 76 aa, Glycine max
  Coding DNA Sequence Number=SeqID_102273
MERDFPLRVKPRALTLEGADGCVVAPPIFDLGDEEEEEKVPTKGDRESTDHDMNDSGMEKEERETMDKSLEEEGDE

SEQ ID NO: 219052 - protein, 136 aa, Glycine max
  Coding DNA Sequence Number=SeqID_102274
MRHYESFSMQEGEFVDDMFGILQVLLNRLMISQRIPKIEENFHNRDNTNTITQSKNNNSQSDPLGPSRSFLQKAVASGGSNLARLDELGGKLLPYFAINRGRSEEEKGSAFLALLILSKLLRKIIFVKKIQAEALP

SEQ ID NO: 219053 - protein, 59 aa, Glycine max
  Coding DNA Sequence Number=SeqID_102275
MTIPTTREFSTYFVLTHMLNENLPGRYTPPPFVEELMEEHHHEEVFPKSIRISLLKLTF

SEQ ID NO: 219054 - protein, 81 aa, Glycine max
  Coding DNA Sequence Number=SeqID_102276
MVDIPEDVNPRNVRTPVAEENVNKALDEFKNEVEGAFPRVGDTLAEILLRKKDCNRDIMLYPCCSVVFDKSTARAFKSSEV

SEQ ID NO: 219055 - protein, 60 aa, Glycine max
  Coding DNA Sequence Number=SeqID_102277
MSGFSRNSPQISASPHQLVLAPYASEPHNAQCNSPGLLGDKHTLRSSRIIREMEVDEPWL

SEQ ID NO: 219056 - protein, 139 aa, Glycine max
  Coding DNA Sequence Number=SeqID_102278
  Homolog annotation: Hit_ID=Q1S3C1; Match level="QueryCoverage=35%, HitCoverage=16%, E-value=9e-09, Identity=55%"; Hit description =Peptidase aspartic, catalytic
MANLAEKRDKEMALKTIEKENHEKGQTMLEAKTNQNNQTIAGGFEQGGSVDKPSKEANQRFDCIYDNSPLGFEKSISPPIKKMKAQNPLGDINMGDETNKKSTYINFRDLNSATPKDEYPIYIKKQLFVVPMPWTLMNG

SEQ ID NO: 219057 - protein, 97 aa, Glycine max
  Coding DNA Sequence Number=SeqID_102279
  Gene Ontology: Mol. function=pyridoxal phosphate binding; Biological process=carboxylic acid metabolic process
MDLIGQIHPPSSKGHKYILIAIDYFTKWVKVIPLKNVEQSEIIDFTNEHIIHRNVKLFTSTPYYAQANGQVEAINKVLISLIKKHVGNKKNLHETLC

SEQ ID NO: 219058 - protein, 72 aa, Glycine max
  Coding DNA Sequence Number=SeqID_102280
  Gene Ontology: Mol. function=ubiquitin thiolesterase activity; Cellular component=intracellular; Biological process=ubiquitin -dependent protein catabolic process
  Homolog annotation: Hit_ID=Q8GWE1; Match level="QueryCoverage=71%, HitCoverage=22%, E-value=3e-18, Identity=82%"; Hit description =Putative carboxyl-terminal proteinase
MTSAKVSSKELKLYNDLGDLQFLWGLGLREDEAECCDVYGLDEELLEMVPKPVLAVLFLYPITTQSEEERLQ

SEQ ID NO: 219059 - protein, 1000 aa, Glycine max
  Coding DNA Sequence Number=SeqID_102281
  Gene Ontology: Mol. function=protein binding; Cellular component =integral to membrane; Biological process=defense response to fungus
  Homolog annotation: Hit_ID=Q5VPF0; Match level="QueryCoverage=95%, HitCoverage=96%, E-value=1e-122, Identity=32%"; Hit description =Putative HcrVf3 protein
  Pfam annotation: Domain name=LRRNT_2; Domain location=29-67; Score =49.0; E_value=1.6e-11; Accession=PF08263.3; Description=Leucine rich repeat N-terminal domain
  Pfam annotation: Domain name=LRR_1; Domain location=115-137; Score =11.2; E_value=2.3; Accession=PF00560.23; Description=Leucine Rich Repeat
  Pfam annotation: Domain name=LRR_1; Domain location=139-161; Score =15.8; E_value=0.16; Accession=PF00560.23; Description=Leucine Rich Repeat
  Pfam annotation: Domain name=LRR_1; Domain location=188-209; Score =4.3; E_value=44; Accession=PF00560.23; Description=Leucine Rich Repeat
  Pfam annotation: Domain name=LRR_1; Domain location=214-236; Score =4.2; E_value=47; Accession=PF00560.23; Description=Leucine Rich Repeat
  Pfam annotation: Domain name=LRR_1; Domain location=241-263; Score =7.4; E_value=12; Accession=PF00560.23; Description=Leucine Rich Repeat
  Pfam annotation: Domain name=LRR_1; Domain location=265-286; Score =8.2; E_value=8.4; Accession=PF00560.23; Description=Leucine Rich Repeat
  Pfam annotation: Domain name=LRR_1; Domain location=288-310; Score =12.3; E_value=1.4; Accession=PF00560.23; Description=Leucine Rich Repeat
  Pfam annotation: Domain name=LRR_1; Domain location=312-333; Score =16.3; E_value=0.11; Accession=PF00560.23; Description=Leucine Rich Repeat
  Pfam annotation: Domain name=LRR_1; Domain location=335-356; Score =13.3; E_value=0.87; Accession=PF00560.23; Description=Leucine Rich Repeat
  Pfam annotation: Domain name=LRR_1; Domain location=362-386; Score =4.0; E_value=52; Accession=PF00560.23; Description=Leucine Rich Repeat
  Pfam annotation: Domain name=LRR_1; Domain location=390-412; Score =12.9; E_value=1.1; Accession=PF00560.23; Description=Leucine Rich Repeat
  Pfam annotation: Domain name=LRR_1; Domain location=414-437; Score =8.4; E_value=7.6; Accession=PF00560.23; Description=Leucine Rich Repeat
  Pfam annotation: Domain name=LRR_1; Domain location=439-461; Score =13.4; E_value=0.83; Accession=PF00560.23; Description=Leucine Rich Repeat
  Pfam annotation: Domain name=LRR_1; Domain location=463-485; Score =12.0; E_value=1.6; Accession=PF00560.23; Description=Leucine Rich Repeat
  Pfam annotation: Domain name=LRR_1; Domain location=487-509; Score =16.0; E_value=0.13; Accession=PF00560.23; Description=Leucine Rich Repeat
  Pfam annotation: Domain name=LRR_1; Domain location=511-533; Score =11.5; E_value=2; Accession=PF00560.23; Description=Leucine Rich Repeat
  Pfam annotation: Domain name=LRR_1; Domain location=558-581; Score =15.4; E_value=0.21; Accession=PF00560.23; Description=Leucine Rich Repeat
  Pfam annotation: Domain name=LRR_1; Domain location=583-605; Score =7.4; E_value=12; Accession=PF00560.23; Description=Leucine Rich Repeat
  Pfam annotation: Domain name=LRR_1; Domain location=607-628; Score =13.4; E_value=0.82; Accession=PF00560.23; Description=Leucine Rich Repeat
  Pfam annotation: Domain name=LRR_1; Domain location=631-653; Score =15.9; E_value=0.14; Accession=PF00560.23; Description=Leucine Rich Repeat
  Pfam annotation: Domain name=LRR_1; Domain location=655-677; Score =12.6; E_value=1.3; Accession=PF00560.23; Description=Leucine Rich Repeat
  Pfam annotation: Domain name=LRR_1; Domain location=679-701; Score =9.6; E_value=4.5; Accession=PF00560.23; Description=Leucine Rich Repeat
  Pfam annotation: Domain name=LRR_1; Domain location=704-726; Score =9.4; E_value=5; Accession=PF00560.23; Description=Leucine Rich Repeat
  Pfam annotation: Domain name=LRR_1; Domain location=728-750; Score =14.9; E_value=0.29; Accession=PF00560.23; Description=Leucine Rich Repeat
  Pfam annotation: Domain name=LRR_1; Domain location=795-817; Score =9.0; E_value=5.9; Accession=PF00560.23; Description=Leucine Rich Repeat
  Pfam annotation: Domain name=LRR_1; Domain location=819-841; Score =13.1; E_value=1; Accession=PF00560.23; Description=Leucine Rich Repeat
  Pfam annotation: Domain name=LRR_1; Domain location=843-865; Score =14.0; E_value=0.56; Accession=PF00560.23; Description=Leucine Rich Repeat
  Pfam annotation: Domain name=LRR_1; Domain location=867-888; Score =14.2; E_value=0.48; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1; Domain location=29-67::115-137::139-161::188-209::214-236::241 -263::265-286::288-310::312-333::335-356::362-386::390-412::414 -437::439-461::463-485::...
  Pfam module annotation: Domain location=487-509::511-533::558 -581::583-605::607-628::631-653::655-677::679-701::704-726::728 -750::795-817::819-841::843-865::867-888
MLGLAFAVVFLLTAFVVLSSCGHSPLGCNEEERHALQWIKGSFKDPSSRLSSWEEEDCCQWKGVVCSNITGHVVKLDLRNPCFPQKNQGGQPNCDFNKYVLEANHVHPSISQLKYLTYLDLSGNKFNSSIPMFIQTMEHLQFLSLSDCHFSGRIPYNLGNLTKLILLDFSFNPLLYADDFYWISQLSSLQYLYMRDVPLGKAQNLLQALSMLPSLLEIELRNCGLNKLHTYQLVRATNLSRVEVLDLAENELQAPILNAFQNMSSIAEIDFSFNNLSSTPFWLGTCSNLVYLSVENNALYGSLPSTLQNLTSLIYLDLSENNLDSVPSWLGELKGLQSLYLSGNDLKHIEGSLASFLGNCCHLHSLDMSSNNLKGDALGVYIRSGCIRYDLMQLDLSHNEFNDSLPPWLGQLENLSDLYIHDSNLVGNLPCDMITKLINLKKLVLSNNNLNGCLPNCIGQLLNLNTLILSSNHFHGVIPRSLEQLVSLKSLDLSRNCLNGTIPQNIGQLKNLITLYLFDNNLHGNIPYSLGQLLNLQNFDMSLNHLESSVSDIRWPKQLVYLNLTNNNITGSLPQDIADRLPNVSHLLFGNNLINGSIPNSLCKIDSLYNLDLSSNLLSGDIPDFWSATQSLNVLNLASNKLSGVIPSSLGNLPTLAWFHLNNNSLQGGIPSSLRNLKQLLILDLGENHLSGIIPLWMGNIFSSMQILRLRQNMLIGKIPSQLCQLSALQILDLSNNNLMGSIPHCIGNLTAMISGKKSSVIQPSEEHRDVEWYEQEVRQVIKGRELDYTRNLKLVANMDLSNNNLSGTIPEGIALLSALQGLNLSHNYLSGHIPKRIGDMKSLESLDLSHDQLSGTISDSISSLTSLSHLNLSYNNLSGPIPRGTQLSTLDDPFIYTGNQFLCGPPMPNECSPDDSLHDNVDEDEDGKKDKVEKLWFYFVIALGYALGFWAVIGSLLIKTSWRRSYFQYIDDSTQRINVSWAIHLSNFKARFIGSPVAE

SEQ ID NO: 219060 - protein, 216 aa, Glycine max
  Coding DNA Sequence Number=SeqID_102282
  Homolog annotation: Hit_ID=Q2HS64; Match level="QueryCoverage=20%, HitCoverage=11%, E-value=8e-17, Identity=97%"; Hit description =Glycoprotease family, putative
MAEEAHSQVIDQKARRIAGGFNLPIIGIHHMEAHALVARLIEKDLQFPFMALLISVTGRCRDKVYNFVKLAELYYVGSHGMDITGPTKSPKQHYCWGTQQTVKWQNCPSAILLPEEDFSGNFLENLFPKLFRKNLLPEEEFVSSGRTSSGMFPEDFHFLPAVFYCAFFFVSSSVCFVCFFRLLAVVSVVVPFAVSVGGPVKYLKIWWSRVPYLKFY

SEQ ID NO: 219061 - protein, 138 aa, Glycine max
  Coding DNA Sequence Number=SeqID_102283
  Homolog annotation: Hit_ID=Q9FHD2; Match level="QueryCoverage=64%, HitCoverage=8%, E-value=6e-10, Identity=44%"; Hit description =Kinesin-like protein
MTYWNKSVSTQLLFNIGNRILSDIFERKNGDVPQVEQTKFEEKKKLEEQDFSRLKKEKELRAAMKSVKDDVIKTKKKLLRGIQMYLQLTRCVYVGIKLKGLAEAAEIYHVVIDENRKLYNEVQDLKVRDLLSNNGPQK

SEQ ID NO: 219062 - protein, 271 aa, Glycine max
  Coding DNA Sequence Number=SeqID_102284
  Homolog annotation: Hit_ID=O04862; Match level="QueryCoverage=47%, HitCoverage=25%, E-value=6e-43, Identity=72%"; Hit description =Dihydropterin pyrophosphokinase /dihydropteroate synthase precursor
  Pfam annotation: Domain name=HPPK; Domain location=181-270; Score =69.8; E_value=8.7e-18; Accession=PF01288.10; Description=7,8-dihydro- 6-hydroxymethylpterin-pyrophosphokinase (HPPK)
MEREKRENLGSERNWGKERYAIGMSTSLQTLNSFSFRHDTLHLLVAKFSASTIQQSASSSSFSNPLHLHSKAVGHHVVHRRVPPPTKPPTSTPSPTQASLSVLFLFLPLWFWVLECPSSSSNPIRGDEVLEVFATMSILMYLGEPRHKLFAARKYLKGVGFSSFHTASNSSVEHSQEEEVVIALGSNVGDRLHNFKEALKLMRNSGINITRHACLYETAPAYVTDQPRFIYSAVRAVTKLGPHELLSTLKRIEKDLGRTDGMRYGVQGQLT

SEQ ID NO: 219063 - protein, 113 aa, Glycine max
  Coding DNA Sequence Number=SeqID_102285
MTSRVCTEGPEIAGGAGGGTSASAAAGVGTGVGAGVEVEASEGPRARALRDPGNVIVGSSGFQQFFRVYVKLMTGLRDSKVSESGTTPLAMHKAVISTGNLSPNELDWAIWEI

SEQ ID NO: 219064 - protein, 89 aa, Glycine max
  Coding DNA Sequence Number=SeqID_102286
VTSAQGGGDKDYKEVPPPPLFKPAGGHINQAVTFNRSYYKETTVVVIGPFYDGSQETTVVEQDYVYDGAVPMAVVVFRYFYDGAVRQPC

SEQ ID NO: 219065 - protein, 135 aa, Glycine max
  Coding DNA Sequence Number=SeqID_102287
MTWLNIDPSSAWRTLWPRWPAQEPQPELEVKEMSGHTYASLGCPHITSGRPAKEEKVEAADDSLSEEDPLNETHQLSKASSSPSGWETLEEDKSEICMPSAQPARLARTLSLLALSAPTLAKRKSTNSRLARHAC

SEQ ID NO: 219066 - protein, 223 aa, Glycine max
  Coding DNA Sequence Number=SeqID_102288
MMAEEEEEPLRGNLLFTATMVTNGNADEVSKKKTKTVEVVPSHYTQTSEGEKLIKLNLQPDAKDLERQGQGQVVTCSGAYNGIGINEQLSKTVKENRRRHYRILRRAAGQPRLRTCERLRRTWGQHRHKHNLVLRWLYPTDRRRMVHNSNTAAGQPRRRSNERLRRPWGQHRRRHNPVLRRLSPENHRRMVLLLLRLSPENRRRMILLLLRCFVADDRHKRQC

SEQ ID NO: 219067 - protein, 526 aa, Glycine max
  Coding DNA Sequence Number=SeqID_102289
  Subcellular localization annotation: CTP_CleavageSite=40; ConfidenceScore=5.08e-01
MTTPPPSPTQAEIPSDETSRKTRQATRLRRLTARTLEQARATVSVNPATDKIPIVHASWNDVPETLKNMIWDDILAEFDIPEGDNAKKKVMSTVATRWRQFKSALTTKYVYGNTDGQAKDDPLVKYGINEKDWVEIAKMRQTPTWKDSLEEQSRQGSIVPSGRDDILNMAIGRPEHPVRVRGAGTGVTITQYFGPASRWSTTSSNITVEQLADIIGNLKEEWQRQAEQENIKREELSQIASQHSAPLQPNDIQVLAARVSTKGSCATAETNALAKKPSQLNGDNVRLHVTAENSNKLVAVGKQCDSFGTIHNVPYADDVVHVSVVEVIFGDAEEAEKDVSSPLKTVEEEKAVEVIDPLGELVKNLFDIYQRPVEVSWDGAKFGINNVQDGFFITHADVSEIILGDKCLNISILQLWLIASIGYGALYGFLEPQCIHNASSRRQECENYIGRWLKEAGKQIYIAPYLNQAHWQLVVLCLGNNLVVWFCSLRKKSDAAIKGAVNSAMKSVTKTAEGKPPQHGPQWMKQ

SEQ ID NO: 219068 - protein, 53 aa, Glycine max
  Coding DNA Sequence Number=SeqID_102290
MGSPSMGGSKRRLSSRGLGGALRQQRARLYIIRSLPLSIEISSYSLFSLLGLL

SEQ ID NO: 219069 - protein, 420 aa, Glycine max
  Coding DNA Sequence Number=SeqID_102291
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=98%, HitCoverage=51%, E-value=1e-133, Identity=55%"; Hit description =Receptor-protein kinase-like protein
  Pfam annotation: Domain name=Pkinase; Domain location=214-420; Score =52.6; E_value=1.3e-12; Accession=PF00069.15; Description=Protein kinase domain
  Pfam annotation: Domain name=Pkinase_Tyr; Domain location=214-418; Score=57.5; E_value=5.3e-16; Accession=PF07714.7; Description =Protein tyrosine kinase
  Pfam module annotation: Pfam domain module=Pkinase::Pkinase_Tyr; Domain location=214-420::214-418
MPHNIAPPNVYSTSRSMGNNKDVNMSFNLTWIFQVDPGSMYLTRLHFCDYFYSKVNEIVFKIFINNQTAEAEADVIGWTGGKGVPTYTDYVIYVKDEAGDDQLWLALHPALETKPKFYDSLLNGVEVFKLNDTDLSGFALVAAILVVVQHQEKKQAPGSYNTSSWLPIYGNSHTAGTKTSGSGKSVGSANISAMAQGLCRYFSLQEMKQATKNFDESNVIGVGGFGKVYKGVIDNGFKMAIKRSNPQSEQGVNEFQTEIEMLSKLRHKHLVSLIGFCEEGNEMCLVYDYMAHDTMREHLYKGNKPLDTLSWKQRLEICIGAARGLHYLHTGAKYTIIHRDVKTTNILLDENWVAKVSDFGLSKTGPNMNQGHVSTPLKGSFGYLDPEYFRRHQLTEKSDVYSFGVVLFEALYLRKVALDT

SEQ ID NO: 219070 - protein, 64 aa, Glycine max
  Coding DNA Sequence Number=SeqID_102292
MAVRGATLFGLELETTARLVGKNSPCVKDGYHVNIDNDNHVKEHGDCGSDNDNTHNHDSHQLMV

SEQ ID NO: 219071 - protein, 39 aa, Glycine max
  Coding DNA Sequence Number=SeqID_102293
MVESHDTCKGLRKSYGIVNVIRFYKMCRPSKEGVKCLSH

SEQ ID NO: 219072 - protein, 154 aa, Glycine max
  Coding DNA Sequence Number=SeqID_102294
RDSNVSMTDLVSTEDDISKKNVCTDNHSGISAGQRDSNVSMTDLVSAEDDVNLQTAKKNVYTDNHSGISARQHDSNVSMTDLVSAEDDGAEDDRDSNVSMTDLVSAEDDVNFCVSTGFSAAIDEGRRRRRLSPRAIRLFVLQTAKKNVIRIITR

SEQ ID NO: 219073 - protein, 95 aa, Glycine max
  Coding DNA Sequence Number=SeqID_102295
  Subcellular localization annotation: CTP_CleavageSite=31; ConfidenceScore=5.31e-01
MWSSAPFPEMSTSSGRDYFSLTPLSQKLGAKASLLSTAPPFPIMTCESDDVWRYRMVIRTFRQPGANKPIDMQGLMSSSAPFVNQGKASLLTRRD

SEQ ID NO: 219074 - protein, 125 aa, Glycine max
  Coding DNA Sequence Number=SeqID_102296
  Subcellular localization annotation: CTP_CleavageSite=50; ConfidenceScore=5.34e-01
MTFLGETSSQTNANSRLAFIFSNGSISHNQTGVYFQCLTPTPMRFPNDCSFETLKSRMHNTLQLTNDQLVYEIDASSIGACRPRIFFINGFICFLEDKWQRNGEGREREETSLQGEDESRRSSPP

SEQ ID NO: 219075 - protein, 234 aa, Glycine max
  Coding DNA Sequence Number=SeqID_102297
  Gene Ontology: Mol. function=protein binding; Cellular component =membrane; Biological process=cell division
  Homolog annotation: Hit_ID=Q6BBR1; Match level="QueryCoverage=99%, HitCoverage=69%, E-value=8e-93, Identity=71%"; Hit description =Hypothetical protein Lj-CDC50 like 1
  Pfam annotation: Domain name=CDC50; Domain location=64-231; Score =83.3; E_value=7.7e-22; Accession=PF03381.6; Description=LEM3 (ligand- effect modulator 3) family  CDC50 family
  Subcellular localization annotation: CTP_CleavageSite=48; ConfidenceScore=5.33e-01
MSTSNAGGAGSNDSNATRRQSKRPKYSKFTQQELPACKPILTPRAVISAFLIVTIVFIPIGVASLIASHDVVEIIDRYDLRCIPSNVTDKVAYIQTPGEKQCNRQLTVDKRMKSPIYVYYQLDNFYQNHRRYVKSRNDEQLRDSGKANSVSGCEPENNANGKAILPCGLIAWSLFNDTYSFSRNSKNLTVNKKDISWKSDRDHKFGSDVFPKNFQNGSIIGGGSLNESIPSSEQ

SEQ ID NO: 219076 - protein, 156 aa, Glycine max
  Coding DNA Sequence Number=SeqID_102298
MVMVMMFVVAATVDISIVVVVAVGVAIVATIVVAEVALVMVAMPMPMVVLVLVVATVIEVVLAMVVIEMLVGCGDVGGGDGDEGGIVGSGGDSDNVCNGGGGGGGGVIDGGGDSDDGGGNDECDNGGDNNVDGDGGSGNNVGSRGDSNDDNKKCQI

SEQ ID NO: 219077 - protein, 54 aa, Glycine max
  Coding DNA Sequence Number=SeqID_102299
MASLLCKLPVPLASLVTGFQFHFSEGGTWLQLFQKERFSSKGVVTPTSELGHKN

SEQ ID NO: 219078 - protein, 108 aa, Glycine max
  Coding DNA Sequence Number=SeqID_102300
MTCDHSLVLVRCLAPIIRQFVKFQDMPKNQKNIDAQSHPGPLGPSGIFLQKAVASGGSNPARLGELGGNHLPYFAINRGGSEEERGSAPLALLSLSNLLGKIVSVKKI

SEQ ID NO: 219079 - protein, 70 aa, Glycine max
  Coding DNA Sequence Number=SeqID_102301
  Subcellular localization annotation: CTP_CleavageSite=58; ConfidenceScore=5.21e-01
MVANKGVILNSIDNPKGDLKKSMDKSSGKYGTSGNTNVRKALADVSNVQENFTTTVGVASSKMKNLFYVG

SEQ ID NO: 219080 - protein, 86 aa, Glycine max
  Coding DNA Sequence Number=SeqID_102302
  Subcellular localization annotation: CTP_CleavageSite=43; ConfidenceScore=5.53e-01
MPSLFSLHIDSDLTHSSTPRVRIPPLLQPPGRCRTRRTTFALAAAKLLSWLSSPALFSTDTLQIKGGQPPFPRLCIHDLRHLISKI

SEQ ID NO: 219081 - protein, 221 aa, Glycine max
  Coding DNA Sequence Number=SeqID_102303
  Gene Ontology: Mol. function=chromatin binding; Cellular component =chromatin; Biological process=chromatin assembly or disassembly
  Homolog annotation: Hit_ID=Q1SAV4; Match level="QueryCoverage=72%, HitCoverage=40%, E-value=5e-32, Identity=47%"; Hit description =Integrase, catalytic region
  Pfam annotation: Domain name=Chromo; Domain location=105-156; Score =16.8; E_value=0.01; Accession=PF00385.14; Description='chromo' (CHRromatin Organisation MOdifier
MKESADKQRRNVQFEVGTQVLVKLRPQHQSTATGSQYSKLAKRFYVPFQIVQKIGLVAYKLDLSESSSIHLVFHYSLLKPYLPFTTQQEAPLSLPPLSEEHQPLITPLVILDTKWTQLREDKDLLVLVQWASLLPKDTSWEPWAQLKAEYNLEDKVILEVLGDVKCRKTQAEKAAEADIEQQAARKQQGNVETSYETKKGEGQRLKREIHKPQYLRDFVSK

SEQ ID NO: 219082 - protein, 834 aa, Glycine max
  Coding DNA Sequence Number=SeqID_102304
  Gene Ontology: Mol. function=RNA-directed DNA polymerase activity; Cellular component=chromatin; Biological process=chromatin assembly or disassembly
MGNVRGLLAESDFIRRHTSGRVYGRVFLVDKCPEILLDHAIHHLCLAVRLRMIRRAHLELSATELEKFLPKSTHKKGIMIEDKASGHAVNLSGGLHEYLSHYSSSAMRWKYPNVYPLGETVHHDQHCCVTLRRRQANYKVEGEVLPRQVAMNNWTSCFMDGQTKFSLMHAMDSGDGLETFGKPYTTLLKYEVMTYGVVRVLRRIVLNAAAKVHEEGIVEELLFKFLQKKGSMEWLEEKIGQRGLLLATVRGHRLLHWIFRHDSELYSHSLVIVPGGGNGDKLPDISGSTKELRTEGFAEEGDCVNGMEKFDKLKTGAQHRAFFRLRKASSTSTFQWKESLARRAELANSGQLRSLPALVPLLGEVGYDLDIPLEKLQRNTSKASKKIGVSSRFRRPCGEPKWHDEEFVVAMVRPKGSFGDGPVVYTKSPGVIPLLNQENRVAIWSDDDWSCVGLKEDGVISRPRRQKSVGKGRPVCEIIHWHHWSGPVAGVAVGDGFQVLGSIALELNDHATMDELHGQGVVVRQYGAKGLQPMHSEDHIGSTNWVDFVALNFIAIDDEDTEGQRGCGWEVQVPDQPSLHEVVRAPTVDEDHDGLVLGVWFFGAREKEAGSAVVPACEPLIAIEAEVALLSVAKWVVGEVGGKMEVGMVGRSHGWCDRGMGGIVPQAYPPEGVPTWQLERGLGAGGPVLHGGCWDPSPRRSSSRGAMALGPRMVSERSGYQWPAKIPPKWGTGGCGSSTGTKPGVSAIKPRDIKFHFGVVDNGCFGYIKPRDIKFRRRRSSNFSVTAIWLEASWEIASLMHSNGDLARGESTMDEGNESIRFVKNRMNFLAFEA

SEQ ID NO: 219083 - protein, 117 aa, Glycine max
  Coding DNA Sequence Number=SeqID_102305
MTFLEKGFWNTYSGSNTFLESLFWNIFLLDKPFRNTFPKAKNPFWKAYSGVQVLLSEWAFRKPNIAFWNTPSGISFLTFASEMNVPEKGYSGTPFPKAYSLRKAYSRIYLLLPERPF

SEQ ID NO: 219084 - protein, 111 aa, Glycine max
  Coding DNA Sequence Number=SeqID_102306
  Homolog annotation: Hit_ID=Q9ZRG1; Match level="QueryCoverage=39%, HitCoverage=17%, E-value=6e-10, Identity=72%"; Hit description=Cyclin
MEAWIYVMDCPTECAYEDHLTKFEVVCAPWGEFAAYVKETWLILHKKRFVKALTDKVMHMGSTTTNRDWAHMILKFHKAVGIGKLKVTYEKYSRQELIRAAAVKPLDRLPL

SEQ ID NO: 219085 - protein, 242 aa, Glycine max
  Coding DNA Sequence Number=SeqID_102307
  Homolog annotation: Hit_ID=Q2HUH8; Match level="QueryCoverage=34%, HitCoverage=21%, E-value=9e-15, Identity=49%"; Hit description =Histidine triad (HIT) protein; Homeodomain-like
MQKFKGHYKQVVSLKKSGCTDNNVMLHAYAIWKEGEGSDFGLEHAWRLLKDQPKWLDQLTENCFKRTKISAFGAYSSSFNPETLVEDSKADTLPQILHPMGQKAAKRKRKGKRIRTSTNHVDLTGVEEAMRERNVLNARLAVLREKELENEYYDILMKDTSTIMDPNNDFDRVWKQFFYETLDDDSYEQIMSYLCAMQQQGGNNSQGRRPRRVIHRNREDGHLRLMTDYFLENLVYTETQFQ

SEQ ID NO: 219086 - protein, 47 aa, Glycine max
  Coding DNA Sequence Number=SeqID_102308
MEIMLKKLPHSSHLLSNEGNQGQDNNGNRQQRIFILSCTRVKGKNEI

SEQ ID NO: 219087 - protein, 79 aa, Glycine max
  Coding DNA Sequence Number=SeqID_102309
MVVRGGYWWLWVMEKKFGTLEMVLEEGRRRKWRFSKATRKAKSKTLKCFCSRERKRSSHARCLIEDCNGQIVDICPMNL

SEQ ID NO: 219088 - protein, 248 aa, Glycine max
  Coding DNA Sequence Number=SeqID_102310
PIASAHRQLTATTVVEDVENVDNATDEPHEKPHNQVTEDVRGDSYGFLGGSLDTSVLMPYVVHVATKLWAERKVKKFGRLAPEIEGIVVVARLNSLIRILIVDNLKSKENIVVEGEAVGVVCEDEVNKGKVVDGQPSESGWAHEQLVHVSVKPKDRSNYWCFSAIYGAPKLTQRKAFDAILPPRVLDRRIQEHWARDTKEGPRVLMNLTGLFKYFGIGVSLAIIGGSFSRKFLKEVSKGRFSRKFLKE

SEQ ID NO: 219089 - protein, 184 aa, Glycine max
  Coding DNA Sequence Number=SeqID_102311
MAGKIQLWLLLKDPNMTNIVGLLAPAMALALPLAIAVVVARQKVGCMMTQSLYDASLSIFLFLRGAFIEEEGGLRLATYDVCVMEFEGIEVEDCVSASDNEDCVGEDRKFIIDLGTTGGKRFTNLEDGRRRGRNWEEEEEAATESVEKSQEKNRQCGNEARKKNSQKKKSFLSEEEEEAVSGNE

SEQ ID NO: 219090 - protein, 83 aa, Glycine max
  Coding DNA Sequence Number=SeqID_102312
MIGRWLVWNLVHGQTISTPSSDDKASLSPTFGEAKENGLLCEGPHTPVLLMWTLDENIPLRDGCRGTTMQLLPMCTYGKHPGS

SEQ ID NO: 219091 - protein, 82 aa, Glycine max
  Coding DNA Sequence Number=SeqID_102313
MAESQQHIIPLGDVMPLVGPLACTSNYLPWFYKVSHPYVVPLEEGQPPRGLLLETKPKPFPMTQALIPKQTNRILEIKLVVA

SEQ ID NO: 219092 - protein, 100 aa, Glycine max
  Coding DNA Sequence Number=SeqID_102314
  Homolog annotation: Hit_ID=O24097; Match level="QueryCoverage=98%, HitCoverage=24%, E-value=5e-33, Identity=63%"; Hit description=MtN19 protein precursor
  Pfam annotation: Domain name=SURNod19; Domain location=1-100; Score= -223.2; E_value=0.025; Accession=PF07712.3; Description=Stress up -regulated Nod 19
MEKGGYLIYGTAHMHSGVVNATLYGQDGRTLCTSTPKYGTGKEAGNEKGYLIGMSVCYPQPGSIKIHDGEILTLESRYKNEFRTGAMGHFYIYLAEELPQ

SEQ ID NO: 219093 - protein, 175 aa, Glycine max
  Coding DNA Sequence Number=SeqID_102315
MELCFHCTLYDGIVIPLWARRGALGMWNTRLGLRPLRRELGENNDGREGATGDDVFWLRAWIEGGSFLRFEVSVDLAYANNNNMQSLLLTDMVVMMWQSRSGVAALVAKELGNLQGRVFRSGRTLSIAQINFLEMGQSKVERIHDFLLQMKRPSFFVFVTWHGHGGHGCAYIAML

SEQ ID NO: 219094 - protein, 169 aa, Glycine max
  Coding DNA Sequence Number=SeqID_102316
MASVVSQSFPNSIVEKLNDSSYLHWRQHVEPVIKSHKLQCFVIKGFVYELAGVGVLVRHEEYTYALLEGFPSDYAPVVSVIESEKHTSSIVKIRTLLYGYEIRLVRYKGYSNPNLYKSTNSDGFRGSYGRGGSNCGGFSDRGGINGGTGHSGGVCSKGHGGSKFPNFQC

SEQ ID NO: 219095 - protein, 137 aa, Glycine max
  Coding DNA Sequence Number=SeqID_102317
MQAIPAPCPQVFSAMAEEFMNGFVHQNGIAVITHNPLKAIPAPRPQVAEDEFLPQHIHLKRFRLHARKLLRTSFYRNTFTSVFFAMAEEFVNGFVHQNGIAVITHNPPKENLPILHMGGEYLLISDKFSQVSLIVRL

SEQ ID NO: 219096 - protein, 90 aa, Glycine max
  Coding DNA Sequence Number=SeqID_102318
MFGGMREKERVLGGERGKTKMRRRGGIIGVKTDLTSLFIPRLCINKTCKWRVISTQYFIPLLKKVVSTGAPVQPLPPMLSSKLELETVLA

SEQ ID NO: 219097 - protein, 117 aa, Glycine max
  Coding DNA Sequence Number=SeqID_102319
MMSQNNQLSTIDNVSLPTRREFNVIYHNAVALSGEDGGVGGGIRCGGVDRDDARLGVAGEVHGAEVVGARPMVGPGEELEEDVVVKDVDKGGHGEVLTIEVVVNGEVGVRDDKNGEQ

SEQ ID NO: 219098 - protein, 197 aa, Glycine max
  Coding DNA Sequence Number=SeqID_102320
  Gene Ontology: Mol. function=RNA-directed DNA polymerase activity; Cellular component=exocyst; Biological process=RNA-dependent DNA replication
  Homolog annotation: Hit_ID=Q1RV13; Match level="QueryCoverage=59%, HitCoverage=31%, E-value=4e-19, Identity=43%"; Hit description=IMP dehydrogenase/GMP reductase
MRVTLDGVHFKRIGALENGMLSNSFTEDEIKQVVWGCNGGQSPALGGHLTTGHRDEKQIVIVEEEESFFWCEKVRHEFNAHKGLRQDDPLAPFLFLLVAKGLSGLVREAKEKDLLSGVEADTMFFIKPNVQDVTTLKVILRFFELASGLKVNLFKSNLVGIHLDNSEVLHFAVILNCKTVNVPFTYWGLSVGVDAKK

SEQ ID NO: 219099 - protein, 221 aa, Glycine max
  Coding DNA Sequence Number=SeqID_102321
  Gene Ontology: Mol. function=ammonium transporter activity; Cellular component=membrane; Biological process=transport
  Homolog annotation: Hit_ID=Q9FSH3; Match level="QueryCoverage=85%, HitCoverage=38%, E-value=2e-93, Identity=87%"; Hit description =Ammonium transporter
  Pfam annotation: Domain name=Ammonium_transp; Domain location=1-181; Score=-100.9; E_value=5.5e-07; Accession=PF00909.11; Description =Ammonium Transporter Family
MERGWENRGSTAALTTLFGKRMISGHWNVTDVCNGLLGGFAAITAGCSVVEPWAAIVCGFVASVVLIACNKLAEKVKFDDPLEAAQLHGGCGAWGVIFTALFAKKEYVSQVYGEGRAHGLFMRGGGKLLAAHVIQILVIVGWVSATMGPLFWGLNKLKLLRISSEDELAGMDLTRHGGFAYAYEDDESHKHGIQLRKMLEIEDSAGRCEHFDVELCNFPYG

SEQ ID NO: 219100 - protein, 103 aa, Glycine max
  Coding DNA Sequence Number=SeqID_102322
MTTVMVVVIIVMLVEWCWCDNDNDNDDGGDRMMVVAEIKWWWCQRQQQWGEIMVAAVTTTIEAMKWWWQLWKQYLPSNNGDGDDDSGVVTVEAKCNGGGGSNG

SEQ ID NO: 219101 - protein, 205 aa, Glycine max
  Coding DNA Sequence Number=SeqID_102323
  Gene Ontology: Cellular component=integral to membrane; Biological process=defense response to bacterium
  Homolog annotation: Hit_ID=Q84WN3; Match level="QueryCoverage=71%, HitCoverage=71%, E-value=3e-26, Identity=41%"; Hit description =Putative cytochrome c oxidoreductase
  Pfam annotation: Domain name=MtN3_slv; Domain location=1-62; Score =34.5; E_value=3.8e-07; Accession=PF03083.6; Description=MtN3saliva family
KHGSTEDFSSLPYICTLLNCSLWTYYGIIKAREYLVATVDGFGIVVETIYVILFLIYAPKGIRGRTLILAVILDVAISAVAVVTTQLALQREAHGGVVGVMGAGLNIVMYFSPLSAMGPLYVAMFKAIGIIFAVIMGIGFLGGSIYLGSVLGAAIAVIGFYAVIWGKSQEQAKEECEVYDDSESYSPLSLFWRTREWRNKIIAII

SEQ ID NO: 219102 - protein, 86 aa, Glycine max
  Coding DNA Sequence Number=SeqID_102324
  Subcellular localization annotation: CTP_CleavageSite=52; ConfidenceScore=5.10e-01
MASTWSFRAFTSSPAFPSAATDYARDLLRAGRLARGPASLYWRGGADTSGARDDAEGSDIDASADDDYVAYIPAALGAWDPWPTQD

SEQ ID NO: 219103 - protein, 198 aa, Glycine max
  Coding DNA Sequence Number=SeqID_102325
  Pfam annotation: Domain name=BRF1; Domain location=8-105; Score= -10.9; E_value=0.0044; Accession=PF07741.3; Description=Brf1-like TBP- binding domain
YVHDESETLSDIDDEEVDLYIHDEEGKHIKKILWETANREYLGAAKETAAAASKKAFEAKFENCSEDILAARELAASSTEAVAKSKKAAKEAAAAANKKAFEAKFENCSEDILAARELAASSTEVVAKSRKVRGVHVRGYGVHGMLMRDWLDCCWVGAWVTWPVRADGMFDQHGSAQSTVRWVVCNCPEQTSRKGTQK

SEQ ID NO: 219104 - protein, 104 aa, Glycine max
  Coding DNA Sequence Number=SeqID_102326
  Gene Ontology: Mol. function=oxidoreductase activity; Cellular component=integral to membrane; Biological process=electron transport
  Homolog annotation: Hit_ID=Q69F95; Match level="QueryCoverage=73%, HitCoverage=19%, E-value=4e-17, Identity=64%"; Hit description =Cytochrome P450 85A
MGTGRGVGVEDWGNNTRPRLAPLPCLIWKSLQNSRIRIHTHVMNEAKGIVPGYPESMRKILGTNIAEVHGAMHKRIRGSLLSLIGPIAVKDRLLPEVDEFMRSP

SEQ ID NO: 219105 - protein, 115 aa, Glycine max
  Coding DNA Sequence Number=SeqID_102327
MLWMKKFLNELGHDQDDYMVLDEKKLKLEKIHIDLNWSDMMTKTIPTKKVEDYCQGPSIVVHTNYVVRGRFVGNSSIIKKSHPSPINREACEELEHPISSYRKEKQSKSDSEREF

SEQ ID NO: 219106 - protein, 106 aa, Glycine max
  Coding DNA Sequence Number=SeqID_102328
  Gene Ontology: Mol. function=monooxygenase activity; Cellular component=integral to membrane; Biological process=electron transport
  Homolog annotation: Hit_ID=Q0PHW2; Match level="QueryCoverage=99%, HitCoverage=22%, E-value=6e-37, Identity=62%"; Hit description =Brassinosteroid-6-oxidase
MSEERIGWDDYKNMSLTRAVILETMRLVSVVARVMRRATNDIESNGFMIPKGWRVYFYTKETNFDPFLYEEPFTFNPWRWLEKKGLKSHNHNMLFGAGGRVCPGKE

SEQ ID NO: 219107 - protein, 81 aa, Glycine max
  Coding DNA Sequence Number=SeqID_102329
MGALSASVREKKVQASGIWWLSMKSCAKPMHQYFKRHWGLARRCVLSDIAPCGAYRPWIFVINGVLCFSKMNESRMEKKER

SEQ ID NO: 219108 - protein, 75 aa, Glycine max
  Coding DNA Sequence Number=SeqID_102330
  Subcellular localization annotation: CTP_CleavageSite=35; ConfidenceScore=5.27e-01
MASKKRHARPSRPQGRNTHGIPPGLYLRLPGSPIRTMFISGTFFRRGTWSSRPHYMINSMKSCKGGSGTDDSPFC

SEQ ID NO: 219109 - protein, 667 aa, Glycine max
  Coding DNA Sequence Number=SeqID_102331
  Gene Ontology: Mol. function=protein serine/threonine kinase activity; Cellular component=integral to membrane; Biological process=protein amino acid phosphorylation
  Homolog annotation: Hit_ID=Q9LHP4; Match level="QueryCoverage=96%, HitCoverage=56%, E-value=0.0, Identity=59%"; Hit description =Receptor protein kinase-like protein
  Pfam annotation: Domain name=LRRNT_2; Domain location=37-81; Score =27.7; E_value=4.2e-05; Accession=PF08263.3; Description=Leucine rich repeat N-terminal domain
  Pfam annotation: Domain name=LRR_1; Domain location=109-131; Score =11.9; E_value=1.7; Accession=PF00560.23; Description=Leucine Rich Repeat
  Pfam annotation: Domain name=LRR_1; Domain location=133-155; Score =17.9; E_value=0.037; Accession=PF00560.23; Description=Leucine Rich Repeat
  Pfam annotation: Domain name=LRR_1; Domain location=157-179; Score =17.8; E_value=0.039; Accession=PF00560.23; Description=Leucine Rich Repeat
  Pfam annotation: Domain name=LRR_1; Domain location=181-203; Score =13.2; E_value=0.97; Accession=PF00560.23; Description=Leucine Rich Repeat
  Pfam annotation: Domain name=LRR_1; Domain location=205-228; Score =6.8; E_value=15; Accession=PF00560.23; Description=Leucine Rich Repeat
  Pfam annotation: Domain name=LRR_1; Domain location=230-252; Score =13.6; E_value=0.7; Accession=PF00560.23; Description=Leucine Rich Repeat
  Pfam annotation: Domain name=LRR_1; Domain location=254-276; Score =10.7; E_value=2.8; Accession=PF00560.23; Description=Leucine Rich Repeat
  Pfam annotation: Domain name=LRR_1; Domain location=278-300; Score =11.5; E_value=2; Accession=PF00560.23; Description=Leucine Rich Repeat
  Pfam annotation: Domain name=LRR_1; Domain location=302-324; Score =9.8; E_value=4.1; Accession=PF00560.23; Description=Leucine Rich Repeat
  Pfam annotation: Domain name=LRR_1; Domain location=326-348; Score =12.7; E_value=1.2; Accession=PF00560.23; Description=Leucine Rich Repeat
  Pfam annotation: Domain name=LRR_1; Domain location=350-372; Score =13.4; E_value=0.81; Accession=PF00560.23; Description=Leucine Rich Repeat
  Pfam annotation: Domain name=LRR_1; Domain location=374-396; Score =11.5; E_value=2; Accession=PF00560.23; Description=Leucine Rich Repeat
  Pfam annotation: Domain name=LRR_1; Domain location=398-420; Score =5.3; E_value=29; Accession=PF00560.23; Description=Leucine Rich Repeat
  Pfam annotation: Domain name=LRR_1; Domain location=422-444; Score =18.3; E_value=0.028; Accession=PF00560.23; Description=Leucine Rich Repeat
  Pfam annotation: Domain name=LRR_1; Domain location=446-468; Score =7.1; E_value=14; Accession=PF00560.23; Description=Leucine Rich Repeat
  Pfam annotation: Domain name=LRR_1; Domain location=470-492; Score =16.2; E_value=0.12; Accession=PF00560.23; Description=Leucine Rich Repeat
  Pfam annotation: Domain name=LRR_1; Domain location=494-516; Score =15.9; E_value=0.15; Accession=PF00560.23; Description=Leucine Rich Repeat
  Pfam annotation: Domain name=LRR_1; Domain location=518-540; Score =14.4; E_value=0.43; Accession=PF00560.23; Description=Leucine Rich Repeat
  Pfam annotation: Domain name=LRR_1; Domain location=542-564; Score =8.2; E_value=8.3; Accession=PF00560.23; Description=Leucine Rich Repeat
  Pfam annotation: Domain name=LRR_1; Domain location=566-588; Score =14.2; E_value=0.49; Accession=PF00560.23; Description=Leucine Rich Repeat
  Pfam annotation: Domain name=LRR_1; Domain location=590-612; Score =17.5; E_value=0.047; Accession=PF00560.23; Description=Leucine Rich Repeat
  Pfam annotation: Domain name=LRR_1; Domain location=639-660; Score =15.9; E_value=0.14; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1; Domain ...
  Pfam module annotation: Pfam domain module=location=37-81::109 -131::133-155::157-179::181-203::205-228::230-252::254-276::278 -300::302-324::326-348::350-372::374-396::398-420::422-444::446 -468::470-492::494-516::518-540:...
  Pfam module annotation: =:542-564::566-588::590-612::639-660
  Subcellular localization annotation: CTP_CleavageSite=79; ConfidenceScore=5.40e-01
MLTSRQSLYISSPSPSSSLFCIILLQLTFLYGLAFSANHEASTLFTWLRSSSSASPPPPPPFSNWNLLDPNPCNWTSITCSSLGLVTEITIQSIPLELPIPSNLSSFHSLQKLVISDANLTGAIPSDIGDCSSLTVIDLSSNNLVGSIPASIGKLHNLQNLSLNSNQLSGKIPVELSNCIGLKNLLLFDNQISGTIPPELGKFSQLESLRAGGNKDIVGKIPEEIGECGNLTVLGLADTRISGSLPASLGRLKRLQTLSIYTTMLSGEIPPELGNCSELVDLFLYENSLSGSIPSELGRLKKLEQLFLWQNGLVGAIPEEIGNCTSLRKIDFSLNSLSGTIPVPLGGLLELEEFMISNNNVSGSIPSSLSNAKNLQQLQVDTNQLSGLIPPELGQLSSLMVFFAWQNQLEGSIPSSLGNCSNLQALDLSRNTLTGSIPVSLFQLQNLTKLLLIANDISGFIPNEIGSCSSLIRLRLGNNRITGSIPKTIGNLKSLNFLDLSGNRLSGPVPDEIGSCTELQMIDFSCNNLEGPLPNSLSSLSAVQVLDASSNKFSGPLLASLGHLVSLSKLILSNNLFSGPIPASLSLCLNLQLLDLSSNKLSGSIPAELGRIETLEIALNLSCNSLSGIIPAQMFALNKLSILDISHNQLEGDLQPLAELDNLVSLN

SEQ ID NO: 219110 - protein, 139 aa, Glycine max
  Coding DNA Sequence Number=SeqID_102332
REREAEGESSSKVKEIENGFPIKEEKLEGEGVKRGSLNAPRMISFGLLPQNLFEFQIFLHIELALSASVLVKSNSGNSKPKKVLGLATLDVVLTELNGGSCRGAQWLSVSVTLCMLVRYAQFKRISDKEEFRLSASGRP

SEQ ID NO: 219111 - protein, 58 aa, Glycine max
  Coding DNA Sequence Number=SeqID_102333
MTRVIKLLVINKGTLKSVEDDKDGGIGARDALVALERDVRCATAEEDGPLRFLNDSAI

SEQ ID NO: 219112 - protein, 108 aa, Glycine max
  Coding DNA Sequence Number=SeqID_102334
  Subcellular localization annotation: CTP_CleavageSite=27; ConfidenceScore=5.32e-01
AKSGSCAQLTIWAQRASIAKRSFSTLRATEESGKASTSRSHAKCEISALSAAVVFSQAQRMIGTKLKSTYSREAGHITFYNNSRAHQIAYFEKRALEAARGAAFTERP

SEQ ID NO: 219113 - protein, 92 aa, Glycine max
  Coding DNA Sequence Number=SeqID_102335
MRLPGKESLLMKSPITINEILDVSISFLNDHLEETPGSTKIEEIHSKCINLAQGKVYGESGFWLKACRMARHDTCQGLVWFKDKKGCPTLFP

SEQ ID NO: 219114 - protein, 51 aa, Glycine max
  Coding DNA Sequence Number=SeqID_102336
MGILRKHYGCPGSPGIPFFNKTGAFEEVTKTHGLRKTPPFDFRHITEFSRI

SEQ ID NO: 219115 - protein, 55 aa, Glycine max
  Coding DNA Sequence Number=SeqID_102337
MAVRLLPATGHPQAGSTGCLAGAIPANNRWYQKSIEPYVYLPMSRWHDLAGGTGT

SEQ ID NO: 219116 - protein, 297 aa, Glycine max
  Coding DNA Sequence Number=SeqID_102338
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=94%, HitCoverage=29%, E-value=3e-55, Identity=52%"; Hit description=Chromo
  Pfam annotation: Domain name=RVP; Domain location=25-126; Score= -14.5; E_value=0.1; Accession=PF00077.10; Description=Retroviral aspartyl protease
PPDEVETVGDPSFQIHHLSYNALKGSSGLGIMKCRLGVQILLDSGSSDNFLQPRLAQCLKLPVEPIPNLQVLVGNGNALTAEGLIQDLEVKIQGHTLKLPVYLLPVSGADLVLGAAWLATIGPDLSDYSTLTLKFYLVFDVPSADMLKEGIIAPSRSPFSPPIILVKKKDGTWRFCTDYRALNAITIKDSFPIPTVDELIDELHGAVYFSKLDLRFAFRTHQGHYEWLVMPFGLTNAPATFQSLMNEINYLGHTVSGKGVTMDQEKVQAVLNWPYPINLKQLRGFLRLTGYYSKLIK

SEQ ID NO: 219117 - protein, 90 aa, Glycine max
  Coding DNA Sequence Number=SeqID_102339
MPLPSTVHASSTNEPGAPRSVVHMSSTYELGAMRTDCLVQFSILAFFPEPHECHCLALFMHPPPTSLEPQEGIAYHYSPILHSPLFFGAP

SEQ ID NO: 219118 - protein, 108 aa, Glycine max
  Coding DNA Sequence Number=SeqID_102340
MGDKGAETNSAPFVIHKRAIVSGGMQRQIMVILRLVSTERNKFDNIRMMSRWQGGSLAEGCFARTKLVSYPYFPFISNNRQVTRGNCHTLISSGDHPLLGYDPRLTTS

SEQ ID NO: 219119 - protein, 218 aa, Glycine max
  Coding DNA Sequence Number=SeqID_102341
  Homolog annotation: Hit_ID=Q1SP02; Match level="QueryCoverage=99%, HitCoverage=52%, E-value=4e-27, Identity=33%"; Hit description=IMP dehydrogenase/GMP reductase
MFHLQLSELTITLDDVVSLLHLPITGALHMFEPLVTSDAIGLLTKLLELSHEEATFETRQAGGPHVRLGDLAQAGGFAWGVAALVHMYDHLNDASQASTRQLGGYITLLQCWIYEHFPTVHTFVVHDAYDEGSPRACRWLTSKAHMTGIKGAPYRRRLDALTVTDVCWMPYGEHRGVRAFDLISSYTGQLRWGQIVVYVRPERVLQQFGYLQTNPPPP

SEQ ID NO: 219120 - protein, 105 aa, Glycine max
  Coding DNA Sequence Number=SeqID_102342
MVDEEEGEKQPTESEKNLTFEMLKSCLGLRAVSLVPVPRVSLRPSGPVFEEISKMSHMAYYLGIEVKQEDKGIFITQEGYAKEVLKKFKMDDANPVGTPMECGTS

SEQ ID NO: 219121 - protein, 139 aa, Glycine max
  Coding DNA Sequence Number=SeqID_102343
MDPKKLSTKRSRRDAMAEGSSAAPEFDSHCFPSAEHQQCFQAADAPPPPHQADPTGSLGMERYLQHLVRQQAANHRGQGFAPFACPTPEQFGAEVAWPGDLPEAQAGEEPTGSPDEAEEARMDEEMTDLLGFLGGSGAT

SEQ ID NO: 219122 - protein, 103 aa, Glycine max
  Coding DNA Sequence Number=SeqID_102344
  Subcellular localization annotation: CTP_CleavageSite=32; ConfidenceScore=5.08e-01
MKSGDMWGYLMVICTFRQPGANKPVDGQRLTSSSALFVGLTREVRFYSRCPKTLKPNDGRDSSLLGRDDRVQWHREVSWLSNFVASETLNFVDVSDASSFLSK

SEQ ID NO: 219123 - protein, 303 aa, Glycine max
  Coding DNA Sequence Number=SeqID_102345
  Gene Ontology: Mol. function=nucleoside-triphosphatase activity; Biological process=defense response
  Homolog annotation: Hit_ID=Q1SI25; Match level="QueryCoverage=53%, HitCoverage=17%, E-value=2e-48, Identity=61%"; Hit description=NB -ARC domain, putative
MTTSDGGGGCLLPGDSYPDWLTFNSEGSSLTFEIPQVNGRNLKKMMCHVHYSSPENITSDGLKNLLVINHTKAIIQLYKRNALVSFEDEEWQGVLSKIEPGNKVQIVVVFWSKLTVYKTTIYLIYEPMNEKIEHSRALNKNVMDSSGEENECVVGTISLQVESIYKPTNDIMEHCHASNKNAIVSSSDENECVVGTISLQVESIYKPTNDIMEHCHASNKNAIVSSSDENACVVRPFSPQHVRSDVAGMNMVSKLRERLFMLDSWFLQPDFLDMDIIGISGNAFFTLLGAPDCLLISKLGLTP

SEQ ID NO: 219124 - protein, 47 aa, Glycine max
  Coding DNA Sequence Number=SeqID_102346
MGARDSSFMNKTQVSELWLSKLGALIARRDKRLAGRACGALSTHIFG

SEQ ID NO: 219125 - protein, 103 aa, Glycine max
  Coding DNA Sequence Number=SeqID_102347
  Subcellular localization annotation: CTP_CleavageSite=40; ConfidenceScore=5.65e-01
MVIVRARGPDTSTPSSFAPPAPAPPPAAPSGTSAQSLDAMVSMLQSLHQGLCLVMQSIHNLAQHRPIISTEDFMAQVAWPGVQSSPLGGDVGQVASDILRRGG

SEQ ID NO: 219126 - protein, 74 aa, Glycine max
  Coding DNA Sequence Number=SeqID_102348
  Gene Ontology: Mol. function=drug transporter activity; Cellular component=membrane; Biological process=multidrug transport
  Homolog annotation: Hit_ID=UPI000034F09A; Match level="QueryCoverage =64%, HitCoverage=8%, E-value=2e-09, Identity=58%"; Hit description =antiporter/ drug transporter/ transporter
  Subcellular localization annotation: CTP_CleavageSite=41; ConfidenceScore=5.25e-01
MAPLVLSPASLSGLRIFHSSPLNPKKEPTSIKGLSSRPASSTMHVPYHCSKQLITDDARLNLANDHKSLNAIHE

SEQ ID NO: 219127 - protein, 80 aa, Glycine max
  Coding DNA Sequence Number=SeqID_102349
MGEGNSSSSMLASYSCSGILLVCVDVKSTGKCTELSNISVFYAEGSSTKHRCLITALRVQTYGNLILLYQVLRRQYIFQC

SEQ ID NO: 219128 - protein, 83 aa, Glycine max
  Coding DNA Sequence Number=SeqID_102350
MIGSGSPGNDALIGEVAKEARDRAADMGVYNEELVYSRKCVSLEYRPSIVDEDLESIPLPIPSLPISSRECRRSDTTPYASKK

SEQ ID NO: 219129 - protein, 809 aa, Glycine max
  Coding DNA Sequence Number=SeqID_102351
  Gene Ontology: Mol. function=nucleoside-triphosphatase activity; Cellular component=membrane; Biological process=defense response
  Homolog annotation: Hit_ID=Q1SI25; Match level="QueryCoverage=98%, HitCoverage=90%, E-value=0.0, Identity=68%"; Hit description=NB-ARC domain, putative
  Pfam annotation: Domain name=LRR_1; Domain location=450-471; Score =0.4; E_value=2.4e+02; Accession=PF00560.23; Description=Leucine Rich Repeat
  Pfam annotation: Domain name=LRR_1; Domain location=473-494; Score =11.7; E_value=1.9; Accession=PF00560.23; Description=Leucine Rich Repeat
  Pfam annotation: Domain name=LRR_1; Domain location=496-518; Score =10.5; E_value=3.1; Accession=PF00560.23; Description=Leucine Rich Repeat
  Pfam annotation: Domain name=LRR_1; Domain location=520-542; Score =5.5; E_value=27; Accession=PF00560.23; Description=Leucine Rich Repeat
  Pfam annotation: Domain name=LRR_1; Domain location=544-566; Score =9.7; E_value=4.3; Accession=PF00560.23; Description=Leucine Rich Repeat
  Pfam annotation: Domain name=LRR_1; Domain location=568-589; Score =0.8; E_value=2e+02; Accession=PF00560.23; Description=Leucine Rich Repeat
  Pfam annotation: Domain name=NACHT; Domain location=60-214; Score= -31.7; E_value=0.017; Accession=PF05729.3; Description=NACHT domain
  Pfam annotation: Domain name=NB-ARC; Domain location=21-317; Score =156.1; E_value=9e-44; Accession=PF00931.13; Description=NB-ARC domain
  Pfam module annotation: Pfam domain module=LRR_1::LRR_1::LRR_1::LRR _1::LRR_1::LRR_1::NACHT::NB-ARC; Domain location=450-471::473 -494::496-518::520-542::544-566::568-589::60-214::21-317
MDEPNGEQTNESEAIKTIVENVKRLLDKTELFVADNPVGVEPRVQEMIELLGQKQSNDVLLLGMWGMGGIGKTTIEKAIYNKIGRNFEGKSFLAHIREIWEQDAGQVYLQEQLLFDIEKETNTKIRNVESGKVMLKERLRHKKVLLILDDVNKLHQLNVLCGSREWFGSGSRIIITTRDMHILRGRRVDKVFRMKGLDEDESIELFSWHAFKQASPREDFIELSRNLVAYSAGLPLALEVLRSYLFDMEVTEWKNVLEKLKKIPNDEVQEKLKISYDGLTDDTEKGIFLDIACFFIGMDRNDVIHILNGCGLCAENGIRVLVERSLVTVDYKNKLGMHDLLRDMGREIIRSETPMELEERSRLCFHEDALDVLSKETGTKAIEGLALKLPRNNTKCLSTKAFKEMKKLRLLQLAGVQLVGDFKYLSKDLRWLCWHGFPLACIPTNLYQGSLVSIELQNSNVNLLWKEAQVMEKLKILNLSHSHYLTQTPDFSNLPNLEKLLLVDCPRLSEISYTIGHLNKVLLLNFQNCISLRKLPRSIYKLKSLKALILSGCLKIDKLEEDLEQMESLTTLIADKTAITRVPFSIVRSKRIGYISLCGYEGFSRDVFPSIIWSWMSPTNSLSSRVQTFLDVSSLVSLDVPNSSSNHLSYISKDLPLLQSLCIECGSELQLSLDAANILDALYATNFEELESTAATSQMHNMNVLTLIECNNQNMTTSDGGGGCLLPGDSYPDWLTFNIEGSSLTFEIPQVNGRNLKKMMCHVHYSSPENITSDGLKHLLVINHTKAIIQLYKRNALVSFEDEEWQGVL

SEQ ID NO: 219130 - protein, 185 aa, Glycine max
  Coding DNA Sequence Number=SeqID_102352
MAREGETVVTSGLHPTEKRHIDDRLMKRGTRRDQGSITNNQKRKWWALLTSPAKNLENLKLELPLAWEPMGSESSSFEAFWLDDVEEGELEELLRLEEVLWKQRLKVEWLMYVDRNTTFFNRKISHRKQVNTIKKIQDDDGNVYRNVEDIGEVLTKYFSDLFTSSPPHDMTEIASLVEGRNYGEM

SEQ ID NO: 219131 - protein, 753 aa, Glycine max
  Coding DNA Sequence Number=SeqID_102353
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=100%, HitCoverage=66%, E-value=2e-95, Identity=41%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=416-547; Score =26.8; E_value=3.5e-05; Accession=PF00665.16; Description=Integrase core domain
  Pfam annotation: Domain name=zf-CCHC; Domain location=256-273; Score =24.9; E_value=7.8e-05; Accession=PF00098.13; Description=Zinc knuckle
  Pfam module annotation: Pfam domain module=rve::zf-CCHC; Domain location=416-547::256-273
MASNSHFPSNLPILTGKNFNRWSVQMKALLGFQDLIDVIENGIEIPKEGASDSQKNEFKDMKKKDCKALMILHQCVDDSHFEKIANAKSAKEAWDILNKAYAGADKIKKVLANSITSCGDTITNLTLVEKVLRTLNPRFDHIVVAIEESKDLESLSVDELQGSLEAHEQRLQERANDKATEQALQAHHQSRNGGSDNRRGKKGRGRFQNTRGRGGYSKDKGKPQPDQRSGDNCSKRSGGSSTRGRGGKKKWDKRNVECFNCGKKGHYAEECWYREKNVVDDAQLATGAVSDTELVLLMVTTKTGADAEDQWYLDTGCSTHMTGHKDWFVSLDESVNHKVRFADDNTIRVEGHGKVVIKRKDGIVSYIEDVLYVPNMRCNLLSLGQLLEKKYRMVMEDKEMKIYDKDRRLIIKAPLNRNRTFKALEFQGFKSTAQNGSRNTSAEIDDRKLQRMPGVQATKECISEICTNKVNTEIGGITHEFTPPYTPQHNGAAERRNRTILNMVRSMLKTKKLPHFLWSEAAATAVYILNKYPTKRLKGVTPEEAWTSTKPKVNKLRIFGSLCYKHVPEQLRQKLDDKGEQMVLIGYHATGGYKLLDPRSKQVSVSRDVIFDELKEYEWKEDPINNTTKILVHSFIPEELSDTTDELPTRNTEGGTRRSQRVMQPSQMLKDYEVMKDSQITDEGDIVHFALYADVEPMSFEEALKNDKWVNAMKEELKSIETNHTWKLMELPKLKRPIAVKWVFKVKRNPASE

SEQ ID NO: 219132 - protein, 96 aa, Glycine max
  Coding DNA Sequence Number=SeqID_102354
  Gene Ontology: Mol. function=transition metal ion binding; Cellular component=cytoplasm; Biological process=fucose metabolic process
LSLTLLLAVLSLVNVKAKYGWSDKSFTSLLQYQKIHACPNDCILYKNESEEMHNCPRCGISRYKVKDDDECSSDENTKKGPPSKDVMASSDHSKVQ

SEQ ID NO: 219133 - protein, 66 aa, Glycine max
  Coding DNA Sequence Number=SeqID_102355
MCAKRTCTNKATYLSLKSDLQREFGVVLEEASTCTRIWPWLEVFACLGSSRERKRCEFKAEAVLRT

SEQ ID NO: 219134 - protein, 312 aa, Glycine max
  Coding DNA Sequence Number=SeqID_102356
GEGQGIGPSSPQGSSQRSSSEEHFSDEEAIQEAEAGGSDIFPASSTSKLSASIGIAEDTFIQMQDEDPAAALRLLLNTSQANTSSEKNPGASSSSDADITSTVRQDCLLLKLSMEYARADVLKSIEENPSAAFGHLNFLKKLHNPLTSDEILGKVIQIESIIDQFANTVQKKRENGARLDAQKQAHILLLEKARAAQREVERLTKEAKEGSSEIKACDDNISSWEATITNLLSHVDDLRQKIVTEQAKRKELQEKAADSIQKLVAEKGREGLKAFSASQAVADEARAMESADQVLSKEMATLKKLYEDLIMT

SEQ ID NO: 219135 - protein, 236 aa, Glycine max
  Coding DNA Sequence Number=SeqID_102357
  Homolog annotation: Hit_ID=Q9FGQ4; Match level="QueryCoverage=21%, HitCoverage=29%, E-value=1e-12, Identity=72%"; Hit description =Arabidopsis thaliana genomic DNA, chromosome 3, TAC clone:K5K13
LCHSFEGNAGALRNFEVLDFLRAKGASKDPTRVIAKVAQFEYKVYDYLVDTVASTTKKLVFYDAHSKANRHPILSFIILTLASCHTSTSLFHLAYQQSSSSPHLHLCFPFFPSSLLSFFLPLPPSSLPPSPPPPPLPFLSSPFPSNECFFMSDSANKLQMVRCPECQNLLLKLTDYSVYQCGGCGAVLRAKHKGYVSGSMLDEGKNGWFLAVDGSFFFLKTAVHGSFSNFHVTSNR

SEQ ID NO: 219136 - protein, 308 aa, Glycine max
  Coding DNA Sequence Number=SeqID_102358
  Gene Ontology: Mol. function=serine esterase activity
  Homolog annotation: Hit_ID=Q4IT23; Match level="QueryCoverage=94%, HitCoverage=96%, E-value=5e-58, Identity=42%"; Hit description =Putative esterase precursor
  Pfam annotation: Domain name=Esterase; Domain location=52-299; Score =13.7; E_value=1.6e-06; Accession=PF00756.11; Description=Putative esterase
MLIRMFLSNRHFISALLALAIGLWLPGSVLARPDLERKIGTTVADSDSADYRFSDLRFTSADGQRHYRVRIAQPRRAPAPDGYPTVYFLDGNAVLMELNAALLAKLAAAKRPPVLVMIGYDNDLRIDAAGRAYDYTLPLPAGMKKAPRAGGGADAFLQLIETRIKPAIAAKLAVDPQRQTLWGHSYGGLFVLHTLFTHPAAFQRYIAVEPSLWWGNGMILQEAQQMTERRAVPATRLQLWVGLAERDRAAPPGVKSPTLPADATHLLAEQLAQLGGLTVGYREWPALGHGAMLGAAIEPALSSVIAED

SEQ ID NO: 219137 - protein, 130 aa, Glycine max
  Coding DNA Sequence Number=SeqID_102359
MLKRKDVPQSISGRDELDKDELHNVLAVTAGSDCSMHSKAEALEHIKKRDTGHQSVSLENKTGDSTVLKIGDSAEVVIKQDMKGRKHKYGFNNNKHEKPENIRVVDDETGDKHQLDEVLRMPSTCVFLKM

SEQ ID NO: 219138 - protein, 34 aa, Glycine max
  Coding DNA Sequence Number=SeqID_102360
GALYPGFMRNLRSGGESMIMPRSPDLHDNSENRV

SEQ ID NO: 219139 - protein, 122 aa, Glycine max
  Coding DNA Sequence Number=SeqID_102361
GGPLGTSTLTFRGLHVLAIRGLHALAFRGLHVLTFRGLHVLAFRGLHTLSFSGLDVLTFKGSFLLSVPGPPPDIGGQPTVRAQPKREAITQLLYISGQDFTRATAKRRVWIMRANMTTLTQI

SEQ ID NO: 219140 - protein, 105 aa, Glycine max
  Coding DNA Sequence Number=SeqID_102362
KKYGYGILLEIEVAFDFSIVIFCYHGISFVVLLQRILIFLTELVDESLHRDVVCSPSWSFQWDSRGRVADEIENPSYHTSHVDSRNSPVDEALVANLMTPSSGKC

SEQ ID NO: 219141 - protein, 99 aa, Glycine max
  Coding DNA Sequence Number=SeqID_102363
MATPVEVIEISSSPASPTLSLSPPTSDAPTEASWDLIEHVVETTKFTKRENACLFIIDFRVPKPPSPLIGYTSFDFVKLSCLLWRSRRNYTSGSRCFLT

SEQ ID NO: 219142 - protein, 377 aa, Glycine max
  Coding DNA Sequence Number=SeqID_102364
  Gene Ontology: Mol. function=protein serine/threonine kinase activity; Cellular component=integral to membrane; Biological process=protein amino acid phosphorylation
  Homolog annotation: Hit_ID=Q9LHP4; Match level="QueryCoverage=91%, HitCoverage=30%, E-value=1e-147, Identity=72%"; Hit description =Receptor protein kinase-like protein
  Pfam annotation: Domain name=Pkinase; Domain location=48-326; Score =149.3; E_value=1e-41; Accession=PF00069.15; Description=Protein kinase domain
  Pfam annotation: Domain name=Pkinase_Tyr; Domain location=48-326; Score=107.1; E_value=5e-29; Accession=PF07714.7; Description=Protein tyrosine kinase
  Pfam module annotation: Pfam domain module=Pkinase::Pkinase_Tyr; Domain location=48-326::48-326
MIAMGITAVIKARRTIRDDDSELGNSWPWQCIPFQKLNFSVNQVLRCLIDRNIIGKGCSGVVYKAAMDNGEVIAVKKLWPTTIDEGEAFKEEKNGVRDSFSTEVKTLGSIRHKNIVRFLGCCWNRKTRLLIFDYMPNGSLSSLLHERTGNSLEWKLRYRILLGAAEGLAYLHHDCVPPIVHRDIKANNILIGLEFEPYIADFGLAKLVDDGDFGRSSNTVAGSYGYIAPEYGYMMKITDKSDVYSYGIVLLEVLTGKQPIDPTIPDGLHVVDWVRQKKALEVLDPSLLSRPESELEEMMQALGIALLCVNSSPDERPTMRDIVAMLKEIKHEREEYGKFDVLLKGPPANGACWNKSIGGVLPTSSSVPVMQTLNTKQ

SEQ ID NO: 219143 - protein, 61 aa, Glycine max
  Coding DNA Sequence Number=SeqID_102365
MIDGEESVSTFLVYGMVMARGGGGVVGRGVRVVGGKGITRSGGGIASDVEREGRRIRKREF

SEQ ID NO: 219144 - protein, 457 aa, Glycine max
  Coding DNA Sequence Number=SeqID_102366
  Gene Ontology: Mol. function=ribonucleoprotein binding; Cellular component=U4/U6 x U5 tri-snRNP complex; Biological process=assembly of spliceosomal tri-snRNP U4/U6.U5
  Homolog annotation: Hit_ID=Q01E93; Match level="QueryCoverage=94%, HitCoverage=87%, E-value=2e-90, Identity=45%"; Hit description=[A] KOG2574 mRNA splicing factor PRP31
  Pfam annotation: Domain name=NOSIC; Domain location=97-149; Score =97.5; E_value=4e-26; Accession=PF08060.3; Description=NOSIC (NUC001) domain
  Pfam annotation: Domain name=Nop; Domain location=189-337; Score =225.8; E_value=9.2e-65; Accession=PF01798.8; Description=Putative snoRNA binding domain
  Pfam module annotation: Pfam domain module=NOSIC::Nop; Domain location=97-149::189-337
MATLADSFLADLDELSDNEAEIPEDNDVDAADMEEDVDGDLADLENLNYDDLDSVSKLQKTQRYTDIIQKVEEALHKKESEVLFQVVDIEDDPEYQLIVDCNALSVDIENEIVIIHNFIRDKYRLKFPELESLVHHPIDYARVVKKIGNEMDLTLVDLEGLLPSAIIMVVSVTASTTTGKPLPEEVLSKTVEACDRALDLDSAKKKVLDFVESRMGYIAPNLSAIVGSAVAAKLMGTAGGLASLAKMPACNVQLLGAKKKNLAGFSTATSQFRVGYLEQTEIFQTTPPSLRMRACRLLAAKSTLAARVDSIRGDPSGKTGRAFKDEIHKKIEKWQEPPPAKQPKPLPVPDSEPKKKRGGRRLRKMKERYAITDMRKLANRMQFGVPEESSLGDGLGEGYGMLGQAGSGKLRVSVGQSKLAAKVAKKFKEKNYGSSGATSGLTSSLAFTPIFSCSLGP

SEQ ID NO: 219145 - protein, 83 aa, Glycine max
  Coding DNA Sequence Number=SeqID_102367
MDKVEEFNRERELLTKLLLQEEAFWKQPSKVIDINWLENEQSRRIEHKRTFFTCSVNSGCWECIHLKHVIEQFIPTVESNIAL

SEQ ID NO: 219146 - protein, 302 aa, Glycine max
  Coding DNA Sequence Number=SeqID_102368
  Gene Ontology: Mol. function=RNA-directed DNA polymerase activity; Biological process=RNA-dependent DNA replication
  Homolog annotation: Hit_ID=Q1SFQ9; Match level="QueryCoverage=75%, HitCoverage=80%, E-value=2e-52, Identity=45%"; Hit description=RNA -directed DNA polymerase
MVLLKVVKRSWKLGGVGFRVGLGMALRGLFADGNGNHGVVIDKVRSIITTDDNLKLVRPFMKEELKEATLLILPDGFNLGFYHRFWGMCGEDVFQACCMWLAEGAFPSSVNDTTIAIILKFDNPRVLAKRLKNVLDKCVSEEQSAFVSGSINDNVLVVSEILHAMKCKRRGKQGDVALKIDISKAYDRIDWDYVKAMLSKLGFHTDFVGWIMLCVSSVIVFSSKIHQREAMAVKRILDDYVVAFGRVINLQISEVTFSKNVDHNMKKRVKSTLGVSESNGGGKYLGFSACVGRSKKAIFNFF

SEQ ID NO: 219147 - protein, 474 aa, Glycine max
  Coding DNA Sequence Number=SeqID_102369
  Gene Ontology: Mol. function=glucose-6-phosphate 1-dehydrogenase activity; Cellular component=cellular_component; Biological process =carbohydrate metabolic process
  Homolog annotation: Hit_ID=Q42919; Match level="QueryCoverage=99%, HitCoverage=100%, E-value=0.0, Identity=79%"; Hit description =Glucose-6-phosphate 1-dehydrogenase, cytoplasmic isoform
  Pfam annotation: Domain name=G6PD_C; Domain location=226-466; Score =430.5; E_value=2.3e-126; Accession=PF02781.6; Description=Glucose-6 -phosphate dehydrogenase, C-terminal domain
  Pfam annotation: Domain name=G6PD_N; Domain location=36-224; Score =338.4; E_value=1.2e-98; Accession=PF00479.12; Description=Glucose-6 -phosphate dehydrogenase, NAD bin
  Pfam module annotation: Pfam domain module=G6PD_C::G6PD_N; Domain location=226-466::36-224
METSEWHIERRSSFGSESPLAREAGNVPETGSLSIVVLGASGDLAKKKTFPALFHLYLQGFLPPDEVHIFGYARTKISDDELRNRLRGYLVPKKGASPQQLEDVEKFLQLIKYVSGSYDSEDGFRLLDKEISEHEYLKNSVEGLSRRLFYLALPPSVYPSVCKMIKTCCMNKSDLGGWTRVVVEKPFGKDLESAEELSTEIGKLFEEPQIYRIDHYLGKELVQNLLVLRFANRFFLPLWNRDNIDNVQVLCLVAMEKPVSLRPEHIRDEKVKVLESVLPINDDEVVLGQYEGYKDDPTVPDESNTPTFATVVLRIHNERWEGVPFILKAGKALNSRKAEIRVQFKDVPVYVRRNKGKGCRYVSKGVKQPGLEMSTVQSELDLSYGQRYQGVTIPEAYERLILDTIRGDQQHFVRRDELKASWQIFTPLLHRIDEGEFKPLPYKPGSRGPAEADQLLEKAGYVQTHGYIWIPPTL

SEQ ID NO: 219148 - protein, 146 aa, Glycine max
  Coding DNA Sequence Number=SeqID_102370
  Gene Ontology: Mol. function=alpha-1,4-glucan-protein synthase (UDP -forming) activity; Cellular component=cellulose and pectin -containing cell wall; Biological process=cellulose biosynthetic process
  Homolog annotation: Hit_ID=O24548; Match level="QueryCoverage=72%, HitCoverage=30%, E-value=2e-56, Identity=97%"; Hit description=Type IIIa membrane protein cp-wap13
  Pfam annotation: Domain name=RGP; Domain location=2-146; Score=10.9; E_value=2.5e-10; Accession=PF03214.4; Description=Reversibly glycosylated polypeptide
MIDFQIESGFSCLIVPVSVIYESLFQLRIEIFDLTYLVVAKDPSGKDINALEQHIKNLLCPSTPFFFNTLYDPYREGADFVRGYPFSLREGAPTAVSHGLWLNIPDYDAPTQLVKPLERNTRYVDAVLTIPKGTLFPMCGMTLASI

SEQ ID NO: 219149 - protein, 261 aa, Glycine max
  Coding DNA Sequence Number=SeqID_102371
  Gene Ontology: Mol. function=catalytic activity; Cellular component =endoplasmic reticulum; Biological process=protein transport
  Homolog annotation: Hit_ID=Q9LTZ8; Match level="QueryCoverage=90%, HitCoverage=20%, E-value=4e-84, Identity=67%"; Hit description =Similarity to negative regulator of vesicle formation
  Pfam annotation: Domain name=PGAP1; Domain location=79-261; Score =80.8; E_value=4.4e-21; Accession=PF07819.3; Description=PGAP1-like protein
MPGFRAKIRIGILIIVVVGICLAALYGLLKPISNGCIMTYMYPTYIPISSSESISPVKYGLYLYHEGWKKIDYKEHLKKLSGVPVLFIPGNGGSFKQARSSFFLFRFSRSWFAFMVRSLAAESDRAYQNGPLEPTFYQEASLRPEEGGVDINLSGFQLPSQYTSRLDWFAVDLEGEHSAMDGAILEEHTEYVVYAIHKILDQYKVSYDARTREGAAVSGSLPKSVILVGHSMGGFVARAAVIHPRLRKSAVELFYTFNPTS

SEQ ID NO: 219150 - protein, 201 aa, Glycine max
  Coding DNA Sequence Number=SeqID_102372
  Gene Ontology: Mol. function=catalytic activity; Cellular component =endoplasmic reticulum; Biological process=protein transport
  Homolog annotation: Hit_ID=Q9LTZ8; Match level="QueryCoverage=71%, HitCoverage=13%, E-value=7e-49, Identity=65%"; Hit description =Similarity to negative regulator of vesicle formation
  Pfam annotation: Domain name=PGAP1; Domain location=1-111; Score= -22.8; E_value=2.8e-07; Accession=PF07819.3; Description=PGAP1-like protein
SPPVALQPSLGHYFARVNSEWIEGYKVQTTNTGRYVSDPVLSHVVVVSISGAYNDYQVRSKLTSLDNIVPPTHGFMISSTAMKNVWLSMEHQAILWCNQLVVQVSHTLLSLIDSRTGQPLPDTQKRLAVFARMLRSGISHNFDWMMQLPSCKRLLNIPVQNTKDVTAVEAFANNIMLNYALWAQKIAFPLFPCVFFCNKSS

SEQ ID NO: 219151 - protein, 75 aa, Glycine max
  Coding DNA Sequence Number=SeqID_102373
ALKGLDDTLQPKSKAAARWIVVKLLPSGWIKLFYGQGSCSMGNFAIKLGVNTVFEAEMLGAINAVEIACNMNWNN

SEQ ID NO: 219152 - protein, 90 aa, Glycine max
  Coding DNA Sequence Number=SeqID_102374
MAYLREGHFHLLIDYHLPLLIKPLKFLRLWMGSDSDAILPRKGLVTRAMSKRLQEDWARAAEEGPRVLMNLRGRFLSPWANVGSNYLCTY

SEQ ID NO: 219153 - protein, 717 aa, Glycine max
  Coding DNA Sequence Number=SeqID_102375
  Gene Ontology: Mol. function=catalytic activity
  Homolog annotation: Hit_ID=Q67TV0; Match level="QueryCoverage=98%, HitCoverage=58%, E-value=1e-154, Identity=42%"; Hit description=GPI inositol-deacylase PGAP1-like protein
MACKGSNGKSHFVLVTNLEPCSGIRLHLWPEKGKSTTSIPLNDRVVEVTSKMMHIPSGPAPRQLEPGSQTEQAPPSAVFWLGPEDMHGFRFLTVSVAPRPTISGRPPPAASMAVGQFFNPEEGNQELSPWFMLQSTYSQKDLVLEEAHPLAVKLSFAISLGLLPVTLSLKTVSCGIRNSGLPEEEAGDLESSSFMASREYVGFVVTQPHKLACWMSETPKEAANKVWAYEAQNFSCLKCCRAKHVSERLCKLRCFPPVALAWDDTSGLHVYPNLNSETIVVDSSPAHWSSTQQSEKTVVLLLVDPHCSYKSSISISVSAAASRLLLLYSPKIVGFSIAVVFFALMRQACSWDLDLRIPSMLTAVESNLTLISHFFPLAILPIFFSLFLSLLMSQPLPPFASFISISLICYIFANGFIAILILISHLVFFVAAVTHIFIKTRWQMWERNVSFFFLRWFVNRSSSFFSLKVVRVLRANPVIVTAVTAMVLGSLVHPSFGLLILLFSHFLCCHNALCSSFLTASCCNHEQNNENFDCNCEDYVGSERLKFKFDGSFKRTFPSEDNSSSSPDSSKSFGETQLDLFHHRHGLLILHLVATMMFAPSVVAWIQRLALGESLPWLLDSVLCIGVILHGICNSKPEFNSFFLSYTGIPIRNVRLYFIYLIAGYWSYFSGLTLAPYRAFYVMGAVGGISFALRMLCRRNGEKKEVTYSSRKHSHRH

SEQ ID NO: 219154 - protein, 88 aa, Glycine max
  Coding DNA Sequence Number=SeqID_102376
MIRGGALRLFAPFCHPEAAGPMTSRDQIWSFCTLVSSRGGGPDDTRRYPTVIRTLLLSERQVMVTRDSRQPRGAKLVSYPNFRPGTFA

SEQ ID NO: 219155 - protein, 125 aa, Glycine max
  Coding DNA Sequence Number=SeqID_102377
  Homolog annotation: Hit_ID=Q9AY32; Match level="QueryCoverage=47%, HitCoverage=90%, E-value=2e-25, Identity=96%"; Hit description=RRNA intron-encoded homing endonuclease
WTLAWFDRSASGVHRSARPFCRRCAPVLNWPGRASGADSDPIVLAFGIGVMINRDSRGHSYFIVRDTVLVSTINDADQGSADVAFRTPLAPYEKSKSLGSGGSMVARLKLKGIDGRAPPGVEPAA

SEQ ID NO: 219156 - protein, 79 aa, Glycine max
  Coding DNA Sequence Number=SeqID_102378
  Subcellular localization annotation: CTP_CleavageSite=65; ConfidenceScore=5.21e-01
MAEEKAMPPRSSFSICFQGQSGDQYRTAQAPEFSSQVCSNSNSSCITSKPDALSSSIPLIATDFRCGTRAELESLSLGE

SEQ ID NO: 219157 - protein, 116 aa, Glycine max
  Coding DNA Sequence Number=SeqID_102379
MEREMITMIVDMLPVFYYEKMVGYMPSNFTYLVFAGERIEVGLRRGKLDYAAFASTRNRRFEAGGAKEKEGDTHAVTSTPTWPKSQQTPHNPTNQYSPLIEAVPKSNKHENAITRK

SEQ ID NO: 219158 - protein, 57 aa, Glycine max
  Coding DNA Sequence Number=SeqID_102380
VKNRLSYEVPKATVELSSVVGLSVHPPLSAASVRLAQQKNLVGHQYQGCALSVRSVR

SEQ ID NO: 219159 - protein, 124 aa, Glycine max
  Coding DNA Sequence Number=SeqID_102381
  Gene Ontology: Mol. function=calcium ion binding; Cellular component =membrane; Biological process=transport
  Homolog annotation: Hit_ID=Q1RUY8; Match level="QueryCoverage=84%, HitCoverage=17%, E-value=8e-48, Identity=93%"; Hit description =Mitochondrial carrier protein, putative
IFVVFAGMTNFTVTFIIIQGGGSLRSWIEMGMAKSFGWKQFLSLMEQKEPTILRAYTSLCLSKSGTLKKSEILESLKNAGLPANEDNAVAMMRFLKADTEESISYGHFRNFMLLLPSDRLQEDP

SEQ ID NO: 219160 - protein, 154 aa, Glycine max
  Coding DNA Sequence Number=SeqID_102382
MWSLLDQSNVKSIGPPPNGALLPIAAIVKPTQHHDMVMQSQVIASLPALLRHRQYASFLVGGIDNEQGDAIVHRCDHHERIDSVQMIVEKRPKVKSPEYCSTFDLPPFEDYDATVRIKVQRLLYIKMVMFSTFNNGIVDEEIVESSFSNTYVEY

SEQ ID NO: 219161 - protein, 78 aa, Glycine max
  Coding DNA Sequence Number=SeqID_102383
MDRIGLKIMYDAWNMSVINGVINAFIRRWHNEISLFHLPIEEMEGEPPHSLVCILPQPQPQPSASQIPDYVSGVVYSC

SEQ ID NO: 219162 - protein, 71 aa, Glycine max
  Coding DNA Sequence Number=SeqID_102384
MFNPSTQDCVVTTLHCAIESPLFTGVAPHHQQVAVHDILIMEVRSPTFGLMIMEDKAVQSVWCLEVWVVAV

SEQ ID NO: 219163 - protein, 407 aa, Glycine max
  Coding DNA Sequence Number=SeqID_102385
  Gene Ontology: Mol. function=calpain activity; Cellular component =intracellular; Biological process=proteolysis
  Homolog annotation: Hit_ID=Q70WR6; Match level="QueryCoverage=84%, HitCoverage=88%, E-value=2e-24, Identity=25%"; Hit description=S locus F-box (SLF)-S4D protein
  Pfam annotation: Domain name=F-box; Domain location=13-60; Score =41.4; E_value=3.1e-09; Accession=PF00646.23; Description=F-box domain
MLGVHGTKREVLSMEQHLPQELVSNILSRLPAKDLVKCKRVCKSWFDLITDYHFVTNHYVAYNNLMHYQSQEEQLLVIGRPFVSALKTHISLLSCNTNDPQKNHISSSSLLNLPCEYNNSEHKYWSEISGPCNGIYFLEGNPNVLMNPSLGQFKALPKPHLSASQGTYSLTEYSGFGFDPKTNDYKVVVIRDIWLKETDERKLGHWTAELYSLNSNSWRKLDDASLPLPIEIWGSSKVYTYVNNCCHWWGYDVDESGAKEDAVLAFDMVNESFRKIKVPRIRGSSKEEFATLAPLKESSTIAVVVYPLRGQEKSFDVWVMKDYWNEGSWVKQYTVEPIETIYKFVGFYGSNQFPWSSSGNDGLVGCDYEPESEKIKDLQYGHGESDDSAAVKDTKEIKVEIIKGHRI

SEQ ID NO: 219164 - protein, 398 aa, Glycine max
  Coding DNA Sequence Number=SeqID_102386
  Gene Ontology: Mol. function=metal ion binding; Cellular component =integral to membrane
  Homolog annotation: Hit_ID=Q9LTZ6; Match level="QueryCoverage=78%, HitCoverage=87%, E-value=8e-69, Identity=48%"; Hit description =Arabidopsis thaliana genomic DNA, chromosome 3, TAC clone:K1G2
  Pfam annotation: Domain name=zf-C3HC4; Domain location=174-212; Score= 37.4; E_value=5e-08; Accession=PF00097.15; Description=Zinc finger, C3HC4 type (RING finger)
MENKRMVANEEQRRSPRNQKVPLTDSNGQNMATLFSPRFKSAAAMAGWDEEALLLASLIVEDTPDRDPKHKKRYVLHSKTPPNSSRKRRAQRSPQAPIPVVLDLDAEETPKIDSGRKKKEKKACVENEGKKACVENEGSKVGEGGNESKEKNPGDASSSSSLPCIDKLRDELSCAICLEICFEPSTTPCGHSFCRKCLRSAADKCGKKCPKCRQLISNGRSCTVNTVLWNTIQLLFPQEVEARKEASALNSRQQAQNLSPESAFFAYLRNDTQPLRVASSRSTNSMRSGTTATTTTTTTSTQENEDAALARMLQREIDEQRSLGTTRTRLARLRARRGGRGVSTSQHEDAALALRMQREEFMQTYRGSSQEQSSRLTSTSLARENLRAMASRAMNRRR

SEQ ID NO: 219165 - protein, 124 aa, Glycine max
  Coding DNA Sequence Number=SeqID_102387
MNSAPFIIQEQQAEWINAHRQIMHPLSFRNNKLGGKRAETDFAPFIIQEQRVEWNNKLGGKRAETNSAPFIIQEQRVEWNNKLGGKRIEMNSAPFIIQEQRVKWNNKLGGKRADTDSAPFVIQG

SEQ ID NO: 219166 - protein, 72 aa, Glycine max
  Coding DNA Sequence Number=SeqID_102388
MNEHDLEEEDEEKVQQREQCLQTHTQQEDNFQVNTCSHQLTIKEERHEDHEGSIILRQLYLPFASCVFDMGK

SEQ ID NO: 219167 - protein, 187 aa, Glycine max
  Coding DNA Sequence Number=SeqID_102389
  Homolog annotation: Hit_ID=Q7PDL8; Match level="QueryCoverage=39%, HitCoverage=8%, E-value=6e-09, Identity=42%"; Hit description =ERYTHROCYTE MEMBRANE PROTEIN PFEMP3
ATCLAFRGLHALTFRGLHILTFRGLHILTIRGLHVLTFRGLHALTLRGLHVLTFRGLHVLAFRGLHTLFFSGLHALAFRGLDALAFKGSVPGPPPDPGGGPTMRAQLEKEAIGSRPQDTQWTRRSPTGPWVSSSGYGPLSVLQGARPPQDRACKTPSGPGEVQQGLGVSSSDYGPLSVLRSVCRPQQ

SEQ ID NO: 219168 - protein, 187 aa, Glycine max
  Coding DNA Sequence Number=SeqID_102390
  Gene Ontology: Mol. function=helicase activity
  Homolog annotation: Hit_ID=Q1SRJ5; Match level="QueryCoverage=97%, HitCoverage=23%, E-value=2e-40, Identity=42%"; Hit description =Probable helicase [imported]-Arabidopsis thaliana-related
KQGYDRVTAVVVYDANGALENPITQNDEIKEYLDCRYISPCEATWRIFGFPIHARKPVVERLHFHLSGQHSVLYEDDDDIDDILSKPSISNSKFLAWMNSNKCFSEDRSWNLRKKGNTIGRLIWVPPTTGELFYLRMMLTTCKGPTSFEDIRTVENVLYPTYREACFAMGFLQDDREFVEAIKEAKD

SEQ ID NO: 219169 - protein, 75 aa, Glycine max
  Coding DNA Sequence Number=SeqID_102391
MTSGEQFYFGWRRCQIIVRERDREGERERGSDDDDDNDDHFGGGGDSGHSDNNDSGHDNDCVGGYGCDGHDDMIF

SEQ ID NO: 219170 - protein, 291 aa, Glycine max
  Coding DNA Sequence Number=SeqID_102392
  Gene Ontology: Mol. function=RNA-directed DNA polymerase activity; Cellular component=nucleus; Biological process=RNA-dependent DNA replication
MKKTSGSHHQRLFKENVRKTKRGLQILKRRVRELFTHREGKNHLVQGKLAQASQLLRLEGINSPRRAGCLRLKFSHGPGEPDAGLGKFSRTNITILSIFSAYPYVRIHEGSIFIGNKYPNRARRWSWRNKHIHEDSFVTPLHPWQIAIQRCKKYFNMSSQSAGVSMSVTMEIQLKEWLIWDHDGRWIYGFQKYIGRSSTFVAELWGVFQGLKLAILKGFTRILLQVDSKAVILAIRSGNEGSASGWRLIQAIQKFIRMVNQFQINHMYKETNRCVDKLANHDCSLDAYGET

SEQ ID NO: 219171 - protein, 298 aa, Glycine max
  Coding DNA Sequence Number=SeqID_102393
  Gene Ontology: Mol. function=nucleic acid binding
  Homolog annotation: Hit_ID=Q1SLA4; Match level="QueryCoverage=90%, HitCoverage=53%, E-value=1e-16, Identity=24%"; Hit description=Zinc finger, CCHC-type; Lipocalin
MVWIRFPGLNLFFYDESILMALAAVVENPVRVDSNTLDVRRGCFARVCVEVDFNKPVAEKVVGSSKGISGEAPRIPVQPPSQGGTSSGQTSAATPQGVPPTSSSITNSINAHSMANHDKTIVTANQQLSKENVTQPGEPVNGEWLVVRRKNHKNQVEKKQKDFVFKGLQGFFFNLFKNQIQSANQEAYLSNHGHVIANLDANNEKKILPEVISKSKHPRKDIDTPIVQMLKNASLAKQKVWKKCHVGMAVAIVGPSTSKSPNVNNVDHEGTLAMDIQQPSLGNVEELNTQKEFIDNAM

SEQ ID NO: 219172 - protein, 309 aa, Glycine max; identical to SEQ ID NO: 186645
  Coding DNA Sequence Number=SeqID_102394
  Homolog annotation: Hit_ID=Q9AVH2; Match level="QueryCoverage=74%, HitCoverage=99%, E-value=2e-72, Identity=54%"; Hit description =Putative senescence-associated protein

SEQ ID NO: 219173 - protein, 379 aa, Glycine max
  Coding DNA Sequence Number=SeqID_102395
  Gene Ontology: Mol. function=RNA-directed DNA polymerase activity; Cellular component=intracellular; Biological process=RNA-dependent DNA replication
  Homolog annotation: Hit_ID=Q1T0S0; Match level="QueryCoverage=76%, HitCoverage=58%, E-value=1e-113, Identity=71%"; Hit description =Pentatricopeptide repeat
  Pfam annotation: Domain name=PPR; Domain location=109-142; Score=6.8; E_value=1.2; Accession=PF01535.11; Description=PPR repeat
  Pfam annotation: Domain name=PPR; Domain location=143-177; Score =29.5; E_value=1.2e-05; Accession=PF01535.11; Description=PPR repeat
  Pfam annotation: Domain name=PPR; Domain location=178-212; Score =41.0; E_value=4e-09; Accession=PF01535.11; Description=PPR repeat
  Pfam annotation: Domain name=PPR; Domain location=213-247; Score =35.8; E_value=1.5e-07; Accession=PF01535.11; Description=PPR repeat
  Pfam annotation: Domain name=PPR; Domain location=248-283; Score=1.9; E_value=4.5; Accession=PF01535.11; Description=PPR repeat
  Pfam annotation: Domain name=PPR; Domain location=284-318; Score=2.6; E_value=3.6; Accession=PF01535.11; Description=PPR repeat
  Pfam module annotation: Pfam domain module=PPR::PPR::PPR::PPR::PPR::PP R; Domain location=109-142::143-177::178-212::213-247::248-283::284 -318
MVLQNNNLLPKTPADREGNRHFSYREQCEEDLTRYMDILTVKLGKGSSEEETLHTLFNDQACDSISVSQDLVHRLLWRYKDDWKSALGWVDAVRIFDDLQALGLEKNTKSMNLLLATLCKEKFVEQACKIFLELQQHIAPNAHTFNIFIRGWCKICHVDKAHWTIQEMKGSGFHPCVISYSTIIQCYCQEGNFSRVYELLDDMQAQGCSANVITYTTIMWALGKAEKFVEALKVPKRMRSSGCRPDTLFFNSLIHKLGRAGRLDDVAYVFKVKMPKAGVSPNTSTYNSLISMFCYHAQEKRATERKEMENLGYCKPDAQTYNPLIKSCFRSEKIDGVLNEILNDMINKQHLSLDLSTHTLLIHWLCRVDAIGRSLYLRR

SEQ ID NO: 219174 - protein, 75 aa, Glycine max
  Coding DNA Sequence Number=SeqID_102396
MKLNDFDSRSSSVEVDIKKQMVMKEVEEMIEEVQNELKNVSYLESGLRHEAINWLTENPNKLAILKSLPLDENEE

SEQ ID NO: 219175 - protein, 129 aa, Glycine max
  Coding DNA Sequence Number=SeqID_102397
MKLCFYNQLIETSEEETGEVSSEENLNQIQQDDQTSSLEEEDTQAINTLTKEHDLLFEAINSIPDPQEKKVFLNKLKKSLKNKPKPKEFITNNKFDVSNITKRLENTSVKPTSIQDLQTEINNLKQEIK

SEQ ID NO: 219176 - protein, 137 aa, Glycine max
  Coding DNA Sequence Number=SeqID_102398
MVSLMDRNILGSLFLKIHFHGLDMKEGKTPTTLIYRIQYKANVYLPRTIKWDKVTLPKKWVMDKATPSIPRPAPTIEQIKQDNSGKIKDGELIQSELPPTTQYQLPKVKDNSDKPVMATPFKTKDVNEEITPKDIKS

SEQ ID NO: 219177 - protein, 95 aa, Glycine max
  Coding DNA Sequence Number=SeqID_102399
MGKGRLRWHLPEDPFRVLPELPEEGVPEDFRKKGSSGSTERSSRRTGLPEIFRNISSENFPEEGFFRMTFQCFRKHFPEEQLLPESFRKNYFFRN

SEQ ID NO: 219178 - protein, 93 aa, Glycine max
  Coding DNA Sequence Number=SeqID_102400
MFLCSMMSPGLLNPDVSCMFSLILAKRHPQIPLVGLNLTITALRHIYQQLAPVMLAQPGGSSGALSKLILTERIMTIHLLPGSSTRLAMNCCA

SEQ ID NO: 219179 - protein, 130 aa, Glycine max
  Coding DNA Sequence Number=SeqID_102401
  Gene Ontology: Mol. function=sequence-specific DNA binding; Cellular component=nucleus; Biological process=regulation of transcription
  Homolog annotation: Hit_ID=Q8SAB5; Match level="QueryCoverage=60%, HitCoverage=16%, E-value=6e-21, Identity=65%"; Hit description=DNA binding protein
MEEVEQANRVVVESCHRVLSLLSQPRDQVQHRNLMVETGETVVRFKKVVSMLHNGLGHARVRKLKNPQIPSSHQSIFLDNPNCKTLTNNNNNNHHLKKSILSPNQLTSIISIVQRESGGGGDLGGVAMPA

SEQ ID NO: 219180 - protein, 132 aa, Glycine max
  Coding DNA Sequence Number=SeqID_102402
  Gene Ontology: Mol. function=structural molecule activity; Cellular component=protein complex; Biological process=microtubule-based movement
  Homolog annotation: Hit_ID=P33625; Match level="QueryCoverage=80%, HitCoverage=23%, E-value=4e-39, Identity=72%"; Hit description =Tubulin alpha chain
  Pfam annotation: Domain name=Tubulin_C; Domain location=39-132; Score= 56.5; E_value=8.5e-14; Accession=PF03953.7; Description=TubulinFtsZ family, C-terminal domain
MSMHIFNETTKICAWIAFENSHTTALVSRLTSLRFDGTIYVDITEFHTNLVPYPRVHFIISLYTSVISTTKAYHEQLSILEITNAMFEPPSMMAKCDPRHGKYMGCYLMYRSDDVPKDVNAIVATIKIERIV

SEQ ID NO: 219181 - protein, 103 aa, Glycine max
  Coding DNA Sequence Number=SeqID_102403
MPISIKGLMATCTYPMCRNIQGVLGDFWNTPVIHISIYLFEVDLPIEEIMFWGDHMGLTIFLLPHQAMIPEIRQKGSNEQIGSSVYAYMFLVEVGTVGARYAG

SEQ ID NO: 219182 - protein, 169 aa, Glycine max
  Coding DNA Sequence Number=SeqID_102404
  Homolog annotation: Hit_ID=Q8H6Q8; Match level="QueryCoverage=87%, HitCoverage=5%, E-value=6e-11, Identity=28%"; Hit description=CTV.20
MNTCASLVLLKPQRGETTLFITDMTKANVSLPRTIKWDEVTLPEKWVMDKATLSIPRPAPTIEQIKQDNSGKVEIAFNRRNSFSSRIEAFRSEYESARRSFLVRTRLIPIGLIRSESHNQFLTVSLQGLDTTSSIPRRTYNQEQEDDQKSIQSPTHSSMHEPYDVILNL

SEQ ID NO: 219183 - protein, 116 aa, Glycine max
  Coding DNA Sequence Number=SeqID_102405
TPSKAIRPPITRAFIEKYCSPRQAQGDASQATDAPPPPHQANPAGSLGMGQYLQHLVRQQEANHWGQFRAEVAWPGDWLEAQAGEAPAGAPGDVEEARMDEEMMNLLDFLGGSGAT

SEQ ID NO: 219184 - protein, 268 aa, Glycine max
  Coding DNA Sequence Number=SeqID_102406
  Gene Ontology: Mol. function=chitin binding; Cellular component =extracellular region; Biological process=chitin metabolic process
  Homolog annotation: Hit_ID=UPI000044A8F0; Match level="QueryCoverage =60%, HitCoverage=99%, E-value=1e-22, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DGPLGTSTLTFRGLYVLVIRGLHALTFRGLHVLAFRGLHAFTFKGLHVLTIIGLQVLTIRGLHVLAFRGLHVLAIRGLHAFTFQGLHALTFRGPNILIFRGLHVLVFRGLHVLAFRGLHALAFRGLHALAFRGLHALAFRGLHILHFRGLHVLAFRGLHTLAFRASSFPLSVLFPGPLPDIGGGPTMQGQPESEAITGRAPQDTQWTRRSPTGPWGFQLGDRTHKTTSGHGEVQQGLGVSSSDYGPLARRHSSLGMADSGQKAHHHHL

SEQ ID NO: 219185 - protein, 215 aa, Glycine max
  Coding DNA Sequence Number=SeqID_102407
  Gene Ontology: Mol. function=transferase activity, transferring glycosyl groups; Cellular component=cytoplasm; Biological process =nucleoside metabolic process
  Homolog annotation: Hit_ID=Q9FKS0; Match level="QueryCoverage=66%, HitCoverage=35%, E-value=8e-43, Identity=51%"; Hit description =Uridine kinase-like protein
MWGRVRTVSPSWGGGRVPVCVAFAGSCRCGVIAAGCGVVAAGRCWVRGGACGLCCCVLCCVFSRCAFALQFQVVEHGLGHLPFTEKQVVTPTDLCFVNCNMSGKEVTDRQWVTNGGSVYTGVDFCKKLCGVSIVRSGESMENALRACCKGIKIGKILIHRDGDNGKQAPEGIHCVCKRFPSLKIVTSEIDIEINEEYRVIPGLGEFGDRYFGTDD

SEQ ID NO: 219186 - protein, 47 aa, Glycine max
  Coding DNA Sequence Number=SeqID_102408
MATARWVLKHPVYGIVILRLGIYTRRRSYRKTLQGSGISTNIIDNNE

SEQ ID NO: 219187 - protein, 109 aa, Glycine max
  Coding DNA Sequence Number=SeqID_102409
MEALSPKQKEIRQLQHDLLQTLFAQSPRKCPIGGLPPQQQWLSTRQLANAVNVGVYRARRLLLDLVSRKKVIVTDGSINNSLRWYPTALLNGDNDGISNSDAPHSPLTE

SEQ ID NO: 219188 - protein, 111 aa, Glycine max
  Coding DNA Sequence Number=SeqID_102410
MYKYIQNILATYNRLHILNTNRYMHAQVISCHTLMGKAEIFSLLIHILKIHFMPYVPILRSIFAPFLAHVYIGKALGYLLNTHMLISSLVTYSTSSRCKEPSRCSLHQMQD

SEQ ID NO: 219189 - protein, 42 aa, Glycine max
  Coding DNA Sequence Number=SeqID_102411
MAGHDKKFVTYPRGKKSITLAMLSSSYAPSSSPRVPAGPALV

SEQ ID NO: 219190 - protein, 70 aa, Glycine max
  Coding DNA Sequence Number=SeqID_102412
  Subcellular localization annotation: CTP_CleavageSite=21; ConfidenceScore=5.10e-01
MNKAGKGVVSYAGVGQESQVPCAAVTSATSSLVSYAGVSEFLLSESGRVARKKRQCLHWVGWLSVGRADL

SEQ ID NO: 219191 - protein, 68 aa, Glycine max
  Coding DNA Sequence Number=SeqID_102413
MPKGNFIAKCGVDTMAPKAFKEGRPRSNWWHLGSLKCRDHVDMIGQFEDVSCEPILLHLLQQIPLQLC

SEQ ID NO: 219192 - protein, 74 aa, Glycine max
  Coding DNA Sequence Number=SeqID_102414
MPFGLMLTASVLIWQKRNFTAFDLTGCKGKATNHLDWDEEEGLVTRAMSKRFQKDLARTIEEGSKVVMNLRIDF

SEQ ID NO: 219193 - protein, 173 aa, Glycine max
  Coding DNA Sequence Number=SeqID_102415
MSNHSDEKEQCQKKRKSTICEASNFRTSRRRFCSNKNEEEMNKGVSTTLKLYDDPWKIKKTLTDSDLGILSRLSLATDLVKKQILPMLGADHARAAETEEGTPVRVWDMDTKSMHQLVLKRWSSSKSYVLIAKWNQDFVRRRDLKKGDEIGFHWDPYNCVFNFCVLKRAMPEN

SEQ ID NO: 219194 - protein, 48 aa, Glycine max
  Coding DNA Sequence Number=SeqID_102416
MVGGLIGRCGSNISRIKNEFGAMIKTPQNPSSLLTHHCPLPPSHLYIV

SEQ ID NO: 219195 - protein, 344 aa, Glycine max
  Coding DNA Sequence Number=SeqID_102417
  Pfam annotation: Domain name=Transposase_23; Domain location=31-98; Score=5.0; E_value=0.00032; Accession=PF03017.5; Description =TNP1ENSPM transposase
  Subcellular localization annotation: CTP_CleavageSite=32; ConfidenceScore=5.03e-01
MELDAIKSELSQIHTQQSTPPRPSNPDVFVARVSTKESCAEASNNVVGGKVFGVGGTIHTIAYGDDVLRVCVDTVYDGEAIVRLPTSEIQYVRDAVNSFIGWPRHLVKPLSYDSDLNVRKPVEHSSDAKLAGESDPLGELMKILFYVYQNPVEVSWEASQFGLPDIGAKFYITHADLAEIISGDKCLNIAILQLWTISMNECGRSKADQSLYGLLETQSIQNAKERCLQCQQYIETWVKESQRQLYLGAYLHQAHWQLFVLHLRENTVVWFCSLRKKPDISIKGAINSAMKTITSSFEGMSNQGAPRWVEPKWFSDGSSLDVEVITTIRQKWATYFLSFRKSSC

SEQ ID NO: 219196 - protein, 141 aa, Glycine max
  Coding DNA Sequence Number=SeqID_102418
  Gene Ontology: Mol. function=nucleic acid binding; Cellular component= intracellular; Biological process=regulation of transcription, DNA -dependent
  Homolog annotation: Hit_ID=Q6YS82; Match level="QueryCoverage=95%, HitCoverage=52%, E-value=1e-25, Identity=48%"; Hit description=RRM -containing RNA-binding protein-like
  Pfam annotation: Domain name=zf-RanBP; Domain location=107-136; Score= 23.7; E_value=0.00067; Accession=PF00641.9; Description=Zn-finger in Ran binding protein and others
  Pfam annotation: Domain name=zf-RanBP; Domain location=42-74; Score =5.7; E_value=0.23; Accession=PF00641.9; Description=Zn-finger in Ran binding protein and others
  Pfam module annotation: Pfam domain module=zf-RanBP::zf-RanBP; Domain location=107-136::42-74
MDKRTGRPKIWLYRDKETNEPKGDATITYEDPHAAVAAVEWFNNNWLCLKKSNCSNVNFAFRGACNRCGIVRPTGASGILGVGGRGKGRAAQESGGISRPAGGGIFGPNDWPCPMCGNINWAKRTKCNICNTNKPGIMRVV

SEQ ID NO: 219197 - protein, 68 aa, Glycine max
  Coding DNA Sequence Number=SeqID_102419
MKIITLLASFVLILFALSSQPLLGAAEASPEQVIDTSGKHCLPLRFIPFNPKIGVIHVSTNLNIMFHY

SEQ ID NO: 219198 - protein, 71 aa, Glycine max
  Coding DNA Sequence Number=SeqID_102420
MVGAFSQNIVTLTGLPMILLSESDLTNPWSGVSCYVLLSAPEWFFTDMMNRWMTMKNLMLEDTGTQCSDRM

SEQ ID NO: 219199 - protein, 85 aa, Glycine max
  Coding DNA Sequence Number=SeqID_102421
MGGELSNWGALRNLPQEASRRQAPPFFPINRGGGLFEIFWTPWLCMSVVLGEKMCFREENPSRGASVSDSVEIFHRSLPFFSLQP

SEQ ID NO: 219200 - protein, 102 aa, Glycine max
  Coding DNA Sequence Number=SeqID_102422
MEMQRKTKEKSPIYLESATQCPCGIRLHQKRARVSVLERKKKEASPAEGREVLYPLVPSRKDKKRNLAHFLDIFKKLEIIMPFGEALQQMPLYSKFLKDMLT

SEQ ID NO: 219201 - protein, 108 aa, Glycine max
  Coding DNA Sequence Number=SeqID_102423
MNALSRTGQHLASSSGNPNQGVEKCREGGDAEESGERVGLTKPGGSLSVILINAIQERFARLASGYAKPNSKELKSREFFRLSIEHALSETTTANDQGLRYLAQAQLA

SEQ ID NO: 219202 - protein, 384 aa, Glycine max
  Coding DNA Sequence Number=SeqID_102424
  Gene Ontology: Mol. function=zinc ion binding; Cellular component =membrane; Biological process=defense response
  Homolog annotation: Hit_ID=Q1SA17; Match level="QueryCoverage=99%, HitCoverage=59%, E-value=1e-115, Identity=45%"; Hit description =Pleckstrin-like; Regulator of chromosome condensation/beta-lactamase- inhibitor protein ...
  Homolog annotation: Hit description=II; Zinc finger, FYVE/PHD-type
  Pfam annotation: Domain name=PH; Domain location=21-122; Score=20.0; E_value=0.0085; Accession=PF00169.19; Description=PH domain
  Pfam annotation: Domain name=RCC1; Domain location=303-352; Score =25.2; E_value=0.00024; Accession=PF00415.9; Description=Regulator of chromosome condensation (RCC1)
  Pfam module annotation: Pfam domain module=PH::RCC1; Domain location =21-122::303-352
MADPQKTAPGERNIEQAITSLKKGSYLLKYGRRGKPKFCPFRLSNDESLLLWYSGKEEKQLKLSTVSRIIPGQRTATFQRYPRPEKEYQSFSLIYNDRSLDLICKDKDEAEIWFVGLKALVTRGNNCKWRLESRTDDSLYYDSPNSGTRRSTPSFSDPGDAGGGAFDLQNRWVKAFSEIISYTAASKSSSQAESLANSSLSSGSVDNSSNRNSASEAFRVSLSSAVSSSSQGSYHEDFDSIGDVFIWGEGIADGILGGGVHRVGALSSSEMDAFLPKALESKLVLDVHSIGCGYRHAVIVTKQGDIFSWGEESGGRLGHGVEMDVFHPKLIDTLGGVNIELVACGEYHTCAVTYSGDLYTWGDGTHNSGMLGHGNEVSHWIPKK

SEQ ID NO: 219203 - protein, 144 aa, Glycine max
  Coding DNA Sequence Number=SeqID_102425
  Gene Ontology: Cellular component=integral to membrane
  Homolog annotation: Hit_ID=Q60CZ6; Match level="QueryCoverage=88%, HitCoverage=58%, E-value=6e-27, Identity=47%"; Hit description=HVA22- like protein c , putative
  Pfam annotation: Domain name=TB2_DP1_HVA22; Domain location=3-49; Score=-22.5; E_value=0.005; Accession=PF03134.9; Description=TB2DP1, HVA22 family
MCFSNSNNYAANFRLPIWPFAKLIFSCWLVLPHFNGAAVVYRNYIRPFYMNPQIPIPQGSQIWYFPQKKSLFNQPDDVLSAAERYMEEHGTEAFERLISKDSSQKDMSSNLIVHAETLLVDNNDRQARARRNGNYMIFDDDYRY

SEQ ID NO: 219204 - protein, 200 aa, Glycine max
  Coding DNA Sequence Number=SeqID_102426
MKTLFSNQRSEAKLSSIAYPIAQRHYRRREIRLRFTTFSTKETLENTFRRRNLGIPGILPSGEGSTVPMWGETRRRRNCGQGIRVGREKPNRLGRSWGRWNRGEGNSKNEKGMLEFLILKILVNTRAKGSNGNLGMGMAGFVVFWSSGGQMSPISGFQTTCLAGVALFGEFYPVCCGLRGAPYSELVPSHDNFTVDFADQ

SEQ ID NO: 219205 - protein, 820 aa, Glycine max
  Coding DNA Sequence Number=SeqID_102427
  Gene Ontology: Mol. function=zinc ion binding; Cellular component =membrane; Biological process=defense response
  Homolog annotation: Hit_ID=Q1SA17; Match level="QueryCoverage=96%, HitCoverage=75%, E-value=0.0, Identity=51%"; Hit description =Pleckstrin-like; Regulator of chromosome condensation/beta-lactamase- inhibitor protein II; ...
  Homolog annotation: Hit description=Zinc finger, FYVE/PHD-type
  Pfam annotation: Domain name=FYVE; Domain location=538-606; Score =60.8; E_value=4.5e-15; Accession=PF01363.12; Description=FYVE zinc finger
  Pfam annotation: Domain name=RCC1; Domain location=210-259; Score =21.2; E_value=0.0036; Accession=PF00415.9; Description=Regulator of chromosome condensation (RCC1)
  Pfam annotation: Domain name=RCC1; Domain location=262-314; Score =38.9; E_value=1.7e-08; Accession=PF00415.9; Description=Regulator of chromosome condensation (RCC1)
  Pfam annotation: Domain name=RCC1; Domain location=317-366; Score =23.8; E_value=0.00061; Accession=PF00415.9; Description=Regulator of chromosome condensation (RCC1)
  Pfam annotation: Domain name=RCC1; Domain location=382-431; Score =24.4; E_value=0.0004; Accession=PF00415.9; Description=Regulator of chromosome condensation (RCC1)
  Pfam annotation: Domain name=RCC1; Domain location=434-483; Score =19.4; E_value=0.0056; Accession=PF00415.9; Description=Regulator of chromosome condensation (RCC1)
  Pfam annotation: Domain name=RCC1; Domain location=488-535; Score =35.1; E_value=2.4e-07; Accession=PF00415.9; Description=Regulator of chromosome condensation (RCC1)
  Pfam module annotation: Pfam domain module=FYVE::RCC1::RCC1::RCC1::RCC 1::RCC1::RCC1; Domain location=538-606::210-259::262-314::317 -366::382-431::434-483::488-535
MGDLYLICKDKDDAEIWFPGLKAIVTRGNNRKWRFESRTDDSLYSDSPKSGTRRSTPSIAPFSDPGDAGGGFIDLQNRWIKAFSEIISYSAASKSSSQAESLANSSLSSGSVDNSSNRNSASEAFRVSLSSAVSSSSQGSYHEDFDSLGDVFIWGEGIADGILGGGVHRVGALSSSEMDAFLPKALESKLVLDVHSIGCGYRHAVLVTKQGEIFSWGEESGGRLGHGVEMDVFHPKLIDTLGGMNIELVACGEYHTCAVTYSGDLYTWGDGAHNSGMLGHGNEVSHWIPKKVGGNLEGLRVLYVSCGPWHTAIVTSAGQLFTFGDGTFGALGHGDLSSANIPREVENLKGLRTTRVACGVWHTAAVVEVVNESVESSTRSSNGRLFTWGDGDKSQLGHADREPRLVPECVNALSTENICRVACGHSLTIALTTSGLVYTMGSTAHGQLGCPASDGKVPTRVGDKIADSFVEDIACGSYHVAVLTSKAEVYTWGKGLNGQLGHGDSDHRNKPALVEFLKDKQVKSVFCGSNFTAVVCLHKWIPSVDHSTCVGCRNPFNFRRKRHNCYNCGLVFCKSCTSKKSIKASLAPSSNKPYRVCDDCYLKLKKAAAESVPSVQTPSLRSVSLQDNRITKVQGTLLRLASFGSIIQTESSQSKLPDSQDSHLFPALNGKPLMRGFAPSKSSNSLSIDSKKHLSVSEPSARISCQSTSSVSSKSSPRQSYEDINDHLKHRNDILSQEVISLRTQVEDLTHKSKSLEAELERTSKQLKEVTAVAADEAGKCKSAKEIIKSLTAQIGPPWTHTEKTTRSTKKGEGPAMAVP

SEQ ID NO: 219206 - protein, 54 aa, Glycine max
  Coding DNA Sequence Number=SeqID_102428
MAMTAQSASSWEQVAKVPSKNMILPSMETDGLSHILPKPKSSSSGPNSLILGKH

SEQ ID NO: 219207 - protein, 121 aa, Glycine max
  Coding DNA Sequence Number=SeqID_102429
MKKILGLQAPMELTSLPSKSPIAAHLLPQTKVRDHHKHQPHGTKIAMETSPHGNQPESHGNSKPSLMEVPNRVTCPQVQKIHFQHRLFRTFYIGSKTDVESDDVECMNVNIGFGEPMLTYI

SEQ ID NO: 219208 - protein, 114 aa, Glycine max
  Coding DNA Sequence Number=SeqID_102430
MKNERRTDEERRKIFTDLLTEMSRKRYESTSAWIFFTEIIFSLKTAEMHSQGESLRKSRKPFFNKTGEVVAAQNFMDWATMLVLTSGMLRDFTNYTTMDVKHFEVVKRRSHANK

SEQ ID NO: 219209 - protein, 374 aa, Glycine max
  Coding DNA Sequence Number=SeqID_102431
  Homolog annotation: Hit_ID=O22227; Match level="QueryCoverage=54%, HitCoverage=69%, E-value=9e-52, Identity=53%"; Hit description =Expressed protein
  Pfam annotation: Domain name=DUF617; Domain location=117-296; Score =287.0; E_value=3.6e-83; Accession=PF04759.4; Description=Protein of unknown function, DUF617
  Subcellular localization annotation: CTP_CleavageSite=50; ConfidenceScore=5.27e-01
MKEQQKQQIFQRSTSACTATTRNSRRILPSNLTHFRSFESDDVSDKLLVRRGSSPSVSNLYQQQQQQHHAPKLTQQNKISSLIRSFLNIFTFPTMIPTCKWLTIPSQLSVTPSLGRKVTGTLFGHRRGHISFAVQLHPRAEPVLLLELAMSTSSLVKEMSSSLVRIALECQKVSVTAAVAHNNSGGGRRRLFQEPAWTMYCNGRNCGYAVSRTCGDLDLHVLSTVQSVSVGAGVIPLLEDGKGGGSGNGGSEGELMYMRARFERVVGSRDSEAFYMLNPDGIAFVGEAVNYFLTGVEVIFTCYSSLNPSKVKRNAYMERGKMGCWRQREREEMGNKVHRKSSSHGGGGDVVVVVVGVIDDRRASELRTEEESSL

SEQ ID NO: 219210 - protein, 161 aa, Glycine max
  Coding DNA Sequence Number=SeqID_102432
  Gene Ontology: Mol. function=protein binding
  Homolog annotation: Hit_ID=Q84SE0; Match level="QueryCoverage=45%, HitCoverage=18%, E-value=3e-25, Identity=72%"; Hit description =Putative TPA: Cgi67 serine protease
METTEPSESNTYVDIEAIYECLETECGVSQEDVILYGQSIGSGPTLHLATKFPRLRGVVLHSGTFSGLQVLYHVHVQAVLSILLATFVGFGVVMSESSILVEFFRWRRRVQALQEQQHGLQLMPQVAQNPRTPNMLRLGLGSGPSNHNQPVVQSRQNSNQS

SEQ ID NO: 219211 - protein, 82 aa, Glycine max
  Coding DNA Sequence Number=SeqID_102433
  Subcellular localization annotation: CTP_CleavageSite=61; ConfidenceScore=5.70e-01
MVTRTFRQPGANEPFDAQRLTSSPAPFVVLTREVRFSLSSFGNIQAQRRARFFSAGQGRSSAMAKGSVVVVQPCRFQDAEVC

SEQ ID NO: 219212 - protein, 335 aa, Glycine max
  Coding DNA Sequence Number=SeqID_102434
MKVDMEAMNEQMTTMMEVMMSMRKMMEANPTTTVIASIAIEKDPIHLPSFNQESHPVSEVYPGYTTKGHAFFGVIVPNALGDPQYRPPSQPLHFVMGGGPPTIVEKEKFVNLEQGLRAIEGGGNYGFADMSELCLVLDVVIPLKFKVSDFDKYKRTTCSKNQLKMYCRKMGAYAKDEKLLMHFFQESLAGAAIIWYTNLESSRVCSWKDLMDAFISYKTCAREIMNHSKNTLKGREIWQLKWYPPMTEREMITMIMDTLLMFYYEKMVGYMSSNFADLVFAGERIEASMRKGKFNYVAFVNPGNGGPREEWRKEGERATCCGCSSCMDKLSTSPC

SEQ ID NO: 219213 - protein, 479 aa, Glycine max
  Coding DNA Sequence Number=SeqID_102435
  Gene Ontology: Mol. function=thioredoxin-disulfide reductase activity; Cellular component=cytoplasm; Biological process=removal of superoxide radicals
  Homolog annotation: Hit_ID=Q70G58; Match level="QueryCoverage=96%, HitCoverage=52%, E-value=2e-78, Identity=63%"; Hit description=NADPH thioredoxin reductase
MKQWIISMVDYHECFRVFDNPNVAVHFNTEAVDLVSNTKGQMSGILVRKIDTGEEYVLEAKGLFYGIGHSPNTELLKGQVELDHSGYVQVQEGTAKTSVEGVFAAGDVQDHEWRQAITAAGSGCVAALSVERYLVSNDLLIEFHQGDAEPISIALLNKSPTFPLPCIIIRPGLSPFQNNQHPPISLPNCLPKTEEVKKELTDRDVHEGFDITLTKHKGQYALRKLYHDSPRLICVLYTSPTCGPCRTLKPILSKKRKKKELLRTPIRYLKRCLRTQTQTKKGEVVALDASMSLFLTHNIRMKIKPWTSAARLVATKDTRGVTGRRGRTRREGEVQTREARVGGTSCGVRGGTLWCSVREGPRGRGWTRPEGGRCCGATREGDDNEGGGGAAARRRLEQRAVAVLWRGGVGEEEVGKVIDEFDQNVHFVEIDIEEDPEIAEAAGIMGTPCVQYFKNKEMLKTVSGVKMKREYREFIEANK

SEQ ID NO: 219214 - protein, 79 aa, Glycine max
  Coding DNA Sequence Number=SeqID_102436
MEVTPSWWCYSEETNRGWAQWWCCHGCCDEEKKRESGAVVVTPWWCHDEEKKMGCGTMVVLPWWCRDEEKRKRMREVGK

SEQ ID NO: 219215 - protein, 79 aa, Glycine max
  Coding DNA Sequence Number=SeqID_102437
MLGPLTEILDAIKNRIRVYIKYSAEFPNNGFSLPSQGSTFYKQEKGFESNSQIHNGEDVSSTSKDRKIAKKPRIYLKAK

SEQ ID NO: 219216 - protein, 264 aa, Glycine max
  Coding DNA Sequence Number=SeqID_102438
MALDLTVLSFNCSRHNYETTAETLEFILAQGRAKVKLGGAWGYQDIQKKGPHVGSHGNEREGEQARGQGARPPPLGARPGVVVKHVQLCGPSSTDLKDQGKPEREEESGGGAGSVGSSSTLYFCSNRGLTAGDGVLSFVGGFYRPVDVEHSLEKSGSSDACCRAPASRGRTIGRSTYVWAFGHIVLASDATALFRPNDSALLGANNPCGSSVVEDESAQGAPSPNVVARSSWRRAVIPAVSARRAVGSCVTTRLARTADREEAK

SEQ ID NO: 219217 - protein, 55 aa, Glycine max
  Coding DNA Sequence Number=SeqID_102439
MDKSLKVGEDECRERERRGTKFMPQMSLILIKHHPQIPLVGLNSARIALRQTYNN

SEQ ID NO: 219218 - protein, 113 aa, Glycine max
  Coding DNA Sequence Number=SeqID_102440
METAGNSPGEGLKREKSLALSSQKSKKVSLSRELVLRSSSKALKVDDSSDDEFEEDSDEDDFAFISHKICKIWRNKGLMSTWKDLNETLSHEDDEEAIICLMADTTSKGSESD

SEQ ID NO: 219219 - protein, 85 aa, Glycine max
  Coding DNA Sequence Number=SeqID_102441
MLTGLSPQIIFPFQFSSSPFVTPLRWVIHDEEAKSNEEESIIVVVGVGEGMGVGKRPWEEIIRITGACDPIVRERRQGLEFGEEN

SEQ ID NO: 219220 - protein, 74 aa, Glycine max
  Coding DNA Sequence Number=SeqID_102442
MMCKKANIWANILNKSVIHKAGSKITLSDIHKLVIFHLMENLPFDLPHIIYINILRNLKGVGGLNNIYYAALIN

SEQ ID NO: 219221 - protein, 143 aa, Glycine max
  Coding DNA Sequence Number=SeqID_102443
MTSVPQRLKGLSKTDEDDERLIQVALQKRKVAALVALTPKRAKKVQLVSEPRAFVIPSAIPRHIKTRVTKANLKIGDKEWAVSFTGNKEDSTSQSSDMTPTQAWCRMKKLKDKNNSQSSISWDLFAKHRRDPSQEVEPPKIEF

SEQ ID NO: 219222 - protein, 261 aa, Glycine max
  Coding DNA Sequence Number=SeqID_102444
MYLQDQAPTYPYGVHISRYIDIKLVADRVCLHLPIWDVAKKKGFKVYYNEEIPTRKMKIVWMDSQKASISGYDGSDNVEHHRVSQVEEVDAAVEKKITASVEAEASTKVMNDTMIHGIIIYFTKTGVMDKNLEASNAPVADEVEHHIQDLTSKQSTTSNEATSRDKGKHDVVIIYSTSFGPTPLNFAQPATVAHDQVQDMIGQAMETFAECQRQENKQPQFVVTPTHVPQPPPIPASLDPSPTTLASIPPLPSSAPPPVQH

SEQ ID NO: 219223 - protein, 70 aa, Glycine max
  Coding DNA Sequence Number=SeqID_102445
  Gene Ontology: Mol. function=DNA binding; Cellular component=nucleus; Biological process=regulation of transcription, DNA-dependent
  Homolog annotation: Hit_ID=Q40174; Match level="QueryCoverage=61%, HitCoverage=16%, E-value=1e-15, Identity=81%"; Hit description=THM18 protein
MWLSIFLLLCFQGLARCGKSCRLRWLNYLRPNLKRGNYTKEEEETIIKLHRHLGNRCENLFPARIIATQA

SEQ ID NO: 219224 - protein, 247 aa, Glycine max
  Coding DNA Sequence Number=SeqID_102446
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=50%, HitCoverage=7%, E-value=2e-30, Identity=51%"; Hit description=Chromo
MADNTRMKELTGDVKRILETMENRNKEYAARFETLETTLEMTLKDKTRDPGSISLAMNNHPFKVVPWYQMMTRENSFTTWIAFTRALETEFGPSPCECPRSQLFKLTQIGSVQSYYVQFTSLANRVQGITQEALLDCFVGGLKPNIRMDVIAQSPTSLLRTVSLAKLYEEKYTPKLKPFSSSFSSKTQTSNTNSNLNTNQNSPQSLKSTSLPPLLPTPYIKPINVKKMTSTEMQLRRERGLSFTCDD

SEQ ID NO: 219225 - protein, 85 aa, Glycine max
  Coding DNA Sequence Number=SeqID_102447
  Gene Ontology: Mol. function=protein serine/threonine kinase activity; Biological process=protein amino acid phosphorylation
  Homolog annotation: Hit_ID=Q1T4M8; Match level="QueryCoverage=86%, HitCoverage=28%, E-value=1e-10, Identity=52%"; Hit description =Protein kinase-like
MKQRYHFNVANERLSQHIEKGYEDRLFINNVASGFTTQVMELDFLCPSEGTHYRWNNGYRITSTTATWDQDVFVRHLLPHSIVLS

SEQ ID NO: 219226 - protein, 496 aa, Glycine max
  Coding DNA Sequence Number=SeqID_102448
  Homolog annotation: Hit_ID=P93716; Match level="QueryCoverage=20%, HitCoverage=24%, E-value=3e-16, Identity=41%"; Hit description =Tapetum-specific zinc finger protein 1
  Pfam annotation: Domain name=zf-C2H2; Domain location=30-52; Score =23.5; E_value=0.00074; Accession=PF00096.16; Description=Zinc finger, C2H2 type
  Pfam annotation: Domain name=zf-C2H2; Domain location=369-391; Score =26.0; E_value=0.00013; Accession=PF00096.16; Description=Zinc finger, C2H2 type
  Pfam annotation: Domain name=zf-C2H2; Domain location=95-117; Score =18.6; E_value=0.023; Accession=PF00096.16; Description=Zinc finger, C2H2 type
  Pfam module annotation: Pfam domain module=zf-C2H2::zf-C2H2::zf-C2H2; Domain location=30-52::369-391::95-117
MKQQPSLLLGSCKAELESPSAAKSPSRTVCECNICGKVFSSGKALGGHRRSHFQKHQKKIKVRFTNHSSKQAGDTSNNIKRARNCDYDTVDDGKRVCCICKKEFPTKNALFGHMRSHPERSWRGVSPPTHFPNKNSSSSSSLSSSFSFSSHNSDSMEKNMEGDRDDYDECVGVGAVCDGGGNRAIDLSTVTCPSWLKTDVRGRKCIGAYEAAETLAYLSVYSKYFCGESNGVSPKKDEVRPKSAPPLIKLGKRKINFSGSSSSKKHEVKKIKFYLKGELKIGKRNDADGEDDDDEDEKLNRCKGLSESEVEDEEGFDNVITEVVAPDRMQDDVDERKGKRVVDHKGKNIKKLVLKSMAKEKENEKVGGYKCGVCGKIFSTFQGLGRHISVHKGKNNNAVIIMDESNHSHSKALGDKENNSSSSSNTHKVDEASMNEAPLPTTMNDAPLPADERKVNDETSETPPLLPLPAHEACQSSSGVKKLDFDLNELPCAMED

SEQ ID NO: 219227 - protein, 174 aa, Glycine max
  Coding DNA Sequence Number=SeqID_102449
  Gene Ontology: Mol. function=transferase activity; Biological process= protein metabolic process
  Homolog annotation: Hit_ID=Q7PC69; Match level="QueryCoverage=56%, HitCoverage=13%, E-value=6e-30, Identity=65%"; Hit description =Cellulose synthase-like C3
MNNKFVRAERFTSIGVVCILDWPKETMLLQFVSIEVDTQQLINAEVYKWQQTGVRIIYRHELKSTTYNTGNLKLAMKCDYVKDYEFVAIFDTDFQPTPDFLKKTVPYFKKLLFIRRNHNGIRNVLQREVSTKRNHEDMKLTSNPTATMAARQAMRIARLAVTKGSCDEDDEQQD

SEQ ID NO: 219228 - protein, 502 aa, Glycine max
  Coding DNA Sequence Number=SeqID_102450
  Gene Ontology: Mol. function=nucleic acid binding; Cellular component= intracellular
  Homolog annotation: Hit_ID=P93716; Match level="QueryCoverage=21%, HitCoverage=25%, E-value=3e-16, Identity=41%"; Hit description =Tapetum-specific zinc finger protein 1
  Pfam annotation: Domain name=zf-C2H2; Domain location=118-140; Score =18.6; E_value=0.023; Accession=PF00096.16; Description=Zinc finger, C2H2 type
  Pfam annotation: Domain name=zf-C2H2; Domain location=392-414; Score =18.1; E_value=0.031; Accession=PF00096.16; Description=Zinc finger, C2H2 type
  Pfam annotation: Domain name=zf-C2H2; Domain location=53-75; Score =17.5; E_value=0.05; Accession=PF00096.16; Description=Zinc finger, C2H2 type
  Pfam module annotation: Pfam domain module=zf-C2H2::zf-C2H2::zf-C2H2; Domain location=118-140::392-414::53-75
MDQKDKHAVSDHHGWVKSCKKEKMKQQRSLLLGSCQAELESPSAAKSPSRTVRECNICGKVFSSGKALGGHRRSHFQKHQKKVKVRFTNHSSKEAGDTSNNINRASNCDYDADDDGKRVCCICKKEFPTKNALFGHMRSHPERSWRGVSPPTHFPNKNSSSSSSLSSSFSFSSHNSDSMEKNMEEDRDDYDECVGVGAVCDGGGNRAIDLSTFTCPSWLKTDVRGRKCIGAYEAAETLAYLSVYSKYFCGESNGVSPKKDEVRPKSAPPLIKLGKRKINFSGSSSSKKHEVKKIKFYLKGELKIGKRNDADGEDDDDEDEKLNRCKGLSESEVEDEEGFDNVITEVVAPDRMQDDVDERKGKRVVDHKGKNIKKLVLKSMAKEKENEKVGGYKCGACGKIFSTFQGLGGHRSVHKGKNNNTVIIMDESNHNHSEALGDQENNSSSSSNMHKVDEAPLPTDETRVNEEIPETPPLLADEACQSSSGVKKLDFDLNELPCAMED

SEQ ID NO: 219229 - protein, 180 aa, Glycine max
  Coding DNA Sequence Number=SeqID_102451
AEYDIPGASDIRTKQKILQTMGEQWRQFKSDLTSKWTLAVDKDSVDDTAKNTALARRNGPNFVRAVETPRGRMCGKNHRPSRSKTLPPTTEAVIDPPSPIRRHVKWKMGCTKKTGQMTSETAKEIAEKIDVLTATIGRSEYPGRVRATGVDVTIKQYFGSAPWTSHTSSSMAPKELEQLT

SEQ ID NO: 219230 - protein, 58 aa, Glycine max
  Coding DNA Sequence Number=SeqID_102452
MYMHRHACIAFGLIILSWKQRGSERKSGAGTSSEGHCGEAIASLNSVGPRETNRESKA

SEQ ID NO: 219231 - protein, 216 aa, Glycine max
  Coding DNA Sequence Number=SeqID_102453
  Gene Ontology: Mol. function=two-component response regulator activity; Cellular component=intracellular; Biological process=two -component signal transduction system (phosphorelay)
  Homolog annotation: Hit_ID=Q8UI16; Match level="QueryCoverage=99%, HitCoverage=100%, E-value=2e-96, Identity=87%"; Hit description=Two component response regulator
  Pfam annotation: Domain name=GerE; Domain location=149-206; Score =77.6; E_value=4e-20; Accession=PF00196.10; Description=Bacterial regulatory proteins, luxR family
  Pfam annotation: Domain name=HTH_11; Domain location=155-204; Score= -0.4; E_value=0.1; Accession=PF08279.2; Description=HTH domain
  Pfam annotation: Domain name=HTH_7; Domain location=147-190; Score =16.7; E_value=0.014; Accession=PF02796.6; Description=Helix-turn -helix domain of resolvase
  Pfam annotation: Domain name=Response_reg; Domain location=4-119; Score=96.1; E_value=1e-25; Accession=PF00072.14; Description =Response regulator receiver domain
  Pfam annotation: Domain name=Sigma70_r4; Domain location=148-196; Score=9.4; E_value=0.033; Accession=PF04545.6; Description=Sigma-70, region 4
  Pfam annotation: Domain name=Sigma70_r4_2; Domain location=142-194; Score=24.6; E_value=0.00035; Accession=PF08281.2; Description=Sigma -70, region 4
  Pfam module annotation: Pfam domain module=GerE::HTH_11::HTH _7::Response_reg::Sigma70_r4::Sigma70_r4_2; Domain location=149 -206::155-204::147-190::4-119::148-196::142-194
MSELVIIIADDHPLFRGALKQAVSGLDGHQTIIEAGDFEAARRAAAARNDADLMLLDLAMPGVSGFSGLMALRAEFSSLPIVIVSATDDATTVRRSIELGASGFISKSSGIDDIRDGIRAVLEGDLWVPAGHHGEKEHDPDVADLIGRLRTLTPQQSRVLGMLAEGLLNKQIAYELNVSEATIKAHVSAILLKLKVDSRTQAVIQLAKINTSALVA

SEQ ID NO: 219232 - protein, 248 aa, Glycine max
  Coding DNA Sequence Number=SeqID_102454
  Gene Ontology: Mol. function=transition metal ion binding; Cellular component=nucleus; Biological process=protein amino acid phosphorylation
  Pfam annotation: Domain name=Transposase_21; Domain location=169-248; Score=-78.0; E_value=5.9e-08; Accession=PF02992.5; Description =Transposase family tnp2
MIRDLGQESFQQAHAPVYEGLQSDSKKSLYTGCKNSLTLLSAVLSLVNVKARYEWSDKSFTSLLEVVHNLLPDDNTLPIPYYKAKKILYPMGMEYQKIHACPNDCILYRHEFEEMSKCHICGTSRYKVKDEEESNYDENSKKGPPAKVLWYLPIIPRFKHLFANKDDEKDLTWHANGRISDALVHHPADCLQWKKTDGLYPDFRKEPRNLRLGLTSDGMNPYGTLSTQHSSWPVLLAQDSQKMTLMFI

SEQ ID NO: 219233 - protein, 264 aa, Glycine max
  Coding DNA Sequence Number=SeqID_102455
  Gene Ontology: Mol. function=hydrolase activity; Cellular component =mitochondrial outer membrane; Biological process=aromatic compound metabolic process
  Homolog annotation: Hit_ID=Q1RUS1; Match level="QueryCoverage=93%, HitCoverage=76%, E-value=1e-102, Identity=70%"; Hit description =Alpha/beta hydrolase
  Pfam annotation: Domain name=Abhydrolase_1; Domain location=14-231; Score=12.1; E_value=0.00091; Accession=PF00561.10; Description =alphabeta hydrolase fold
  Pfam annotation: Domain name=Abhydrolase_3; Domain location=1-223; Score=-88.7; E_value=0.06; Accession=PF07859.3; Description =alphabeta hydrolase fold
  Pfam module annotation: Pfam domain module=Abhydrolase_1::Abhydrolase_ 3; Domain location=14-231::1-223
MPLACGERLANAGYAVFGVDYEGHGRSGGVRCLITKFDNVVNDCEDFFKSVCELQDYKGKPRFLYGDSMGGSVCLLLHKRDPSFWDGTILVAPMCKISDKLMKPIPIVINMLTKFEDIVPKWKIVPTKNIIDSAFKDRGKREAIRNNKLIYQDKPRLKTAMEMMRTSMSLEESLHEVTIPFLVLQGEKDTVTDPEISMALYDQASSVDKTIKLYRGMCHGVATGESDENIAIVFADIIAWLDERASKEKFDSFISNENDDGIMK

SEQ ID NO: 219234 - protein, 153 aa, Glycine max
  Coding DNA Sequence Number=SeqID_102456
  Homolog annotation: Hit_ID=Q5CEG7; Match level="QueryCoverage=68%, HitCoverage=99%, E-value=8e-45, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPR

SEQ ID NO: 219235 - protein, 60 aa, Glycine max
  Coding DNA Sequence Number=SeqID_102457
  Subcellular localization annotation: CTP_CleavageSite=20; ConfidenceScore=5.52e-01
MEKGVVTVASSGRTAKASSRTSGRSSSSRKFSEEGFFRMPFEYSGRTFRKSHFFRKVYVC

SEQ ID NO: 219236 - protein, 96 aa, Glycine max
  Coding DNA Sequence Number=SeqID_102458
  Subcellular localization annotation: CTP_CleavageSite=82; ConfidenceScore=5.09e-01
MGDSSLTMGSVIMGKPPAGRVIPRSRQQQRRQALVPPFFLAIHADWALMLPAIKATHPSRQCQRRDAPRRGLASAFCEIASCAAGVWKACEIGSCS

SEQ ID NO: 219237 - protein, 52 aa, Glycine max
  Coding DNA Sequence Number=SeqID_102459
MEMVGENTLLDQKSHHRCRRRKHDCRMVDALRTFQSESYRFHRKQLKKYLKT

SEQ ID NO: 219238 - protein, 456 aa, Glycine max
  Coding DNA Sequence Number=SeqID_102460
  Gene Ontology: Mol. function=protein serine/threonine kinase activity; Biological process=protein amino acid phosphorylation
  Homolog annotation: Hit_ID=Q01CK2; Match level="QueryCoverage=30%, HitCoverage=24%, E-value=6e-39, Identity=56%"; Hit description=[T] KOG2492 CDK5 activator-binding protein
AMKNRYLAHAQHHPPFHDSALPKRKLDKSCTVKSPSQYAMDAIISKGKSSNKPLVVVGCFPQGSRDLKDLERISIIGVQQINRVFEIVEKTLKGHEVRLLTCQKLATLELQKVRKNEFVEILPINVGCLGACTYCKTKHVRGHLRSYTIDSLIGCVKSMISEGVRALLWKVVYSEHSDPKSLWVATLDPNGAITFYDLNKRRAPNPEAVKVPQDPCGIPQSSDLYCGCFFENCDAGHGNKKGRNDTVLVVVIFVLTVLIIVGLITGFWYYYKRKTNVAKYPQDNLDEDDNFLDRLSGMTAHFTFAAFCRATEDFSRNIAEGGFGSVYLGVLEDGTQLAVKKLEGVGQGAKEFKAEVSIVGSIHHRTLILDFQTVTVNAVLAHPTLVEWLVFSSAGPWENWDHLCTIYNLEDDVAFDAGNIVMTEPISVEPNITLTKEQTATSENTRSKRIISIAKK

SEQ ID NO: 219239 - protein, 180 aa, Glycine max
  Coding DNA Sequence Number=SeqID_102461
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RSR6; Match level="QueryCoverage=99%, HitCoverage=43%, E-value=4e-48, Identity=45%"; Hit description =Glycoside hydrolase, family 1
MEPLQYGDYPISMKTNAGVIHYTNLNVSDNSDALKNQLRDFTADMAANICQRTASNSSLQDVTRVKYLHGYIGSVLDALSDLEKGLTQRINQTRTYTDTDGSNIKGYFAWSFLDLFELLDGYKSSFGLYYVDRDDPELKRYPKLSAKWYNRFLKGRRTSIVGTIELEKDPSLVFVSQLFE

SEQ ID NO: 219240 - protein, 279 aa, Glycine max
  Coding DNA Sequence Number=SeqID_102462
PFITRGFSDPNARVLRGVRKAWDAVQRKDKELRGNGNGIINRYRKWLRFHTQGLDWLPKFRVVAEEEAEALEESEEVQALKAELEKAQAVKEKFKSTTIKVRKEYDELKDINLATVKALEQETKRARKKEHDRNKFRGALWGSNKEPKLRRDERDQSRVEGMILKDGLKACLRSKRSLTQQLSEMEGNMLAIIDKYREELNLEAAHEHRLVDEYAKVFVEKEAWGRRNGERKKERRRHFKEKMSLEEAHHHRRSWIKAWRQKEMNEGRGREEHEILCSK

SEQ ID NO: 219241 - protein, 217 aa, Glycine max
  Coding DNA Sequence Number=SeqID_102463
MATMMEAMTSMKKILEANAVIVAATSTVAKANPMPPSGLKQMYHPTSDMVGKDLGSTDDPMMCKFKTSMPSRHMACLPMWRTLPMRMSITLLPYSLRANNPKTDHAHVSQPMGEAHEIPHHNLADFEPCLGYATEGQAVGGIPMPNTLKGPQFRPQPQPLHFAVVRAPPAMPEKGKVNHLKERLRAIEGGEDYAFANLEELFLIPKHGHSQVQGAGL

SEQ ID NO: 219242 - protein, 342 aa, Glycine max
  Coding DNA Sequence Number=SeqID_102464
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=1e-42, Identity=31%"; Hit description= UPI00006A17C9 related cluster
MAVPKDSFSTETESQVGDFVTFIGLHTRTFRGLHVHAFRGLHVLMFIGLHALAYRGLHVLACRGLHALAIIGLHALAFRGLHVVTFRGLDALAFRGLHVIAFRGLHVQSIRGLHILTFRGLHVLTFRGLHLIALRGLHVLTFRGLHALGFKGLHALTFRGLHILAFRGLHRAARLRLQGLCVLTFIGLHTLTFIGLHVIGFRGLHALAFRGQGLHVLAYRGLHVLPFRGLHVLAFRAQHVLAFRGLHVLAFKGLHVLTFRGLQVLAFRGLHILTFRGLHALTFRALHILAFKWLHALSFRGLHGTTRPRLQRTTRHHLQRVARPRLHRATRPLLQMTTRPRL

SEQ ID NO: 219243 - protein, 228 aa, Glycine max
  Coding DNA Sequence Number=SeqID_102465
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=4e-30, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TFRGLHILTFKGLHALAFIGLHTLAFRGLHVLIIRGLHILAIRGLHILAFRGLHDLTFKGLHVLAFRRLRVLTFKGLHALAFIGLHLLALRALHALAFIRLHTFAFRGLHILAFRGLHALAFRGLRVLTFIGLRVLAFRGLRVLAFRGLHVHPFRGLHVLPLRGLHALTFRGLHALAFRGLRVLAFRGLHVLAFKVLHVLTFRGLHVLAFRGDLLDVVSCILGSFVLN

SEQ ID NO: 219244 - protein, 146 aa, Glycine max
  Coding DNA Sequence Number=SeqID_102466
MAPDRMQLQNMCKKEHESFKEYAQRWRDLAAQVAPPMMVREMITIIVDTLPGFYYEKLVGYTPSSFDDLVFANERIKVGLKRGKFDHLALTNKKPMANREDEKEEGTHAVTVVPTWPNFPPAQQCLYPANINPSYYPPPNQPQRSP

SEQ ID NO: 219245 - protein, 291 aa, Glycine max
  Coding DNA Sequence Number=SeqID_102467
MGEIEEGQERRKADMQAMKEKMATMMEAMMSIKRIMEVNAAAVAATSAIVEVDPTPPSSLNQINHLTSDVVGQEGKELGSIGDPHFVQVQNTHAFPPYGLPPNYTTPNVAHTPNENVNNSTTILVESRQPQSNHAHVSQPMGETHEIPHHNLADFEPCIGCATEGQAIGGVPLSNTLEGPRFCPQPQPLYFAVGRVPPAMAENGKLDQIEERLRAVEGGEDYAFADMEDLCLVPDMVIPLKFKVPDFDKYKGTTCPKNHLKVYCRKKGAYAKDEKLLMHFFQESLTGAADT

SEQ ID NO: 219246 - protein, 75 aa, Glycine max
  Coding DNA Sequence Number=SeqID_102468
MEGGIGHILSITLKEEKRIEGLKSFQEYALYWWTSLVRERRIHGDPPIEYLNDLKSALRKRHILSYYERELMDKL

SEQ ID NO: 219247 - protein, 83 aa, Glycine max
  Coding DNA Sequence Number=SeqID_102469
MKKKNTESRRDEDENIQSKNGPLRGVEPIPLSLQCPFIEKMGEEVAAQLTQASWRLPPEATCSPRRAGCFLLKLPDGTRWAQC

SEQ ID NO: 219248 - protein, 297 aa, Glycine max
  Coding DNA Sequence Number=SeqID_102470
MVNGSTSYGRGGNSVNNRKNDPKDYSKKGVQNARGGKNPQGAKGGELRIGVKSSFKKHNQPVIKHKEQIGNELIPKVNSTGGMENKNVTKPYDESLHLLKFHELRNNHMNVPMIPVHMDEDAIKFVNGYKQKMVKGGAANTLVNGNDENNGLLKGMYDTSKEYETSLMFLLETHSYKDSTNRIIPKLGFNNHFIQDGQAHWYLTVVYGSPKFQYLKVLWEALINIAGSIRGGWSVIGGFNTIHQPHDRSGGTAKPSWRASHHSRKMHYRTTIFKPNDRKKELQPELQPNSRKRPKRK

SEQ ID NO: 219249 - protein, 157 aa, Glycine max
  Coding DNA Sequence Number=SeqID_102471
MPQTELLEEPCGEKIIVIQKMLPKQQRPTTSARRQREGVVVAEDAPHMDDAVEEVFQHAEEAGVDAQGFPGGSRDTLVLAAYVDHERPELKLSSHGRKVQKFERPTIEIERWHKETSNFHLLVGEVTNTASFAHHRHIPQLRHFSCRRSSVDVSGVT

SEQ ID NO: 219250 - protein, 70 aa, Glycine max
  Coding DNA Sequence Number=SeqID_102472
  Gene Ontology: Mol. function=cytochrome-b5 reductase activity; Cellular component=cellulose and pectin-containing cell wall; Biological process=electron transport
  Homolog annotation: Hit_ID=Q5PY87; Match level="QueryCoverage=84%, HitCoverage=20%, E-value=2e-20, Identity=85%"; Hit description =NADH:cytochrome b5 reductase
MLVKGRFKYQPNQVRALGMIAGGTGITPMFQVCVTRAILENQQDKTNINLIYANVTFDDILLKMLSTLVE

SEQ ID NO: 219251 - protein, 39 aa, Glycine max
  Coding DNA Sequence Number=SeqID_102473
NYVGHMVECTKDMFQSLQDALEGGQTEVEIGECFIESQE

SEQ ID NO: 219252 - protein, 86 aa, Glycine max
  Coding DNA Sequence Number=SeqID_102474
MAVKHFEVVKRKSHANKKWSSDKIRCCNYFSLNIGKFGGSADFEPVAKPILWLSDVVVHGLAYRRSWKWMSCHDALSENQLAKCTA

SEQ ID NO: 219253 - protein, 174 aa, Glycine max
  Coding DNA Sequence Number=SeqID_102475
MYVGIESVTVSGIRATLGSSYIGIPGIPHLPLPRSHFHQYSRAWGMWEQPVEPLGEVVPPESPWAYTFDYLASYYKHSHPYMISSEEGGAPCCLVREPQTQPDDQMPNYVPSANYPCEDQFHMIIRTMQRLLDLRVVLGGHKQSLTHTTRVGDGTRTLNLELQLSGIKTEEEGQ

SEQ ID NO: 219254 - protein, 142 aa, Glycine max
  Coding DNA Sequence Number=SeqID_102476
  Gene Ontology: Mol. function=oxidoreductase activity, acting on CH-OH group of donors; Biological process=alcohol metabolic process
  Homolog annotation: Hit_ID=Q9FJ99; Match level="QueryCoverage=84%, HitCoverage=20%, E-value=3e-37, Identity=56%"; Hit description =Mandelonitrile lyase-like protein
  Pfam annotation: Domain name=GMC_oxred_C; Domain location=7-140; Score=-23.0; E_value=0.00011; Accession=PF05199.4; Description=GMC oxidoreductase
MENIMGIRLVTRYCVSLHDLELQDLTEDDNNSLTFNYFKDPEDLKKCVEGMIIVIDMINSKAFSKFCYHNMSVQDLIDLMLNLPVNLRPKHANISFSLEQYCIDIVLTIYHYHGGCQSGKAVDHNYKVIGIEALRVIDASLH

SEQ ID NO: 219255 - protein, 98 aa, Glycine max
  Coding DNA Sequence Number=SeqID_102477
MYVGAVAVVRKLGSAEEKADGFKVFSEVSLLVIDYKHLEIDYKIQNSNFKILFEKPICNLSLIYTLYFASPFVVEDEDGESGRSKEQSKGPRVRDQIK

SEQ ID NO: 219256 - protein, 70 aa, Glycine max
  Coding DNA Sequence Number=SeqID_102478
MHAGKKEIVSPIGEFGLASTHGAKCSGLATHIGDLTMQGTRASAFPNFGSAFLGFRGSFFRPWGYSQGYW

SEQ ID NO: 219257 - protein, 82 aa, Glycine max
  Coding DNA Sequence Number=SeqID_102479
MDNGVILNEKHSFTESRISRDPTSQPKDTLCDNESSMTRSKARRVKHVLQGLIMEINYAQGELELTPHWVSFLQVEEDLRTT

SEQ ID NO: 219258 - protein, 110 aa, Glycine max
  Coding DNA Sequence Number=SeqID_102480
  Gene Ontology: Mol. function=adenosylmethionine decarboxylase activity; Biological process=spermidine biosynthetic process
  Homolog annotation: Hit_ID=Q6D1W3; Match level="QueryCoverage=100%, HitCoverage=48%, E-value=3e-52, Identity=81%"; Hit description=S -adenosylmethionine decarboxylase proenzyme (EC 4.1.1.50) (AdoMetDC) (SamDC) [Contains: ...
  Homolog annotation: Hit description=S-adenosylmethionine decarboxylase beta chain; S- adenosylmethionine decarboxylase alpha chain]
MVDEMLHAIDVAGEAAHAVIHGHDIRLQLVDEIIQRLQGRNHAAGRDFNVGAEDVTLVEVRDHRTGQRAGMLGIIDILRIDRLLADQNRHAGTLRLIILACDIQHVSTDD

SEQ ID NO: 219259 - protein, 68 aa, Glycine max
  Coding DNA Sequence Number=SeqID_102481
MGPVPARTCPGGWSPTGRPRGVGNALTFVDELRWTLKVVAVHLLPAAGRPQAAVVPRTTPARGRSTSR

SEQ ID NO: 219260 - protein, 239 aa, Glycine max
  Coding DNA Sequence Number=SeqID_102482
MESLVLEDKLKACQRSKRSLMEQLSKIEENMLIIIDQYKEKIEREAIDRVIELLHGEAMKWMNIFALTLNESQELPRLLARAKAVADTYSASDEVHATYHCHAFTFIQLLHYSLHSVFSSHCHHKKVTIVTKKNVCALRHPYRTCAKAKIMSKIEEVQEQLKADMDAMKEQTTTMMETIMSMRKMMEVNTDAVAATSAAIEVDATNPSGVNQVSHPVLNMVGQGGKVLGSTGGPHFAQV

SEQ ID NO: 219261 - protein, 155 aa, Glycine max
  Coding DNA Sequence Number=SeqID_102483
MAFGTMATRPKHKKKLVKDARLVDLADKTSEEIHEDVVLESLKTLSTEEVQRQSSEKDTMMHIDGELVLEVTKMEVVVVPKDMDHAERETLEEVMLQFVIEASLNNTCCANSGLEKLSLQELLTPLGSPIFPYPIDLSSDFDSSSDEFFRKLDEE

SEQ ID NO: 219262 - protein, 119 aa, Glycine max
  Coding DNA Sequence Number=SeqID_102484
MDTLPVFYYEKMVGYMPSSFADLVFAGERIEVGLRKGKFDYTASTSAENRRTGTGGAKKKEGDAHAVTTTPTQPNSQQTPQDPMYQYPSHQHNYSANIGSPPRPTPVRTSMPNESQRPP

SEQ ID NO: 219263 - protein, 68 aa, Glycine max
  Coding DNA Sequence Number=SeqID_102485
MERVSMCHISKALLARGGCMRIRSNNESCESSDTEDLDVDFGQLVNQAEEEENEDWGLPSNLRRMMEQ

SEQ ID NO: 219264 - protein, 170 aa, Glycine max
  Coding DNA Sequence Number=SeqID_102486
MKIKKRTKERKEGFPIKDREEVKREKKQFSINERKRIESLQKPDCHSESFLTGNIPPHMNKEEKTETPSTQNHSRSILLVRDRMFDLREDPQGNPPFSSFSGATLELLFHDCLREDPQGNPPFSSFSEATAVHVFSTFESGAEFHDCLSADPQGNPPYSTFVRSTMNVIA

SEQ ID NO: 219265 - protein, 153 aa, Glycine max
  Coding DNA Sequence Number=SeqID_102487
  Subcellular localization annotation: CTP_CleavageSite=64; ConfidenceScore=5.56e-01
MKPHATGKAWGPGTAGAVYTGRSCRSTAPSLYGLPSAGQPNVACMRASGAPSSRCEPRWILLMVADMKVDELCRRDRYLVELAKACDQCWKSQCPVGLLWVHWMSRRCNTYKLVGGIRDKLCYMNIDLSQDRIDQLAFRQWEIRIMVTGEDVA

SEQ ID NO: 219266 - protein, 225 aa, Glycine max
  Coding DNA Sequence Number=SeqID_102488
  Gene Ontology: Mol. function=nucleic acid binding; Biological process= DNA integration
MGERFMFLDLNPVEGGIIAFGGMGKGKIIGIEDEVRKYEDILPQIGESSDLQPQTKDWKNKMDEQGKAVRNKSRLVAQGYNHQEARKNIKLFQIDVKRVFLNGFIEEEVYVKQPPATSESICKDFFDLMKNKFEMSMMGELKFFLGLQIKQNNKDYVNDKDGFYMYKVMVGEKMNLPKVIFYYWMQVFRIKGYPKSIIQGWNFFQEGGNDGGLSKEHKDLKALHQ

SEQ ID NO: 219267 - protein, 167 aa, Glycine max
  Coding DNA Sequence Number=SeqID_102489
  Pfam annotation: Domain name=zf-CCHC; Domain location=95-112; Score =17.9; E_value=0.0011; Accession=PF00098.13; Description=Zinc knuckle
MSLATLFGKLHEHEMELMRLHQHEKNDKKNKGIALKASSSSIQEESDKEDLNKIQEDDDFRFFMKRFNNFLRNKRNQRKSNINPKKKGEDSSLAPKCYECDQPEHMRFDCLVFKRRMEKSDKRNVKEKKEKKAHITWKDNDMDNSSDLENEIINLGLMAKDYESEEE

SEQ ID NO: 219268 - protein, 217 aa, Glycine max
  Coding DNA Sequence Number=SeqID_102490
  Gene Ontology: Mol. function=zinc ion binding
MKYNEGSTVVLTTHPYEGNPEELENSNSDVSPAFHRLYICVKAFIGLDSCFLKGPFGGEILAAVGRDPNDQMLPIAYAVVEGENTNSWKWVMELLIKNLGGTEKFLKSTSTHLSKILSEAHAAKAAYTRAYEDAMKKMRKENEEAFEYLWKTFPARYWRKKHMKHATSTLSIRLMGNIWDITEFPDVQPPPPKKMLGQPKNQEGRKLERHLVAVQIG

SEQ ID NO: 219269 - protein, 611 aa, Glycine max
  Coding DNA Sequence Number=SeqID_102491
  Gene Ontology: Mol. function=RNA-directed DNA polymerase activity; Cellular component=chromatin; Biological process=RNA-dependent DNA replication
MDEFLSSIWNSDDNNQVNPPLPSLDEAAKGFSTSEAFQVSNDDEDHHNASSSTVQHDSDDDDHYDASSSVRVIFGVFVNPWTRSRLASLPNLVRVYAKSDEFTPFNNHGRSFDDHLDHLKCVLQTLQKGQFFVKLSKCAFGQRHIDYLGHIVSIKEVEPDPSKIQAMTDWLPPNFVKSLRGFLRLTGFYQRFIKHYAQMANAFDKLKEAMMKSPILALLDFGALSILETDASGTGMGAVLSQSGHPIAYFRVNDSGDQDIGATLLSIAKLLGFDYTIQYKSGLSNVVVTSDWPRPLAAYNRVLSGQTCKKTFNSTSGLAPTASTLNVATVILAVVDNFSKGAHFGMLPTHFTAHRVAHLFINMSDDQTEVLNRILEQYLRAFVHNQPSQWGKFLSLAEWCYNITTHSSTKLTSYEVTYGKPPPSVPNYMSGSSHVDVVDFMQVSRQETFRFLKKKLKHAQASMKKIVDAHHKDVIFVVGVWVYVKLRPYRQSSISDNNDLNCNQRTLLGKTGLTCKILITLRTRCFSKGQGMITICTRMIVTIGPIVRVGSLKGGRTMSIRLCPLVSGAVRSTVSFVSKAVDCTTYLSMNDHGIRTGKFTFKFYFPSLLLE

SEQ ID NO: 219270 - protein, 259 aa, Glycine max
  Coding DNA Sequence Number=SeqID_102492
  Gene Ontology: Mol. function=RNA-directed DNA polymerase activity; Cellular component=chromatin; Biological process=chromatin assembly or disassembly
MDERPEKIAHCCLEGQGGITEPKWHDVVLVVALEPGGVMEVVQELVNGGNWEPIFNDDGVECTIVHTETPRSILLLDQEHMGRIRATTRPYMVTKKHLFNLDFNSVLLKIGIPIWFNVNWEVGRWAVGIGLNKTEGGSGGLAVWYPSLQWRPKEECEVEALDIDENCFAHPIATEFTTISHHNTKTLNGLGLQAETAGQAVMDEVVGTTPINQNDDLCAVNVAVDAKRVESSKSMGTKFGGTRSFGATSSEAIKRKNLA

SEQ ID NO: 219271 - protein, 156 aa, Glycine max
  Coding DNA Sequence Number=SeqID_102493
MADNTRLEEAITIFTQTQSSLHSKLNDVISRFTILESRSPDRPLSLPPPRRKLDVPWFDGANAMSWIFKISQLFDYHGTPIAAALAKLQEDKLNDARRPSRFRPLATPLAITPIASALSVPPPLLPAPPQIVFKKLTTAEMAARCEKGLCYNCDAL

SEQ ID NO: 219272 - protein, 203 aa, Glycine max
  Coding DNA Sequence Number=SeqID_102494
  Gene Ontology: Mol. function=DNA binding; Cellular component =mitochondrion; Biological process=DNA integration
MMLALALGKFPDSLCKKPPSSMDELRERAKGYILIGHTRTLPFFHVGDGYTRTIGKSPRIAQAYEQFLSRLDVKHLTTFVEHPQTNGQAEAAKRVILKALRTRLDKSKGIWKDKLPSILCVYHCSPQTTTNETSFRLTYETNAMIPVEVGKSPTRRLFFQEQNNEENTRVELETKDEVQKMVRIKEEATKLQASRRYNTKVQP

SEQ ID NO: 219273 - protein, 227 aa, Glycine max
  Coding DNA Sequence Number=SeqID_102495
AVRQPGFFAKGLDLGLFDPFKDVKDGELLDEEDIATGEEDAGEEEDDGANEIGNKIIFDHLWFNLNLVKGLANQLGIPRAGLGFDEPWKFFEAHQGQTLGSLKAELGFDEPLEILRGSPRVDLRFDEPWRFVEAHQERTLGLMRPWRFVRAHQGWTFGLTSLGDSSRITEGSPRADHGFDKFLEIRQGSPRADDGFDKPWRFVKAHQGQTLGLTSLGDSSTLTKGKP

SEQ ID NO: 219274 - protein, 211 aa, Glycine max
  Coding DNA Sequence Number=SeqID_102496
  Gene Ontology: Mol. function=structural constituent of ribosome; Cellular component=ribonucleoprotein complex; Biological process =translation
  Homolog annotation: Hit_ID=P30707; Match level="QueryCoverage=62%, HitCoverage=78%, E-value=8e-40, Identity=62%"; Hit description=60S ribosomal protein L9
MKHLNLDFQLITNENGKRKLKIDAWFGSRKTSVAIRTALSHVENLITDVTKGYRYKMRFVYAHFPIDASIGNNKFIEIVLLGLVIDLVKDELILDGNDIELVSRSCTLINQHYLHQRVKKLTWSVSIMSKAEVEDQTITWLTPHSLQQVVSDDFDITTMLNFLQLYELVGLGSSSSMAVEWRRKKDDWRCHFKEKMGQEQAHHHRKPWIRA

SEQ ID NO: 219275 - protein, 122 aa, Glycine max
  Coding DNA Sequence Number=SeqID_102497
MWAIRCLRPCEKSTERYVMFPQRICNGEHHCHHSLSYKHGGIFGTQEMGIIGLIPHLLNKRSLQLSVFNEKFLVSASHQLVLTMSLPFVHITRHSYRLNGPMKCLDCSDVGYSLLATLLEVH

SEQ ID NO: 219276 - protein, 99 aa, Glycine max
  Coding DNA Sequence Number=SeqID_102498
  Pfam annotation: Domain name=zf-CCHC; Domain location=13-30; Score =4.7; E_value=0.17; Accession=PF00098.13; Description=Zinc knuckle
  Pfam annotation: Domain name=zf-CCHC; Domain location=58-75; Score =6.1; E_value=0.098; Accession=PF00098.13; Description=Zinc knuckle
  Pfam module annotation: Pfam domain module=zf-CCHC::zf-CCHC; Domain location=13-30::58-75
MSNRKKDKDKSSIIYYECKKPGHFKYNLHKLLRYCRSSLDKSRNGYDGKVYVHDKDTILHYFCGKTGHTTSRCRDRPKKGTPPILDGSLLVELLWRLDL

SEQ ID NO: 219277 - protein, 156 aa, Glycine max
  Coding DNA Sequence Number=SeqID_102499
MLLSSFAFEHPRHHPHLPLLDFHSPAKPSSLRHPTLLHHLRPPPLPLSLPVELSKVIKTISIFNNNNKIFILISFTGCKLCKHAYPHVQLYSHPFSFWFLTPKPLCGRNLKAVWSGSLVAMLCCHVAITRRAGEDDDEGMGCGGSGKGVDEERKNK

SEQ ID NO: 219278 - protein, 542 aa, Glycine max
  Coding DNA Sequence Number=SeqID_102500
  Homolog annotation: Hit_ID=Q5ZFS5; Match level="QueryCoverage=47%, HitCoverage=82%, E-value=6e-50, Identity=47%"; Hit description=Nod factor-like protein
  Subcellular localization annotation: CTP_CleavageSite=88; ConfidenceScore=5.33e-01
MAYKFLQVTRFMSIYFSVGLTSRIFQVKSSPPVQLLHKSTMTQLLISGSLSDPSSHTTQHGLPGSNFQGPLPLYQPGGNIGSWGASPSAPNANGGRLGMPPMYWQGYYGAPNGLPQLHQQSLLQPPPGLSMPSSMQQPMQYPNITPSLPTVSSNLPELPSSLLPASASIPSITSASLPPSNLPPAPSALAPAPSALPPAPSALSPSSSALSPAPSATLASEILPVSVTNEAPIVSTSAAMLAANLPSLTISGPDINAIVPPISSKPHAISGSSLPYQTVSQFSPAVVGSSTSIHSETSAPSLVIPGRLLQPGPSIVSSAQPSQAPHKDVEVVQVSSTSSSEPSVPVLAETQPPILPLPVTSRPSYRPGGAPIQTHHGYNYRGRGRGRGTGGLRPVTKFTEDFDFMAMNEKFKKDEVWGHLGKSKSHSKEKDGEENAFDEDYQDEDNDDVSNIEVKPLYNKDDFFDSLSSNMHGNASQNGRTRYSEQIKIDTETFGDFVRHHGGRRGRGPGRVGRTRGGYYGRLGGYGYNGRGRGRGMSSQNL

SEQ ID NO: 219279 - protein, 65 aa, Glycine max
  Coding DNA Sequence Number=SeqID_102501
  Subcellular localization annotation: CTP_CleavageSite=52; ConfidenceScore=5.15e-01
MISAIPAGKASATVTTLSAFYYKMKGQNNLCGRAGNTIHDAPSMTANHNATRYMERTAKQHTTTF

SEQ ID NO: 219280 - protein, 79 aa, Glycine max
  Coding DNA Sequence Number=SeqID_102502
MQGSQRNHEGRIGGFVLYRILELSFEDFALIKLFFFGLGEEKEEEDGCFTLLDVFEACNTCLGEFGLPGRADPTQIFLL

SEQ ID NO: 219281 - protein, 73 aa, Glycine max
  Coding DNA Sequence Number=SeqID_102503
MKEVAESLKEFVEVTKKKMENKKKMEIKEAQEVVHEVDIEQIDWLNRKNPIKFAIIKALPLDVKEDYILSFMP

SEQ ID NO: 219282 - protein, 131 aa, Glycine max
  Coding DNA Sequence Number=SeqID_102504
MGEVEEVQEQMKTDMEAMKEQTATMMEAMMSMKKIMEVNAAAIAATSTIAEICRSGRQKVGRYGRPSFSAKNKHAFPPYGLPPNYTPPNVAYTPNENVNNSTPILIESQQPQSDHAHVFRPIGETHEIPHC

SEQ ID NO: 219283 - protein, 100 aa, Glycine max
  Coding DNA Sequence Number=SeqID_102505
  Homolog annotation: Hit_ID=Q1T473; Match level="QueryCoverage=86%, HitCoverage=23%, E-value=7e-07, Identity=33%"; Hit description=Zinc finger, CCHC-type; Zinc finger, SWIM-type
MAYSKILFNKAIEGLRKYITGFPCKHACSCITYLRDNVENYSDKSFTTRIWMVSYSEIIHPMPDIDVNTRDDYPLIDLPPLKRMPSRPSSLGEKAMLRDR

SEQ ID NO: 219284 - protein, 306 aa, Glycine max
  Coding DNA Sequence Number=SeqID_102506
  Gene Ontology: Mol. function=DNA binding
  Homolog annotation: Hit_ID=Q1SDS1; Match level="QueryCoverage=70%, HitCoverage=40%, E-value=2e-25, Identity=35%"; Hit description=IMP dehydrogenase/GMP reductase
MAEVSTEAIASFAQYYDQTLRISKIVKISTHELDHGKQVENGVVRVQRKCLEAKARVLASQGEWAPLMDILALLIFGVVLFPNVDGLADRATIDAFLAFYDRKESLFVAILADLYDTFDRRCEMNNARIICCTPDLYVWLVSHFFHQEMRHVCLLEGHRSCTEKKEANWDRLLASKEGASINWFPRWKEGRTGILISCGKFPNVPLMGTRGCINYNPVLAIRQLGYPMRGAPSEEGLIPFITRGFNSTNAGVLQRVHKAWEMSQRKDKELRGSSNGPIGGYHRWLKAYAQVLDWLSSLRTTKGDGD

SEQ ID NO: 219285 - protein, 60 aa, Glycine max
  Coding DNA Sequence Number=SeqID_102507
MSTPRYQQKGKQGKGSQELPRLLAKAKAMADTYSAPEEIHGLLSYCQHMIDLMDHMIRNR

SEQ ID NO: 219286 - protein, 987 aa, Glycine max
  Coding DNA Sequence Number=SeqID_102508
  Gene Ontology: Mol. function=heat shock protein binding; Cellular component=integral to membrane; Biological process=protein folding
  Homolog annotation: Hit_ID=Q1SJE9; Match level="QueryCoverage=69%, HitCoverage=80%, E-value=1e-59, Identity=53%"; Hit description=Heat shock protein DnaJ, N-terminal
  Pfam annotation: Domain name=TolA; Domain location=570-920; Score= -114.3; E_value=0.0017; Accession=PF06519.2; Description=TolA protein
  Subcellular localization annotation: CTP_CleavageSite=82; ConfidenceScore=5.02e-01
EKRKEFKQGGSVLANSPIGQKEGGIKGVTRNPTLPLPSNSITASPHQSPAPSNTRSFPPIPTMNDFDGLFTSDFGLKPQGKSAPMAPQPKGSSNSASLNFDFGSRSARASSNFDDLLAGAGSDNRRSDSPFDLDSMYGGPPARSANSPPPPVYDKPVYDDDIFDGVPGLKSTSKVKFDDVFATTAESGGGAAAFDDLLGGFGKESKSLDGKRSEKDEKGVSDFDDLLAGFGHSRSSSGGSCQRELKFGVFWLFNLGTSMRNAKIDCVEPRNSGKFTASCKFYNFKLSSIVEKLSGFADMHTPDIGLSSEPTASASKTIPTAAEDPFKVFESASAPVDSSAGHFMNPLEEISKFSSSGSTKNDSSSTSNGKVYEDIDPFDGLGKSVPAFSSERNSRKGSSSPRLNTSTSWTGDKEPVDKISGRSPERHTQNKIPVENDQEFLHAPFHMPTYSSDSDKPVGQRSTSPPYNNVDFRQTNIQADMSPKYEDNLEASEDIWLTVSEIPLFTQPTTAPPPSRPPPPRPVHIPKSGTTSPASTNARKKTNEFSSFPGSTRFSQGPKSAPAAGRVSPSSQFDELDDFAMGRSRGNDNESANGLPDEELEMNSAAAAMKEAMDRAEAKFRHAKEVREREYSKAARSKEAVQMEKDERTVLEEQENQERFDRERQQKEKEGKEQRRLMKEREEKEREQQRLERERARQAVERATREARERAAAEARQRAERAAVEKANAEARGRAERAAVQRAQAEARERAAAEAKERAEKAAAEVKDRETRERATAARAEVEARVKAERAAVERAAAEARERAAAAARMNQQKNENDLESFFGMGARASSVPRPPRANSSDNVFESQFQSDVTRKSTSASTSMKKTSSSTNIVDDLSSIFGAAPTSGEFQEVEGETEERRRARLERHQRTKERAAKALAEKNQRDLQTQREQAERHPVSLTDLITAAAVKKAYRKATLCIHPDKVQQKGANLQQKYVAEKVFDLLK

SEQ ID NO: 219287 - protein, 384 aa, Glycine max
  Coding DNA Sequence Number=SeqID_102509
  Gene Ontology: Cellular component=integral to membrane; Biological process=peroxisome organization and biogenesis
  Homolog annotation: Hit_ID=Q8LFS8; Match level="QueryCoverage=99%, HitCoverage=79%, E-value=1e-167, Identity=75%"; Hit description =Amino acid transport protein AAP2
  Pfam annotation: Domain name=Aa_trans; Domain location=41-384; Score =301.6; E_value=1.4e-87; Accession=PF01490.8; Description =Transmembrane amino acid transporter protein
MPENAATTNLNHLQVFGIEDDVPSHSQNNSKCYDDDGRLKRTGNVWTASSHIITAVIGSGVLSLAWAIAQLGWIAGPTVMFLFSLVTFYTSSLLADCYRAGDPNSGKRNYTYMDAVRSILGGANVTLCGIFQYLNLLGIVIGYTIAASISMMAIKRSNCFHKSGGKNPCHMSSNVYMIIFGATEIFLSQIPDFDQLWWLSTVAAIMSFTYSIIGLSLGIAKVAETGTFKGGLTGISIGPVSETQKIWRTSQALGDIAFAYSYAVVLIEIQDTIKSPPSEAKTMKKATLISIAVTTTFYMLCGCMGYAAFGDAAPGNLLTGFGFYNPYWLIDIANAAIVIHLVGAYQVFSQPIFAFVEKEVTQRWPHIEREFKIPIPGFSPYKLK

SEQ ID NO: 219288 - protein, 58 aa, Glycine max
  Coding DNA Sequence Number=SeqID_102510
MTNILKAHILVVKHLIKHIKERIADTQNSASLNNQIHLTNEEHYANAYRWILKEFIRM

SEQ ID NO: 219289 - protein, 36 aa, Glycine max
  Coding DNA Sequence Number=SeqID_102511
MADKHVVLEPNWLVLSKKYIQRRDSYIDSLLNDKVD

SEQ ID NO: 219290 - protein, 97 aa, Glycine max
  Coding DNA Sequence Number=SeqID_102512
  Subcellular localization annotation: CTP_CleavageSite=31; ConfidenceScore=5.12e-01
MPAFIYSCTSSTHRPRFGSGAIGMPWGRLVMASFLKRPNKVITSQDLSDNINSLTTPNYMGHQVYHVLTIAEEPADLLGGEVGVCHSLAFASNRGSF

SEQ ID NO: 219291 - protein, 82 aa, Glycine max
  Coding DNA Sequence Number=SeqID_102513
  Gene Ontology: Mol. function=sequence-specific DNA binding; Cellular component=nucleus; Biological process=regulation of transcription
  Homolog annotation: Hit_ID=Q6IET0; Match level="QueryCoverage=44%, HitCoverage=6%, E-value=9e-14, Identity=83%"; Hit description=WRKY transcription factor 1
MGVNGESTDKRQRKATLVLEPTTVAAWELHAQFVSMFVDIHLHFLAIISLCFNYFLVTCIHYTHCIIAVRGGRILNSAEKNP

SEQ ID NO: 219292 - protein, 54 aa, Glycine max
  Coding DNA Sequence Number=SeqID_102514
MEQKELENLVLKGKNEKVKGVSTGEWMEAGQIEKRKKKKQEDSNLIDQRGSKKV

SEQ ID NO: 219293 - protein, 169 aa, Glycine max
  Coding DNA Sequence Number=SeqID_102515
  Homolog annotation: Hit_ID=Q00XB0; Match level="QueryCoverage=88%, HitCoverage=46%, E-value=4e-08, Identity=27%"; Hit description =Homology to unknown gene
PVQILKSTKADGWSAISDEEVESILPAAAYALAKIHMHLVYSGYCYTARGGFCYTEEDIFDFHTGKDFSACLFTKILYFMSDDGKGVDGLPTEGVEITSFDQEGARYMIYTPSDPLLFVAMKGENGMLYIADDDLLEDPAVIDAIDEETEFNALVEEEAALIEAMMHER

SEQ ID NO: 219294 - protein, 88 aa, Glycine max
  Coding DNA Sequence Number=SeqID_102516
  Subcellular localization annotation: CTP_CleavageSite=61; ConfidenceScore=5.19e-01
MTCPQPPSINQDASTRSCLIKKASPRCGKWPHVFLLSTLGIVVGTSFTLILTVSAIQTIFAAQLKKEQEQTQSQDIETALPSTSPPPS

SEQ ID NO: 219295 - protein, 47 aa, Glycine max
  Coding DNA Sequence Number=SeqID_102517
MATGIIGKREKVGPVEQRLVHMVSTRKRQSRYDNSQRFYQNREGAVT

SEQ ID NO: 219296 - protein, 89 aa, Glycine max
  Coding DNA Sequence Number=SeqID_102518
MSEAEKVYYRFNPIFMLAEPLMLAVTEQIQGFLILEGHIALWQFCVELRGLIAVIDILVCTIFPRQFDLVPFIQTNFEPFLLFKKHRIC

SEQ ID NO: 219297 - protein, 506 aa, Glycine max
  Coding DNA Sequence Number=SeqID_102519
  Gene Ontology: Mol. function=protein dimerization activity; Cellular component=nucleus; Biological process=regulation of transcription, DNA-dependent
  Homolog annotation: Hit_ID=Q1RW37; Match level="QueryCoverage=54%, HitCoverage=97%, E-value=1e-85, Identity=58%"; Hit description=Tumor- related protein, putative
MSVVPCNCNHTTEKDNLSGESESFHKFFECWISEQKQHLKDLLAAESTQLISDEELQALNDKVVEHYEYYYKAKSRCAKQDVLAMLSPTWMSSLEEAFLWIGGWRPSMAFHLIYSKSGLQFEARLDEVLQGLRTHDLGDLSASQLAQLDEMQRRTILEEREITDLMARHQETVADASMVELSHVVSEMIRANQRGEVDQSKEIENKVESTLVLKEEGLEKILLKADELRFITLKDVVDVLTPKQAIHFLIAAAELHLRLHEWGKKMDARKCNQGFGEESYQKEYEVLRERTASGDLGAAQVQANAGVDPDVVTAIRRQRLSEIALWFCPYNNSHNNNISSVDTVSQIVSDQPLNIVTEDAAPVQNHATKWAVKGTRILLATVFLHLLDQILVLLKEVAFILIQYSTSILYNDRLYGSYATAYLLLRCGKEKVMVLKFSRFLLSLDKPIRNPKGSSKYAIVERFHYTMQYAIEGMSSDSVFHVKMLAHPQIRLAEFSSSVARFGGSD

SEQ ID NO: 219298 - protein, 89 aa, Glycine max
  Coding DNA Sequence Number=SeqID_102520
MVRFLLEERLSEDRFGVNTSVPELMQDISGQCLPSILASLTLLQSKIGCILLWNFDAKMPNVCWNTNEAIKGNKRMKGLSYSFGQDQCQ

SEQ ID NO: 219299 - protein, 46 aa, Glycine max
  Coding DNA Sequence Number=SeqID_102521
MGITGRITWDSLGHGSAYEDLKRSEGSDSTGFGAVLSKWVEKHPMN

SEQ ID NO: 219300 - protein, 452 aa, Glycine max
  Coding DNA Sequence Number=SeqID_102522
  Gene Ontology: Mol. function=pepsin A activity; Cellular component =cellulose and pectin-containing cell wall; Biological process =proteolysis
  Homolog annotation: Hit_ID=Q1SJD1; Match level="QueryCoverage=82%, HitCoverage=89%, E-value=1e-151, Identity=67%"; Hit description =Peptidase aspartic, active site; Immunoglobulin/major histocompatibil ity complex
  Pfam annotation: Domain name=Asp; Domain location=70-439; Score= -89.0; E_value=2.4e-08; Accession=PF00026.14; Description=Eukaryotic aspartyl protease
MKMGKVVMVVAVMVLFNMFYCSAWSGGNKHKSGRNSILPGEAISSWPSLLNPAGSSIVFPLYGNVYPVGFYNVTLNIGQPARPYFLDVDTGSDLTWLQCDAPCTHCSEANHQCEVPNLERLKSSSLLMNTPHPLHRPSNDFVPCRDPLCASLQPTEDYNCEHPDQCDYEINYADQYSTYGVLLNDVYLLNSSNGVQLKVRMALGCGYDQVFSPSSYHPLDGLLGLGRGKASLISQLNSQGLVRNVIGHCLSSQGGGYIFFGNAYDSARVTWTPISSVDSKHYSAGPAELVFGGRKTGVGSLTAVFDTGSSYTYFNSHAYQALLSWLNKELSGKPLKVAPDDQTLSLCWHGKRPFTSLREVRKYFKPVALSFTNGGRVKAQFEIPPEAYLIISNLGNVCLGILNGFEVGLEELNLVGDISMQDKVMVFENEKQLIGWGPADCSRVPKSGDVSI

SEQ ID NO: 219301 - protein, 617 aa, Glycine max
  Coding DNA Sequence Number=SeqID_102523
  Gene Ontology: Mol. function=signal transducer activity; Cellular component=membrane; Biological process=response to light stimulus
  Homolog annotation: Hit_ID=Q1SGZ1; Match level="QueryCoverage=95%, HitCoverage=96%, E-value=1e-179, Identity=54%"; Hit description =BTB/POZ; NPH3
  Pfam annotation: Domain name=BTB; Domain location=16-133; Score=22.3; E_value=3.9e-05; Accession=PF00651.21; Description=BTBPOZ domain
  Pfam annotation: Domain name=NPH3; Domain location=208-475; Score =372.7; E_value=5.7e-109; Accession=PF03000.5; Description=NPH3 family
  Pfam module annotation: Pfam domain module=BTB::NPH3; Domain location= 16-133::208-475
MASMKLGSKSEMFYLYGQSWLCSTGLPSDVIIEIGDTSFHLHKFPLISRSKVLESMMKETSSEHEKSVLELHDLPGGAKAFFLVAKFCYGIKMELTASNVVGLRCAAEHLQMTENYGEGNLIMQTEHFLNHVFSYWTDTLKALKTCEEVLPFAEELHITSRSIHSLVLKVADQSLVSFPVSSSQSVSQSSEDAEVWNGISLTPKTSGEDWWFEDVSSLSLPLYKRFVQGASARQMKPKRIAESLVYYAKKHIPLLGSQATSQNGNSSSLKSTISTPSEADQRNLIEEIVELLPNEKGIAPTKFLLGCLRAAMALYASSSCCANLEKRIGAQLDEADLEDLLIPNIGYSMETLHDIDCVHRMLDHFMIVEHDVIDSTSNDIEEEGRIIGGSQPQSPMAKVANLIDSYLAEVAPDVNVKLPKFQSLAAVIPDYARTLDDGVYRAIDIYLKSHQWLTDSEKEQICRLMNCQKLSLEASTHAAQNERLPLRVVVQVLFFEQLKLRTSVAGWFFASDSVENSQNLSANLALIRNDGNTPPNPVLAFDNMKERVAELEKECLSMKQDLEKMIKSKGSWNMLLKKLGCKLVPKPSNLKVSKPCRKSKISPASTTPMEEKAMEVN

SEQ ID NO: 219302 - protein, 167 aa, Glycine max
  Coding DNA Sequence Number=SeqID_102524
  Homolog annotation: Hit_ID=O23274; Match level="QueryCoverage=69%, HitCoverage=7%, E-value=3e-35, Identity=60%"; Hit description =Kinesin like protein
MAIAILATQSFCDFTTSIASAVAMEGEKGKVTELRFEANVPILWSIMTTVQSKGAAMGTATTEKAFKRWGRRNPFVRYGLPMISLTVLGSIGLSQLLQGSKDIAKVKDDREWEIIETRKALSRTGPVNAYNPKKISLEDELMALQQKVDINNYEYKKIPKPKEGNRD

SEQ ID NO: 219303 - protein, 533 aa, Glycine max
  Coding DNA Sequence Number=SeqID_102525
  Gene Ontology: Mol. function=oxidoreductase activity; Cellular component=membrane; Biological process=electron transport
  Homolog annotation: Hit_ID=Q1RW32; Match level="QueryCoverage=99%, HitCoverage=95%, E-value=0.0, Identity=81%"; Hit description =Pyridine nucleotide-disulphide oxidoreductase, class I
  Pfam annotation: Domain name=Pyr_redox; Domain location=243-366; Score=8.1; E_value=0.0033; Accession=PF00070.17; Description =Pyridine nucleotide-disulphide oxidor
  Pfam annotation: Domain name=Pyr_redox_2; Domain location=70-416; Score=13.3; E_value=3.9e-05; Accession=PF07992.4; Description =Pyridine nucleotide-disulphide oxidor
  Pfam module annotation: Pfam domain module=Pyr_redox::Pyr_redox_2; Domain location=243-366::70-416
  Subcellular localization annotation: CTP_CleavageSite=52; ConfidenceScore=5.37e-01
GAKQWSALIPNFRRSRGIGSSVFSSSLRKRLQLRFFASGENGGNGGVLEEISEAEKEPTNFAWPDNKKPRVCILGGGFGGLYTALRLESLEWPDDKKPQIVLVDQSERFVFKPMLYELLSGEVDEWEIAPRFSDLLANTSVQFFKDRVKVLNPSDHWGMNGSKASSCGGTVHLESGLLIEYDWYNLHCLTRLVLALGAEAKLDVVPGAIEFAIPFSTLEDARKVNDKLTKLERKTFGTDFQISVAVVGCGYSGVELAATLAERLQNRGIVRAINVETMICPNAPPGNREVALKVLSSRKVELLLGYFVRCIRRLSDLESSDPLTGVDENSTEVVPDFEKYILELQPAERGMQSKIIEADLVLWTVGTKPPLPQLEPSDEPFVIPLNARGQAETDETLRVKGHPRIFALGDSSALRDSNGRILPATAQVAFQQADFTGWNLWAAINGRPLLPFRFQNLGEMMTLGRNDAAISPSFIDGLTLEGSIGHTARKIAYLIRLPTDEHRLKVGISWLTKSAIDSVSSLQSTLYKVLSGS

SEQ ID NO: 219304 - protein, 560 aa, Glycine max
  Coding DNA Sequence Number=SeqID_102526
  Gene Ontology: Mol. function=amidase activity; Cellular component =cytoplasm; Biological process=metabolic process
  Homolog annotation: Hit_ID=Q1RW31; Match level="QueryCoverage=99%, HitCoverage=91%, E-value=0.0, Identity=76%"; Hit description=Amidase
  Pfam annotation: Domain name=Amidase; Domain location=159-560; Score =198.6; E_value=1.5e-56; Accession=PF01425.11; Description=Amidase
MGLFRSKGVIYRPVKDVNLGPDSTEFYLQANVKAPRMTGILVKIFTWFLESPILGPLLLYILKGNNLIHKLITNADLEESPLYVPSHHFEGLLFSTRFFPSDHKEQEVKCLDSALTPEEQVQLAIECLPTSSEKAHNGTNSSFSRWTIMDYSRAYSSGEITPLMVAERFIAAVNESSKPPLRMGFFIHYSADDILRQANESTLRYKKGEPISVLDGVPVAIKDEMDCLPYPTTGGTKWLHRERPCTDDACCVKRLRLCGAILVGKTNMHELGVGISGINPHYGAARNPYDTNKISGGSSSGSATVVSAGLCPVALGVDGGGSVRVPASLCGVVGLKPTFGRVPHSGVLPLNWTVGMVGILAGTVEDALITYAAISGEISSHQPSNMLTKINLPLLPLTKSICDIKLAKYGKWFDDCSDDVILCCSRALRKLQDHYGWKTIDVTIPDIEAMRLAHYLTIGSECSTWFDSFGEKYFAEFGWDARVALNIYGAFSGKEYIKAQKLRNRQLQFHMKIFAEADVIVSPTTGVTAYSIQDDALKTGELDYVNGGNFLGLPAVTVPV

SEQ ID NO: 219305 - protein, 58 aa, Glycine max
  Coding DNA Sequence Number=SeqID_102527
MARTSLSSISIPFLILLIIAFTFFAQLAPVSADLQKRKFGPMSSPPPPPRLSPGPGSG

SEQ ID NO: 219306 - protein, 110 aa, Glycine max
  Coding DNA Sequence Number=SeqID_102528
  Homolog annotation: Hit_ID=Q8LLE5; Match level="QueryCoverage=80%, HitCoverage=19%, E-value=4e-11, Identity=43%"; Hit description =Coiled-coil protein
RAASRFAECQKTIASLGQQLKSLATLEDFLLDSDNPMESTCQVTKGHQNGGEHLKLHHSDLSLPKKDSESPISFNSPITNEKSSNGFAILDLFLLQFDNKTAGSSTPMFK

SEQ ID NO: 219307 - protein, 70 aa, Glycine max
  Coding DNA Sequence Number=SeqID_102529
  Homolog annotation: Hit_ID=Q1RW31; Match level="QueryCoverage=47%, HitCoverage=5%, E-value=1e-10, Identity=91%"; Hit description=Amidase
VGYDKLGLPIGLQFIGRPWAEATLIHLAFATQHVRRKYAQAVCHVFSSESIAMLWQVSVISFKSNSAVAG

SEQ ID NO: 219308 - protein, 550 aa, Glycine max
  Coding DNA Sequence Number=SeqID_102530
  Gene Ontology: Mol. function=exonuclease activity; Cellular component= chromosome; Biological process=response to DNA damage stimulus
  Homolog annotation: Hit_ID=Q53JH6; Match level="QueryCoverage=93%, HitCoverage=53%, E-value=2e-94, Identity=40%"; Hit description =Coiled-coil protein
  Pfam annotation: Domain name=DUF869; Domain location=53-549; Score =260.4; E_value=3.7e-75; Accession=PF05911.2; Description=Plant protein of unknown function (DUF869)
  Pfam annotation: Domain name=M; Domain location=137-157; Score=12.1; E_value=2.1; Accession=PF02370.7; Description=M protein repeat
  Pfam annotation: Domain name=M; Domain location=210-232; Score=0.8; E_ value=99; Accession=PF02370.7; Description=M protein repeat
  Pfam annotation: Domain name=M; Domain location=393-413; Score=2.2; E_ value=64; Accession=PF02370.7; Description=M protein repeat
  Pfam annotation: Domain name=M; Domain location=449-469; Score=1.9; E_ value=71; Accession=PF02370.7; Description=M protein repeat
  Pfam annotation: Domain name=Strep_SA_rep; Domain location=140-164; Score=9.2; E_value=3.3; Accession=PF06696.2; Description =Streptococcal surface antigen repeat
  Pfam annotation: Domain name=Strep_SA_rep; Domain location=375-399; Score=7.4; E_value=6.4; Accession=PF06696.2; Description =Streptococcal surface antigen repeat
  Pfam annotation: Domain name=Strep_SA_rep; Domain location=431-455; Score=8.4; E_value=4.3; Accession=PF06696.2; Description =Streptococcal surface antigen repeat
  Pfam module annotation: Pfam domain module=DUF869::M::M::M::M::Strep _SA_rep::Strep_SA_rep::Strep_SA_rep; Domain location=53-549::137 -157::210-232::393-413::449-469::140-164::375-399::431-455
MVYPTQAGFSPEVTSKAAPNEEVSTPKKSKEEDTDVKIITDKLATALLTISAKEDLVKQHSKVAEEAVSGWEKAENEVSSLKQKLDAERKKNSILEDRVGHLDGALKECMRQLRQAREVQEQKIVEAVVNSSRDWESKKSELERKVAELEAQLQTVKADAAASIRFDLHQRLEAVQKENSSLKHELQSRLEELEFRIVERDLRSQAAETASKQHLESVKKVAKLEAECRRLKAMTRKTFSVNDHRSVTASSVYAESFTDSMSDSGDRLLAVESDMRKLGGWEMNECELSRFDSCSSSLVMELDQFKNEKGNGKNHAVPSTEINLMDDFLEMERLAALPDGESGSSFVREGVASDQSNVGQATMKAEIEAMIQKDDELEKKLGKMEAEMEAMIQKNVELEKKLKKMEAGKVEVDMVLTKYQMQLETSESQTREAELKVAEFQTQLALAKKSNQEACEELKATKAKKAIVESTLKLTQTEVEELISQIRSLEEKIQKERALSAKNSIKWGKLEDELSKMKHKVLVQQDTEIKHRECVNLDLKVKTGQFANTY

SEQ ID NO: 219309 - protein, 535 aa, Glycine max
  Coding DNA Sequence Number=SeqID_102531
  Gene Ontology: Mol. function=structural constituent of ribosome; Cellular component=small ribosomal subunit; Biological process =metabolic process
  Homolog annotation: Hit_ID=Q1RW27; Match level="QueryCoverage=98%, HitCoverage=99%, E-value=0.0, Identity=81%"; Hit description =Octicosapeptide/Phox/Bem1p; CBS
  Pfam annotation: Domain name=CBS; Domain location=220-340; Score =76.1; E_value=1.1e-19; Accession=PF00571.18; Description=CBS domain
  Pfam annotation: Domain name=CBS; Domain location=52-170; Score=86.1; E_value=1.1e-22; Accession=PF00571.18; Description=CBS domain
  Pfam annotation: Domain name=PB1; Domain location=404-487; Score =45.1; E_value=2.3e-10; Accession=PF00564.15; Description=PB1 domain
  Pfam module annotation: Pfam domain module=CBS::CBS::PB1; Domain location=220-340::52-170::404-487
  Subcellular localization annotation: CTP_CleavageSite=34; ConfidenceScore=5.06e-01
MSGHITRRNSVPHKRPPSLSKKLENGSLSEPPSKASSPPPQEFDGGERTVKKLRLSKALTISEVTTVSEACRRMAARRVDAVLLTDSNVLLSGIMTDKDIATRVIAEGLRPEQTMVSKVMTRSPIFVTSDTLALEALQKMVQGKFRHLPVVENGEVIAILDITRCLYDAITRMEKAAEQGSAIAAAVEGVERHRGSNVSASALIEALRERMFKPSLSTLMGENTKVAIASPADPVYVAARKMRDLRVNSAVIVSLSGTKIQGILTSKDILMRVVAQNLSPELTLVEKVMTPNPDCASVDTTILDSLHMMHDGKFLHLPVVDKDGYVVACMDVLQITHAAISMVESSSGAVNDVANTIMQKFWDSAFNLEPPEDSDTHSEISGLMTSDGADTSKSAYQSVGFGNSFAFKFKDLSGRVHRFNCGTEHIDELVSTIMQRLDVNDVERPMILYEDDEGDKIVLATDSDLVSAVSYATSAGMKALKLHLDFGSSTKATTPKSCTATRQKTSALSMRSSIFASAIVITSIGMLVYLKRSKQ

SEQ ID NO: 219310 - protein, 224 aa, Glycine max
  Coding DNA Sequence Number=SeqID_102532
MDALNQFLGYPLVLEEGQEWEYGQRRNRADGFDKEAIAQLLCIPGQDFARTAAGRRVRIMHTNMTTLTQTWMTLLLSNILPSDHNSDLPLPKCMPPTRYTLDPNKSNRALGFPALITGLCQSFGVPVTPNRRRVATRRPQTHRHQPHQADPTGSFDTERYLRHLVRQQAANHRAHVQTYDCLYQLSLSLQSQGFTHFPCPTPDQFRAEVAWPGDWPEVQAGEAS

SEQ ID NO: 219311 - protein, 288 aa, Glycine max
  Coding DNA Sequence Number=SeqID_102533
  Homolog annotation: Hit_ID=Q473X1; Match level="QueryCoverage=28%, HitCoverage=40%, E-value=3e-23, Identity=59%"; Hit description =Probable transmembrane protein
MGVQALALAGGAHQALIEGDVGTQAGDFLIALGQRGLHLGVGGAADAVGGFQRGLLLAQFGQLRLQRLGTLLGSLQALALGVARRGHPAATQHGQYQAEQPDAADHQQAATVGRWLWCAGQADLHAHGRTVGHGWIPGHREGDTGTAPVANDALVYDRTGMPSSIVWSPAQFRRRSIAMTEAHLFVIGILLAWLAGIRVYLTVFGVGLAGLLGWVDLPPALQATESWWVLGTSAALAVAEFFADKIPGVDSAWDLVQTLARVPAGAFLAAATLSPDGQLGTGALAAGA

SEQ ID NO: 219312 - protein, 123 aa, Glycine max
  Coding DNA Sequence Number=SeqID_102534
MNLSIPFRIRTPELKRCTLTFDLVPHRRKVTKRDAIPGLRGRSVSIAKMVPTAAAKELGSLALGVEKGYPRRPVKLLDLSEPALIHREEGDDASLYGLRVNQRTSVAVAGVQVQLITTRTTAA

SEQ ID NO: 219313 - protein, 87 aa, Glycine max
  Coding DNA Sequence Number=SeqID_102535
  Gene Ontology: Mol. function=metal ion transporter activity; Cellular component=membrane; Biological process=metal ion transport
  Homolog annotation: Hit_ID=Q1RW15; Match level="QueryCoverage=77%, HitCoverage=18%, E-value=3e-17, Identity=58%"; Hit description=Mg2+ transporter protein, CorA-like
MTSGVKVRENGSTYRGGSLMNKTGVKVLKEAKKERVGGVDHENLGGSDDSFDVFQDGRRVRQHGIEDSTVTRRQPGSPRYGVLPNII

SEQ ID NO: 219314 - protein, 725 aa, Glycine max
  Coding DNA Sequence Number=SeqID_102536
  Gene Ontology: Cellular component=mitochondrion
  Homolog annotation: Hit_ID=Q1RW25; Match level="QueryCoverage=99%, HitCoverage=96%, E-value=0.0, Identity=74%"; Hit description =Streptomyces cyclase/dehydrase
  Pfam annotation: Domain name=Polyketide_cyc; Domain location=105-240; Score=72.5; E_value=1.4e-18; Accession=PF03364.10; Description =Streptomyces cyclasedehydrase
  Pfam annotation: Domain name=Polyketide_cyc; Domain location=348-479; Score=83.2; E_value=8.3e-22; Accession=PF03364.10; Description =Streptomyces cyclasedehydrase
  Pfam module annotation: Pfam domain module=Polyketide_cyc::Polyketide_ cyc; Domain location=105-240::348-479
  Subcellular localization annotation: CTP_CleavageSite=59; ConfidenceScore=5.78e-01
MITTCRTSSTTNLGGAQPLSLRFLSKPAPPFLSLSLFFPSHSTNNGIAVSSTQCKPRIRCDKEVGNGNSNGVEEEAKDEEGEREVQCEVQVVSWRERRVKAEISVNADIESVWNALTDYEHLADFIPNLVWSGKIPCPYPGRIWLEQRGFQRSMYWHIEARVVLDLQEFINSAWDRELHFSMVDGDFKKFEGKWSVKSGTRSSSTNLSYEVNVIPRFNFPAIFLERIIRSDLPVNLRALAYRVERNISGNQKLSLPENHLDKTSSDIYESSAQKINSALCENREYLVSSIPGTLPMPSSEVNINNWGAFGKTCRLDRPCVVDEIHLRRFDGLLENGGVHRCVFATITVKASVRDVWNVMSSYETLPEIVPNLAISKILSRDNNKVRILQEGCKGLLYMVLHARVVLDLCEYLEQEISFEQVEGDFDSFHGKWTFEQLGNHHTLLKYSVESKMRKDTFLSEAIMEEVIYEDLPSNLCAIRDYIENRTASNMFEACKQNTDLGQQTVPSGFEDDDSYCSAEDLFDCNAQSSSQQRPRVPGLQRDIEVLKSELLKFIAEHGQEGFMPMRKQLRLHGRVDIEKAINRMGGFRKIATIMNLSLAYKHRKPKGYWDNLENLHYEISRFQRSWGMDPSFMPSRRSFERAGRFDIARALEKWGGLRQVSRLLSLKVRRQRSRQDNLAKDKKVDDDVASPDVDSEIKTPSRPTVSQDPQNWLTELKQLDINWVE

SEQ ID NO: 219315 - protein, 66 aa, Glycine max
  Coding DNA Sequence Number=SeqID_102537
MAQTNLCSISVPFLILLMIAFNFSAQITPVSADLKMRKLGLMPSPPPPPQPGKPQHPRHPPRQDGP

SEQ ID NO: 219316 - protein, 100 aa, Glycine max
  Coding DNA Sequence Number=SeqID_102538
MGSGVSIVPAVGGDFVEEEDEECWLVTMGSGVSVVPDVGTGHENGVGMGSRVDIGASVGGDFIEEEDGKCWLVTGLNCSEFSNGDLKAVQVGCGRCSFCH

SEQ ID NO: 219317 - protein, 136 aa, Glycine max
  Coding DNA Sequence Number=SeqID_102539
MVAWSMELSEFGLKLEPNVPVKAQCLVDFITKHSPFPKPDNNDGGNWWMLYVDGSCNPRGNGARITLKVLGDISLEQSFRLSARLAPSSNSLTCAKCENDAKCNIEIRKPFLSLICTDLKGEPRNNRQSVKSVNIK

SEQ ID NO: 219318 - protein, 75 aa, Glycine max
  Coding DNA Sequence Number=SeqID_102540
MARTTLSSIFVPFLILLVIAITFFAELTPVSADLKMRKLGSHPSPPPPPLRAPSRHTRPPRPRHRHPPPHPPAIS

SEQ ID NO: 219319 - protein, 260 aa, Glycine max
  Coding DNA Sequence Number=SeqID_102541
  Gene Ontology: Mol. function=diacylglycerol kinase activity; Cellular component=integral to membrane; Biological process=intracellular signaling cascade
  Homolog annotation: Hit_ID=Q1RW07; Match level="QueryCoverage=97%, HitCoverage=36%, E-value=1e-124, Identity=81%"; Hit description =Diacylglycerol kinase accessory region; Diacylglycerol kinase, catalytic region; Protein ...
  Homolog annotation: Hit description=kinase C, phorbol ester/diacylglyc erol binding
  Pfam annotation: Domain name=C1_1; Domain location=44-105; Score =44.8; E_value=2.9e-10; Accession=PF00130.12; Description=Phorbol estersdiacylglycerol binding
TTASPRTPLHRCSVCGVAAHFLCSQFAAKDCKCVAQAGFGHIRHHWSERWVDVDENHEMSAFCFYCDEPCGVPFVKASPTWDCRWCQRLIHVKCHNKLTRDSGDFCDLGPLRRIILSPLCVKQVDEDKQGGRLSSIITSSVNGQIRKRRNRNKSLGGYNANGKSDGSSITDATLLEYVLNGLHWNKFGDEKLFDLVNNGRVLGNGLTATPNQIKKYTLVGLPQDASPLLVFINARSGGQLGPSLHRRLNMLLNPVQGMLF

SEQ ID NO: 219320 - protein, 38 aa, Glycine max
  Coding DNA Sequence Number=SeqID_102542
MPQPHGINMDLREHSNRVSLLPRPRLRRIRLGLTFLIQ

SEQ ID NO: 219321 - protein, 192 aa, Glycine max
  Coding DNA Sequence Number=SeqID_102543
  Gene Ontology: Mol. function=diacylglycerol kinase activity; Cellular component=integral to membrane; Biological process=intracellular signaling cascade
  Homolog annotation: Hit_ID=Q1RW07; Match level="QueryCoverage=98%, HitCoverage=27%, E-value=5e-97, Identity=89%"; Hit description =Diacylglycerol kinase accessory region; Diacylglycerol kinase, catalytic region; Protein ...
  Homolog annotation: Hit description=kinase C, phorbol ester/diacylglyc erol binding
  Pfam annotation: Domain name=DAGK_acc; Domain location=2-127; Score =92.5; E_value=1.3e-24; Accession=PF00609.10; Description =Diacylglycerol kinase accessory domain
MFLNKLRYAKEGARDIMDRTCADLPWQVWLEVDGRDIEIPKDSEGLIVLNIGSYMGGVDLWQNGYEHDDDFRLQSMHDKMLEVVCVCGAWHLGKLQVGLSQARRLAQGKAIKIHCSSPFPVQIDGEPFIIQPGYLEITHRGQAFMSRRTSEDEPKGRASAIMTEVLLDAECKGIINASQKKALLQEMAINLS

SEQ ID NO: 219322 - protein, 69 aa, Glycine max
  Coding DNA Sequence Number=SeqID_102544
LILEHLNGWLKSTLSVGVVLRWVGIEGNVGWLEAFHKGELEMFPCKGEVERNVVWLEVMEEEESTEISE

SEQ ID NO: 219323 - protein, 121 aa, Glycine max
  Coding DNA Sequence Number=SeqID_102545
MKDPENSRRKKILNHQLITNQEDQIPTQILKTNRFVKTESKGLNSPSQIVVAATKPSLLKRERKKEKEREREREREKKHLNSLTLCGCPEARKALEGEWKENEKKSTNGEGGGAVEFLVWR

SEQ ID NO: 219324 - protein, 251 aa, Glycine max
  Coding DNA Sequence Number=SeqID_102546
  Gene Ontology: Mol. function=protein serine/threonine kinase activity; Cellular component=integral to membrane; Biological process=protein amino acid phosphorylation
  Homolog annotation: Hit_ID=Q1SM08; Match level="QueryCoverage=93%, HitCoverage=43%, E-value=3e-89, Identity=70%"; Hit description =Protein kinase
  Pfam annotation: Domain name=LRRNT_2; Domain location=49-90; Score =18.9; E_value=0.0093; Accession=PF08263.3; Description=Leucine rich repeat N-terminal domain
  Pfam annotation: Domain name=LRR_1; Domain location=117-139; Score =15.1; E_value=0.26; Accession=PF00560.23; Description=Leucine Rich Repeat
  Pfam annotation: Domain name=LRR_1; Domain location=141-163; Score =14.4; E_value=0.42; Accession=PF00560.23; Description=Leucine Rich Repeat
  Pfam annotation: Domain name=LRR_1; Domain location=165-197; Score =12.0; E_value=1.6; Accession=PF00560.23; Description=Leucine Rich Repeat
  Pfam module annotation: Pfam domain module=LRRNT_2::LRR_1::LRR_1::LRR_ 1; Domain location=49-90::117-139::141-163::165-197
MLLIKLFLLVIFSPWKLLKRDSNRGPLKILTRWLIFLTILQVGCAIKDPDVEGEALLDVLHFLNDSNKQITDWDSFLVSPCFSWSHVTCRNGHVISLALASVGFSGTLSPSITKLKYLSSLELQNNNLSGPLPDYISNLTELQYLNLADNSFNGSIPANWGELPNLKHLDLSSNGLTGTFQIRTSSVALALSSLALLNLKIQLQPTNQNWQKLYVMQVVVHLHFCVLGLSLRIDTIESTGEKVMMSLLMFQ

SEQ ID NO: 219325 - protein, 142 aa, Glycine max
  Coding DNA Sequence Number=SeqID_102547
  Homolog annotation: Hit_ID=Q9MAX8; Match level="QueryCoverage=42%, HitCoverage=21%, E-value=4e-26, Identity=93%"; Hit description =Epsilon1-COP
MDLGDDELKLAEGDVAAVDEGVALEGVFLGEVGDVAAVDGGLVRPEIQVVAEVEQVVRCSHYYLFSDSDLENCTIRKHTQIQWKKERERERTQNRTLIVSRWNPNPKKTYLPLTSFPHTSISPPPSLPTKSPTFVAFFSLSN

SEQ ID NO: 219326 - protein, 485 aa, Glycine max
  Coding DNA Sequence Number=SeqID_102548
  Gene Ontology: Mol. function=ammonium transporter activity; Cellular component=membrane; Biological process=transport
  Homolog annotation: Hit_ID=Q1SM09; Match level="QueryCoverage=100%, HitCoverage=99%, E-value=0.0, Identity=85%"; Hit description=Blood group Rhesus C/E and D polypeptide; Rh-like protein/ammonium transporter
  Pfam annotation: Domain name=Ammonium_transp; Domain location=31-456; Score=256.2; E_value=6.7e-74; Accession=PF00909.11; Description =Ammonium Transporter Family
MATPPVNSLPIAYQAWTSLGVPDWLNKGDNAWQMVSATLVGIQSMPGLVILYGSIVKKKWAVNSAFMALYAFAAVIICWVAWAYKMSFGEELLPFWGKAGPALGQRFLIKQAGLPATPHYFRNGGGLETAEITPFYPMGTMVWFQCVFAAIAVVILAGSVLARMNFKAWMMFVPLWLTFSYTIGAFSLWGGGFLFHWGVMDYSGGYVIHLSSGIAGFTAAYWVGPRSKKDRERFPPNNVLLTLAGAGLLWMGWAGFNGGDPYAANTDSSMAVLNTNICAATSLLVWTWLDVIFFKKPSVIGAVQGMITGLVCITPGAGLVQGWAAIVMGVLSGSVPWFSMMVLGKKLKLFQMVDDTLAVFHTHAVAGLLGGILTGLFAEPRLCALFLPVTNSKGGVYGGPGGVQILKQIVGALFIIGWNLVVTSIICVVISFIVPLRMTEEELLIGDDAVHGEEAYALWGDGEKLSIYKDDTTHHGVVSSGATQV

SEQ ID NO: 219327 - protein, 125 aa, Glycine max
  Coding DNA Sequence Number=SeqID_102549
  Gene Ontology: Mol. function=RNA-directed DNA polymerase activity; Cellular component=chromatin; Biological process=RNA-dependent DNA replication
MALLQKDNFHWHVEAQSTFDKLKQAITHAPILALPDFNARFTLETDASSVAMGVVLMQHGHPLTFFSQAFCPRLQRASTYVRELHAITTIVPKWRQYLLGHKFTILTDHKSLRELMNQVIQTSEQ

SEQ ID NO: 219328 - protein, 207 aa, Glycine max
  Coding DNA Sequence Number=SeqID_102550
  Gene Ontology: Mol. function=protein binding; Cellular component =integral to membrane
  Homolog annotation: Hit_ID=Q5N731; Match level="QueryCoverage=95%, HitCoverage=58%, E-value=2e-78, Identity=67%"; Hit description =Putative NTS2 protein
  Pfam annotation: Domain name=DUF803; Domain location=2-205; Score =232.4; E_value=9.9e-67; Accession=PF05653.4; Description=Protein of unknown function (DUF803)
ELRIAMDMGSAVLAHFLLKEKLQKMGMLGCLLCIVGSTVIVLHAPEEKSLSSVQEIWELAIQPAFLSYTASAIAVTLFLVLYCAPRHGQTNILVYTGICSIVGSLTVMSVKAVGIAIKLTLEGANQAFHFQAWVFAMALDNFNTAVVSPIYYALFTSFTILASAIMFKDYSGQSISSIASELCGFITILSGTTILHSTREPDPPVVA

SEQ ID NO: 219329 - protein, 287 aa, Glycine max
  Coding DNA Sequence Number=SeqID_102551
  Gene Ontology: Mol. function=chromatin binding; Cellular component =chromatin; Biological process=chromatin assembly or disassembly
MGSDVRNFVWQCLTCQQIKYEPKRPAGLLQPLPIPASPWKDLSLDFITCLPSSQGYTTILVVMDRFTKGAHFGALPSTYTASKVASLFINMVCKLHGFPRSLVLDRDPVFVGRFWCELFTIHLPSLLTYRSLPIKVVDHLLTARQDLSASLQARFRKAQQTMKTQADSKCRDISYNVKDLVYVKLRPYRQTSLAGSTFHKLSKRYYGPFQITELIGTVAYRLALPPSSKIHNVFHCSILKPHHGPLPNTIDPLPPRASDNHPLIEPMVILTMKWDTTQVPPSLLVLV

SEQ ID NO: 219330 - protein, 138 aa, Glycine max
  Coding DNA Sequence Number=SeqID_102552
MPRIHDAILYYNGKWNMPPQNKFVGCAFTGKNPKKFQIPSTCTIDELKNLIKQVAPKGIPPLGIHESQTVRRLFFRQPARFEYSDTVIKYEINELITNEELLKVLVQSNYWKKYGPIEILAVFTKYVEDEVSGTSLKN

SEQ ID NO: 219331 - protein, 226 aa, Glycine max
  Coding DNA Sequence Number=SeqID_102553
  Homolog annotation: Hit_ID=Q1S1U2; Match level="QueryCoverage=77%, HitCoverage=24%, E-value=5e-60, Identity=66%"; Hit description =Membrane attack complex component/perforin/complement C9
MDPNVKLLPGQGEPMEDLGRYRQLVGTLNYLIVTIPDITFAVNVVMKDNALNFMDIQTRSYYESEAQDIKFMCRRKGGNGKRSLSHSEWCQTVLSQPDVISMSFVPITSLLGGINGSGYLTHAMNLYLRLVEHFYRRFDVIREQEFDIIRGGNFSIREQTLNGDKPQIEELHQFLEFQLPRQWAPVFGELALGPERKPQNAASLQFSFMGPKLYVNTTPVMLLVLC

SEQ ID NO: 219332 - protein, 1168 aa, Glycine max
  Coding DNA Sequence Number=SeqID_102554
  Gene Ontology: Mol. function=ATP-dependent helicase activity; Cellular component=nucleus; Biological process=mRNA catabolic process, nonsense-mediated decay
  Homolog annotation: Hit_ID=Q9SQV1; Match level="QueryCoverage=74%, HitCoverage=75%, E-value=1e-172, Identity=51%"; Hit description =Probable DEAD-box ATP-dependent RNA helicase 40
  Pfam annotation: Domain name=DEAD; Domain location=548-700; Score =118.3; E_value=2.2e-32; Accession=PF00270.19; Description=DEADDEAH box helicase
  Pfam annotation: Domain name=DUF1777; Domain location=1013-1146; Score=-56.5; E_value=0.00024; Accession=PF08648.2; Description =Protein of unknown function (DUF1777)
  Pfam annotation: Domain name=Helicase_C; Domain location=750-826; Score=124.5; E_value=2.9e-34; Accession=PF00271.21; Description =Helicase conserved C-terminal domain
  Pfam annotation: Domain name=WW; Domain location=22-52; Score=42.0; E_ value=2.1e-09; Accession=PF00397.16; Description=WW domain
  Pfam module annotation: Pfam domain module=DEAD::DUF1777::Helicase _C::WW; Domain location=548-700::1013-1146::750-826::22-52
MATAEAASTGLGPRYAPDDPTLPQPWKGLIDGSTGLLYYWNPETNVTQYEKPTPPVPAPVASAPSLAPIPAAHTMQPGGMMQQHGQQMLQVQSSQQHLAQQHGQSMLPQQQQQQQSPHIAHVTQQQSSQGAQAAQQQNHHGQQMMQQPQGHQARQPMMQPQGQQMHHQMPPQAIHSQHFGQGMPQDQGSHIVQPQAHQFTSQNMHYMSYQQNVITSRQPNSQHIQPNMVSPGQPNSQQVQHNMHGQPFENQQTTYPKVEVAEFKNGSQVGHSLSHYPQRSALPVQNNQNNPAEVGSGQVPNVGVNAGQPQQFRALSGSMQQSPSGSDLYYQHGPNFHSQMSPGMMHGHPSNVHPAGQKMGHEDNLHGRAGNEYDYNSTKDMSTMGCQQPDITPIPIPRNQQDMRIGNAPFQNVMPSGNGSGIAGNAVPSMFVPPIGGPSPLSTNPSMRPPYMGSSDATDLSPAEIYCQQHEVTATGDNIPPPFMTFDATGFPPEILREVSAISAPEQEHMSYAALLTCYWHNYTCNYYPDFWSLQKGWIYSAGFSSPTPIQAQTWPVALQGRDIVAIAKTGSGKTLGYLMPAFILLRQRRNNSLNGPTVLVLAPTRELATQIQDEVIKFGRSSRVSCTCLYGGAPKALQLKELDRGADIVVATPGRLNDILEMKKIDLGKFHSLCLMRLTECLTWVLSLKFVNIGNVDELAANKAITQYVEVVPQMEKQRRLEQILRSQERGSKVIIFCSTKRLCDQLARSIGRTFGAAAIHGDKSQGERDWVLGQFRTGKSPILVATDVAARGLDIKDIRVVINYDFPTGIEDYVHRIGRTGRAGATGVSYTFFSEQDWKHAGDLIKVLEGANQHVLPELRQMALRGPSNFGKDRGGMSRFDSGGGGGGRWDTGGRGGFGGRGGGMRDGSFGGRGSGFGGRGGGIRDGGFGGRGGGFGGRGGMRDGGSGQGGRGDFFPGRGNRGRGSGGPRGGHVGWGRGERGMDDRYNMEGRGQGRGRGRFDNRRDVSSKGRGRSHSRSPERVRTWDYSKSSSRSRSRSRSRSWSRGRSRSRSWSRGRSRSYSRSISPRRSRSRSRGRSYSRSRSRSPSYDRRDRSDQQLPDQKDIRAHEVGTSDPRMLPVSSGLGTQGNSFLGTEQVEQQPIVSSTDPGNPEAVADLSHQSVSDI

SEQ ID NO: 219333 - protein, 330 aa, Glycine max
  Coding DNA Sequence Number=SeqID_102555
  Gene Ontology: Mol. function=binding; Cellular component=integral to membrane; Biological process=transport
  Homolog annotation: Hit_ID=Q5ZDR4; Match level="QueryCoverage=93%, HitCoverage=95%, E-value=1e-125, Identity=71%"; Hit description =Putative mitochondrial carrier protein
  Pfam annotation: Domain name=Mito_carr; Domain location=122-214; Score=64.1; E_value=4.4e-16; Accession=PF00153.17; Description =Mitochondrial carrier protein
  Pfam annotation: Domain name=Mito_carr; Domain location=229-315; Score=77.0; E_value=6.1e-20; Accession=PF00153.17; Description =Mitochondrial carrier protein
  Pfam annotation: Domain name=Mito_carr; Domain location=26-111; Score= 41.4; E_value=3e-09; Accession=PF00153.17; Description=Mitochondrial carrier protein
  Pfam module annotation: Pfam domain module=Mito_carr::Mito_carr::Mito_ carr; Domain location=122-214::229-315::26-111
MEAAEPATAPQLALADTDINWDRLDKTKFHMIGAILFTVQSALLHPTAVVKTRMQVAAGSRGMSVFSHILRSDGIPGIFRGFGTSAVGSVPGRILALTSLEVSKDIILKHTQGTHIPEASRVGLANGVAGLVSNLVSCVYFVPLDVICQRLMVQGLPGTTFCRGPLDVVRKVVEAEGFRGLYRGFGLTALTQSPASALWWGSYAAAQHLIWRSLGYKDDTGNKPSHMEMVTVQATAGMVAGACSSVITTPIDTVKTRLQVMDNYGSGRPSVLKTAKTLLKEDGWWGFYRGFGPRFLNMSLYGTTMIVTYELISMSPIAYLFWHQYFFENG

SEQ ID NO: 219334 - protein, 529 aa, Glycine max
  Coding DNA Sequence Number=SeqID_102556
  Homolog annotation: Hit_ID=Q9LUT8; Match level="QueryCoverage=86%, HitCoverage=36%, E-value=1e-101, Identity=42%"; Hit description =Arabidopsis thaliana genomic DNA, chromosome 3, P1 clone: MGD8
  Pfam annotation: Domain name=YTH; Domain location=331-412; Score =172.1; E_value=1.4e-48; Accession=PF04146.6; Description=YT521-B -like family
MINEGAPEYFCYQNVYYPAATNYGYYCTGFETPGEWEDHHRIFGVDGPNIQFMGAQNESLPYVYYNYGYAQSPYNPYNPYIPGAMIGADGSLGGGQHYYTLPNYQSPVSAPGYIPSVQPDNFSDSSADSFFGASASVSKPDGRGLRHKFNSASGNFPRNSSNFLSNQTSSLARVSERPRAYDGSRFLNLALPAVHRDRNSAAKLRPKLHNGKVVPNGGNGSSDVLGEQNQGPRVSRSKHQLSVKAYTTMAGDANEQGNIVIYPDQYNKEDFSLDYENAKFFVIKSYSEDDVHKSIKYNVWSSTPHGNKLENAYEDAKKIAAEKSEVCPIFLFFSVNASGQFCGVAEMVGTVDFNKNMDFWQQDKWSGSFPLKWHIIKDVPNPNFRHITLENNENKPVTNSRDTQEIMYWKDNYEKNLKPKDDSDGFKQISVSSPDQIVSNSDVTGIKHVDDEKAEKIAVDKEDISSILKIGSVTIAPKQVEAKHSVSNGNKEQGDALTEGSMQVGSIPLDAMALQPGKGVLSVKSESHR

SEQ ID NO: 219335 - protein, 731 aa, Glycine max
  Coding DNA Sequence Number=SeqID_102557
  Homolog annotation: Hit_ID=Q1S1T5; Match level="QueryCoverage=99%, HitCoverage=87%, E-value=0.0, Identity=54%"; Hit description =Calponin-like actin-binding
MICKILGLTGVDLFSPSDVVERRNTRKVCMCIRSFSKKSRSMNINVPDFDIVTCMVAMPKDLVGCRRRSIELSHSILADSSGSYYLQKHERRKSRQGYPITDSTKDYETYSDQSGNTENKPLVLQFDDLHTDDLYDYSSDINNSIASPMVEHVYLPEELDQLDIQNQRRNEIFNDDFELLCSMESLQYHCSEDIEHDCELTWSSSPTSGDLHADLIDMTSHLDTGMEQVQESRSIMDFDYFEHVSLSSNASVIVTPKNDKTPGKRDASLLTKDRKDTDLFNEENSTPNVYQSASSHGSNPTPQTAENGKLFEIGDDNEALLVACMNCYSREVLNLGDQVDAQNNFKNIESFKVHSDKNGQWDKIKEEHESQGIVKCKDMLYQIISSAGYSYSVKKFEETETLLYSPGCYFCNTNSLDGIVPHSNEASSTSLKMFLAYEERDSQLDLDNASCYQSQESLSCQSYDLPESCKWDQKGKCAITSYKDEKSSHILEDGSREEITPCKQKASEVLMSTVVKLDTDGKELSIDSLALASNALAADDCEKCSTLGDDPNDFFKGDTTEDNEEQGQRVLDMLTNGVVVPANCDDDIPSPESCINSKLELNGDHQACQYEKDPVYRSEHTRVVHLKKEIKPEDERVHIFENLAGTEEEGKEIPKAKPQKRLLLRSVLGGAAAVGLLFMIMHLRRNGGEKAPQPSMASSHKGKEKIQKKSTRKVKRSTTKGVYPAERIKLK

SEQ ID NO: 219336 - protein, 228 aa, Glycine max
  Coding DNA Sequence Number=SeqID_102558
  Gene Ontology: Mol. function=inorganic anion exchanger activity; Cellular component=integral to membrane; Biological process=anion transport
  Homolog annotation: Hit_ID=Q8VYR7; Match level="QueryCoverage=99%, HitCoverage=32%, E-value=1e-104, Identity=81%"; Hit description =Boron transporter 1
  Pfam annotation: Domain name=HCO3_cotransp; Domain location=1-228; Score=-362.7; E_value=0.011; Accession=PF00955.11; Description=HCO3- transporter family
MEETFVPFRGIKNDLQGRLMCYKQDWIGGLTAGFRILAPTTYIFFASAIPVISFGEQLERDTDGVLTAVQTLASTALCGIIHSIIGGQPLLILGVAEPTVIMYTFMFNFAKSRPELGSKLFLAWTGWVCMWTAILLFLLAILGACSIINRFTRLAGELFGLLIAMLFMQEAVRGLIHEFHIPERANLTSPEFQSSWRFGNGMFSLVLSFGLLHTALRSRKARSWRYGS

SEQ ID NO: 219337 - protein, 398 aa, Glycine max
  Coding DNA Sequence Number=SeqID_102559
  Gene Ontology: Mol. function=inorganic anion exchanger activity; Cellular component=integral to membrane; Biological process=anion transport
  Homolog annotation: Hit_ID=Q7X9F3; Match level="QueryCoverage=100%, HitCoverage=56%, E-value=0.0, Identity=80%"; Hit description=Boron transporter
MVLLWTAVSYIPAGSIPKGIPRRLFSPNPWSSGAFENWTDMLNVPVLYIIGAFIPATMIAVLYYFDHSVASQLAQQKEFNLRKPPSFHYDLLLLGFMVIICGLIGIPPSNGVIPQSPMHTKSLATLKHQLLRNRLVATARSSMKKLESLGQVYGGMQDAYWKMQTPLVHQEPSSQGLKELKESTIQLASSMGSINAPVDESVFDIEKEIDDLLPVEVKEQRVSNLLQSLMVGGCVAAMPFLKKIPTSVLWGYFAFMAIENLPGNQFWERILLIFTAPSRRYKVLEECHATYVETVPFKTIAVFTAFQTAYLLVCFGITWVPTAGVLFPLMIMLLVPVRQYILPKFFKGAHLQDLDAAEYEEVPALPFNLVTEGDLSRTASFADDGEVLDGIITRSRGE

SEQ ID NO: 219338 - protein, 145 aa, Glycine max
  Coding DNA Sequence Number=SeqID_102560
MSEIEKVQEQMKADMEAMKEQMTPMMEAMMSMRRMMEVNTTTVVATSTKSGPDSPTWLYSSGPHFVQAQNKHSFPPYGLPPNYTPPNVAYIPNENVDNSTPMPIESQQPQFDHAHVSQPMGETHEVPRHTVADFEPHLKYATEGQ

SEQ ID NO: 219339 - protein, 115 aa, Glycine max
  Coding DNA Sequence Number=SeqID_102561
  Gene Ontology: Mol. function=oxidoreductase activity, acting on the CH-NH group of donors, NAD or NADP as acceptor; Biological process =putrescine catabolic process
  Homolog annotation: Hit_ID=Q5PHV8; Match level="QueryCoverage=93%, HitCoverage=22%, E-value=1e-19, Identity=41%"; Hit description =Putative aldehyde dehydrogenase
MADVQVLSGLSCQQFINGQLIDGEGQQECIVNPANGETLIVLTEASSAQVGSAVKAAQQAFGHWSRTTPAQRAALLLRIADAIERQAPQLAQLEALNCGKPLHQALNDDLPAAVD

SEQ ID NO: 219340 - protein, 106 aa, Glycine max
  Coding DNA Sequence Number=SeqID_102562
  Gene Ontology: Mol. function=transcription factor activity; Biological process=regulation of transcription, DNA-dependent
  Homolog annotation: Hit_ID=Q3KHG3; Match level="QueryCoverage=86%, HitCoverage=30%, E-value=3e-32, Identity=70%"; Hit description =Transcriptional Regulator, LysR family
MDVHARRIWARAGLKPEIAMKTASTEAVRSLVAAGMGVSIQPDMAYRAWSLEGNMIEARKLDDLLEPLDIGLAWRRGSARPELVTPFLTIARENGSKHAAGLKHSI

SEQ ID NO: 219341 - protein, 221 aa, Glycine max
  Coding DNA Sequence Number=SeqID_102563
MEILRQGKVDFHNENWKGTTSTKGMPIVTNIEKVKSRHVWDSRGSREGQCTTGATCGMMNHGKGCRGVHGGEKKLGPWEDPFVVVTMLFRLIQLHLWRSSPHDGDKLGVYKSTCEHNKGDAVVIVDFFLPSCCAMVAKPIGWCVYIVVCNQVPMDLVHRERHNGIKGIDARMDGKTSMTGCDGGSVDMKVANGGDLLGSVTVVVTVGATSMVVVDSEGRVT

SEQ ID NO: 219342 - protein, 76 aa, Glycine max
  Coding DNA Sequence Number=SeqID_102564
MALKKLSAKRSRRDATTKGTSAAPEFDSHRFRSAEHQQRFKAIKGWSFHKERRVQLRDDEYTDFQEEIAHRHWTSL

SEQ ID NO: 219343 - protein, 494 aa, Glycine max
  Coding DNA Sequence Number=SeqID_102565
  Homolog annotation: Hit_ID=Q9FNM6; Match level="QueryCoverage=95%, HitCoverage=66%, E-value=1e-120, Identity=47%"; Hit description =Arabidopsis thaliana genomic DNA, chromosome 5, P1 clone:MAH20
  Pfam annotation: Domain name=DDT; Domain location=276-336; Score =45.0; E_value=2.6e-10; Accession=PF02791.7; Description=DDT domain
MRDNGSLTRSSDYLKRLNLYRQRVWMCKVTGKTGLTYEEALVSEQLATEKVQQFPKELMTIALRIIQYSMLPLKDLADSIGEKLQEQLFVGAELHWKKDDGVHPCKILKVIQKGVDTVSYEVAWLDKNKNIREQAEVSAEDLVHKKPLFSRNILKSFIRESTYRNAPWVLHDELAKNHGISTDIPEELRGRVFYKDGLLVCSKKRKHEESREDTDTCKKKLDGAQVDDSVQEKENGQPKDAAIKYPIDDLLVIPSPDDPVFTDRPSPAKSFNIPMSCVGELLMVWDFLSSFGRLLQLSPYSLEDFEIAICHKDSNVALVVESHAALFRLLIKDDDEYSLAVKNRKLKSKITTNNWTEYLCHFLEMINIPELWQHKTTIKRGHYGLVDASAKLRILGELVNRALETAIFRGKLDEIIEQRQALGATRRGEALENGRRRREEKERLKAESESNGFVDGYHLNGENVLANNSIQNGDVGEKRIIEIEPSGQNDPLGR

SEQ ID NO: 219344 - protein, 91 aa, Glycine max
  Coding DNA Sequence Number=SeqID_102566
MITSFSSEGNDEEDHHEHWNGSMSRSQSKHPNQQASPLPTKLPAGAHIPSCAWAEEGGSEYPRHMPGADHKQPNHKVDQFSRFPNLPLNPR

SEQ ID NO: 219345 - protein, 408 aa, Glycine max
  Coding DNA Sequence Number=SeqID_102567
  Gene Ontology: Mol. function=kinase activity; Cellular component =intracellular; Biological process=intracellular protein transport
  Homolog annotation: Hit_ID=Q1S1S0; Match level="QueryCoverage=92%, HitCoverage=93%, E-value=1e-127, Identity=65%"; Hit description=GAT; ENTH/VHS
  Pfam annotation: Domain name=GAT; Domain location=184-279; Score =19.4; E_value=2e-05; Accession=PF03127.5; Description=GAT domain
  Pfam annotation: Domain name=VHS; Domain location=2-133; Score=40.3; E_value=6.6e-09; Accession=PF00790.9; Description=VHS domain
  Pfam module annotation: Pfam domain module=GAT::VHS; Domain location =184-279::2-133
MAALVNAATSEKLAETDWMKNIEICELVAHDQRQARDVVKAIKKRLGNKNPNIQLYAVALLEMLMNNIGDRVHQQVIDTGIIPILVKIVKKKSDLPVRERIFLLLDATQTSLGGASGKFPQYYNAYYDLVVIWYGYGGQSAGVQFPQRDQVTQSNRPRSQLNGINNVPNREQVPPRHQQAESQTVPESSIIQKASNALEVLKEVLDAIDAQHPQAARDEFTLDLVEQSSFQKQRVMHLVMASRDERIVSRAIELNEQLQKVLARHDSLLSGRPTTIANHLECEEAEDEEEEPEQLFRRLRKGKACARPEDEEREPEFPHLCFLEERLNRPLIRPLSLEPSREANTYSAPAVIPPHMAIPPPPSKHIERERYFQENKKDGATLAGHLRGLSLHSHNGSSSHSGSFDFSD

SEQ ID NO: 219346 - protein, 68 aa, Glycine max
  Coding DNA Sequence Number=SeqID_102568
MVPFEILGRKRDGGVELQSCVGRPLWSCVRQIKSNPLSVFFGLRWFSMMRLWRLSKESLLATTTTKLL

SEQ ID NO: 219347 - protein, 145 aa, Glycine max
  Coding DNA Sequence Number=SeqID_102569
  Gene Ontology: Mol. function=nucleic acid binding; Biological process= DNA integration
MDEANSISSPMVGGCKLTKSGYESFSDPTLYRSVVGALQYATITRTEISFLANKVYFKSSSFFGSNLASWWSKKQSVVARSSIEAEYRSLALATAEEKVIAKHLQVVHVPAVDQRAYILTKALTPNFTTYRSKLRVVEKHSANPS

SEQ ID NO: 219348 - protein, 487 aa, Glycine max
  Coding DNA Sequence Number=SeqID_102570
  Gene Ontology: Mol. function=ferrochelatase activity; Cellular component=chloroplast; Biological process=heme biosynthetic process
  Homolog annotation: Hit_ID=Q9FEK8; Match level="QueryCoverage=94%, HitCoverage=93%, E-value=0.0, Identity=68%"; Hit description =Ferrochelatase
  Pfam annotation: Domain name=Ferrochelatase; Domain location=81-372; Score=436.4; E_value=3.8e-128; Accession=PF00762.10; Description =Ferrochelatase
  Subcellular localization annotation: CTP_CleavageSite=16; ConfidenceScore=5.00e-01
LLPQAIRTSQKMYRCSGGHVEGSTNTNPLKNYVVGRSTSGWFETQPLVSEQLLNRRLLPVEALVTPTVQDFSDTPLIGDDKIGVLLLNLGGPETLEDVQPFLFNLFADPDIIRLPRLFSFLQKPLAQFVSVLRAPKSKEGYASIGGGSPLRRITDAQARHFPIIYFPYITTAEELRKSLWSKNVPAKVYVGMRYWHPFTEEAIEQHTVIPSWYQREGYIKAMTNLIEKELRGFDCPEEVMIFFSAHGVPLAYVEEAGDPYKAEMEECVDLIMEELEKRKITNAYTLAYQSRVGPVEWLKPYTDETIIELGEKGVKSLLAVPISEHIETLEEIDVEYKELALNSGIEKWGRVPALGTEPTFISDLADAVIESLPYVGAMAVSNLEARQSLVPLGSVEELLAAYDSQRRELPPPVIVWEWGWTKSAETWNGRAAMLAVLLLLFLEVTTGEGFLHQWGILPLFRQDCGGVRHGLKGAKNVESVCGYVLVH

SEQ ID NO: 219349 - protein, 51 aa, Glycine max
  Coding DNA Sequence Number=SeqID_102571
MAIKYAFGKTFEFIACAWDVGRLSEILCANFVHKIKVLKPPCSSNADDYLG

SEQ ID NO: 219350 - protein, 361 aa, Glycine max
  Coding DNA Sequence Number=SeqID_102572
  Gene Ontology: Mol. function=protein serine/threonine kinase activity; Cellular component=spindle pole body; Biological process =protein amino acid phosphorylation
  Homolog annotation: Hit_ID=Q43466; Match level="QueryCoverage=99%, HitCoverage=100%, E-value=1e-158, Identity=76%"; Hit description =Protein kinase 3
  Pfam annotation: Domain name=Pkinase; Domain location=4-270; Score =189.1; E_value=1e-53; Accession=PF00069.15; Description=Protein kinase domain
  Pfam annotation: Domain name=Pkinase_Tyr; Domain location=4-271; Score=-67.6; E_value=2.5e-08; Accession=PF07714.7; Description =Protein tyrosine kinase
  Pfam module annotation: Pfam domain module=Pkinase::Pkinase_Tyr; Domain location=4-270::4-271
MDKYEAVKDLGAGNFGVARLMRNKETKELVAMKYIERGQKVVLTPTHLAIVMEYAAGGELFERICNAGRFSEDEVDSLLLVFSALFHPLAFSVMPTVAISHLFFHLIVQARYFFQQLISGVHYCHAMQICHRDLKLENTLLDGSPAPRLKICDFGYSKSSLLHSRPKSTVGTPAYIAPEVLSRREYDGKLADVWSCGVTLYVMLVGAYPFEDQDDPRNFRKTIQRIMAVQYKIPDYVHISQDCRHLLSRIFVANPLRRISLKEIKNHPWFLKNLPRELTESAQAVYYQRGNPSFSVQSVEEIMKIVGEARDPPPVSRLVKGFGWEGKEDEGEEDVEEEEDEEDEYDKRVKEVHASGEFQIS

SEQ ID NO: 219351 - protein, 161 aa, Glycine max
  Coding DNA Sequence Number=SeqID_102573
  Subcellular localization annotation: CTP_CleavageSite=60; ConfidenceScore=5.42e-01
MENCIFHYHHHTLLTLPSISHKPHFRFFTRPDLGGGGGGVRVASSSSSCLLFHRRRPFIRASAGASPCEFSSLNSPLEPRSMVGKFLIGVLQNHPQMFHLAVGEELKLLAEDRDAAHARMVLGSASDEALLHRDPKNPDDAAKIAVVVSSRSLILYSECKE

SEQ ID NO: 219352 - protein, 97 aa, Glycine max
  Coding DNA Sequence Number=SeqID_102574
  Gene Ontology: Mol. function=transporter activity; Cellular component= integral to membrane; Biological process=transport
  Homolog annotation: Hit_ID=Q5TKJ2; Match level="QueryCoverage=79%, HitCoverage=13%, E-value=2e-22, Identity=61%"; Hit description =Putative cellular retinaldehyde-binding/triple function
  Pfam annotation: Domain name=EMP24_GP25L; Domain location=10-91; Score=57.9; E_value=3.3e-14; Accession=PF01105.14; Description =emp24gp25Lp24 family
MGKNIIEKKKEANCLLSWELRVIGWEVTYGAEFVPSSEGSYTVIVQKARKVASSEEPVLCNSFKVGEPGKVVLTIDNTSSKKKKLLYRLKTKPSPSD

SEQ ID NO: 219353 - protein, 167 aa, Glycine max
  Coding DNA Sequence Number=SeqID_102575
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=98%, HitCoverage=8%, E-value=5e-74, Identity=72%"; Hit description=RNase H, putative
MPGLDPRIVEHRLPLKPECPPVKQKLRRTHPDMALKIKEEVQKQIDAGFLVTSEYPPWLANIVPVPKRDGKVRMCVDYRDLNKASPKDDFPLPHIDVLVDSAAKSKVFSFMDGATYQRGMTTLFHDMMHKEIEVYVDDMIVKSGTEERTCRVLAEDVSTAEKVPTFD

SEQ ID NO: 219354 - protein, 202 aa, Glycine max
  Coding DNA Sequence Number=SeqID_102576
LNTFLETLVVLAKGESLPAYSRYCRMPTDIREIEDALCILGRGFVLNAEGHPGKILRKDLTTLAQVWSVLSYSNLAPTSHTSDLTLDRARGAASDSLVLENLSPVINLAYIRKNCWNPVDLIVTIRGARRAKARPIEAPSTSAAPPPAPPLDSIPSAEQFNEWVARPGTQPPLHREAESLTAQVPQQREDESSETSTPKPLI

SEQ ID NO: 219355 - protein, 513 aa, Glycine max
  Coding DNA Sequence Number=SeqID_102577
  Gene Ontology: Mol. function=RNA-directed DNA polymerase activity; Biological process=RNA-dependent DNA replication
MGIKSVRQATSLSSLDLVPKKGIMLKYVFKVKPLKNIAKNKAENVGKEDPLTTTPLMDVDPIYDNHTNEKGETPKDVEPTIVNNVTMENEDETRILDLGRPYDIVVVPNARGAGCKEFLSLTRDLKYKFRFQILIILEPRISGARAKKVGRKLGFPSSFCVEDDGFRISIFKSGDHFIHAKISQKHNALIWVLSIMYEALHQSDKDGMERLRMECVDMSLDKGYSGGQIKLRSHLWKEYQKILHKKDLFWYRRAWMVWLKFSDRNSRFFHISRTNRKRRNVIQHPTLDDGKVIHDLEEIKEAIQCYFSTMFEDDDTPTDWAWKRLFLSLMEDELNLIQSISMDHEIKAIIFSMGPLKLSGIDRLTTPTSCSSPRSIILLLSSTIGILVYAMSSIRQGRDNVILPKRFVTPCGVLRKRLGSPRSSKCRMMENESPSSSPLKVILDCLNTYASGVGTKVNCDKTKVFLTKGVNHSISSNIIRAGNFMMLPDLGKYLDIPLLHDRKRKSHYQHTIL

SEQ ID NO: 219356 - protein, 333 aa, Glycine max
  Coding DNA Sequence Number=SeqID_102578
  Gene Ontology: Mol. function=DNA binding; Cellular component=nucleus; Biological process=regulation of transcription, DNA-dependent
  Homolog annotation: Hit_ID=Q42467; Match level="QueryCoverage=97%, HitCoverage=99%, E-value=1e-82, Identity=50%"; Hit description=CY13 protein
  Pfam annotation: Domain name=Myb_DNA-binding; Domain location=14-61; Score=45.6; E_value=1.6e-10; Accession=PF00249.21; Description=Myb -like DNA-binding domain
  Pfam annotation: Domain name=Myb_DNA-binding; Domain location=67-112; Score=43.8; E_value=5.7e-10; Accession=PF00249.21; Description=Myb -like DNA-binding domain
  Pfam module annotation: Pfam domain module=Myb_DNA-binding::Myb_DNA -binding; Domain location=14-61::67-112
MGRPPCCDKIGIKKGPWTPEEDIILVSYIQEHGPGNWRSVPSNTGLMRCSKSCRLRWTNYLRPGIKRGNFTDHEEKMIIHLQALLGNRWAAIASYLPQRTDNDIKNYWNTHLKKKLKKMQIGGGSDDDNNDDKSNSSNNSQIKGQWERRLQTDIHMAKQALCEALSLDKPTQIFPETKLPSTSSHHHPTTTTTPNQTTSLYASSTENIARLLENWMKKSPNMTTTTTTTMETKPFSNNNMVITTGSSSSEGTQSTITCTQEYALDSLWSFNSERSSQSEENTNLGESKPQYQEPQETQVPLMLLENWLFDDAAPQCNEDLMNMSLEESTEGLF

SEQ ID NO: 219357 - protein, 65 aa, Glycine max
  Coding DNA Sequence Number=SeqID_102579
MERKTFGFLFLLLLVLASESRGERLLDKEARERWFHRWSVPRPSSQMLLQQAMLIEITTAKEAMK

SEQ ID NO: 219358 - protein, 137 aa, Glycine max
  Coding DNA Sequence Number=SeqID_102580
MAYYVHDDNSWNIDELCPLLPSWVLFELMAYLVPLSSNGNDFPIWVVTPDGLFSVKYAYSILSKAPIDTCPSFVSRIWEWNGPRITKSTKRFGKTTKRGNYFCNYQMGVNFKLIPIKVGVGIGQARPGFKKSEPSLR

SEQ ID NO: 219359 - protein, 258 aa, Glycine max
  Coding DNA Sequence Number=SeqID_102581
  Homolog annotation: Hit_ID=Q1SU57; Match level="QueryCoverage=46%, HitCoverage=71%, E-value=4e-13, Identity=33%"; Hit description=Zinc finger, CCHC-type
MEEGNKKNNEREENSLRKSSQALGMYESALRFVISNQLKRTHIRINRPPHLPLSQISLLAPKERPCLLKDVCFGVNRGDLNSSSFMKEDTMLENDIEKDFVEYKELEGAFNNPLCPTIRVTKDVLSLSCSGMEVLELDNDFCLVCFTDWDDVNELHKVIVWVRIPGLSLEFYDHNILRKIGNNLGRTIRIDHNTLHKAEGGDEVEYEELNMVCFACGKYGDRKDHCLEFSQIKEASVKDSPIATSGSAPTAPFDQQDT

SEQ ID NO: 219360 - protein, 52 aa, Glycine max
  Coding DNA Sequence Number=SeqID_102582
MVVNSRGSLNRLGMWDPLNIGVASLAKVDKERCGNVRVIWELLCHVDNFVQN

SEQ ID NO: 219361 - protein, 298 aa, Glycine max
  Coding DNA Sequence Number=SeqID_102583
MACPEWEEGGFTNFAGTHNQPDWTRTVGLNYVRPDWVIQMREPFGLRYLLAKTEGRRWAARFWWKVGNLDREIDCSDGGVGKRLRSGLVGGYKLVRKGAAAARKLYRLGRLCLRVGYRLITEGRLRSGRKPTIPAAVDALPIAIEPMPSVPIDPDMPNALRDIEATAPAYRESVRTLMSRYDIVQVYGAGGRLPLIAGTPFLAFEHGTLRSLPFESSYMGQLTYLTYTRARHAFITNADVLGSAQRLELPSYSFIPHPVNEDSLHETPESQALRASLCRELDTDFIVFHPSRQHWEPE

SEQ ID NO: 219362 - protein, 53 aa, Glycine max
  Coding DNA Sequence Number=SeqID_102584
MGEKNRLIVSKSDVLGLCPYKNFSINDAMVKGVAGGLWVQKGSEGQFRIYSLL

SEQ ID NO: 219363 - protein, 276 aa, Glycine max
  Coding DNA Sequence Number=SeqID_102585
  Gene Ontology: Mol. function=pyridoxal phosphate binding; Cellular component=membrane; Biological process=lipopolysaccharide biosynthetic process
  Homolog annotation: Hit_ID=Q7WR35; Match level="QueryCoverage=74%, HitCoverage=53%, E-value=1e-48, Identity=46%"; Hit description =DegT/DnrJ/EryC1/StrS aminotransferase family protein
MRLDFRRRQSRGAVVAETVDQLGQGLGPHGDSAALTCCDHFAGMERETAQIADGADRRSLVGGADRTCGIFDDRQIVLTGYRHDGIHVGGQAEQVDCDDGLGARRDGGFKRCRIQIERVRIDVRENRLGAHVFRGVGRGDPGERRHDDLVPRPQSQGQRGQVQRGGTRRRGQRVRGSMALGEQLFELTRHRTLRHPAAGETAAHTFDFAFVERGGSELHYLIYSGWQMKGASARSDSVERNTYRHESAILTILPCTGGAIVENATRNQPRAAGLAP

SEQ ID NO: 219364 - protein, 284 aa, Glycine max
  Coding DNA Sequence Number=SeqID_102586
MLPAAHSPAISDHLGISVTESSEADTTELEAWLSQVPSALLYAGQEFLDFLVAACGGVSTTLIARRGGRIAGAFRYLSKTVPGIGTIINSLPWYGSHGACLLDTQPDPQVRRALLAAFGNRIAATPDVISATVILTPVEESYRQEYIDALQPRVLDPRNGQITALPPDGPNLLHDLEFCFAQKTRNLARKACKQGFEEIVSDEDWAWQFLHDVHVENMAAVGGKAKPREHFDAFRVHLAPGRRRLSVAMLEGQPAAAMLLAGFNDTIEYITPVIKVEHRSRQPL

SEQ ID NO: 219365 - protein, 40 aa, Glycine max
  Coding DNA Sequence Number=SeqID_102587
MSTFDNLGYNLRLSDIQAAVGIAQFAKLEHLLAERRSRAT

SEQ ID NO: 219366 - protein, 103 aa, Glycine max
  Coding DNA Sequence Number=SeqID_102588
MSIGFNDEICAISELGYNRKNFDKDPGHRISQHTTVPILGKEPWRRQKEQLLQRYLGFNMNEAKFKLSLTRGICGLSFDFKYPVTIMLFGLSLVQQEGSEDKA

SEQ ID NO: 219367 - protein, 220 aa, Glycine max
  Coding DNA Sequence Number=SeqID_102589
  Gene Ontology: Mol. function=nucleic acid binding; Biological process= DNA integration
  Homolog annotation: Hit_ID=Q1SRN1; Match level="QueryCoverage=67%, HitCoverage=9%, E-value=6e-28, Identity=43%"; Hit description =Integrase, catalytic region
MTPTCGQSLLAYKSSSSNHLSMIQHHPPSICQEKKETNECSKSWLLIKSQSSLIPKKFCHGLWSQTSSFLEFLIDPTIPSRYLTKQGCDADVINPAYSDWEQQDLLLFTWFLSMLSEMVLPRVVHCVHSWQVWQEIHKFFHSQMSVHNLINFTELKSITKREITQLQNLARIQAVADILLSREDTVSHCDHINDILEGLPEEYSPLAAIIQYHTEPCDIL

SEQ ID NO: 219368 - protein, 85 aa, Glycine max
  Coding DNA Sequence Number=SeqID_102590
  Gene Ontology: Mol. function=metal ion binding
MMPSRTGFGIPQYCSGCDRSFCGAYWHALGVTGNGSYPVCSQDTLRPITDSCIRQMGRTLPDVISEWIAKFENREIGKVINLPSL

SEQ ID NO: 219369 - protein, 137 aa, Glycine max
  Coding DNA Sequence Number=SeqID_102591
  Gene Ontology: Mol. function=DNA binding; Cellular component=nucleus; Biological process=regulation of transcription
  Homolog annotation: Hit_ID=Q0PJL6; Match level="QueryCoverage=94%, HitCoverage=43%, E-value=9e-17, Identity=38%"; Hit description=MYB transcription factor MYB56
  Subcellular localization annotation: CTP_CleavageSite=87; ConfidenceScore=5.04e-01
MARSLPGRTDNKIKNYWKSHLKRYLTALGIDPVTHKPFKDATTTPPTNNSQVSMVTTTSKNGTNNTDSNIPRIYYFNVFLNSKVQISADHDCSADGADSNGSSGVTIEEASPQVNLELSIAPPSQPEDASMKETLNG

SEQ ID NO: 219370 - protein, 181 aa, Glycine max
  Coding DNA Sequence Number=SeqID_102592
  Gene Ontology: Mol. function=phospholipase C activity; Biological process=intracellular signaling cascade
MEYWLESANLDEIHQETGVQDPYWIPPSTFGAGGVPTENIDYIGELKILKIEMAQMKKDMQELISKKQEKSEMCLMELYILTGMHENMLIWKTKVEQQLMEITNKLSDVRKLREDTTLSYPPVSWEDWLESTNIDNIQGKELAPWFGNPELLNVPQEVVLQDLNSSLPTQLHSVELTNMNR

SEQ ID NO: 219371 - protein, 67 aa, Glycine max
  Coding DNA Sequence Number=SeqID_102593
MEKKLITARSSVHIGAVPVAEMEASALLVAIKWIVDKDLSNVIFEIDRKHVHDLLHSINYRAHLDFL

SEQ ID NO: 219372 - protein, 600 aa, Glycine max
  Coding DNA Sequence Number=SeqID_102594
  Gene Ontology: Mol. function=amidase activity; Cellular component =integral to membrane; Biological process=translation
  Homolog annotation: Hit_ID=Q1SIW5; Match level="QueryCoverage=99%, HitCoverage=97%, E-value=0.0, Identity=71%"; Hit description=Amidase
  Pfam annotation: Domain name=Amidase; Domain location=175-570; Score =342.0; E_value=9.8e-100; Accession=PF01425.11; Description=Amidase
MPKNKCPREAVTEWTRGSGATICFHFSTTLVRCHVLLLLVFVHSSSANLTNMGSKNQCQLSDKKGYVSSLGCFFGLLDANFFEDKQIAEGANEFNIPIIRANRKLVASENGELHYPSPLVFNADWNSQPTHFENKSFNYPSISGIQSPESEEDIAFMSVLELGELIKTKQITSLELTQIFLRRLKKYNPTLEAVVTYTEELAHEQAKEADKLLSRGVYLGPLHGIPYGLKDIISVPKYKTTWGSKSFKNQVIDVEAWVYKRLKSAGAVLVAKLVSGSLAYDDIWFGGRTRNPWNIEEFSTGSSAGPAASTSAGMVPFAFGTETAGSITFPAARCGVTALRPTFGTIGRSGVMSISESLDKLGPFCRSATDCAIILDIVRGKDLDDPSSKHSSLDDPFLVDITKLTVGYLDDAEMEVVHVLDSKGVKMVPFKLNYTVDSVQGILNFTMDVDMLAHFDEWQRSGKDNVYEAQDQWPTELRRARLIPAVDYVQAQRARGRLIKEIRESFSVDAFIGNATDWEKVCLGNLVGLPVIVVPTGLKNISDPPPGGTRRRTTIPTGIYAPPNRDHIALALAMAYQEVTNHHKQRPPINDLGPNDKLPS

SEQ ID NO: 219373 - protein, 126 aa, Glycine max
  Coding DNA Sequence Number=SeqID_102595
MEGLLPLVYKAIKKRKTRRQYQCLSSGAALSYNMNVAEFYPQTHDHGHGYNYMQEPSTSMQKVVDHDDDDTENIGYLRYNSVREFSNGFSSPHQQRTCAADSPDSKQLVSFGVWMSYKIDSYKLQI

SEQ ID NO: 219374 - protein, 542 aa, Glycine max
  Coding DNA Sequence Number=SeqID_102596
  Gene Ontology: Mol. function=transporter activity; Cellular component= mitochondrial inner membrane; Biological process=transport
  Homolog annotation: Hit_ID=Q1SMQ9; Match level="QueryCoverage=94%, HitCoverage=97%, E-value=0.0, Identity=71%"; Hit description=Calcium- binding EF-hand; Adenine nucleotide translocator 1
  Pfam annotation: Domain name=Mito_carr; Domain location=253-340; Score=101.9; E_value=1.9e-27; Accession=PF00153.17; Description =Mitochondrial carrier protein
  Pfam annotation: Domain name=Mito_carr; Domain location=347-438; Score=107.8; E_value=3.2e-29; Accession=PF00153.17; Description =Mitochondrial carrier protein
  Pfam annotation: Domain name=Mito_carr; Domain location=445-541; Score=90.2; E_value=6.4e-24; Accession=PF00153.17; Description =Mitochondrial carrier protein
  Pfam annotation: Domain name=efhand; Domain location=117-145; Score =17.6; E_value=0.044; Accession=PF00036.22; Description=EF hand
  Pfam annotation: Domain name=efhand; Domain location=189-217; Score =26.6; E_value=8.7e-05; Accession=PF00036.22; Description=EF hand
  Pfam annotation: Domain name=efhand; Domain location=50-78; Score =14.2; E_value=0.36; Accession=PF00036.22; Description=EF hand
  Pfam annotation: Domain name=efhand; Domain location=86-114; Score =28.8; E_value=2e-05; Accession=PF00036.22; Description=EF hand
  Pfam module annotation: Pfam domain module=Mito_carr::Mito_carr::Mito_ carr::efhand::efhand::efhand::efhand; Domain location=253-340::347 -438::445-541::117-145::189-217::50-78::86-114
MSGAGQAIDMEHVGFSKAKADHGRGKKTGPVSMDHVLLALRETKEERDLRIRSLFNFFDAANNGYLDYAHIEAGLSALQIPPEYKYAKELFKVCDADRDGRIDYRDFRRYMDDKELELYRIFQAIDVEHNGCILPEELWDALVKAGRYSGTTTLFIVFCASWLVLLFSICSLHPFCAYGDVRIEIDEEELARFVEHVDKDNNGIITFEEWRDFLLLYPHEATIENIYHHWERVCLVDIGEQAVIPEGISKHVHRSRYFIAGGIAGAASRTATAPLDRLKVVLQVQTGRASIMPAVMKIWKQDGLLGFFRGNGLNVVKVAPESAIKFYAYEMLKNVIGDAQDGKSDIGTAGRLFAGGMAGAVAQMAIYPMDLVKTRLQTCASDGGRVPKLVTLTKDIWVHEGPRAFYRGLVPSLLGMIPYAGIDLTAYDTLKDLSKRYILYDSDPGPLVQLGCGTVSGALGATCVYPLQVIRTSITMILRLQAQPANSTSAYKGMSDVFWKTLKDEGFRGFYKGLIPNLLKVVPAASITYMVYESMKKSLDLD

SEQ ID NO: 219375 - protein, 184 aa, Glycine max
  Coding DNA Sequence Number=SeqID_102597
  Homolog annotation: Hit_ID=Q1SIX8; Match level="QueryCoverage=98%, HitCoverage=88%, E-value=5e-37, Identity=50%"; Hit description=VQ
  Pfam annotation: Domain name=VQ; Domain location=13-43; Score=37.8; E_ value=3.8e-08; Accession=PF05678.4; Description=VQ motif
MEKPPIYGAASDCKPLTTFVQTNSDAFREVVQRLTGPSEASAAKEGDAKKVATMKRTTSKLHERRKYMKPKVEIVKPTFNYKTGACLSPSKSRSSSFPPSPGSGSSSLLPSPTTPSTLFSLLKILEDEKKQESVMPEVNKEEEEKAIKERRFYLHPSPRAKPGYTEPELLNLFPLASPNASEKV

SEQ ID NO: 219376 - protein, 50 aa, Glycine max
  Coding DNA Sequence Number=SeqID_102598
MEHLNCGEPKDANFGLRSAKRFRGWFFQGGIVETESEYLRGERGSSYYEL

SEQ ID NO: 219377 - protein, 223 aa, Glycine max
  Coding DNA Sequence Number=SeqID_102599
  Gene Ontology: Mol. function=oxidoreductase activity; Cellular component=microsome; Biological process=metabolic process
  Homolog annotation: Hit_ID=Q1SMR0; Match level="QueryCoverage=81%, HitCoverage=54%, E-value=3e-78, Identity=82%"; Hit description=Short- chain dehydrogenase/reductase SDR
  Pfam annotation: Domain name=KR; Domain location=50-209; Score=-90.0; E_value=0.039; Accession=PF08659.1; Description=KR domain
  Pfam annotation: Domain name=adh_short; Domain location=50-200; Score= 10.1; E_value=1.2e-06; Accession=PF00106.15; Description=short chain dehydrogenase
  Pfam module annotation: Pfam domain module=KR::adh_short; Domain location=50-209::50-200
MGHKEKSKERKEKRLQEISLLRTIPYADHQRLLFLAIYPLIHHRWWSKETIAVVTGGNRGIGFEISRQLADHGVTVILTSRDASVGVESIKVLQEGGLQDVACHQLDILDTSSINQFCEWLKENYGGLDILVNNAGVNFNFGSDNSVENSKLVIETNYYGTKRMIKAMIPLMKSSSAGGRIVNVSSRLGRLNGKRNQTTLIQYPFTGNTLSMFFRINIRVLEC

SEQ ID NO: 219378 - protein, 580 aa, Glycine max
  Coding DNA Sequence Number=SeqID_102600
  Homolog annotation: Hit_ID=Q2QWE9; Match level="QueryCoverage=84%, HitCoverage=77%, E-value=1e-120, Identity=47%"; Hit description =Expressed protein
  Pfam annotation: Domain name=XS; Domain location=356-477; Score= -16.3; E_value=0.00017; Accession=PF03468.5; Description=XS domain
  Pfam annotation: Domain name=zf-XS; Domain location=286-324; Score =28.5; E_value=2.3e-05; Accession=PF03470.5; Description=XS zinc finger domain
  Pfam module annotation: Pfam domain module=XS::zf-XS; Domain location= 356-477::286-324
MPSQLKVHLAISPFVLLHTTAGDRLRISEKRNSKRGCERPFTMADIGDSSSKGKNVLESLPKIEQLTQGVADVNIESGQDDGEWVVYAKKSKNRARSTTVKPWSPPVHNSRPTGNTKMAHKPVTRNDGGVGRASGSGNPWQSQNANFKRPAGRGNGRPQLTASESESSNNVTSNPVIRPPLEHGWNWQSISGSKQSKSVDDSLVKGEITEESPMKNDSVDDEGDEEEGFDAMEDTDDDLMSDDYDSDTSQKSHETRKKSKWFKDFFENLDGLSIEKINEPERQWHCTACRGGPGAIDWYRGLQPLITHAKTKGSKRVKIHREFAELLEEELRKRGSAVIPPGEVFGKWKGLKDEEKDHEIVWPPMVVIQNTRLEQDENDKWLGMGNQELLNYFSAYDAVKARHAYGPQGHRGLSVLIFEASAIGYLEAERLHKHFAEQGTDRDAWFSHHRRLFLPGGRRQLYGYMAIKEDLDFFNRHCQGKSRLKYDMRSYQEMVVNQLRQMNEDNQLLIYLKDRDAKKQKQTKALEESLGIVTEKLRRTMEENRIVRLRTKMQHEENKEELLIDEFWMCFGMNCFIERC

SEQ ID NO: 219379 - protein, 153 aa, Glycine max
  Coding DNA Sequence Number=SeqID_102601
  Homolog annotation: Hit_ID=Q1SIX1; Match level="QueryCoverage=40%, HitCoverage=13%, E-value=1e-18, Identity=69%"; Hit description =Cytokine, four-helical bundle
MAEAPYHCYYILQPSDIGPMLMRLLAGAEEILRVPDNQLVDSSINKEIESSVQACLLKPSSEVIGKAEAATGVIVDEETLALDITDQDDKTTACITEEWKQLVVSEDPKLYSPSCMPKAKLGQSSVSPRDGNRQLDRETSRILETLEVQMKVA

SEQ ID NO: 219380 - protein, 328 aa, Glycine max
  Coding DNA Sequence Number=SeqID_102602
  Gene Ontology: Mol. function=metal ion transporter activity; Cellular component=integral to membrane; Biological process=metal ion transport
  Homolog annotation: Hit_ID=Q941P4; Match level="QueryCoverage=99%, HitCoverage=93%, E-value=1e-119, Identity=68%"; Hit description=Zinc transporter protein ZIP1
  Pfam annotation: Domain name=Zip; Domain location=21-325; Score =339.7; E_value=5.1e-99; Accession=PF02535.12; Description=ZIP Zinc transporter
LVAAECTCDEEDQERDKSKALRYKIAALISILVASAIGVCIPLLGKVIPALSPEKNIFFIIKAFAAGVILATGFIHILPDAFENLTSPCLNKYPWDAFPFTGFVAMCTAMGTLMVETYATAYFKKHHHSQVQTTYVEKEESGDVHLHTHATHGHAHGHLPSHDHQSSALLRHRVISQVLELGIIVHSIIIGISMGASESPKTIRPLVAALTFHQFFEGMGLGSCIIQANFQRLSITIMGLFFALTTPVGIGIGIGITNVYDENSPTALIVEGIFNAASAGILIYMALVDLLAADFMNPRMQKSGSLRLGANLSLLLGAGCMSLLAKWA

SEQ ID NO: 219381 - protein, 148 aa, Glycine max
  Coding DNA Sequence Number=SeqID_102603
  Homolog annotation: Hit_ID=Q1SMR0; Match level="QueryCoverage=38%, HitCoverage=18%, E-value=3e-23, Identity=82%"; Hit description=Short- chain dehydrogenase/reductase SDR
MAKKLSERPDGEKIYINSYCPGWVKTALTGYAGSVSVEDGADSGVWLSLIPDQAITGKLRMIDYQNNSSMSPHTQVIIHSLEVLLTRLVWGGGKWRKESHGSLPAKSRKQRKVPSSSIEFITKAIILKQAARLPRTRFGARKMGRGQH

SEQ ID NO: 219382 - protein, 82 aa, Glycine max
  Coding DNA Sequence Number=SeqID_102604
MEDTVKGSIVYKVVVTEKNIDATLEVIGEPGHDGIHHHTQIIAFSQRCKHDLDPPRRKGSVRAEWQIQERDFGNFEMEERMK

SEQ ID NO: 219383 - protein, 68 aa, Glycine max
  Coding DNA Sequence Number=SeqID_102605
MKGDAEKAWNIGNGFGRMKGEEMAFFLSYLDFKAQNTQVSNALGNGNAPHTLDIFAKIPTGRSWTSVS

SEQ ID NO: 219384 - protein, 100 aa, Glycine max
  Coding DNA Sequence Number=SeqID_102606
MEEPVEYRNQVQADVVSTEKDNGKPNFNKAQDDGKRGRLPQEPHYAYSSKNHNHSSLITLVNKSQAGGRVENTQVIYIGTEAEVDQKKESTSPSTNQDMS

SEQ ID NO: 219385 - protein, 84 aa, Glycine max
  Coding DNA Sequence Number=SeqID_102607
MQHVQNLYTTGECYKEVNCGRQKKVKVEKSQGKVVVRGFLSMGLHLEEGKEHGFFSAGTERETDLNIEGPTNTAWIGFEETNTV

SEQ ID NO: 219386 - protein, 292 aa, Glycine max
  Coding DNA Sequence Number=SeqID_102608
  Gene Ontology: Mol. function=RNA-directed DNA polymerase activity; Biological process=RNA-dependent DNA replication
MHYVEVRTEAEEVEELELNPRTNDGNRVKPLEETSTFQLNPKQEVAKLMAAQFIREIDYTTWLSNVVMVKKPNEKWRMCTDYTHLSRACSKVVYPLSNIERLVDGTTKHKLLSFLDAYYGYNQIKMDPMDKKQKTFITESANYYKMKPRSLCGWHGSRVYVDNIRLNLEKCIFEGTLATPYVLSKPNTNKRLIVYLSVSNEAICAMLVQEEGGNARAQVLADFINELHPPQPHLEQEWWTMHEDDSSNQHGSGAMVGYEAFLERLRLAKEDPQLLKYYYAFEGLKEEFEEVQ

SEQ ID NO: 219387 - protein, 80 aa, Glycine max
  Coding DNA Sequence Number=SeqID_102609
MVRILEDCTVNEKAFRMVNSEMKENMVSLDRFPDKETPPKIKFARQKEIMSSKEKIDKSTWIKVGNKDQSFMAKGQLQKR

SEQ ID NO: 219388 - protein, 282 aa, Glycine max
  Coding DNA Sequence Number=SeqID_102610
  Gene Ontology: Mol. function=chitin binding; Cellular component =extracellular region; Biological process=chitin metabolic process
  Homolog annotation: Hit_ID=UPI000044A8F0; Match level="QueryCoverage =85%, HitCoverage=99%, E-value=3e-28, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MAPLLLLQNGQVTKSNRAYTLREFPERFAKDGPLGTSTLTFRGLHVLTIRGLQVLAIRGLHVLAFRGSCTFTFRGLQVLAIRRLHVLAIRGLHALTFRGLHVLAFKGSCTFTIRGLQVLAIRGLYALTFRGLHVFTFRGSCTFTFRGLHVLAFRGLHVLAFRGLHVLAFRGPHALAFKGLHVLAFTGSCTFTFRGLRVLAIKGSCTFTFVGLHALTSEDYMSPIFKGRHALTFRGLHVLAIIGLHCLTFKRRQVLNFRGLHALAFRGLRILTFSGLHIHTLR

SEQ ID NO: 219389 - protein, 287 aa, Glycine max
  Coding DNA Sequence Number=SeqID_102611
  Gene Ontology: Mol. function=phospholipid-translocating ATPase activity; Cellular component=integral to membrane; Biological process=pathogenesis
  Homolog annotation: Hit_ID=Q5PC53; Match level="QueryCoverage=77%, HitCoverage=96%, E-value=1e-76, Identity=68%"; Hit description =Protein mgtC
  Pfam annotation: Domain name=MgtC; Domain location=15-143; Score =250.2; E_value=4.3e-72; Accession=PF02308.7; Description=MgtC family
MLTGDRLMFPYISHLLAAMLLGAIIGAERQWRQRMAGLRTNALVATGAAVFILSSLSTSPDSPGRIAAQIVSGIGFLGAGVIMREGMNIRGLNTAATLWCSAGIGVLCGLGQFWNAGMASVIILCANILLREAAQRINQLPVLHEGEKCYVLKITCNDEHEDAVRQNIVNMAKELTLSLKAIYCDTAQEGGKTEIRAEVMTREEYRKLLELIMGNIGGNKIMASKWAVTRRESYRSADSGQTFHHLRRKAKLLAAHKLGQFLLSGLPYRNDLFKQTPAFPRQHESFS

SEQ ID NO: 219390 - protein, 278 aa, Glycine max
  Coding DNA Sequence Number=SeqID_102612
  Gene Ontology: Mol. function=acyltransferase activity
HHLALELQRAVDHGIRADDHAWLAAGGQRDAEVRLAHVHTALDLRTDAHGDVTVDGFHVVADAAFDQPDATVHGFNAAFDLAAAIAEDAAVDGADVAMGDHVAAQAHTAVDRFDLAGARAIGDLHPAVDGVDAAGLDAFADADAAVDGVQLAVALAGFGADAAVDLADVLLGADRSGGQQYAQQQRNGESFHGDLDGCAAGRPRAEMSPFPGIPRNCLKSLESPCATTSSHHADITSPLPAAGAACCWGWPWHWRCRCRVPRRPRARPSASCRNCAVS

SEQ ID NO: 219391 - protein, 123 aa, Glycine max
  Coding DNA Sequence Number=SeqID_102613
  Gene Ontology: Mol. function=nucleic acid binding; Biological process= DNA integration
TTPVIENNVQTIVDDIVQEQDNDEVLPQIPIQQPQQPQEVPLRRFDRDRRKHEDDIGLTKDVSINFCQAMCSSNSQNWINAMKDEMKSMQDNEVWYLIKLPESVKPIGCKWIFKTKRDSKDNV

SEQ ID NO: 219392 - protein, 71 aa, Glycine max
  Coding DNA Sequence Number=SeqID_102614
MTDDKSELIDLVLREGFQDKHIVLKKEPKVKDLEQSKKITAKPPKDLLKEWRTQRDLSLDNIIGEISLVMQ

SEQ ID NO: 219393 - protein, 100 aa, Glycine max
  Coding DNA Sequence Number=SeqID_102615
MFATQFREFSPLGISILCLSLEGNPSHCSLLFSRRNPKLSRNSIDHTFTVGILEIIFVEGKKESHEDNTSGGFNLFSVSLTFENSIGAVGGITEGILGNR

SEQ ID NO: 219394 - protein, 78 aa, Glycine max
  Coding DNA Sequence Number=SeqID_102616
MLQSFKCRQWRTTRAEKKTWTRGEDCWTRGALVAEEEELKGEEALGRGRKLYNDSLQKDAKLGEIGEWNGERWVWCLA

SEQ ID NO: 219395 - protein, 103 aa, Glycine max
  Coding DNA Sequence Number=SeqID_102617
  Gene Ontology: Mol. function=metal ion transporter activity; Cellular component=integral to membrane; Biological process=metal ion transport
  Homolog annotation: Hit_ID=Q941P4; Match level="QueryCoverage=65%, HitCoverage=19%, E-value=2e-18, Identity=70%"; Hit description=Zinc transporter protein ZIP1
MGLFLALTTPMGIGIGIGITNVYDENSPTALIVEGIFNAASAEILIYVARIDLLAADFKNPRMKKTATNKNFLCPSAVSKGPRMSIPQTMKGRGETIGCNLSA

SEQ ID NO: 219396 - protein, 65 aa, Glycine max
  Coding DNA Sequence Number=SeqID_102618
MGAKYLEVVKQGSHPNNGWSPDENRTNNILRLSKLNNGSSREIQMVITFHSDVRFRRIIYPDAQN

SEQ ID NO: 219397 - protein, 95 aa, Glycine max
  Coding DNA Sequence Number=SeqID_102619
MTNKAKGKGKEVAGKGSAGKRKGAFDDDKTGGDRKRNKRGWTCQIRARVAGHVSSLKRKCWPETNCFEFWTFRCRPCSNALVSPVIFFGFVDVQT

SEQ ID NO: 219398 - protein, 61 aa, Glycine max
  Coding DNA Sequence Number=SeqID_102620
MGSKGGIAGREERGEWWWSRSCGGLGRRWWERGRARRRPKPNYKVTLRGRRTHTKSAQYRQ

SEQ ID NO: 219399 - protein, 138 aa, Glycine max
  Coding DNA Sequence Number=SeqID_102621
  Gene Ontology: Cellular component=cytoplasm; Biological process =multicellular organismal development
  Homolog annotation: Hit_ID=O48771; Match level="QueryCoverage=93%, HitCoverage=15%, E-value=1e-35, Identity=54%"; Hit description =Argonaute (AGO1)-like protein
MQNIERPYTLIEEEPQLRKSNPVARANVSTVSLTLNIICSPYAHSSTLGPWKKKCLSEIGVVTQCIAPVKITDQYLTNVLLKINSKLGGINSLLTIEHSGHLPLIKDTPTMILGMDVSHNLPGRLDSPSIALINFKGI

SEQ ID NO: 219400 - protein, 140 aa, Glycine max
  Coding DNA Sequence Number=SeqID_102622
MKAYSDNEDQCDARWRCVACRMRELNVLGPYMRQYFELVVHVDDMAAGEKTSVTLTEDVSCIEKKKHDKEVVEGWVAWKTFPRDDPMQAHECHTLECGDVWSNTQWGVLSAVVILFKQQMGGHQETHWERRKGHYKMGNK

SEQ ID NO: 219401 - protein, 146 aa, Glycine max
  Coding DNA Sequence Number=SeqID_102623
MSYIEIGCWFRSSSCMLGRLTLRLRDDRVVFNLSNTLKQPSSFASCSYIESVDISDALMEGLHETEEDKLLRVLRGNKEAFGWNIHDIKVVKGENAKSTFKMNAYKFKVYYEGFQQYNGRDHLAVTQAVSVGVEYGRGDFTTIIVG

SEQ ID NO: 219402 - protein, 92 aa, Glycine max
  Coding DNA Sequence Number=SeqID_102624
MWDLIQVTHEGTPKCLGNIFEEEDINVKVLKYLNKTWQPKVTTISESNDLATMTHAELFGKLRGYEMDLTRMVEEEAIDKKNRGLALMTSIP

SEQ ID NO: 219403 - protein, 156 aa, Glycine max
  Coding DNA Sequence Number=SeqID_102625
MEAMKKQMATMMEAMMSMRKMMEVIMATVVVASTATEVDPTHPSGLNQKSEALGSTGGPHFVQVQNKHSFPPYGLPPNYTPPNVAHTPNENVNNFAPKPIESQQPQSDYAHVSQPMEETHEASLDHNLADFEPHLGYATEGQAIGGVPLPNTLEGP

SEQ ID NO: 219404 - protein, 63 aa, Glycine max
  Coding DNA Sequence Number=SeqID_102626
MLSRSCLGLLNLVSVDDYQTLGGRVPRLVTTAAGDVPELYIDGMENPGSDDAVSPARRERRIV

SEQ ID NO: 219405 - protein, 582 aa, Glycine max
  Coding DNA Sequence Number=SeqID_102627
  Gene Ontology: Mol. function=transferase activity; Cellular component= alpha,alpha-trehalose-phosphate synthase complex (UDP-forming); Biological process=trehalose biosynthetic process
  Homolog annotation: Hit_ID=Q1RTI3; Match level="QueryCoverage=98%, HitCoverage=68%, E-value=0.0, Identity=75%"; Hit description =Glycosyl transferase, family 20; Trehalose-phosphatase
  Pfam annotation: Domain name=Glyco_transf_20; Domain location=1-274; Score=110.2; E_value=6.1e-30; Accession=PF00982.11; Description =Glycosyltransferase family 20
  Pfam annotation: Domain name=Hydrolase_3; Domain location=322-564; Score=-77.9; E_value=0.013; Accession=PF08282.2; Description =haloacid dehalogenase-like hydrolase
  Pfam annotation: Domain name=Trehalose_PPase; Domain location=323 -558; Score=354.4; E_value=1.8e-103; Accession=PF02358.7; Description= Trehalose-phosphatase
  Pfam module annotation: Pfam domain module=Glyco_transf_20::Hydrolase_ 3::Trehalose_PPase; Domain location=1-274::322-564::323-558
MLGLDYESKRGYIGLDYYGRTVTVKILPAGIHMGLLESVLSLPQTALRVKELKKEYEGKVVILGVDDMDLFKGISLKFLALGKLLEVDESLRGRVVLVQILNAARSRGKDIQDVKNESEAIAREINEKYSQPGYQPIVYINGPISTQEKAAYYAVSECCVVNAVRDGMNLVPYEYTVCRQGSFALDKALGVEGEDKKTLKQSVIIVSEFIGCSPSLSGAIRVNPWNIDEVAEAMNSAVTMSEAEKHLRHEKHYKYISSHDVAYWARSFDQDLDRACREHYSKRYWGVGLGLGFRIVALDPTFRKLSVDHIASAYRDTHSRLILLDYDGTMMPQATIKTPSKEVITVLNYLCSDPENMVFIVSGRDKDCLSKWFSPCEKLGLSAEHGYFTRWTKDSPWETCGLTTDFEWKMIAEPVMALYTEATDGSFIEHKESAMVWHHQEADPYFGSCQAKELLDHLESVLANEPVGVIRGQHIVEVKPQGVSKGKVVEDLISIMRSKGKSPDFLLCIGDDRSDEDMFESIALSVSNPALSTIISKVFACTVGQKPSMAEYYLDDTSEVIKLLEGLATAAGPSASIIYQDL

SEQ ID NO: 219406 - protein, 195 aa, Glycine max
  Coding DNA Sequence Number=SeqID_102628
MGGLCQDPFEKLQKPITGKSISIMKECVLSKKRDEIPPRRETPQQSAQVITKNTATPRMTRTQSTRLMREGLGGWTFTAKDFNRVNSRIECPKWPLESVPTREVLIMRARMTWWAWPLHFLFRTLRTENQEEKSTGQYNFCCSLETKSQLRKRTLKLIISWHLMRRSLQSKKDFEGSDFFCPMNIPKRLQMGKSS

SEQ ID NO: 219407 - protein, 110 aa, Glycine max
  Coding DNA Sequence Number=SeqID_102629
MDFDLLLYRRLQKLSIIEAALTLAGVSFPDPHSTARPTTSLSLPWLACNLLTPANTTSYFPYPGQTLREEVTSSSLTRIRCPSLCVTPYSCMSCLPPCHASFLLEIVPNN

SEQ ID NO: 219408 - protein, 356 aa, Glycine max
  Coding DNA Sequence Number=SeqID_102630
  Gene Ontology: Mol. function=transferase activity, transferring glycosyl groups; Cellular component=endoplasmic reticulum membrane; Biological process=GPI anchor biosynthetic process
  Homolog annotation: Hit_ID=Q9LEQ5; Match level="QueryCoverage=100%, HitCoverage=89%, E-value=1e-99, Identity=46%"; Hit description =Dolichyl-phosphate-mannose--glycolipid alpha-mannosyltransferase -like protein
  Pfam annotation: Domain name=Glyco_transf_22; Domain location=1-289; Score=90.3; E_value=5.8e-24; Accession=PF03901.7; Description=Alg9 -like mannosyltransferase family
MVNSVLVQTYFNPDEHWQGPEIAHRIAFGGNKVSEATCTPSSSFRFIGSLPYCILIPHGLWAPRLLQSVFSAVGDLYLYKLAAVLFGDSVAKWTWGLAVAAVACAIRPTSAITWLYVGLLELFKAHDRFKFIFLEVAPIGYVFGGSLFQDPGAWTYLLIRSFHVWHMDSRDYYGTHKWHWYFTQGFPVMIFSHLPFCIAGIIYSKQWKFSGLLAWVLGFYSLLGHKEFRFALPVLPIALMFSGYSLAVIEDPGPEDAMNHLAREALHGKVKSILFLTPCHATPYYSMLHHNLPMQFLDCTPSEEKGVPDESDRFLMDPIPFVSEYAKNKSLPSHVVLFDSEEQKLKNLLISLDYKE

SEQ ID NO: 219409 - protein, 249 aa, Glycine max
  Coding DNA Sequence Number=SeqID_102631
  Gene Ontology: Mol. function=zinc ion binding; Cellular component =integral to membrane; Biological process=defense response to bacterium
  Homolog annotation: Hit_ID=Q6KAE5; Match level="QueryCoverage=99%, HitCoverage=48%, E-value=1e-111, Identity=75%"; Hit description =Putative receptor-like kinase Xa21-binding protein 3
  Pfam annotation: Domain name=Ank; Domain location=111-145; Score =21.8; E_value=0.0025; Accession=PF00023.20; Description=Ankyrin repeat
  Pfam annotation: Domain name=Ank; Domain location=172-204; Score =38.4; E_value=2.4e-08; Accession=PF00023.20; Description=Ankyrin repeat
  Pfam annotation: Domain name=Ank; Domain location=215-247; Score =41.3; E_value=3.3e-09; Accession=PF00023.20; Description=Ankyrin repeat
  Pfam annotation: Domain name=Ank; Domain location=50-82; Score=32.0; E_value=2.1e-06; Accession=PF00023.20; Description=Ankyrin repeat
  Pfam annotation: Domain name=Ank; Domain location=83-109; Score=14.0; E_value=0.29; Accession=PF00023.20; Description=Ankyrin repeat
  Pfam module annotation: Pfam domain module=Ank::Ank::Ank::Ank::Ank; Domain location=111-145::172-204::215-247::50-82::83-109
MKFLSLVGNSFGCSASGERLVSAARDGDVQEAKALLEYNPRLARYSTFGVRNSPLHYSAAHGHHEIVYLLLESGVDINLRNYRGQTALMQACQHGHWEVVQTLIHKADYLNGGTALHLAALNGHTRCIRLILADYIPSVPNFWNALQTGDHKSISEFDQSGLCEVINRTADGGITALHMAALNGHVESVQLLLDLGASVSEVTVEDGTTIDLIGSGSTPLHYAACGGNQQCCQLLIAKGANLTAENANG

SEQ ID NO: 219410 - protein, 178 aa, Glycine max
  Coding DNA Sequence Number=SeqID_102632
  Gene Ontology: Mol. function=metal ion binding
  Homolog annotation: Hit_ID=Q6KAE5; Match level="QueryCoverage=72%, HitCoverage=23%, E-value=3e-14, Identity=37%"; Hit description =Putative receptor-like kinase Xa21-binding protein 3
MKKVRTLVRFAISAKRGYPTVTINICTWPYDRLKLEPEHLAKWFLTFLPTVQGTKEGLTSAPKQRLGFILNEGNPWQLMERNDLEGEEFLDPREVGLQNGVVMSLESPNTSLEHVQNVRDKFDVLCISLCSGLASGSFTNETMPCLQRGHAIEPGGPVVVVEVEFVEQRYKAHCVQNS

SEQ ID NO: 219411 - protein, 84 aa, Glycine max
  Coding DNA Sequence Number=SeqID_102633
  Subcellular localization annotation: CTP_CleavageSite=52; ConfidenceScore=5.61e-01
MLPFDLRARYGTSRIVQQWVPSTSKRSSKGYMPSAMRASLAKLPTLSEIFAQFSAVKRSLPLAKCKSMQLTLGLAGSLPAKTTL

SEQ ID NO: 219412 - protein, 100 aa, Glycine max
  Coding DNA Sequence Number=SeqID_102634
MDAVAPVSFTANENVSTPIEVQPTATSHTAHSSDHTRPRWLQWIPYLDEFLSSMKALGSTILKPAKKAALIKKIMDENPKPMQFSEVNSQDLEKSIDRYH

SEQ ID NO: 219413 - protein, 189 aa, Glycine max
  Coding DNA Sequence Number=SeqID_102635
MTAITEVKQPNFLMMKRVWMAIALPIVIFYFSGIQGLVQLAIVWVFASIMLLMFAYKKFRIKKWNASTRDHFGEQDGMWSHEFGSTSMKLDQHKGLIHLKEENKQKTYPFSAVKEWRYNLSTTRQRTGLDKELDRTHDFRESGFYIAVDDVQYPEWRIMFFPQQGDFNSQEGIRDTELQLNRWMHVFDK

SEQ ID NO: 219414 - protein, 170 aa, Glycine max
  Coding DNA Sequence Number=SeqID_102636
  Gene Ontology: Mol. function=4 iron, 4 sulfur cluster binding; Cellular component=membrane; Biological process=electron transport
  Homolog annotation: Hit_ID=Q8ZL85; Match level="QueryCoverage=69%, HitCoverage=75%, E-value=6e-36, Identity=57%"; Hit description =Putative oxidoreductase
  Pfam annotation: Domain name=Fer4; Domain location=119-148; Score =4.9; E_value=0.063; Accession=PF00037.17; Description=4Fe-4S binding domain
  Pfam annotation: Domain name=Fer4; Domain location=59-84; Score=3.2; E_value=0.11; Accession=PF00037.17; Description=4Fe-4S binding domain
  Pfam annotation: Domain name=Fer4; Domain location=90-113; Score =34.5; E_value=3.7e-07; Accession=PF00037.17; Description=4Fe-4S binding domain
  Pfam module annotation: Pfam domain module=Fer4::Fer4::Fer4; Domain location=119-148::59-84::90-113
MSHLPKTLLIPFRIKARSGAFLARCVFIPNGVEDEPDQDCSTVSARRFAPRIRVVKSDELSTATLCRQCEDAPCANVCPEGAIRHEGDVWRVDQRLCIGCKSCMVACPYGAMTVMLTDEGVQALKCDLCAHWQTGPACVAACPTQALRCIEPAELERLSAERRRWAAQAM

SEQ ID NO: 219415 - protein, 520 aa, Glycine max
  Coding DNA Sequence Number=SeqID_102637
  Gene Ontology: Mol. function=metal ion binding; Cellular component =integral to membrane; Biological process=ubiquitin cycle
  Homolog annotation: Hit_ID=Q940Q4; Match level="QueryCoverage=96%, HitCoverage=95%, E-value=5e-91, Identity=42%"; Hit description=RING -H2 finger protein ATL4K
  Pfam annotation: Domain name=zf-C3HC4; Domain location=130-171; Score= 35.2; E_value=2.3e-07; Accession=PF00097.15; Description=Zinc finger, C3HC4 type (RING finger)
MGFRSDVFVSPPEQPPYFLSEPTPPFPPTVRSDSFSFNDRALKVSPSILLIIIILAIVFFISGLLHLLVRFLWRPQTREPDELDNVTALQGQLQQLFHLHDAGVDQSFIDTLPVFLYKAIIGLKKYPFDCAVCLCEFEPEDKLRLLPKCSHAFHMECIDTWLLSHSTCPLCRATLLPEFSASNACSPIVLVLESGSSESSREIVPEREPAAAAVGRTSSVITANSRLGCRGDSEFGSTRVDLKSGELFSEIPDPTVQNGVEKVVTVKLGKFRSVDGGGGGGDGGGEGTSSINNVDARRCFSMGSFAYVMDESSSLQVPIRTPIKKQSSKKKSGLPLTPGHRPAMSECDCESRRDFKFAGFDATTIVEDDAASTGATTASTTCNGNSAAAIGRSRKESFSISKIWLRGKKDKPNAGADSSRRAVSFRFPVKSSVVAAASGSADDDDLKGKNCKFDTRSTMSEMDIGKWENGRGTEFDYDEENQSCYSMDSSQARAPSFARRTLLWLTGGRQNKVVHSASNL

SEQ ID NO: 219416 - protein, 49 aa, Glycine max
  Coding DNA Sequence Number=SeqID_102638
MSPITHFSSSNAFRYSALTVMQQGSWGKAPYRSQLAGLAFTVADFWFTG

SEQ ID NO: 219417 - protein, 62 aa, Glycine max
  Coding DNA Sequence Number=SeqID_102639
MVASSGKEGSKDDVVMVDPVEAKRLAAIQMERIKAKEKFKRRHQIEAINGAWAIYIYGVTQH

SEQ ID NO: 219418 - protein, 492 aa, Glycine max
  Coding DNA Sequence Number=SeqID_102640
  Gene Ontology: Mol. function=protein binding; Cellular component =intracellular; Biological process=defense response
  Homolog annotation: Hit_ID=Q1S2K5; Match level="QueryCoverage=63%, HitCoverage=55%, E-value=1e-109, Identity=58%"; Hit description =Disease resistance protein; AAA ATPase
  Pfam annotation: Domain name=NB-ARC; Domain location=116-404; Score= -39.5; E_value=9.1e-08; Accession=PF00931.13; Description=NB-ARC domain
MVPQSNTEDRVTEFEPSSVCLDKKVQSFMEESLNSVFGQGRVAENQTMKVEAHGEDGSKFALGSNEKPVFGRGCGFGNHDCTVSCCHVPFELDHSDSEDANVVSFEVMKENPFWVYDREALRLFRKFDKGHLQFRHILLGNVDVLMAAHLGVIFMPQGLGHFLGIDTFYPGGYLKGLERRKEIIDHQSAWRRVVCLAINSGISTPGYFRDRILFLTVLQSPNMEQLRTDIWGSNSNCFDDVWTLSVVDQLMCRIPGCKFLVVSRPKFQTVLSYEMELLIEEDALSLFCHHAFGQKSIPLAANENSVKQVVTECGRLPLALKVIGASLRDQTEMFWLSVKNRLSQGQSIGESHEINLIDRMAISINYLPEKIKECYLDLCCFPKDKKIPLDVLINMWVEIHGIPETEAYAIISVTQHDELRDLALNLRNHESIDERRLLVMPKKENGMPKEWLRYRQKPFEAQIVSIHTGEMKEMDWCNLEFPKAEVLTITTP

SEQ ID NO: 219419 - protein, 191 aa, Glycine max
  Coding DNA Sequence Number=SeqID_102641
  Pfam annotation: Domain name=G-patch; Domain location=2-43; Score =21.2; E_value=0.0005; Accession=PF01585.13; Description=G-patch domain
MMVARVMLRHGYEPGMGLGKNNDSMANLVDIKENRGKFRLGYKPTRTDVRRSIVERRSRGAGPQLRPQAREVPPCDISKSFMSVGLRHEEQVTVIYDEVPQELSDWCGHAFLIFNWETGKSWNDPKFPWWAQCNALVLTLQLGLGFRVLSLLRSVEESYAGTNIEDPVVDFEREANRLEFEEDKGMEFPLS

SEQ ID NO: 219420 - protein, 38 aa, Glycine max
  Coding DNA Sequence Number=SeqID_102642
MGRVNLGLNVRMVVMTCGKAWAEQMRKMSDKGESMSHF

SEQ ID NO: 219421 - protein, 196 aa, Glycine max
  Coding DNA Sequence Number=SeqID_102643
MQGLQRAVLRGSHSIGLRHATKRWSLNSIYRVWFEFTQSVISGLLTGLPHRLSKGCMPQLGLLAFKENEKGVVRVRVLVRHVHCIGWCIVRWQAVRRERILTLHHMGTARATQHFPYLTYPVWDWTTCLVYAGWVGWIRLSNGIGGGNCGRIFLHHPSYTQHGLHNGGHLVLHGLHGFRKARSLFLGIVFTFDYDC

SEQ ID NO: 219422 - protein, 96 aa, Glycine max
  Coding DNA Sequence Number=SeqID_102644
PTGCPFPPASSYCSDIGIVPARHPVDPEKSNRVLGFPALITSLCQFYGVPITPNKAIDAPPPPLEFTSAHPQKVRDRQVIRRPAQDVKEALLGGNL

SEQ ID NO: 219423 - protein, 47 aa, Glycine max
  Coding DNA Sequence Number=SeqID_102645
MAQNSTAHHSAYFGKKALEAARGETFAEIPRFLFNASSMLNVFMLLV

SEQ ID NO: 219424 - protein, 169 aa, Glycine max
  Coding DNA Sequence Number=SeqID_102646
  Gene Ontology: Mol. function=RNA-directed DNA polymerase activity; Cellular component=extracellular region; Biological process=RNA -dependent DNA replication
  Homolog annotation: Hit_ID=Q1S6N2; Match level="QueryCoverage=67%, HitCoverage=47%, E-value=1e-20, Identity=42%"; Hit description=RNA -directed DNA polymerase
MLDWVLVANEVVKEMKREKKEVIFKVDFEDAYDSIDWNFLLLHDEADGEFSMHKGLRQGDPLATFLFLLVAKRISGLMRQASKSKNFQGLVVGKDKVEVSVLQFADDILFFGEVSPNNVMCIKAILVCFELAFGLKPYWENGGGKFISIKIAWDIRDLVKVCGEVDGEG

SEQ ID NO: 219425 - protein, 103 aa, Glycine max
  Coding DNA Sequence Number=SeqID_102647
MDREDRLIGKYQPPMAHTWLRKLCEQWVSHYDPKQNFLQHNCHWLGIRVTKAWKVVWSTIVWSLWHLCKSVIFDDKLLDFDGVVEDIRFRAWAWIKAKWILVL

SEQ ID NO: 219426 - protein, 79 aa, Glycine max
  Coding DNA Sequence Number=SeqID_102648
  Subcellular localization annotation: CTP_CleavageSite=46; ConfidenceScore=5.04e-01
MKIKFENSSGRGELFQNVQDPFGYAFRLFWAKNTFSRRKIKSKYFRNASVSDSVEILHRSSSFFTVLHPFFVRSSFFNG

SEQ ID NO: 219427 - protein, 137 aa, Glycine max
  Coding DNA Sequence Number=SeqID_102649
WLKARMQGITWLPKKKSPSGEEAEVPEESEKVQALKAELERMRVVKEKLKTSVTTIRKECDKLGDVNMTTAEANNELKLQRAERDKSRVESMILKDKLKACQRSKRSLTEQLSRIEENMLTVIGQYKEKLDLAASHG

SEQ ID NO: 219428 - protein, 111 aa, Glycine max
  Coding DNA Sequence Number=SeqID_102650
MGETHKVPYHNLANFEPCLGYATEGQAAGGRVPPAMVEKGKLDHIEERLKAIEGGIDHAFADMAELCLVPDVVIPPKFKVPNFDKCKGTTCPNNHLKMYCRKMGGYAKDEN

SEQ ID NO: 219429 - protein, 193 aa, Glycine max
  Coding DNA Sequence Number=SeqID_102651
  Gene Ontology: Mol. function=protein serine/threonine kinase activity; Biological process=protein amino acid phosphorylation
  Homolog annotation: Hit_ID=Q2HT01; Match level="QueryCoverage=80%, HitCoverage=28%, E-value=3e-40, Identity=53%"; Hit description =Protein kinase
  Subcellular localization annotation: CTP_CleavageSite=36; ConfidenceScore=5.13e-01
MGICHGKPIETQQSQRETNTPSEFPSELQTPTKTPKSSSKFPFYSPSPLPSWFKNSPSSNSNPSSVSSTPLRIFKRPFPPPSPAKHIRALLARRHGSVKPNEASIPEASECELGLDKSFGFAKQFSAHYELSDEVGRGHFGYTCSAKGKKGAFKGLNVAVKVIPKAKVPLLAWLENGVAIESTPRVMIGGGII

SEQ ID NO: 219430 - protein, 550 aa, Glycine max
  Coding DNA Sequence Number=SeqID_102652
  Gene Ontology: Mol. function=RNA-directed DNA polymerase activity; Biological process=RNA-dependent DNA replication
MVKKEITDMLCLQETKVEQMDKSICQALWGDLERKTRDHDFIYLEGMWVPDGQKMSIVNIYSPCDVAQKRNLWEQIRQLRNSSFGGNVEEFSDWIAELDFEDVPCVGRKFTWYKPNGTAKSTVLNCWFQDKSFKKVVQECWAADHIRGWGGFVLKEKLKAIKARLKVWNKEQFGDMQKKIQRIERELNKLESEGDERLLSDDELLTRKKLQLWITAQSHESLLRQKARGMLVDGAWIAEPGMVKEGIRLFFKNRFEEFFANGVFLKGSNASFLALIPKVHDPQNRNDFRLISLVGCIYKIVAKVLARRMKEFMKQRGETNRAWCLKFISKRPMIQFSRISERWKEDAAMFLNCSLLAIPFLYLGIPIGTNPRRSERKFAWVKWDSVCLPKEKGGDKVESWVWSMGAILEDGWKDDGVPLMLKYFRLQPLFDAEIDLASKFLEEVDGIIIYLDRVDNWTWKGDSSGVYTVGNAYTMLMGDYTDENQDGAFSVLWKSAIMVGSFVLDKHIGSIFPMSEITFPFACAWKDIWCLVPAMTMLVDILDMEYLAAL

SEQ ID NO: 219431 - protein, 412 aa, Glycine max
  Coding DNA Sequence Number=SeqID_102653
  Pfam annotation: Domain name=RRM_1; Domain location=1-62; Score=7.1; E_value=0.032; Accession=PF00076.12; Description=RNA recognition motif. (a.k.a. RRM, R
MSEKELWYEFKKWGDVRRVFIARTRNRIGKRYGFVRFKGVGDVRRLERQLDNLIVRGLKLHVNIPKHGRVRMLRGETNANVKYRIGATKHGVKSELNACEPNGNKLLLVSASEHTCREMDMTQRSGALINGEEYTVYMVEETCYNPDRCKWWTGSSIGVSIELSSDDSKVGTPWLDDEVILENESLAALSVMLADGDEQVRGEDARQQTSGQNSCHGPLGNNLRLLTRSQNLVALEGTSGPTVADKSKIGEVTRGQSEADGAEAGVNRSFTQQRRFGEKYTEGVTITTISKEKEDKNGKNWKQSDAVNGVKNNNESGPLMGHTKNTNTGINEGADGNMEVTEWEEQDKGQHEPCALPDSKYNETCNQIKEVTSYWVMAQDLGVTCGEREESLITTMINLEERDKIEADKMGK

SEQ ID NO: 219432 - protein, 879 aa, Glycine max
  Coding DNA Sequence Number=SeqID_102654
  Homolog annotation: Hit_ID=Q2HT01; Match level="QueryCoverage=49%, HitCoverage=46%, E-value=1e-83, Identity=92%"; Hit description =Protein kinase
  Pfam annotation: Domain name=Pkinase; Domain location=288-571; Score =29.1; E_value=2.7e-10; Accession=PF00069.15; Description=Protein kinase domain
  Pfam module annotation: Pfam domain module=Pkinase::RVT_2; Domain location=288-571::277-504
RVANFTTDEVETMLLEHEYRIDRAKKRSLVSVNLSEGNFRANDSSQPSNSNSQGCFADVQCQVCHKWEHDSSASHHVTNMFQNIQQLTPFEGPDQITIGYAQGLNINSSSNAKEILLQGLVGHDGLYQFPALQSLVPRTSQSLSTSDSVVPIVDTASYPSPSFSMTWQFCTNYYAPHPSPKWGSGKEASTYSGTWSTLFSQANMPLNYCDHAFTSSDYLINQLPSSSINHEFNLAMYTQCVLVPNLALLNQESIQNDFSPILNPTKSALSNPAWFAAVKAEVKENPDGTVNKYKARLVAKGFHQQLGYDYNETFSPVIKLVTVRLILSLALTYKWPLQQLDDVNNAFLNGTLQEEVFMTQPPGFDSSNKQLVLNKALYGLKQAPRAWFDKLKATLFQFKFSSSWCDPSLFVYSEQNSVVYILVYVDDIIITGNNSNLIQSLNFLFTSKDDKSTLKAIDFGLSDYVKPDERLNDIVGSAYYVAPEVLHRSYGTEADMWSIGVIAYILLCGSRPFWARTESGIFRAVLKADPSFDEAPWPSLSVDAKDFVKRLLNKDYRKRLTAAQALSHPWLVNHHDDMRIPLDMIIHKLVKAYICSSSLRKSALRGRKIRQGTRESVSVTEHRSSKPCYAKTSTVPLNLSLLLCSFNHKDLILMTEKLKGKVPLRLLKAKCKTCKPEIILKKSGREGAYDDLQVLSLSLNKLTGPVPASLLGLLWLKVVNLTSNLFHGPMSVFAHWVEVDNAPGCNNFCLPSLGDCDPRMELLLSVALAKTLTVAQLAYLRDQFTLLGPNKSGLISMQNFKTAVLRSSTDASKDSRVLDYVSMVSSIQYRKLDFEEFCAAAISVHQLEGMETWEQHARHAYELFKKEGNRPIMIEELAS

SEQ ID NO: 219433 - protein, 62 aa, Glycine max
  Coding DNA Sequence Number=SeqID_102655
MGRYARLKVKIERHYEVTFLLKCKTCYQHGLCMKKGRAFNASINCSNDLKTLDEEQSKESIH

SEQ ID NO: 219434 - protein, 85 aa, Glycine max
  Coding DNA Sequence Number=SeqID_102656
  Homolog annotation: Hit_ID=Q94BM7; Match level="QueryCoverage=72%, HitCoverage=7%, E-value=3e-21, Identity=75%"; Hit description =Putative phytochrome A supressor spa1 protein
MWEIFILNTPLVPKTISRMSSLQVFIYHKAFPMPALSFKFYSSDPLSGNEEDDSAQFITSVCWRGQSSTLVAANSTGNVKILEMT

SEQ ID NO: 219435 - protein, 214 aa, Glycine max
  Coding DNA Sequence Number=SeqID_102657
  Gene Ontology: Mol. function=transferase activity, transferring acyl groups, acyl groups converted into alkyl on transfer; Biological process=carboxylic acid metabolic process
  Homolog annotation: Hit_ID=Q30DX9; Match level="QueryCoverage=43%, HitCoverage=22%, E-value=9e-26, Identity=48%"; Hit description=2 -isopropylmalate synthase 1
MEYKLRMSKDKAVNISCNMVKFGRSLGCNDVKFSAQDTRMLDREFLYEILGEVIKVGATMLNIPDTVGVRAGARQLEVTINGLGERAGNASLEEPFFFSFLPRASSFLSFAGGPFFLLPHSSASPFASPTQGGCSSSVQAVASPSFKCASSSILPRGVALLFFIEMIRRLCLCCVLGDPQIGQMIRRLCLCCVELADHVDPQEENVDPRASYGS

SEQ ID NO: 219436 - protein, 132 aa, Glycine max
  Coding DNA Sequence Number=SeqID_102658
MKALNSWISPLIVPELAIWYRFPQLYTLCYPIPANPIIKFTSKEVIFGSKNRAITYNQGFSKKVEDRDEFEGGVDGIDIVGVEGGVDGGDDAGEEGLVEFPHVLDGARNLLLQRQQKNMKNRHRYVANSLLL

SEQ ID NO: 219437 - protein, 711 aa, Glycine max
  Coding DNA Sequence Number=SeqID_102659
  Gene Ontology: Mol. function=protein kinase activity; Cellular component=nucleus; Biological process=protein amino acid phosphorylation
  Homolog annotation: Hit_ID=Q9LJR3; Match level="QueryCoverage=97%, HitCoverage=81%, E-value=0.0, Identity=55%"; Hit description =Photomorphogenesis repressor protein-like
  Pfam annotation: Domain name=Pkinase; Domain location=23-257; Score= -89.7; E_value=0.0032; Accession=PF00069.15; Description=Protein kinase domain
  Pfam annotation: Domain name=WD40; Domain location=484-522; Score =14.7; E_value=0.33; Accession=PF00400.22; Description=WD domain, G -beta repeat
  Pfam annotation: Domain name=WD40; Domain location=534-572; Score =1.7; E_value=23; Accession=PF00400.22; Description=WD domain, G-beta repeat
  Pfam annotation: Domain name=WD40; Domain location=589-627; Score =11.6; E_value=1.6; Accession=PF00400.22; Description=WD domain, G -beta repeat
  Pfam annotation: Domain name=WD40; Domain location=632-669; Score =30.9; E_value=4.6e-06; Accession=PF00400.22; Description=WD domain, G-beta repeat
  Pfam module annotation: Pfam domain module=Pkinase::WD40::WD40::WD40:: WD40; Domain location=23-257::484-522::534-572::589-627::632-669
MGDISLRLWLDKPERSVNVFECLHIFREIVEIVHAAHSQGIVVHNVRPSCFVMSAFNHVWLIESATCSHSGSDTLEEAVEIKTPTPTSIHDMHQRRCLGSEDFVPVKTSTASLTDSSCMLSSVVFLAPASSVDDTEENKMKNRRKDEEVAGKKQSFPTKQVLQMETSWYTSPEEVAGTSLPSCASDVYQLGVLLFELFCPLISREEKRRTMSSLRHRVLPPQLLLKWPKEASFCLWLLHPEPNSRPTIGELLQSEFLNEPRDDIEKCEAVVEIGERIDDQELLLEFLSLIQQKKGEAAEKLQHTISFLCSDIEEATKQKTVFKEMTSTELGSDDCSTSSFPSITVVGNEDSACLGTRKRVRTIPCVDDTDTEGCECDSNMVDDQKNDTSILSKTPRFLNNLKKLESAYFLTRCKSAYSSRKLVVQDSPIDITDEKGSVVVAERNCANKVELKEMSREGKSLWTNPFLEGLCKYLSFSKLKVKADLKQGDLLQSSNLVCSLSFDRDAEFFATAGVNKKIKVFECNTTINEYRDIHYPVVEMVSRSTLSSTCWNTYIKSQIASSNFEGVVQLWDVTRSQVQSEMKEHERRGVSVGTIKTKANVCCVQFPLDFAHFLAFGSADHQIYYYDLRNLKVPLCAMVGHDKTVSYIKFVDTMSLVSASTDNTLKLWDLSMCASRVIDSPIQSFTGHKNVKEYRLWHFVGMLTKTLFRMT

SEQ ID NO: 219438 - protein, 53 aa, Glycine max
  Coding DNA Sequence Number=SeqID_102660
MDYAGLTHGLPATRIRFDLCDLDPIILGKGDEDVEMEKAQATSNMESLVVGDV

SEQ ID NO: 219439 - protein, 80 aa, Glycine max
  Coding DNA Sequence Number=SeqID_102661
MDHRKEKENNAYKWKIFVNYGADSSKIWKNNIGPQKRSKFSHLVPNVHQIYGERKRERGIVTIEVCSVSTRPSYTKLSGF

SEQ ID NO: 219440 - protein, 268 aa, Glycine max
  Coding DNA Sequence Number=SeqID_102662
  Gene Ontology: Mol. function=protein kinase activity; Cellular component=nucleus; Biological process=protein amino acid phosphorylation
  Homolog annotation: Hit_ID=Q9LJR3; Match level="QueryCoverage=94%, HitCoverage=38%, E-value=7e-62, Identity=43%"; Hit description =Photomorphogenesis repressor protein-like
MTSTELGSDDCSTSSFPSITVIENEDSACLGTRKRVRTIPCVDDTEGCERDSNMGDDQKNDMSILSKTPRKLVVQDSSIDTTDERGSVVAAERSCAKKVALKEKKFREDKSPWTNPFLDGLCKYLSFSKFKVKADLKQGDLLQSSNLVCLLSFDRDAEFFATAGVNKKIKVFECNTTIYEDRDIHYPVVEMVSQSTLSSTCWNTYFKSQIASSNFEGVVEGVSVGTIKTKSNVCCVQFPLDFAHFLAFRSADHQIYYYDLRNLKVPLV

SEQ ID NO: 219441 - protein, 249 aa, Glycine max
  Coding DNA Sequence Number=SeqID_102663
  Homolog annotation: Hit_ID=Q42384; Match level="QueryCoverage=42%, HitCoverage=19%, E-value=7e-21, Identity=54%"; Hit description =PP1/PP2A phosphatases pleiotropic regulator PRL1
  Pfam annotation: Domain name=WD40; Domain location=100-138; Score =17.6; E_value=0.046; Accession=PF00400.22; Description=WD domain, G -beta repeat
  Pfam annotation: Domain name=WD40; Domain location=142-192; Score =30.9; E_value=4.5e-06; Accession=PF00400.22; Description=WD domain, G-beta repeat
  Pfam module annotation: Pfam domain module=WD40::WD40; Domain location=100-138::142-192
MEGTVFLSINVGGDFAHFPPLEDAPVSLTSLTRKRLRWKFDYVVSLCHNDFTEILDAYERGDRFYLYTKRGPSSEALHLGHLIPFMFTKFGKTQLAHTLCVSTQVISGHLGWVRSVAVDPSNISWLFCSSCSFGQLWDLASGVLKLTLIVHIEQVRGLAVSNRHTYMFSAGDHKQNPQVVTGSHDTTIKIWDLRYGNLWLYFSYLLACLCSDYMHNLTHVAFIFIQAATRYLSDKITTQIDSNKVFYKY

SEQ ID NO: 219442 - protein, 129 aa, Glycine max
  Coding DNA Sequence Number=SeqID_102664
  Gene Ontology: Mol. function=nucleic acid binding; Biological process= DNA integration
  Homolog annotation: Hit_ID=Q1SLU0; Match level="QueryCoverage=90%, HitCoverage=15%, E-value=2e-17, Identity=34%"; Hit description =Peptidase S8 and S53, subtilisin, kexin, sedolisin; Integrase, catalytic region
MEANTTHIIPPPVFDGEEYDLWAARMTTHLKALDLWELIEEDYAVWPLPENPTSMKETATIKSYVDKPLSIANKVRLLGKNFPDKRIVQKIIVTRLREKCTSYCSEKHRHQTALLVLDSREMLKKVPSN

SEQ ID NO: 219443 - protein, 237 aa, Glycine max
  Coding DNA Sequence Number=SeqID_102665
  Gene Ontology: Mol. function=transporter activity; Cellular component= integral to membrane; Biological process=transport
  Homolog annotation: Hit_ID=Q1RVU7; Match level="QueryCoverage=79%, HitCoverage=51%, E-value=5e-44, Identity=44%"; Hit description=IMP dehydrogenase/GMP reductase
  Pfam annotation: Domain name=Ank; Domain location=19-49; Score=25.8; E_value=0.00015; Accession=PF00023.20; Description=Ankyrin repeat
  Pfam annotation: Domain name=Ank; Domain location=53-85; Score=7.3; E_ value=2.7; Accession=PF00023.20; Description=Ankyrin repeat
  Pfam annotation: Domain name=Ank; Domain location=99-130; Score=28.8; E_value=2e-05; Accession=PF00023.20; Description=Ankyrin repeat
  Pfam module annotation: Pfam domain module=Ank::Ank::Ank; Domain location=19-49::53-85::99-130
MVLRLVEMNKDLVRVKGREGFTPLHLASQENKTEVLDKFLKACPDSVEDVTARSETALHIAVKHGHYETLQVLFRWLMRNSRKDSHKFIRTMLDWKDQKGNTVLHVAALNDHIEAVSLLLTMVDLDAKNLEGKTASDIASSEHMRSILIRDPGFRWHMTEEESNTYLVVVALIATAIYQVALSPPGGLYPSNGLEEQNCLPGSCECHFTFDLQWLEVEDEDVRVLFTVLELLIYIVN

SEQ ID NO: 219444 - protein, 88 aa, Glycine max
  Coding DNA Sequence Number=SeqID_102666
MASLLYDVHDFDLYKIPSDSDMKLLLLQMTSSWAVKSIITALQANGSPYVKDLLKLYDLGASFSCLLDATLDLELMETVGNLYGTANL

SEQ ID NO: 219445 - protein, 128 aa, Glycine max
  Coding DNA Sequence Number=SeqID_102667
MKGIKCPKCKASEEDYRLKIYKLKIWLKINLIDITTIKLKISLIAKDIIKDKSNRYNNYIKSKYIIISSNTLSQPTLLRVSEARLTGASSNGGKCAESPPTFIERKTLEKPKETGHQEYSRFGSYLYV

SEQ ID NO: 219446 - protein, 80 aa, Glycine max
  Coding DNA Sequence Number=SeqID_102668
MERKKTQYFILHPFGYESFILSIKDQGVATCTQHYCWGTQQTVKWRNCPSAIILPEEGSSGKVPEIIFPESFRKNLLPED

SEQ ID NO: 219447 - protein, 88 aa, Glycine max
  Coding DNA Sequence Number=SeqID_102669
MGLRKVKSEMVKTSRKLRIEMVSGCCQILTADRLSCGSSYVKKPLIGELKGTQRDSVMIKYPAWIGHHYPPPPATSSPPLALLATICR

SEQ ID NO: 219448 - protein, 107 aa, Glycine max
  Coding DNA Sequence Number=SeqID_102670
MMRQSKVNDPTSNLPVITDHTVSTMTRIIKLPVINNSALKRNTLNGVDDHGDDKEGATGVVGASDGPWRRWPAVVVVVEEPFCFFIDSAIGGSFCRFQSMESKEDRK

SEQ ID NO: 219449 - protein, 275 aa, Glycine max
  Coding DNA Sequence Number=SeqID_102671
  Subcellular localization annotation: CTP_CleavageSite=43; ConfidenceScore=5.61e-01
MTFKGPRKAMGKRSEAPLTSTAPDTSAPSLPDPSTAPSITVPSSSTAAPLSAPSVPAPLIGPSSFTSETLFAMLQSLHRGQIIIIHRLQSSSQQPSMSMEEFLTQVAWPGVQPSPSRGGEASAAHEFVPDVEDEPVPPKPFIFETNPVTQEEATAHDPISPIHISPAPISEDTGHGARAAHFSGLFVNDLNEQMYELNGLECLDFALIKLAAIRREEKEHVIRCMTENASQFVRLIVKECIDRIPVSVMMKAMFDCDSHLAKKLTTCLNDLSLAP

SEQ ID NO: 219450 - protein, 367 aa, Glycine max
  Coding DNA Sequence Number=SeqID_102672
  Gene Ontology: Mol. function=hydrolase activity, hydrolyzing O -glycosyl compounds; Cellular component=membrane; Biological process =carbohydrate metabolic process
  Homolog annotation: Hit_ID=Q6NKW9; Match level="QueryCoverage=97%, HitCoverage=74%, E-value=1e-158, Identity=74%"; Hit description =Putative glucan endo-1,3-beta-glucosidase 8 precursor (EC 3.2.1.39) ((1->3)-beta-glucan ...
  Homolog annotation: Hit description=endohydrolase 8) ((1->3)-beta -glucanase 8)
  Pfam annotation: Domain name=Glyco_hydro_17; Domain location=26-346; Score=255.8; E_value=8.8e-74; Accession=PF00332.9; Description =Glycosyl hydrolases family 17
MGKGWFLRLVMVIGVMGWCWWCVEGLGVNWGTQATHQLKADTVVEMLKDNGIQKVKLFDADESSMSALSGSGIEVMVAIPNNQLAEMNDYDRALQWVKKNVTRYNFRGGINIKYVAVGNEPFLKSYNGSFLNITLPALQNIQNALNDAGLGDSIKATVPLNADVYESPPNNPVPSAGIFRPDISDLMTQIVQFLAKNNAPFTVNIYPFLSLYGNDNFPFDYAFFDGVANPINDNGVSYTNVFDANFDTLVSALEKVGYGNMPILVGEVGWPTDGDKNANVGNAFRFYNGLLPRLAINKGTPLRPGFIEVYLFGLIDEDAKTIAPGNFERHWGIFGYDGKPKFPMDLSGKGQNKLLVGAQNVHYLEPN

SEQ ID NO: 219451 - protein, 87 aa, Glycine max
  Coding DNA Sequence Number=SeqID_102673
METYSTYLCCSLYTRHFSFFGRKHLSKNLLDNRLIFKIVIFKGEVGLDSLTPENNQIKAQITQDNQKCRVEYQQNQPFHGQNQKREN

SEQ ID NO: 219452 - protein, 212 aa, Glycine max
  Coding DNA Sequence Number=SeqID_102674
  Gene Ontology: Mol. function=amino acid-polyamine transporter activity; Cellular component=membrane; Biological process=amino acid transport
  Homolog annotation: Hit_ID=O22778; Match level="QueryCoverage=50%, HitCoverage=24%, E-value=5e-24, Identity=53%"; Hit description =Putative tyrosine-specific transport protein
  Subcellular localization annotation: CTP_CleavageSite=89; ConfidenceScore=5.16e-01
MLLSKPIFFSYKPFTCPKINGTVHFVGHITNLQTSYKTTIALIFITNGSNAPVTTNFAPCNAITFTTPSPEDNANNGNNANNPTKNEVPDETSKGKSFWGAVGLIIGIVVGPGMLALPSLTIKFGPFPSTIIILASWLYFISSIIIVAELRFDSMGEHGVEEVSFTSLATKTLGSGFGAFVALVYSTLSFSLLVGGLIIDVVNRLLCLLMLL

SEQ ID NO: 219453 - protein, 298 aa, Glycine max
  Coding DNA Sequence Number=SeqID_102675
  Gene Ontology: Mol. function=DNA binding; Biological process =regulation of transcription
  Homolog annotation: Hit_ID=Q9SQQ9; Match level="QueryCoverage=96%, HitCoverage=68%, E-value=6e-52, Identity=45%"; Hit description =Transfactor-like
MEAATGISEASGVQMKHLSIGLQTNKNSEINDALQMQIEVQRRLHEQLEVQRHLQLRIEAQGKYLQAVLEKAQETLGRQNLGAEGVEAAKVQLSELASRVSPQSLDSKFSELKELQVLWPQQTQEGQATDCSMGSFLNYSEESQRDRETHSMNLNLRACNGPPFSVSKGCAEESMHLKPDYRLCDEVKENMMFLSSSSNSKVVKGDFLSERPSSLLSMNVGVQEEENFGRTTVPKEEGWKRRESTETGRVPVKLNYEKISQDYRLANFDVKLDLNSHDDNDASSHCQQFDLNGFSWNC

SEQ ID NO: 219454 - protein, 336 aa, Glycine max
  Coding DNA Sequence Number=SeqID_102676
  Gene Ontology: Mol. function=zinc ion binding; Biological process =cell redox homeostasis
  Homolog annotation: Hit_ID=Q1S8X5; Match level="QueryCoverage=87%, HitCoverage=85%, E-value=3e-44, Identity=34%"; Hit description=Zinc finger, RING-type; RINGv
  Pfam annotation: Domain name=zf-C3HC4; Domain location=226-266; Score= 41.5; E_value=3e-09; Accession=PF00097.15; Description=Zinc finger, C3HC4 type (RING finger)
MENDIEGVHWCNICSKMVNPMSDDENICPFCETEISEVMDNLRDQNDVVDLRSAWVFSLYAPIFLGLMGVFSPSLARIASHGGSSSRGVEEEVEQERENELVLGRRRRTSTYMMHLFRGLHVRMVSELENPEDNRNMDGRSILVIDPFSEGALILRGPNLSHTSSPNESNAVGSSLNDLVVGSGFDLLLQHLAQIGPGGYSSVNPPAQKAAIEALPSVTSEEKLQCTVCLEDVEVGSEAKEMPCKHKFHGDCIVSWLKLHGSCPVCRFQMPSEDSTLEANVGVGNGDNQNSELVRAGEERPRNGRRNCRGCGCGCGLLVILDFVRNCKKMRLMLQL

SEQ ID NO: 219455 - protein, 67 aa, Glycine max
  Coding DNA Sequence Number=SeqID_102677
MKKLLNNEVFSPPLTWRAHYKAKNKTFELLRLRMCVQRACLADRELVTRRLADGSSRVVRADFLAKQ

SEQ ID NO: 219456 - protein, 152 aa, Glycine max
  Coding DNA Sequence Number=SeqID_102678
MASIKFGTVAGEQCPKCMTRGNPSDLQPFDPAIDRTLHRLVRHHFVPFEHPKHSVIGETEHFVVGNFEHPDFEHFENMAQPPPRERTLWEMAAPDFTYESLCIQYPDEDVPYVLKTGLIHLLPKFHGLVGEDPHKHLKEFHIVCSTMKPPDV

SEQ ID NO: 219457 - protein, 185 aa, Glycine max
  Coding DNA Sequence Number=SeqID_102679
  Gene Ontology: Mol. function=ubiquitin-protein ligase activity; Cellular component=ubiquitin ligase complex; Biological process =protein ubiquitination
  Homolog annotation: Hit_ID=Q9LF41; Match level="QueryCoverage=76%, HitCoverage=13%, E-value=7e-54, Identity=75%"; Hit description =Ubiquitin-fusion degradation protein-like
  Pfam annotation: Domain name=U-box; Domain location=88-162; Score =156.3; E_value=8e-44; Accession=PF04564.6; Description=U-box domain
MAGHTMIRQVLWDFSYTAYCSQEILFCLYYHTRKCNLTGNSLQLFSAGADVLHRIGEDGRIIQEFIQLGAKAKVAASEAMDAEATLGEIPDEFLDPIQYTLMKDPVILPSSRITVDRPVIQRHLLSDSTDPFNRSHLTADMLIPDDALKARIEEFVRSQEMKKHLSLQSTKATIQTTNGETMLVD

SEQ ID NO: 219458 - protein, 342 aa, Glycine max
  Coding DNA Sequence Number=SeqID_102680
MGETHEIPHHNLADFEPCLGYAIEGQAVDVIPLQNTLEGPQYHPQPHPLHSTAGKNPHAMAEMGKLDHLEERLRAIEGGEDYAFANLEELFLVPNIITPPKFNVPDFDKYKGTTCPKNHLKMYCRKMGAYAKDEELLIHFFQESLTRAAVTWYTNLEPSLVHSWTDLMVAFVGHYQYNFDMAPDRMQLQSICKRGHVLAFRGLHALTLPSEEYTSSPSEDYVSSPSKGYTPSPSEDYTSSPPEDYMSSPSEGYTPTPSESYTPSPYFQRTTRLHHQRTTRPRLQRATHPRLMRAARLLLQRTPRPRLRRATSLAFGGLHALTFRGLHALAFRGLYVLTFRGL

SEQ ID NO: 219459 - protein, 504 aa, Glycine max
  Coding DNA Sequence Number=SeqID_102681
  Gene Ontology: Mol. function=zinc ion binding; Cellular component =nucleus; Biological process=regulation of transcription
  Homolog annotation: Hit_ID=Q1SQ40; Match level="QueryCoverage=99%, HitCoverage=100%, E-value=1e-140, Identity=55%"; Hit description =Zinc finger, Dof-type
  Pfam annotation: Domain name=zf-Dof; Domain location=122-184; Score =142.6; E_value=1.1e-39; Accession=PF02701.6; Description=Dof domain, zinc finger
MSQKEKGPGIRLFGRKIPVPECQIPANSGPTYLIENEYNMIILFLLSLSIFSDTCCSIKKTELKIPSECGENSEQQENSSDSRDSKQESQHKVQENEPIVNPKPVEDNMETGSSDQDKVLKKPDKILQCPRCNSMDTKFCYFNNYNVNQPRHFCKNCQRYWTAGGTMRNVPIGAGRRKNKHLASQYQHIIVTSDGIPASRLETTDSSGLQQQHIASLESSVSFRSSADNCTMLKFGTDTPLCKSMDSMLNLRDQRRCADASSISCVEYRGEPSLCGSSVMTNGAQGNELSEHNTSNWLQCYPVPPWVLPYPGWNNVNSMEAVHRSSAPMCNPYNNTGPTAMQWCPTPMVAIPGMCPPSIPLQFVPPSYWSGTPLWNAGTGAVSIGSNACLSPTSSTNNSCCSGNGSPTLGKHTRDTVCTDEEKSEKCVLVPKTIRIDAPNEASKSPIIRATLAIKLDKQQFVSNGDILKKIEPKEGKDRVLGASQILEANPAAISRAHAFQESL

SEQ ID NO: 219460 - protein, 52 aa, Glycine max
  Coding DNA Sequence Number=SeqID_102682
MVGPTIEGHRDGRRRGLSVRGLRRGGRWRERARFSEGEERSTLNGERGCPKG

SEQ ID NO: 219461 - protein, 100 aa, Glycine max
  Coding DNA Sequence Number=SeqID_102683
MVASGTNQLQPTLSLPEKPSKLGFNLGATRGNSLCDKVNLHMVRVEENDGEVGGIGIGIGILGEFVKGFSGVVLPKFLAEVEGFVGFEGESVEGADGDML

SEQ ID NO: 219462 - protein, 428 aa, Glycine max
  Coding DNA Sequence Number=SeqID_102684
  Gene Ontology: Mol. function=DNA binding; Cellular component=beta -galactosidase complex; Biological process=DNA integration
  Homolog annotation: Hit_ID=Q1SS89; Match level="QueryCoverage=99%, HitCoverage=67%, E-value=3e-81, Identity=47%"; Hit description =Integrase, catalytic region
MDVTFIELENFFAFQSSHSSRLGEMMSEEQNWEDWPGFEASNDVGVEVQPRELETISIDQRKETEDVENNEQVIAEIEESAETESEQPLLVEVETESEQPFHDLTVPQSESPENISEVQVLNSPQNIFDGYKLPFRHNRGQPPNRYSADHETSKSKHPIANYVSTHKLSKPFKALVYNLSANDVPYTVNEAMKNPKWIQAIEEEMKALQENNTWSLVPLLEGKKTMGLEKLNTIRVLISLAANLDWPLHQFDVKNAFLHGDLEEEVYMDIPPAWFGRFSFAMRKHGFKQSHSDHTLFLKHQQGKVTALMIYVDDMIITGNDEKEISRLQEHLATEFEMKNLGGLKYLKSSPGRGLMFAKKQHLHLQGYTNADWVGSVTDRKSTSGYLTFVGGNLVSWRSKKQKVVALSSAEAEFRGMAEGVCELLWLK

SEQ ID NO: 219463 - protein, 241 aa, Glycine max
  Coding DNA Sequence Number=SeqID_102685
  Gene Ontology: Mol. function=DNA binding; Biological process=DNA integration
  Homolog annotation: Hit_ID=Q1SD84; Match level="QueryCoverage=74%, HitCoverage=11%, E-value=6e-27, Identity=31%"; Hit description =Integrase, catalytic region
METPTIRVLKQEEENSLLAELTARMTQALNLNPTQSQSSSSKAAIQIGIKLDDPAFKKWRTKNAVVKGWLINSMDLKLVSNFIRFLTAKAIWDSIATTYFDGSDTSQVYDLKRRVTKLKQGDRSIETYYNNLQGLWREIDFRRPNPMICDADIQRYNLILQEDKVYTFLDGLDDRLDKIQAHVLQMQPFPMVEQAYALVQREDLRQFVMMVNEDIASRGAMLSRRGHKPQHRLSLQITSNV

SEQ ID NO: 219464 - protein, 113 aa, Glycine max
  Coding DNA Sequence Number=SeqID_102686
  Gene Ontology: Mol. function=catalytic activity
  Homolog annotation: Hit_ID=Q2QZ87; Match level="QueryCoverage=48%, HitCoverage=14%, E-value=8e-18, Identity=81%"; Hit description=ATP -citrate synthase, putative, expressed
MVAGGGASATYVDTVGDLGYASEPGNYAEYSGAPNEEEVLQYARVVIDDIQTHDLLPALDNIYDLFTTCMIGYGQNLVWNWMDSSIKGSGKTINVGDPVYILGNVSSTEEAAA

SEQ ID NO: 219465 - protein, 156 aa, Glycine max
  Coding DNA Sequence Number=SeqID_102687
  Gene Ontology: Mol. function=peroxidase activity; Biological process =response to oxidative stress
  Homolog annotation: Hit_ID=Q1SQ39; Match level="QueryCoverage=98%, HitCoverage=85%, E-value=2e-16, Identity=33%"; Hit description=Haem peroxidase
  Pfam annotation: Domain name=peroxidase; Domain location=1-118; Score= -71.3; E_value=0.001; Accession=PF00141.13; Description=Peroxidase
MAEKDSGTNDSVRGYNLIDEAKKTLEAACPSTVMCRHHNPSNQRHRGLIKRTQIQPLDGKTRQIISLLAESRAKPDPTMDPALNAKLEILAKKGLLQIDQQLALDAGTKGFVLDFASNGDKFQKGFANAIVKMGEIDVLVGNQGEIRKKCSVFNRN

SEQ ID NO: 219466 - protein, 150 aa, Glycine max
  Coding DNA Sequence Number=SeqID_102688
  Gene Ontology: Mol. function=DNA binding; Cellular component=nucleus; Biological process=regulation of transcription
  Homolog annotation: Hit_ID=Q6YTS9; Match level="QueryCoverage=52%, HitCoverage=23%, E-value=3e-08, Identity=41%"; Hit description =Proline-rich protein family-like
MNFTKQRIRKVKIKSNRKGGIHIVQAPDVAVVVDLRVQILIIVIILIIVITIIGIVFGFNRGGTFLHGVHELEVDQGGVESRNVEGANVLDLGAVALAELLHFVAALDGGFGRGGTGAAACDGISNLLPVGGLQVVALRVMTLRLSTVTS

SEQ ID NO: 219467 - protein, 112 aa, Glycine max
  Coding DNA Sequence Number=SeqID_102689
  Homolog annotation: Hit_ID=Q00M75; Match level="QueryCoverage=27%, HitCoverage=5%, E-value=1e-09, Identity=96%"; Hit description=PPR -repeat containing protein
MLQIAKLLTQKDRSYNFHWSVYGVILRASPGVAVKLCLGDLLVMGSNPETASLHMQGRCRQQGHSLVAQHGRRDERQPLDVARKQNAEVKKRMNSSRTREGEGEGERQETGF

SEQ ID NO: 219468 - protein, 56 aa, Glycine max
  Coding DNA Sequence Number=SeqID_102690
MEMRNQPFMKTVCNLNQERTKVIDTVRVYDLNEVIATEKSENEGLKVVRESVGGEK

SEQ ID NO: 219469 - protein, 119 aa, Glycine max
  Coding DNA Sequence Number=SeqID_102691
MMHAPDSTLRCNVVISLGAQRSSLPGDKPPQYKVHSATATLFPMNMAKTSAKDPGRSVHFAPHEHTQHPTYERGPKQVPKTLEGQYTSLPHEHTQHAHANAFPTFHFHVILNIKIISSQ

SEQ ID NO: 219470 - protein, 54 aa, Glycine max
  Coding DNA Sequence Number=SeqID_102692
MSYLKIKIVGVLTEHDEKNIALQNAGTTPGRGGSNVFEVQGQPLREALPSFRLL

SEQ ID NO: 219471 - protein, 365 aa, Glycine max
  Coding DNA Sequence Number=SeqID_102693
  Gene Ontology: Mol. function=nucleic acid binding; Biological process= DNA integration
QQVLATIRGLKLSKYLHEEHVPKKFESKEYEEAAPILTKMVGLEQSWQIWKRLEVYYASQTHAKVKKLKVQLRMITKDKSISKYLLAIKKIVDSLVAIGSAISDDDHIEAIFYGLPEYCYFANTAFGPSYSSGRGRRDNSNFRGEYNNLGGRSNFRGGYNSNRGGRYNNGRGNDRSNKDKIQIILGIRTIDYNVKFANFQVNHSQYQCFSQSDQAFMSTPTTVMDPLWYPDSGASHHITNDESNLSVKTDYTGNDRVKIGNGSDNQVFFEFHANSCNVKQEHAKETLLQGKFSKGLYVFPNLQHQNHISAFHSTTNSSFTVLELWHSRLAHASLKAARQLPFFTSQSVYASPLDLILQIFGVQPP

SEQ ID NO: 219472 - protein, 188 aa, Glycine max
  Coding DNA Sequence Number=SeqID_102694
  Gene Ontology: Mol. function=DNA binding; Cellular component =mitochondrion; Biological process=DNA integration
  Homolog annotation: Hit_ID=Q1T4S3; Match level="QueryCoverage=69%, HitCoverage=8%, E-value=4e-36, Identity=53%"; Hit description=Zinc finger, CCHC-type
MELAMPTKATSCSCLLKKLSKQLEGAKVEKTLCAFRIAFSRRIGDSVLICSSRKQTIVSRSSTEAEYRGLAAVTADILWLQHLLRELRVPVALPRIYCDNLGVVHLAANPVMHSRTKHFELDLHFVRNKVLSRELVVVHLSAEFQVVDILTKAISNPQFTIFKSKLKVSSTSTMILKGGVKENCQADN

SEQ ID NO: 219473 - protein, 88 aa, Glycine max
  Coding DNA Sequence Number=SeqID_102695
MELIIIITLLSFSFSYLIPTCSSSQIQLEPSLQLEDDNIGVNTNLQLSLPTVPRKLRFTEKVKEDDGARDLASHKQENSFAAAASLSM

SEQ ID NO: 219474 - protein, 495 aa, Glycine max
  Coding DNA Sequence Number=SeqID_102696
MGWTSIVLVDHLGEGNKVAFWHSNIGLEPESQAFVFIDDDQVSDGYKLQNQKVKEYENGVHAVLENNEEGLDSSQYHMESADCMKNEYEAKVKDLVEPVSHSTKDIESFMMFPNDIESVKRSPTSPISNPVKGRNSPWNPEDGYMDKTVTQCEPHLEVCYKESNYHVVKDICIDEGVLKKDKVMFLNPDDEKAHNFFPSDSYENKEKQKDNTSIGVLSLIPTGEKAHNFFPSESYENKEKQKDNTSINVLSLTPTKESDKDPANHDQPKDLMHKDEDATEKVSSNVNKETPLPEDKVLLQDLLAQDSVSSDDKGEQISNEPELHSQPEESKNTVEEAILETPSLALEDDESNNDNVLSEKGSFTHQLDPSVPSDCGKEDCHQAGVCKCDEIQQTMKPVEGKSDDQAVTGTVRHSLGEASFSAIGPMSGRISYSGPVPYSGSISLRSDSSTTSTRSFAFPIIQSEWNSSPVRMAKADRSHYRKQRWWKDSFLCCKF

SEQ ID NO: 219475 - protein, 41 aa, Glycine max
  Coding DNA Sequence Number=SeqID_102697
MEARVCGKSSQLQNVDTVPTPLAHSVFVLYAMDRAKSRFGI

SEQ ID NO: 219476 - protein, 137 aa, Glycine max
  Coding DNA Sequence Number=SeqID_102698
MDPRAPMWSCCFFFCVEFSWENSGWWENGIENKGVMMITVSGDKIKVAESDKDGDFGEKQLWELKDTRKSESERDTTTTEKLHIFGVKLNFDMRGRGENLMLQYTLLNLGYWRVGSGFRFTVANALIAEGEGGGCNV

SEQ ID NO: 219477 - protein, 407 aa, Glycine max
  Coding DNA Sequence Number=SeqID_102699
  Gene Ontology: Mol. function=RNA-directed DNA polymerase activity; Biological process=RNA-dependent DNA replication
ILGSSDVSSYVGVSGKLQLQKERKKELWIASLEMSNMNIGGKPRDCTELHIIGDCILGVKWKDVRKKVVGEGIQMLCIQETKKEDIVQGVCYVIWGSKEVKWGRRIPWTTRDLEEKNVVIIYMLLDIERKKKMLGRVENEEEFNEFVQMMKVVDIPLVGKKYTWYLPNGRACSPIDSVLVFEEWLFLWQGCTQFVMPRFFLDHCPIILMDNVIDWGAKPFRVLDSWLEAKVKNMIDKGGGSNSRYFHSMVRWKIRKNALRGVKIGGEWVDEPKRIKEEVERLFDEAKVKEAMCECGGDKSLGPNGLNFKFVKTFWNVLKKDITIFMREFHRNGVLPWGCNASFITLIPNVENPQSLSEFRLISLGLKFSPIHGAMMANNEVVDEARRRKKQCLIFKVDYEKTYDLVS

SEQ ID NO: 219478 - protein, 94 aa, Glycine max
  Coding DNA Sequence Number=SeqID_102700
MYLQLQRTTRPRRQRDYTSLPSEDYMFPIFKGGHALTFRGLHVLAIIGLHSLAFERRHVLNFRGLHALAFRGLRVLTFSVLHIRTLREFKVLYP

SEQ ID NO: 219479 - protein, 250 aa, Glycine max
  Coding DNA Sequence Number=SeqID_102701
  Gene Ontology: Mol. function=transporter activity; Cellular component= integral to membrane; Biological process=transport
  Homolog annotation: Hit_ID=Q93Q61; Match level="QueryCoverage=59%, HitCoverage=33%, E-value=6e-63, Identity=77%"; Hit description =Integral membrane protein
  Subcellular localization annotation: CTP_CleavageSite=19; ConfidenceScore=5.01e-01
MALPSGCPCLSNRNAPLPCAEMPMAWMAPAATPLADSTSRITSAAVRHSDAISRSAQPGCGATIARLRRATPCSWPRRSYNPALMKHQRQHGGDRQRSRQAVDADVLAEQADQDADHIRAAKAAEVAQRIDHAARAAGHFGVEQFGRDGPEHPGCRLNKHAAADQRSVRPPDVILQQHRQRHAGSKAGQRQGDEDFALAGAIGEGGDDQHAEDGADIGQDSEQAHLLHIAVGQPFQNGRQPQGVAVDTGL

SEQ ID NO: 219480 - protein, 67 aa, Glycine max
  Coding DNA Sequence Number=SeqID_102702
  Homolog annotation: Hit_ID=Q9M876; Match level="QueryCoverage=77%, HitCoverage=10%, E-value=2e-07, Identity=52%"; Hit description =Putative tyrosyl-tRNA synthetase
MNGVRDTQLVHVQGFNIKFRSYEGFFEVVVDAHGGAADERNIAVATVAKPGEDDEVEEVAKVGWKPQ

SEQ ID NO: 219481 - protein, 148 aa, Glycine max
  Coding DNA Sequence Number=SeqID_102703
MYILTCWKRQSCVATFGPNIRIYEIKKCLYSPLLSFKSISPWDRKYRDRSYCRSPYASRSRNKSRSYSLSNSYIHTPPLLGFAKNCLWREKYASHEALQNGGFNPFSFSLTFGNSIRAIRGKIEESQKIARDAAIAVGRHVIPLRGKG

SEQ ID NO: 219482 - protein, 152 aa, Glycine max
  Coding DNA Sequence Number=SeqID_102704
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=40%, E-value=2e-63, Identity=62%"; Hit description =Photosystem II P680 chlorophyll A apoprotein
  Pfam annotation: Domain name=PSII; Domain location=1-152; Score= -82.9; E_value=6.5e-07; Accession=PF00421.9; Description=Photosystem II protein
MALYELAVFDPSDPVLDPMWRQGMFVIPFMTRLGITNSWGGWNITGGTITNPGIWSYEGVACFGFGAFHVTGLYGPGIWVSDPYGLTGRIQSVNPAWGVEGFDPFVPGGVASHHIAAGTLGILAGLFHLSVRPPQRLYKGLRMGNIETVLSS

SEQ ID NO: 219483 - protein, 138 aa, Glycine max
  Coding DNA Sequence Number=SeqID_102705
MEADMEAMKEQMATIMEAMMSMKKIMEADAVAVAATRAVAKVNLMPPSDLNQMNHPTSDMVGKDLGSTDDPMMCKFKTSTPSRHMACLPTIRHPVWRTLPMRMSITPLLYPLRANNPKLVMHMSLKPWGRHMKFPTTI

SEQ ID NO: 219484 - protein, 100 aa, Glycine max
  Coding DNA Sequence Number=SeqID_102706
  Homolog annotation: Hit_ID=Q851B2; Match level="QueryCoverage=95%, HitCoverage=26%, E-value=2e-18, Identity=46%"; Hit description =Putative ATP synthase subunit
MWLHMKERSLTNKANQSKQEIKSIIGTKSIVQKAFEMKEHSISGEWPDAVKVWKVTHMRSNGTWCIPKGEEIMEALENVGDIYQEEISKAHVSLVEHFAM

SEQ ID NO: 219485 - protein, 141 aa, Glycine max
  Coding DNA Sequence Number=SeqID_102707
  Homolog annotation: Hit_ID=Q2HS46; Match level="QueryCoverage=51%, HitCoverage=55%, E-value=4e-08, Identity=38%"; Hit description =Polynucleotidyl transferase, Ribonuclease H fold
MQTVNQWKESYSFNQHLRSNPDDSTLTTWSPPQKNHRLKWQFHQSIDSNGKWSPSTPREAEAWALHQAINWTHELGMHNVIFELDCKLVVDNMVKNIKGSTDFHAILNRFRASFVISQRVSFVKRHANLVAYNSIRIKILC

SEQ ID NO: 219486 - protein, 57 aa, Glycine max
  Coding DNA Sequence Number=SeqID_102708
MDILTLGQGFGLRFGDEGDVPHYSHNTHATMMIRKFYAKLVMHAPMWTLKHQVFMVM

SEQ ID NO: 219487 - protein, 135 aa, Glycine max
  Coding DNA Sequence Number=SeqID_102709
  Gene Ontology: Mol. function=nucleoside-triphosphatase activity
  Homolog annotation: Hit_ID=Q2PCF1; Match level="QueryCoverage=99%, HitCoverage=8%, E-value=3e-19, Identity=44%"; Hit description =Pleiotropic drug resistance protein 2
MEEGVEADEVVRSLSSLRMNIGSLSRRSWVSETVPEMWGAGAGHGGDVFERSTRVDDDNDEEELMWAAIERLPTFERLRKSIVKRVLEESGRFNYEEVDISNLGFQGKKKLLHAILRNVEADNERFLRRMRERID

SEQ ID NO: 219488 - protein, 90 aa, Glycine max
  Coding DNA Sequence Number=SeqID_102710
GVVTLLDIPGGGKRVVKEILAFLEGNGLESLIIHGQCIDGAHVSYVENGLESLIIHGQCIDGAHVSYVGNGLESLIIHGQCIDGAHVSYV

SEQ ID NO: 219489 - protein, 279 aa, Glycine max
  Coding DNA Sequence Number=SeqID_102711
  Gene Ontology: Mol. function=ion channel activity; Cellular component= integral to membrane; Biological process=ion transport
  Homolog annotation: Hit_ID=P0C0S1; Match level="QueryCoverage=98%, HitCoverage=96%, E-value=3e-93, Identity=63%"; Hit description=Small- conductance mechanosensitive channel
  Pfam annotation: Domain name=MS_channel; Domain location=70-269; Score=282.6; E_value=7.6e-82; Accession=PF00924.9; Description =Mechanosensitive ion channel
  Pfam annotation: Domain name=TM_helix; Domain location=14-66; Score =63.6; E_value=6.5e-16; Accession=PF05552.2; Description=Conserved TM helix
  Pfam module annotation: Pfam domain module=MS_channel::TM_helix; Domain location=70-269::14-66
MEDLNVVDGINNAGGWLVRNQALILSYAVNIVAAIAIIIVGMIIARVVSNGVNRLLVARHIDATVADFLSALVRYGIIAFTIIAALGRVGVQTASVIAVLGAAGLAVGLALQGSLSNLAAGVLLVTFRPFRTGEFVDLGGVMGTVQNVQIFSTTLKTADGKIVVVPNGKIIAGNIVNFSREPIRRNEFIIGVAYDADVDQVIDLLREVVEADERVLKDLGIQIGLNELAASSLNFVVRCWSKSGDLQNVYWDLMKNFKRTLDAHGIGIPYPQMDVHLHQ

SEQ ID NO: 219490 - protein, 87 aa, Glycine max
  Coding DNA Sequence Number=SeqID_102712
MHETLKASQVAIVDEVERNVIELVSKQSKTSNEATSRDKGEPNVIIVYSTNSRPPPLNYAQLATTTRDQVQDMIGQAMESFIDRKRQ

SEQ ID NO: 219491 - protein, 258 aa, Glycine max
  Coding DNA Sequence Number=SeqID_102713
MYFRFNLVMFRAPDALPGSNRIRLELLKTYGALIMTSISSLGSSNSIQSFSQVGQRSGMQPPPPPPDGEGQGKDGGGLLGAIDSALKSAGIEGGLESIFGQSGTSSTSASSDSSETTDSSDSTTDAASALNTFLQNLISALQSQGTTDTGSSDSEESSTSSTEASAAQGMPPPPPYGGHGMEAKLQSLISSLSSDSTDSTATDTSSDSSSSELESSFQSLVSALGGNSDSASLSGFLQALSSGMQHRGPAGNVVSTTA

SEQ ID NO: 219492 - protein, 765 aa, Glycine max
  Coding DNA Sequence Number=SeqID_102714
  Gene Ontology: Mol. function=transporter activity; Cellular component= membrane; Biological process=transport
  Homolog annotation: Hit_ID=Q1H072; Match level="QueryCoverage=36%, HitCoverage=96%, E-value=1e-89, Identity=62%"; Hit description =Binding-protein-dependent transport systems inner membrane component
  Pfam annotation: Domain name=BPD_transp_1; Domain location=302-523; Score=158.2; E_value=2.1e-44; Accession=PF00528.12; Description =Binding-protein-dependent transport s
  Pfam annotation: Domain name=BPD_transp_1; Domain location=561-763; Score=124.3; E_value=3.3e-34; Accession=PF00528.12; Description =Binding-protein-dependent transport s
  Pfam annotation: Domain name=ErfK_YbiS_YhnG; Domain location=62-224; Score=38.2; E_value=2.8e-08; Accession=PF03734.5; Description =ErfKYbiSYcfSYnhG
  Pfam module annotation: Pfam domain module=BPD_transp_1::BPD_transp _1::ErfK_YbiS_YhnG; Domain location=302-523::561-763::62-224
  Subcellular localization annotation: CTP_CleavageSite=46; ConfidenceScore=5.25e-01
MPVISIAWWLAPAAATPISRLAVEMMPSFAPNTAARNQPLRCKNLRVSYIKSPSTTGKSLRITVMHIEISIPAQTLTLFDDNGGQVTRYAVSTAANGAGCVKNSGCTPLGAHIIRAKIGAGAAENTVFVGRRPTGETFTQDLKVQFPERDWILTRILWLSGTEPGKNRLGNVDTMQRYIYIHGTPDETVLGVPGSHGCVRMRNADLIALFDLVPHFATLLPVVFGVLCLTFALLHLVPGDPVDVMLGESASPADRVALKAQLGLDQPLPVQFGQYLSHLLRGDFGHSIHTQTPISQLLWQAYPATLLLAVVALAIGLVIGIPLGIWSALKAGHWQDVMITMLSIRLAAMPAFWLGPVLMLVFAVWLGWLPVSGTGSGAAILLPALTLGLGLSAILTRMTRTSLLEVLNEDYIRTARAKGLSERQVLLKHALRAALLPLVTIVGLQMGSLLAGAVITETIFSWNGIGRLLVDSIEKRDYPVTQACNRCDLSLAGSADTGHAMKTFSLLTLGFWLLVVMLGHVVGLEPNRIDLNAILQWPSQQHWLGTDDLGRDILARVIHGVEVSFMVTLVVTAVTMTVGLSIGLVAGYKGGKLDAVLMQLTNIFLAFPGMLLAIAFAAVLGAGINNLILALCLTGWVTYARLSRGQSLALRQRLHVLAAESLGAGSVRVMLLHILPLLISILLVEAAYSMASVMIAEASLSFLGLGIQAPNASWGAMLRDAVRFMLVAPHYVLTVGVCMMSLILAINLGGDVLRDKLDVRSERQV

SEQ ID NO: 219493 - protein, 223 aa, Glycine max
  Coding DNA Sequence Number=SeqID_102715
  Gene Ontology: Mol. function=transition metal ion binding; Cellular component=integral to membrane; Biological process=nitrogen fixation
  Homolog annotation: Hit_ID=UPI000067FDF0; Match level="QueryCoverage =93%, HitCoverage=88%, E-value=1e-62, Identity=59%"; Hit description =conserved hypothetical protein
  Pfam annotation: Domain name=DUF125; Domain location=14-223; Score =284.8; E_value=1.7e-82; Accession=PF01988.9; Description=Integral membrane protein DUF125
MAHHELHFLQRSGWLRAAVLGANDGIISTASLLMGVAAAGASHQAMLMTGIAGLVAGALSMAAGEYVSVSSQTDIEQADLAREAEELKENPESELRELTGIYIQRGLSPELARQVAQALSQHDSLGAHARDELGLHDNNQAQPLQAALTSALAFSSGALLPIVTAWLAPHTQAQTWLTISTLPFLGLLGMVSARTGGANVLKSVSRVVFWGALALAATALIGR

SEQ ID NO: 219494 - protein, 249 aa, Glycine max
  Coding DNA Sequence Number=SeqID_102716
  Gene Ontology: Mol. function=peptide-aspartate beta-dioxygenase activity; Cellular component=integral to endoplasmic reticulum membrane; Biological process=peptidyl-amino acid modification
  Homolog annotation: Hit_ID=Q8XY86; Match level="QueryCoverage=98%, HitCoverage=82%, E-value=4e-98, Identity=65%"; Hit description =Probable aspartyl/asparaginyl beta-hydroxylase transmembrane protein
  Pfam annotation: Domain name=Asp_Arg_Hydrox; Domain location=16-173; Score=285.8; E_value=8.5e-83; Accession=PF05118.5; Description =AspartylAsparaginyl beta-hydroxylase
PTTPYLPVSDFPELKAITDRWQEIREEALYVREQERIAAAQTNNDAGFNSFFKTGWKRFYLKWYDAHHPSASIYCPKTVALLQSIPSVKAAMFAELPPGAHLRPHRDPYAGSLRFHLGLETPNDDQCFIRVDGEDYSWRDGQAVMFDETYIHEAYNKTDETRVILFCDIERPMRYGWAQAVNRFLANTIVTAASSPNEAGDQTGLINRLFHYAWVIGQYRRRFKKWNKKVYQVTRILLIALVCYAIWKL

SEQ ID NO: 219495 - protein, 52 aa, Glycine max
  Coding DNA Sequence Number=SeqID_102717
MGQNVFYKFNDYEIFGELDISNLKLRKRCRSKTYIPKSEEFRIRLPNLVEFK

SEQ ID NO: 219496 - protein, 348 aa, Glycine max
  Coding DNA Sequence Number=SeqID_102718
  Gene Ontology: Cellular component=mitochondrion
MVRVTNRTDMRQLRGITSQGATHAKDGGKRPVLLPETNNKQNIMKRIGLSAVPEVLSKIEQNYDVFTITDKFRNLSLKDSSASSSNHSFLSTLTPTASLLERFKIRTNPSAFTRNVIEMTKAPFFDIKNPIINLTEKANNYMMSIGFRFMPGQGEFLIKDLRAPDTLVGLRKLKESLGLSLTKGSLNSNPLLKLKGISDSVSNSMESLASRVLVEVITFNEGYYGRFLILVQMGIGCTVWYGFVPGDGINMPIEGLNTLFSPIENYDTIFTNPDAHVIPGFNKMTLIEGVNNPAAPLSQAFAQDRPFMDMDIEIPDSNKSIIIGVSLGLAVAILFTFGINPCCGEVIV

SEQ ID NO: 219497 - protein, 224 aa, Glycine max
  Coding DNA Sequence Number=SeqID_102719
  Pfam annotation: Domain name=Transposase_23; Domain location=139-209; Score=-11.0; E_value=0.018; Accession=PF03017.5; Description =TNP1ENSPM transposase
MGPVLLDSQRPFLGGCAEKGTGSVDGVIDPPSPVKRHVKWKMARTKKTGEMMTEAAKEIAEKIDVLTAAIRCPEHPGRVRATGAVADPANQGPTRGVHHRKSDAAAHGILQPNAVLDSVPDAISGTCTASRASGNDLETGDSDRCGLYIEADHARLVALGRVYEGSTVVHNTHLLPSQVKVGVEEGTDADAPVPVSTDEVSLVGQALHTFLAWPTHLVKSLSQQ

SEQ ID NO: 219498 - protein, 84 aa, Glycine max
  Coding DNA Sequence Number=SeqID_102720
MQSLQDVVQQRPVMSVEEFLQKVAWLRVQPSPLGGEPSTGVLDMSSSQPESSAPMPDLPLPQDSPSGTPALDLNEYAMDSAQDH

SEQ ID NO: 219499 - protein, 98 aa, Glycine max
  Coding DNA Sequence Number=SeqID_102721
MATSDHAICVIELMKAGVAAHDVQRYVKESDRAAQCTRQDKMSNEELKLQDPRCRIQCPGHPARKYWTHKSVISLTDCAGSTMSDTMSRTSCPKILDT

SEQ ID NO: 219500 - protein, 151 aa, Glycine max
  Coding DNA Sequence Number=SeqID_102722
RDSNVSMTDLVSAEDDTTKMNVYTDNHSGISARQRDSNVSITDLVSAEDDTAKKNVYTDNHSGISARQRDSNVSITDLVSAEDDAFRLTDNKKNVYTDNHSGIFARQRDSNVSMTDLVSAEDDTAKKNVYTDNHSGISARQRDSNVRMTDL

SEQ ID NO: 219501 - protein, 35 aa, Glycine max
  Coding DNA Sequence Number=SeqID_102723
MEEALAHAPSDVEQSRHAVEACQAIAEKGWSDCST

SEQ ID NO: 219502 - protein, 64 aa, Glycine max
  Coding DNA Sequence Number=SeqID_102724
MEHCLRHMADQQATKSKAKDVKEVLLVGNLELPTKKLPAKRSRKGTIEEDSSVAPQADTGFDKH

SEQ ID NO: 219503 - protein, 60 aa, Glycine max
  Coding DNA Sequence Number=SeqID_102725
AGAEAKHHYSLGDGRQWATDAPPSPLEFTSAHPTKGLSISYTTWPTNRRASPKPKVVKIP

SEQ ID NO: 219504 - protein, 457 aa, Glycine max
  Coding DNA Sequence Number=SeqID_102726
  Gene Ontology: Mol. function=inositol tetrakisphosphate 1-kinase activity; Biological process=signal transduction
  Homolog annotation: Hit_ID=O80568; Match level="QueryCoverage=98%, HitCoverage=99%, E-value=1e-137, Identity=53%"; Hit description =Inositol-tetrakisphosphate 1-kinase 4 (EC 2.7.1.134) (Inositol- triphosphate 5/6-kinase ...
  Homolog annotation: Hit description=4) (EC 2.7.1.159) (Inositol 1,3,4- trisphosphate 5/6-kinase 4) (Ins(1,3,4)P(3) 5/6-kinase 4)
  Pfam annotation: Domain name=Ins134_P3_kin; Domain location=126-445; Score=29.1; E_value=1.2e-12; Accession=PF05770.2; Description =Inositol 1, 3, 4-trisphosphate 56-kinase
MGVVRGVILDESVLLAESDDDKTVSLLRPGAESLIQTLVLSRTHSGIAHGVGLPDDKVMAGWSNADDGSVIIYLISNKKEFLPKLSSYNWLVVVLNVGGESSCHTPNILQIENLEELPLTICHLNKRSIGTNAVTVGYTMKPSRVEDFAKRGAFPLCPTQNGLMFVPLTSKLPLSSQLKDVDIVLHKATDEILSVEDNKITFTQNMQALQRYLDQHQDFCVIDPLSNVYPLLDRLEIQQFLLGLVELNTEGKYLIRGAHFLKVDNFDEFDFATGLAEARLSLPCIVKPKVACGVSDAHKMAIVFRVDDFKNLSVPLPNVIQEYVDHSSTLYKFYVLGEKIFHAVKKSIPNADILRKSSDGDELKPLLFDSLKSMPTADSITSNVSIDLKLVTDAANWLRRRLQLTIFGFDVVIQEGTHDHVIVDVNYLPSFKEVPDDISIPAFWDAIRNKFDSRVPK

SEQ ID NO: 219505 - protein, 214 aa, Glycine max
  Coding DNA Sequence Number=SeqID_102727
MGNAMGSKKAKIMKIDGETFKLKTPARANDVVKDYPGHVLLDSHAVKNFGPRAKPLEPDYELKPKKIYFLVELPKVKPEPLGTRRVRSSGIRGMNAQDRLDFLMLSKRSVSDLTMVKHGPGPENGGPTRLKMRLPKAHLERLMEESHDGGEVAEKIISLYMGNNAAVDGSGATVEAHNRKPRRKRVSFSPVEQGEIHEESAAPQQSLVYSSPSR

SEQ ID NO: 219506 - protein, 173 aa, Glycine max
  Coding DNA Sequence Number=SeqID_102728
  Homolog annotation: Hit_ID=Q2LAH6; Match level="QueryCoverage=45%, HitCoverage=21%, E-value=9e-32, Identity=74%"; Hit description=Endo -1,4-beta-glucanase
MEEQAEYDNDELEKVNGLLTEKEKEIQDLEAKLEFYRSNMVDEEPMVYNMSIYPMEALKIVFPARITPLRCHGKLEFALLLKLLLLLQLLLWRAIHVFQFANKYKGPYSNGLKPIVCPFYCSYSGYQHNKATKNPMYLNYIKVNGQTLGAADSNNTFGWDNKHVGARIMLSKV

SEQ ID NO: 219507 - protein, 169 aa, Glycine max
  Coding DNA Sequence Number=SeqID_102729
MASPTPSLWPQKPTIVLLLICISFSHSYSVEEAITSSKKLDQPVFPPPAYTEIKCGSCPCGDTCGEQLPPPPPQPSPAPPPPCLSPPPPPPSPPPPKIPSCPQNCNPLPPPPPRFVYVPLPGVPKPYTWVYYYSAAENRGVGLIVLAGLGGLSMATLLLDDILKLKLYF

SEQ ID NO: 219508 - protein, 578 aa, Glycine max
  Coding DNA Sequence Number=SeqID_102730
  Gene Ontology: Mol. function=RNA-directed DNA polymerase activity; Biological process=RNA-dependent DNA replication
MELFDVLLIGRSFTWISPANTTADYVYKENLKKLKFELKRWNYDAFGDLEEAKRRSAMQIGTLDDIDEEGDFKTSFFHNTVNWFRRVNGIRGVNVNDTWVEDQLRLKQEVKNFFEQRYIEHGGPRMSLEEEDILKVVNEFHHNGTLPRGVNATFVSLIPKGNPLAPFLFLMVADGLGGLMRMATDKDLFVRPKVVVLKCFKPASSLKDNFFKSKLAEVAVASDLQQRLAAILNFWVMVIPFIYLGIPVDPSRVPPHQDVKLTNERKKCFKRYFDDVDVRRQVNLEFANFSNGREAFHNVDSLRDKGELDAKSWWLAHGAYAPTLLKIALKLLGKPSSYSCDGRRMYWVNWKKVCSSKDLGCLGIKDLETFNNALLYKWMWRFLVDNNSTWARTIRERAKVYKDILLSPSTSLGGRMLAREIDGFSVGKAYSIMKNVVDLEENGFYKQLWAVKAPSKVVALTWIIALNSVLTRENLRRRGISLANNDVTCVRKMIRPNPVSFVETRRPDRHFSSSRSSSRSMPPLHCEGSCRANLVANNVDEDVNDLGGVELRRHCEAVMIEEEEEKVQQEERVIYIGD

SEQ ID NO: 219509 - protein, 339 aa, Glycine max
  Coding DNA Sequence Number=SeqID_102731
  Gene Ontology: Mol. function=transcription regulator activity; Cellular component=nucleus; Biological process=regulation of transcription
  Homolog annotation: Hit_ID=Q651K2; Match level="QueryCoverage=42%, HitCoverage=44%, E-value=3e-25, Identity=46%"; Hit description=BHLH protein-like
  Pfam annotation: Domain name=HLH; Domain location=248-295; Score =33.0; E_value=1.1e-06; Accession=PF00010.16; Description=Helix-loop -helix DNA-binding domain
MALAKDQRIPRDSSMSSKVQNCVFSETSVEVTSMTVHRVNEYHKSVLEDQEDGSPTTNGLSNDSAITHSPPLCGSVKGYAYKGTNYQLEEAEPLINFKGYSNLMQGGGSLLSFQQNKMVPNNCYMKENGQKEVCVWENNLHQGRDHWNQTSPRNTRDMRLVENANCFQTSSGYISIVNNAKEKQHGQSSSGLLYPAPTIPNASSLHKLGAQESVLQKRPFMGESMKAAKKQCSIESKTTKHNSSPSKDPQSVAAKNRRERISERLKILQELVPNGSKVDLVTMLEKAISYVKFLQLQVKVLATDEFWPVQGGKPPDISQVKEVIDTILSSQKERSSSSK

SEQ ID NO: 219510 - protein, 279 aa, Glycine max
  Coding DNA Sequence Number=SeqID_102732
  Pfam annotation: Domain name=dsrm; Domain location=25-89; Score=50.0; E_value=8e-12; Accession=PF00035.15; Description=Double-stranded RNA binding motif
MALENLHVKFKTEERPVTHENTTLSKSILHEYAAKLKVEKPAYNTVQLEGLLPLFVSSMTFQGTTYVGDAARSKKEAEQLAARNAITSILDGATSGLLYETIKSKYSTFGAVRSTKSECINASSAVVEHVPSLVAVPVAANGNETKVALIVPSFNQECQMREHVSSVQAITITEVPNLNLLPGPEQSTAGVSCELSIGIGSGALSIGDGSRELSVGDGSGSKKRKRNKSKANKKLGLEYGENVLALVAMLAIEAFSLNRIASYSVAQEHVKVINDHFAA

SEQ ID NO: 219511 - protein, 48 aa, Glycine max
  Coding DNA Sequence Number=SeqID_102733
MQRRETRLSTRVRPLSETSRLEKLQLSLSLALASSAKMMHLKYRRACA

SEQ ID NO: 219512 - protein, 72 aa, Glycine max
  Coding DNA Sequence Number=SeqID_102734
MGKKVGSAIVGSSFLVLLLLASLVIADLETLPWRGLRSNRTAKMGKGSVTHLLKMEGSGQAKVLKFEVTFWI

SEQ ID NO: 219513 - protein, 130 aa, Glycine max
  Coding DNA Sequence Number=SeqID_102735
  Gene Ontology: Mol. function=protein serine/threonine kinase activity; Cellular component=chloroplast; Biological process=protein amino acid phosphorylation
  Homolog annotation: Hit_ID=Q10NC1; Match level="QueryCoverage=93%, HitCoverage=32%, E-value=3e-30, Identity=55%"; Hit description =Protein kinase APK1B, chloroplast, putative, expressed
MISAKREVYELNCSNNIIEMIGLNSKDGSKEENDLSGLSSKVSSSAMLLTPQSEDEILQASNLKNFTFNELRTATRNFRPDSMVGEGGFGSVFKGWIDEHTLAPTKPGTGMVIAVKRLNQESNQGHIEWL

SEQ ID NO: 219514 - protein, 100 aa, Glycine max
  Coding DNA Sequence Number=SeqID_102736
  Gene Ontology: Mol. function=metal ion binding; Biological process =metal ion transport
  Homolog annotation: Hit_ID=Q2QXS5; Match level="QueryCoverage=86%, HitCoverage=11%, E-value=2e-16, Identity=48%"; Hit description=Heavy metal-associated domain containing protein, expressed
  Pfam annotation: Domain name=HMA; Domain location=15-75; Score=41.3; E_value=3.4e-09; Accession=PF00403.16; Description=Heavy-metal -associated domain
MSTSDYELIKIETFVLKVRMNCQGCINKVRKVLQKVEGVCKVDINAEEQKAIVTGIVDPSTLVQKLVKFGKHAEIWKAGHNGHQDNNQTQIINGPSDSEN

SEQ ID NO: 219515 - protein, 52 aa, Glycine max
  Coding DNA Sequence Number=SeqID_102737
MLRRHFPTNPIDALDYSNKQFPYTDQKGKVMTSTTAYVERRKVRPRGFKDPK

SEQ ID NO: 219516 - protein, 61 aa, Glycine max
  Coding DNA Sequence Number=SeqID_102738
MGGAMREFLEFRALEKRNRSKTTKIGMKSECGEVDKTENQKRMINLPENASLTGKSEIESL

SEQ ID NO: 219517 - protein, 170 aa, Glycine max
  Coding DNA Sequence Number=SeqID_102739
  Gene Ontology: Mol. function=pyridoxal kinase activity; Cellular component=cytosol; Biological process=pyridoxine biosynthetic process
  Homolog annotation: Hit_ID=Q4JR83; Match level="QueryCoverage=77%, HitCoverage=42%, E-value=1e-69, Identity=97%"; Hit description =Pyridoxal kinase
MEFVILLGNWQYPLMSFFSGFCGLIYGVTLSVNVNKFRCGYPTFKGQVLNGQQLWDLIEGLEGNDLLFYTHLLTGYIGSESFLNTVLQVVNKLRSTNPGLTYVCDPVMGDEGKLYVPQELVSVYREKVVPVASVLTPNQFEAELLTGFRIQSEGHGREACRLLHAAGPSK

SEQ ID NO: 219518 - protein, 129 aa, Glycine max
  Coding DNA Sequence Number=SeqID_102740
  Gene Ontology: Mol. function=transferase activity, transferring glycosyl groups; Biological process=metabolic process
  Homolog annotation: Hit_ID=Q9ZWS2; Match level="QueryCoverage=68%, HitCoverage=19%, E-value=3e-39, Identity=85%"; Hit description =Flavonoid 3-O-galactosyl transferase
MKKNGGSVAYVSFGTVVTPPPHEIVAVAKALEVSGFPFLWSLKKHLKDLLPKGFLERTSESGKVVAWAPQTKVLGHGSVGVFVTDCGCNSKVSVIATIVTKSLGRRKLFSQINSFIVVFILVGQLSLMS

SEQ ID NO: 219519 - protein, 129 aa, Glycine max
  Coding DNA Sequence Number=SeqID_102741
  Subcellular localization annotation: CTP_CleavageSite=18; ConfidenceScore=5.58e-01
MVTTSRDYITKGNKAVTSSQTRKRTITSSNNTSITYLSKVGGRSCLLLSTVGLPQLTNDEINPTDGTLPTLGRLKSSEGMKRLWNRIKQGAKGQEVLQPTGADTRVRSYNQGLSAKGERGEVQREREKK

SEQ ID NO: 219520 - protein, 66 aa, Glycine max
  Coding DNA Sequence Number=SeqID_102742
IFRKVIDLIQHKLLQPRYAHCYLNMKAARCFVSHLDVTLTSSVGPECVELISIVCGVDLYCSESNL

SEQ ID NO: 219521 - protein, 103 aa, Glycine max
  Coding DNA Sequence Number=SeqID_102743
MTKWRNYVSYVTSRHNALIGCGIGRLSKDIKTLAQEELLGILKVHEKDPCCVKRKGECRWKNYVKKSFMDKDLKEKSKVRFGRIFDLLQTMIDRRIVIDGSSD

SEQ ID NO: 219522 - protein, 69 aa, Glycine max
  Coding DNA Sequence Number=SeqID_102744
  Subcellular localization annotation: CTP_CleavageSite=50; ConfidenceScore=5.21e-01
MAYSLVDVASFHLFSFSIQLPLNFKNQRTPLMKKIQGLQAPHGATSCGIRASSSRFYHCFSHNLLVLNL

SEQ ID NO: 219523 - protein, 64 aa, Glycine max
  Coding DNA Sequence Number=SeqID_102745
VHVIFLSRLGILHSALRGLELYTVAGYSPKMNAYGRWGNLSLAIHPSPIRLNKIPYLKGLPRDT

SEQ ID NO: 219524 - protein, 79 aa, Glycine max
  Coding DNA Sequence Number=SeqID_102746
  Subcellular localization annotation: CTP_CleavageSite=36; ConfidenceScore=5.47e-01
MASANSNPPPPPPPPPTLVADFSFPANVMAIPIPVSAMLIQTAFPQQDLTATPTGVTPLQAKASRKKGAWLVNIFKHKG

SEQ ID NO: 219525 - protein, 304 aa, Glycine max
  Coding DNA Sequence Number=SeqID_102747
  Pfam annotation: Domain name=zf-CCHC; Domain location=101-118; Score =22.8; E_value=0.00017; Accession=PF00098.13; Description=Zinc knuckle
MPPIVVMTLERKGKKASRGNINLPYFHGKDNVEAYLDWKIKVEQQLKRKSTSKSYGSHSYPKKDQSLGILGAAPSKPKDDKGKTIEKQPPKASMQEKTSSIKCFKCLGRGHITSQCPTKRTMIMRGQDIYSIQDEATTSPSSSDSEEAKGEGSSEEIYPQEERQPLMVKEECKEVSVSSKRLTKKESHFAIKTNIKETSPLRQPPHLLLCKKALVSTTTPLGLDIIPQVKELLDEGLVRKSLNPCALLVPKIGVIRPQIPKIGDMMNVLSGATLFYKITHVSNIFKIHVDRDLLGRFMVIKLSS

SEQ ID NO: 219526 - protein, 153 aa, Glycine max
  Coding DNA Sequence Number=SeqID_102748
MAARPDELRLSHEATGSPRENPNPNQYPVNSGITRQSWDGFKRVPMGTSFITMSKEHLKSSSRVIRKNGVGSSGFKKRHQKRIPYGRPQDRQRFRPFQRQSAPVTKGNQVVFQVGGRMLTAIDVCRNLPFGGRATRDSRDACSTKGIRAESPP

SEQ ID NO: 219527 - protein, 90 aa, Glycine max
  Coding DNA Sequence Number=SeqID_102749
MAKIQGPKEEKTYSNIYKDEWTQPWSMGLEIYPEVHENPRACFSSSSPILLESSIQYPWGVGLHQLPSSQMPCFAINRHGKAEVKDPRVH

SEQ ID NO: 219528 - protein, 71 aa, Glycine max
  Coding DNA Sequence Number=SeqID_102750
MVGAFSQNIVTLTGLPMILLSESDLTNPLCGVSCYVLLSAPGWFVTDMMNRWMTMKNLMLEDTGTPRSDRM

SEQ ID NO: 219529 - protein, 208 aa, Glycine max
  Coding DNA Sequence Number=SeqID_102751
QKLLAEKTKKKLQEAAQLGSVDGIIDPPSPVRRHVKWKMTCTKKTWEMTTKAAKEIAEKIDSFEEQATQGSFVPHGRQDVLAAAIGRPEHPGRVRATGADIRDQLEESITEKVTRQAPPEPLVGPGPSGPRVSTKGSCVDPSGNDPETSDSDRCDLYIEADPARLVALGRVYKGSTLVHNTPLLSGQVKVSVDEVKDADASVPVLTAE

SEQ ID NO: 219530 - protein, 310 aa, Glycine max
  Coding DNA Sequence Number=SeqID_102752
  Gene Ontology: Mol. function=sequence-specific DNA binding; Cellular component=intracellular; Biological process=response to DNA damage stimulus
  Homolog annotation: Hit_ID=Q47FA0; Match level="QueryCoverage=99%, HitCoverage=45%, E-value=1e-112, Identity=68%"; Hit description=NAD -dependent DNA ligase
  Pfam annotation: Domain name=DNA_ligase_OB; Domain location=241-309; Score=128.1; E_value=2.4e-35; Accession=PF03120.7; Description=NAD -dependent DNA ligase OB-fold domain
  Pfam annotation: Domain name=DNA_ligase_aden; Domain location=1-239; Score=333.3; E_value=4.1e-97; Accession=PF01653.9; Description=NAD -dependent DNA ligase adenylation
  Pfam module annotation: Pfam domain module=DNA_ligase_OB::DNA_ligase _aden; Domain location=241-309::1-239
MLSLNNAFSDDELEAFDRRVREGAGVSIVEYAVEPKFDGLAITLTYEQGLFVQGATRGDGYTGENVTHNLKTIRAIPSRLNMTNPPALLEVRGEVLMLKKDFEKLNQQQAAVGGKLFANPRNAAAGSLRQLDSNITAKRPLHFFAYGLGASDGVPELHSHAEAMQYLADLRFPVSVLRGVKTGVQGLRDYYAEIGEKRKDLPFDIDGVVYKVNDFDMQETLGFVSRAPRWAVAHKFPAEEATTVVEDITVQVGRTGAITPVARLKPVFVGGVTVTNATLHNEDELRRKNILIGDTVVVRRAGDVIPEVVL

SEQ ID NO: 219531 - protein, 52 aa, Glycine max
  Coding DNA Sequence Number=SeqID_102753
MNYVLVHASSTHEFGAMHSDCLVQFSILYPFFGAPSIAFSFMHPPPTSLEPW

SEQ ID NO: 219532 - protein, 85 aa, Glycine max
  Coding DNA Sequence Number=SeqID_102754
MGHEDDNDDNNNNNNKNNNSKNDDDGHGGDYVHQELVSSLQQQTVTRVHPRTRGERGGITQGQQPPTNQVQQDEKPQHISKRTQC

SEQ ID NO: 219533 - protein, 51 aa, Glycine max
  Coding DNA Sequence Number=SeqID_102755
ASNFWGFRLDGGGCMNDNQFVGLGIRFVGGGYKNSATQAIRGAPDSMVEDA

SEQ ID NO: 219534 - protein, 102 aa, Glycine max
  Coding DNA Sequence Number=SeqID_102756
MYMNHEDVGCMSDFTKEGCTTQHIYHTTYHRDLVPHNTFFGHCRNLPFGGRTTRELMGVSSKGGKCTESPPTFIRGKRRKNQKGCFPRSYVFLNCDKEIRPK

SEQ ID NO: 219535 - protein, 123 aa, Glycine max
  Coding DNA Sequence Number=SeqID_102757
QLEVGNRGWWVYACFVDVENLLCTIARPPPSTTCDGVVPGDMSRGSGDLGDVRRAPGSQQIKGTMTTKRGGLWWLASCESCVIYGGLPLVIDYQGLEKRGQEARRASGNRYQGRNRSLVIDYQ

SEQ ID NO: 219536 - protein, 152 aa, Glycine max
  Coding DNA Sequence Number=SeqID_102758
RVVRQFGYIQIVPPPPVRDSLTDHVVPTGELCVVPGQVVPDNMEWFFQISHPFVTPTEDIVEPRPAPPPPPHDDDFVEPPVPEVPIALDLPTHSMVDCTGCVRIAEHLERVINLRMVNEGTDLYDIMDLCLRIARGDDPDDSLRPRQRRRIN

SEQ ID NO: 219537 - protein, 48 aa, Glycine max
  Coding DNA Sequence Number=SeqID_102759
MWSYAPFSEMRIYPSDYPYKEQHLLILTHASGGRHIYPSDYPYKDNIC

SEQ ID NO: 219538 - protein, 219 aa, Glycine max
  Coding DNA Sequence Number=SeqID_102760
  Subcellular localization annotation: CTP_CleavageSite=87; ConfidenceScore=5.09e-01
MLRLAPPSRLAREPIKISSSDDFSSSDSEATPTPTPQPSSPPPVQTKKSLSLINISKFPLLGSTWRKCWRPWVQQTRENIPCRKFLVAFPIGKQQYYYPESKIIQNPHVEFILRQHEVVTPPQWTKCDHIHTSSTQYAALPPDAIVPLGTPSWTRPMYPNLVKMCPQWMPTSTSKTICPSPVPVEQKQEITSSDPYDKALRLTLCDTLYPDIHIIKKKI

SEQ ID NO: 219539 - protein, 158 aa, Glycine max
  Coding DNA Sequence Number=SeqID_102761
MEYREVLWHLGDEFHMRVLDDLALRHFLHVDPSNGNLDMLIKERDFLVCTGGGLDGCGVGVGVASLSDELKSSEDEILIGSFGVKDLCPTYGESGKASASRSRAKRKISALSAVGVFSQAQRTTGAKPEFTYPHHRAYFGKRALEAVFASGKCTGSHK

SEQ ID NO: 219540 - protein, 142 aa, Glycine max
  Coding DNA Sequence Number=SeqID_102762
MTTLTQIWMMLLLSNIPPGDHNADLPPRKYQLGSRPHDTQWTRRSPTGPWGVMPARHPMDLENSNRVLGFLALITGLCQFYKVLVAPSKVIRPPTNRAFIKKYCAPRQAQGETPQQPEVDQQRATGTPPPPLEFTSAHPQKG

SEQ ID NO: 219541 - protein, 168 aa, Glycine max
  Coding DNA Sequence Number=SeqID_102763
MAHLELSIPWARAQQSSRTNSPRGLPAILRETSEGTQLLDGSISLSAPIPKVRRTICTYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISSTL

SEQ ID NO: 219542 - protein, 87 aa, Glycine max
  Coding DNA Sequence Number=SeqID_102764
  Homolog annotation: Hit_ID=Q17063; Match level="QueryCoverage=75%, HitCoverage=65%, E-value=7e-07, Identity=46%"; Hit description =Hemolysin
  Subcellular localization annotation: CTP_CleavageSite=57; ConfidenceScore=5.04e-01
MNRKLGYGAQLRANLDPTKGVALLSQQDRGHASRNPLRRRGGRCKTQGASPGGAVVGADLGGSSKYSNENFEGRRGERFHVNGTCTW

SEQ ID NO: 219543 - protein, 125 aa, Glycine max
  Coding DNA Sequence Number=SeqID_102765
MRRYLMVIRTFSQPEASEPVDTQRLTSSSAPLSSRDGESDDMRRYLMVIRTFSQPEASEPVDMQRLTSSSAPLSSRDDESDDMRRYLMVIRTFSQLEASEPVDTHRLTSSSAPLSSRDGKSDDMR

SEQ ID NO: 219544 - protein, 71 aa, Glycine max
  Coding DNA Sequence Number=SeqID_102766
  Subcellular localization annotation: CTP_CleavageSite=18; ConfidenceScore=5.03e-01
MPPPMRNSTPMIALPMIAVSMVPTKNSRLVMLIACENGNVRVIADMPTAKKSHSGAWPPPPYLGVSTGIIA

SEQ ID NO: 219545 - protein, 334 aa, Glycine max
  Coding DNA Sequence Number=SeqID_102767
  Gene Ontology: Mol. function=two-component sensor activity; Cellular component=integral to membrane; Biological process=two-component signal transduction system (phosphorelay)
  Homolog annotation: Hit_ID=Q3Q4C6; Match level="QueryCoverage=96%, HitCoverage=31%, E-value=2e-77, Identity=46%"; Hit description =PAS:GGDEF
  Pfam annotation: Domain name=EAL; Domain location=68-312; Score =234.7; E_value=2e-67; Accession=PF00563.11; Description=EAL domain
MQDISAAYILGGERIFVTVSIGISQYPEDAVNAEEMIQHADQAMYDAKGRGRNSLRFFSLAIRDALSQRVSLARDLRTALENGELRDYYQPIVNLRSGKNCESRSVDAVAAPGTWPDQSRHCLFQWPKKPGDINAMGDWIFNQAAQHATQWESLVSDDAFAISVNKSPVQFVEKMSVQSDWVHALRSMGVAGKRIVVEITEGLLLNPDPVVEERLLQYRDMGIQVAIDDFGTGYSSLSYLSKFDIDYLKIDQSFTRNLNAGNESYVLCEAIIVMAHKLGLKVIAEGVETALQRDLLIAIHCDYAQGFFYSPPVPAEAFEQMLVQQSREESAAAN

SEQ ID NO: 219546 - protein, 131 aa, Glycine max
  Coding DNA Sequence Number=SeqID_102768
MIMRGQDTYSSQDDATTSPSYSESEEAKGEESSEEIYLQEEGQPLMVKEECKEVSVSSKRLGKKESHFKIKTNIIETSPLRQPPHLLLCKKTLVSTTTPLGLDIIPQVKELLDEGLFHKSLNPCALLVPKI

SEQ ID NO: 219547 - protein, 224 aa, Glycine max
  Coding DNA Sequence Number=SeqID_102769
  Gene Ontology: Mol. function=RNA-directed DNA polymerase activity; Biological process=RNA-dependent DNA replication
MRKGKSEANTEKKKDTTLNEGKEVPYPLVPSRKEKERHLAIFLDIFKKLEITLPFGEALQQMPLYAKFLKDMLTMKNWYIHSDRIVVEGNYSVVIQHSLPPKHKDPGVVMIPCSIGEVFVGKALIDLGASINLMPLSMCQRLGEIEIMLTCMTLQLADRSITRPYGVIEHVLVKVKHLIFPTNFVVIDIEEDADIPLIHGRPFMSTASCVVDMGKKMLQMGIED

SEQ ID NO: 219548 - protein, 215 aa, Glycine max
  Coding DNA Sequence Number=SeqID_102770
  Gene Ontology: Mol. function=transporter activity; Cellular component= integral to membrane; Biological process=transport
  Homolog annotation: Hit_ID=Q6RH46; Match level="QueryCoverage=52%, HitCoverage=40%, E-value=5e-45, Identity=81%"; Hit description =Putative ABC transporter permease component
MAIAARAGVRSVSIEQIHAAYAMGGSRMQIVWHVILKAAMPEIFTGMRIGIGVGWTTLVAAEMVAADRGLGFMVLNAAQFLASDTVIMGIIVIGVFAFAFDLLVRAVLTESALVSDPYPIHPLTEQKYEQHYGEGYQRILRCTGPFIFKCSFQVSRRKLTDSFVQYVRHSPDLPKHRGSLCEPDDLDRLPLKMNMPCASIIEAVGVGVQILPSAV

SEQ ID NO: 219549 - protein, 179 aa, Glycine max
  Coding DNA Sequence Number=SeqID_102771
  Gene Ontology: Mol. function=protein kinase activity; Cellular component=membrane; Biological process=protein amino acid phosphorylation
  Homolog annotation: Hit_ID=Q2QZ78; Match level="QueryCoverage=85%, HitCoverage=27%, E-value=2e-49, Identity=60%"; Hit description=AT hook motif-containing protein, putative
MKNLDQSLNIYFLTRQIVEAVNKDEGGMFFLYGYGGTGKTYIWKKLASSLRADNKIVIMVASSGIVSLLLPGGRTAHSKFKIPVPVFEDSTCNIHQGTQLAELLNQTNLIIWDEAPMAHKFCFEALDHSLRDIIKHNSKDNTIFGGKVMVFGGDFRKILPVIPRGSRNNSKLLSYLYTF

SEQ ID NO: 219550 - protein, 125 aa, Glycine max
  Coding DNA Sequence Number=SeqID_102772
MRRQNLVILHPLSSRGGGPDDMRRQNLVILHPLSSRGGGLDDMRRQIWSFRTPCHLDTAVSDGAQRQNWSFCTLCHPEAAGPMTCGDKIWSFRTPLPFRHSRVRWRADTKFGHSAPFVNRGRQAR

SEQ ID NO: 219551 - protein, 152 aa, Glycine max
  Coding DNA Sequence Number=SeqID_102773
  Subcellular localization annotation: CTP_CleavageSite=10; ConfidenceScore=5.07e-01
PRARPAEAPSASAAPHLASASAAPPLARIAAAPSTLPPLVAPPDSIPTVEQFNEWVAWPGTQPPPHMDDEDPAAQLTHQSVDESSESSTPEPLIRKRRVVVTPEVVATPKKSPEATPKPLAPMADTTSPQQATDPSTPEDQTTPVQSPNASL

SEQ ID NO: 219552 - protein, 86 aa, Glycine max
  Coding DNA Sequence Number=SeqID_102774
  Gene Ontology: Cellular component=chloroplast
MGDKLHRREGNSPDHQLRPLNDRSVIKEVGVQRQPGGERSALEGRTRASSAGRSGSENVGLSNANVGENPMPRKPKGSSARFVHGG

SEQ ID NO: 219553 - protein, 153 aa, Glycine max
  Coding DNA Sequence Number=SeqID_102775
  Homolog annotation: Hit_ID=Q5CEG7; Match level="QueryCoverage=68%, HitCoverage=99%, E-value=8e-45, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHQSRTRVKLNRVFFPR

SEQ ID NO: 219554 - protein, 144 aa, Glycine max
  Coding DNA Sequence Number=SeqID_102776
MWTTTGEELATQLAQASKVASSRSNSLLEEGSGRPKWCLALVVWKVGFVVDLGMDFVDNWVVGKEKGCYWMSNDIVWLVGSFHVGTTIAAWVSPSSHPLPLASFSAYTRAYSPATLCSWAVARFNSSWYLLTMANMLVFVSHKC

SEQ ID NO: 219555 - protein, 157 aa, Glycine max
  Coding DNA Sequence Number=SeqID_102777
ATLTTVDLPPGTYDRFRLGRAFASVASAFSPEYQQPAHGDVPLTGFRTQPSSEPSATKSHGGLWLEPITNLKSTSAGRQMRAPVVAVLNERQVWNQTGAPLHLFPLTTTKPLTAPPRYLPFFTTKAFYFPIFTLPTPANGKMPLNGRNRRQPNRRPP

SEQ ID NO: 219556 - protein, 74 aa, Glycine max
  Coding DNA Sequence Number=SeqID_102778
MGNQSSCSPLPEGTELALEFRATYPSVSFLASRVVSTEKALALPSGNLGGQLAEPMVDVGWVVDDYDHSKAFFH

SEQ ID NO: 219557 - protein, 119 aa, Glycine max
  Coding DNA Sequence Number=SeqID_102779
  Subcellular localization annotation: CTP_CleavageSite=38; ConfidenceScore=5.44e-01
MPISPYKSISWSVSSRHGDRTHKTPSGPGKVQQGPGVSSSGYGPLSVLQGARTPQQGIAPTGHPVDPKKSNRVLGFPALITGLCQFYGVPVAPTIRPRINRTFIKKYCAPRRAQGETPQ

SEQ ID NO: 219558 - protein, 152 aa, Glycine max
  Coding DNA Sequence Number=SeqID_102780
  Homolog annotation: Hit_ID=Q5CEG7; Match level="QueryCoverage=58%, HitCoverage=84%, E-value=2e-36, Identity=82%"; Hit description =Senescence-associated protein
  Subcellular localization annotation: CTP_CleavageSite=37; ConfidenceScore=5.56e-01
MNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPRSLGCGFAG

SEQ ID NO: 219559 - protein, 70 aa, Glycine max
  Coding DNA Sequence Number=SeqID_102781
MAHECVIQGRKARGVATNVYSRCGLRTLFMKGSGVVFTHGEEWFPRSYISSIAMRKSDLRSSCESGKVTC

SEQ ID NO: 219560 - protein, 108 aa, Glycine max
  Coding DNA Sequence Number=SeqID_102782
  Homolog annotation: Hit_ID=Q8H3G8; Match level="QueryCoverage=49%, HitCoverage=6%, E-value=8e-11, Identity=59%"; Hit description=Myosin heavy chain-like protein
MAIAEDINDMSFISAQSAEVTSHTTDKGHDGWEKAENEVTSLKKQVQALTLRNSKLEDRVTYLDSALKEFVRQLRQTRVQLMNGQPRRKQTTKVEVEVEVEVLTMPCN

SEQ ID NO: 219561 - protein, 177 aa, Glycine max
  Coding DNA Sequence Number=SeqID_102783
MSEIEEVQEQMKASMEAMKEQMTTMMEAMMSMRRMMEVNAAIVVAASTATEVDPTHPSTLNQVQSKHHFPPYGLPSNYTPLNVVHTLDENPCLGYATEGQAFGGIPLPNTLGGPQYRPQPQPLHFVVEKLPPTMVERENFDHIEERLRVIKGGGNYAFADMAELCLVPDVIIPLKFK

SEQ ID NO: 219562 - protein, 72 aa, Glycine max
  Coding DNA Sequence Number=SeqID_102784
  Subcellular localization annotation: CTP_CleavageSite=63; ConfidenceScore=5.34e-01
MGVQIATRPTWAFQDVPPEGGCFWRKQPSSPGRAGISKLRRFRNVSVGDFATIFNRSSTFFVRSSLFFGLQP

SEQ ID NO: 219563 - protein, 76 aa, Glycine max
  Coding DNA Sequence Number=SeqID_102785
MSRRSKLNNGSSREIQMVITFHTEVRLSFSHGCPIRADNMSRRSKLNNGSSREIQIVIAFPMDVRFGRIICRDARN

SEQ ID NO: 219564 - protein, 48 aa, Glycine max
  Coding DNA Sequence Number=SeqID_102786
MENWRTALRNNFAGLQTRRKWRICEQRYAITSRGSRLEGGGHMNSARQ

SEQ ID NO: 219565 - protein, 76 aa, Glycine max
  Coding DNA Sequence Number=SeqID_102787
MATTTVARGRARPIVDIGPPFEGGEAKVKLVNDSAQVITLPTHLEAIKILPMTHLGIPTETEAVATINACARVRLT

SEQ ID NO: 219566 - protein, 66 aa, Glycine max
  Coding DNA Sequence Number=SeqID_102788
MRKIPKKGAKRSFPWFSWTLAHQGLPLARLGHQIASWFKKPARLGKLTASGLSFSLPGDRGRTRIK

SEQ ID NO: 219567 - protein, 171 aa, Glycine max
  Coding DNA Sequence Number=SeqID_102789
MPVGLCYPDPDQCSCSTTYLGCHLPVYRYCTSETPSGPREVQQGTGISSIDHRPLPVLRGTTVGVRPAANAPPLPPHQPPSLESISARMKRMELKDNFYQYTLHQQRQDPNLYPWPTPELFRATVAWPEEDVMQSYPVRALVRRLQVDWARDPRKGPRVLMSLRVDFEPMG

SEQ ID NO: 219568 - protein, 82 aa, Glycine max
  Coding DNA Sequence Number=SeqID_102790
MAAVQRNFNKFGIKEIAKIGKLLLIQILKEEHLLCHCGSKNMKPVAKPDTLVGGDVYSIEPPYDFIVNHVLDAHWGVLNEED

SEQ ID NO: 219569 - protein, 67 aa, Glycine max
  Coding DNA Sequence Number=SeqID_102791
MRKVRPKRILRSLGLGAKDTRFECSFKPMLIPCGWGILAKQSNPDWSPYDVSLHMMSHMLEMERLSL

SEQ ID NO: 219570 - protein, 514 aa, Glycine max
  Coding DNA Sequence Number=SeqID_102792
  Homolog annotation: Hit_ID=Q1SJP5; Match level="QueryCoverage=44%, HitCoverage=99%, E-value=3e-70, Identity=44%"; Hit description =Cyclin-like F-box; Serine/threonine protein phosphatase, BSU1
  Pfam annotation: Domain name=RINT1_TIP1; Domain location=243-514; Score=-163.4; E_value=0.035; Accession=PF04437.4; Description=RINT-1 TIP-1 family
MTKRIRKDSSLPEDVEKVNNSSVELDTREGVNDGFPRAGAGANDSLLPGLFYDLALNCLAWASRSDYASLAWWEVFNPKRNRWITLPKIPCHDYFNHPGKESSAVGSEMLSCMDSDSGTWELLPNMHTPRTLCSGFFMDGKCYVIASMYPLIVSLTCGDEYDVKTRNWRKIEEHLTNMVNKYDNERHTWSELGRLPVRADSSNGWGLAFKGCGEKLLVMSGQRGPEGFRNGTIDWKVLGVKEHLRVFVYNYAVMGWSGEMLLDSLSRRFAGIYNLTSLSGDYVDSMDELLQPLVDEAKLVGYSCRREWISAMVTSLTTYLAKEIFPSYISQVDEERVTGIQSSAIVSWLHLIDLTIAFDKRIKSLVDHSGITSLNALTDDEKVIKVTISINAAHYFESVLKEWSEDVFFLEMGMDEDDQPEMENNSNNYGELLPESSKRFIFYDEIKKLEEFKTQWVEKISLVIFRGFDCHSRDYVNNKRQWLEGEEGWTMSKTLIEALDYLQSKMSVVEELID

SEQ ID NO: 219571 - protein, 133 aa, Glycine max
  Coding DNA Sequence Number=SeqID_102793
MEIMKKKLKEAIKTELSQMALQHLPLVDALDPNVLAARVNTKGSCVEAVGNVVAEEPSAVDVTTMGLYIVGDDYTRLVALGKVFDSAGMIHNVPYADDVVKVSVVTIYDDDVRVPFPTVLILRNHSNQDPSSE

SEQ ID NO: 219572 - protein, 375 aa, Glycine max
  Coding DNA Sequence Number=SeqID_102794
  Homolog annotation: Hit_ID=Q1SCY9; Match level="QueryCoverage=20%, HitCoverage=5%, E-value=1e-08, Identity=37%"; Hit description =Integrase, catalytic region; Zinc finger, CCHC-type
MSDSSKDPLTPSPENIHVQTMSLGPKPVAIPYGVKLNGVNYSLWSQVVETFVASRGKFGYSIGKTPNPSTDDASYDRWSMENDIVKGWLIGAMEPDLMNLYPDVNQAQQKEIDEERVYIFLASLDDLYDRVRSDILHTEPFPNPDNAFVVVKSEEQRRNTMLHSQVTPSVTMEPKTTLTQNLQDIPRPLQGNRWDRMDQSYHIPDYCEPEALQGKFQIPILTLAMPKQTTSKKGEPKPTENVQDTTLPQPTTTTSKVEEAIEEKKSVSPPSPDLKTQQKMDFQILSEPIKDQKVKEELVPKPTPPPRVATMQTYEKSQKVQEVVESKPTTTMLTKGEKEFEAKPTPTMLTKVNTTERPQKGMLCFDAPEFEGENG

SEQ ID NO: 219573 - protein, 126 aa, Glycine max
  Coding DNA Sequence Number=SeqID_102795
MKKGKARKENEDRGVGEGGVASVEVKVLWRFVVVIVAVVGSVAMSIGDQWMYDSIMFEEVDMNDENENEAGLNEEEHVDCSDVLNTSQWARSVAYEIGFVAMIMKSDTNTDIRGRTSFVLIGCERS

SEQ ID NO: 219574 - protein, 192 aa, Glycine max
  Coding DNA Sequence Number=SeqID_102796
  Gene Ontology: Mol. function=RNA-directed DNA polymerase activity; Biological process=RNA-dependent DNA replication
MAELYLMPNVVIPLKFKVSNYDKYKGTTCPKNHLKMYNKKMGAYSKNENLLMHFFQESLTGATVTWQYHYNSDMATDKMRLQNVCKKEHESFKEYIQRWRDLAAQVVPPMMEREMITMIVDTLLVFYYEKMVGYMPSSFSDFVFTGKKIEVGLRRGKFDYPTLMNRKPGANGENKKEGETHADVILPPKGIG

SEQ ID NO: 219575 - protein, 85 aa, Glycine max
  Coding DNA Sequence Number=SeqID_102797
  Subcellular localization annotation: CTP_CleavageSite=16; ConfidenceScore=5.12e-01
WANCASTAKHNFNSLSVAEESGRASISRPQANARLALSSNPLTRAKREELGYNNNNNKNIRNNFNKGPGKELSRQQEEQLLQRYL

SEQ ID NO: 219576 - protein, 49 aa, Glycine max
  Coding DNA Sequence Number=SeqID_102798
MVYYAPWTEFKKRRSNAIHPLMKKQNHQKNTRQEAELLPLAMQEQGSKE

SEQ ID NO: 219577 - protein, 260 aa, Glycine max
  Coding DNA Sequence Number=SeqID_102799
  Gene Ontology: Mol. function=cyclopropane-fatty-acyl-phospholipid synthase activity; Biological process=lipid biosynthetic process
  Homolog annotation: Hit_ID=Q8PAZ7; Match level="QueryCoverage=92%, HitCoverage=54%, E-value=2e-79, Identity=59%"; Hit description =Cyclopropane-fatty-acyl-phospholipid synthase
STPRGSHTIGLQQSLQRGHVGVQVFGADRFDHLDRYQLVELALQVAVVLHQQRDMVLQARCLHALGSQRVLLGGDGGGGDVAAVVLRGVQRKTTPAGADLHHAIARLELELLADAVQLAARGGLQRFGFAGEQRRRIHQVRRQEQGEEIVAQVVVGGDVAPAALTAVAVQPVPSAQQPASHTGRALLHAVQQFAVAYQQLYQGNQIIAVPLALDVALAGADAALRSDLPVERGVIDGHRYLQPCVGVAQPDLAKGIAHAQ

SEQ ID NO: 219578 - protein, 63 aa, Glycine max
  Coding DNA Sequence Number=SeqID_102800
GTKGAEDDVSLCMLSSVLSYRQQKNVYTDNHSGISARQRDSKVSMTDLVSAEDDDTTVSEWQK

SEQ ID NO: 219579 - protein, 153 aa, Glycine max
  Coding DNA Sequence Number=SeqID_102801
MTCGEKLWSFCTPFAIQTQSCPMARRDKLWSFCTLLSSRGGEPDDMLETNYGHSAHLLPFRHSRVRWYAETNYGHSAPFCHPEAAGPMTCGDKLWSFRTPFAIQTQSCPMARRDKLWSFCTLLSSRGGGPDDTRRFTSSSALTRSVILTFESR

SEQ ID NO: 219580 - protein, 88 aa, Glycine max
  Coding DNA Sequence Number=SeqID_102802
MRYEDLWPSFVANLMAMISPRRIYQPPFPKWYNPNATCAYHVSQPTLRWEGDAGLAGASSMGGKCAESPPTFIRGKRRKNQKGVVYEL

SEQ ID NO: 219581 - protein, 128 aa, Glycine max
  Coding DNA Sequence Number=SeqID_102803
MEKKKESKRRKEMREEERRVVQKDERAKQFGEEVDTYEEQGNHWGMKPLTHTISKPYALVDVEQHLLILDLHDTFDLHNILDLHDFVLVNQYDSRMNHFEKGENDMNLSKGPNYDESLLVELLWRLDL

SEQ ID NO: 219582 - protein, 77 aa, Glycine max
  Coding DNA Sequence Number=SeqID_102804
MTYEAAKQITNRIDVLTTGIGQPEHPGRVRAIEVSITIKHYFGSASRGSHTSSSMAPQELEQLTHKIRDQLKEFMRV

SEQ ID NO: 219583 - protein, 89 aa, Glycine max
  Coding DNA Sequence Number=SeqID_102805
  Gene Ontology: Mol. function=actin binding
  Homolog annotation: Hit_ID=Q2HV31; Match level="QueryCoverage=95%, HitCoverage=14%, E-value=9e-22, Identity=63%"; Hit description =Prefoldin
MLKRQKKVLEKETQLLLAQTELNNIKKQLQSAENTKSKTLSELDKAKVTLQELRKKLNGVRESKQSAIEAAEVVNNRPNNLSRHYPKKL

SEQ ID NO: 219584 - protein, 64 aa, Glycine max
  Coding DNA Sequence Number=SeqID_102806
MWVPWGSSDDNGVLWVRATTMWMSRERFPTDFRREEKEKSDFRREEKEKSDFRPEDDQEKREGK

SEQ ID NO: 219585 - protein, 69 aa, Glycine max
  Coding DNA Sequence Number=SeqID_102807
MACWLRTAESENPRLVVYTRWRQWRPQRSPGGGGKTDVNNMVNISFRKTNVARGSLTSVLGKLMLLEAV

SEQ ID NO: 219586 - protein, 362 aa, Glycine max
  Coding DNA Sequence Number=SeqID_102808
  Gene Ontology: Mol. function=RNA-directed DNA polymerase activity; Biological process=RNA-dependent DNA replication
MSEIEEVQEQMKADMKVMKEQMATTMEAMMSIKKMMEVNTATVVVTTEGREVKHLEVRAVLILCKFRTSIPSHHMACLPTIHHPMLHTLPMRMSITLHPYSLRASNPNLIMHMSLNPWGRHMKHPETTLWPTPSLALDMLLRGKHLVAVPPAMVERDEFNYIEERLKVIEGGENYAFANMAKLCRVPDMVIPPKLKVSDFDKYKGTTCPKNHLKMYGKKMGAYVKNEKLLMHFFHENLTGAAVTWYTNLEASRVHSWKDLMVAFIRQYQYNSDMAPNRMQLHNMSKNEHESFIGKRIEVGLRIGKFDYPTWMNRKPGENGENEKEGETHVVAVVPTWPNFPLAQQYQYSANISPSHYPPVIP

SEQ ID NO: 219587 - protein, 133 aa, Glycine max
  Coding DNA Sequence Number=SeqID_102809
MKLLLSWIKLIRKQPNKFPIAVSAIAGNNDGRSKNVKEKRTSKKKQKREEEAFLLILATMAATKMKKKPSLGKKMQNRGAKKKKNEEDAESRNRSRRMKKQKKKQKQKQNRPRKEEEAGGGEREARVIFFKNS

SEQ ID NO: 219588 - protein, 45 aa, Glycine max
  Coding DNA Sequence Number=SeqID_102810
MPTSSRQLGGSSPESYSLHPAAVILLPQTRFAIITSITHTIQNCE

SEQ ID NO: 219589 - protein, 248 aa, Glycine max
  Coding DNA Sequence Number=SeqID_102811
  Subcellular localization annotation: CTP_CleavageSite=69; ConfidenceScore=5.51e-01
MYMLLRFIQNKSRCGNWNSQSHSHTAVPTLAVLTMLLAQPIFLSRNFPTLNNRNSRTSLQLHNPPALIRVSPQRTPIIASSGCFGCFVKPLDVRTKTSLGAFFKKRKGCAHICHSLKEESEVGGNGNNGRDWTTSILLFLLWAALMYYVFFLTPNQTPLDRVKSNSVLKCPSNIRIFNMSRDTYFLKKLLNLKGDDGFRMNEVLVSLWYLMGLWPLVYSMLLLPTGRRLLKQDRYFESRLSNQDSNYE

SEQ ID NO: 219590 - protein, 263 aa, Glycine max
  Coding DNA Sequence Number=SeqID_102812
  Gene Ontology: Mol. function=nucleic acid binding; Cellular component= endoplasmic reticulum membrane; Biological process=DNA integration
  Homolog annotation: Hit_ID=Q1RSG2; Match level="QueryCoverage=99%, HitCoverage=39%, E-value=8e-53, Identity=70%"; Hit description =Integrase, catalytic region; Zinc finger, CCHC-type
MVIPENYEENGRQPEPTPNELESSRRPQMNPQLPAILQDCVMFNDDDPFDEETINFALFSDCEPLTFEESSSDDNWRKAMDDEIHAIKKNDTWELTNLPTNKRHIGVKWVDKTKYNPNGEINCFKARLVAKGYKQKPGTLTNGIFYANNNDVELVRYTDCDWGGDIETRKSTSGYTFHLGASAVSWYSKKQPIIALSTTEVEYIAATSCATQVVWMRRILEVMHDKHNTLRKIFCDNKFAMALSKNLVFHGRSKHIDIRYHKI

SEQ ID NO: 219591 - protein, 66 aa, Glycine max
  Coding DNA Sequence Number=SeqID_102813
MAETKTKRNLPRQCRREDAATPPSTPTKKKTNEGHEEDEEHAIGRSRRRRRKRSCSSFFERKKKEE

SEQ ID NO: 219592 - protein, 91 aa, Glycine max
  Coding DNA Sequence Number=SeqID_102814
MEFFLELLEHLDYDWVNNVTEAILLFLRNWISSSKNVGVCEMATVDNDGRRRRYKPGPKNGINDMGRSQEPLSNLHIELALKYMLDCHLYN

SEQ ID NO: 219593 - protein, 134 aa, Glycine max
  Coding DNA Sequence Number=SeqID_102815
  Gene Ontology: Mol. function=RNA-directed DNA polymerase activity; Biological process=RNA-dependent DNA replication
MVEYLLVAINYFTKWIEARPLCEISVCETTGQAEAAKRVILRALRTKIDKPKDNNQRTSLSTHIGHRRHNPRQSRGTIHKEIVVLRTTQRKAHEGRTKDIGQGPRDDLNPRKGHPTSTDREIQYQGSISSLSTW

SEQ ID NO: 219594 - protein, 135 aa, Glycine max
  Coding DNA Sequence Number=SeqID_102816
  Gene Ontology: Mol. function=DNA binding; Biological process=DNA integration
MKTRFMTKFLAEFTGNDQTTPDWWKLYVDGAPNVKGSGASIILEGPNNVTLQQALKFNFKASKYQAKYKALIMNCIPKESNTKADLLPKLVSTKKTGHCGSKTTRDFDDANIQVFFMDNSSELQEIQEIQVTSTS

SEQ ID NO: 219595 - protein, 159 aa, Glycine max
  Coding DNA Sequence Number=SeqID_102817
MGLDDNVVDVELDIYFGLVFEDPIHQSLASRKLSTWNLDVPSTSLSMLSKWTSAMHLCSWLVRSLLSCVHCSGLASSLYSFSCKAEEWIGVRLDGIRRDFKPMECLPVKDVYGATLVNEDLEHHEIGDHDGDNHGVVLVDRVDTLEVSINENDRKEILW

SEQ ID NO: 219596 - protein, 112 aa, Glycine max
  Coding DNA Sequence Number=SeqID_102818
  Homolog annotation: Hit_ID=Q1SYR3; Match level="QueryCoverage=55%, HitCoverage=2%, E-value=1e-09, Identity=39%"; Hit description=RNase H, putative
MDVVRKGAWNIGKILASPAPLCKVEGIGPECQPLVVDTYHFGCNRASFDVEAIDPFMKFLHDIVFLLVVQTFEGHLVWFLPFSCHNLLGVYGGSLKCFLDDGFEMSVRQVAS

SEQ ID NO: 219597 - protein, 92 aa, Glycine max
  Coding DNA Sequence Number=SeqID_102819
MDELGKRVKVYIQIEEMSRFRDEERDPEDTKKISTETTMLTEEGTEQKIKEDIGTTSKDASDNLRKNRKMSPLTNQRCYQHHCRQIFLWRVV

SEQ ID NO: 219598 - protein, 166 aa, Glycine max
  Coding DNA Sequence Number=SeqID_102820
MQQGQAVILIARFPDPKYGVKMGFSKEAQNIPWWFQSQKRCKDKLKLPRNKHRIMVTSRKITKVMEKVLGMLEMVLEERRRRKWRFSKATRKAKVETLKCFCSRERKPSSDARHCIRDRNGHIVDIYQMNPQTKFREDPTVNEGWEAFLPRQLHVACLRSFIKRLS

SEQ ID NO: 219599 - protein, 61 aa, Glycine max
  Coding DNA Sequence Number=SeqID_102821
MENWRRALRNNFAGLQTRWWRMHEERQAMTFMGLRKKRQAMTFMGLRKKVEHGELANSATQ

SEQ ID NO: 219600 - protein, 91 aa, Glycine max
  Coding DNA Sequence Number=SeqID_102822
MVHQVKLNHGGDHLAKIGAKDESSYIAACLLPNTFRIVDVLVTFSFTLTKMSWTMKRTGFTGALYRTRARARVMGKSGGGTREDEGSTWRP

SEQ ID NO: 219601 - protein, 95 aa, Glycine max
  Coding DNA Sequence Number=SeqID_102823
  Subcellular localization annotation: CTP_CleavageSite=31; ConfidenceScore=5.35e-01
MEFLLRSFVLDSVIKKTLTALPLSPASRKLSSSAPSKPSSVQPQFRQEAWDLWFLKFLWCGAFERFFFCLFLFVLDEEHAEFCGGEVFVLARWFL

SEQ ID NO: 219602 - protein, 152 aa, Glycine max
  Coding DNA Sequence Number=SeqID_102824
MEGLVDLAAIDAFFAFHHGKESPVVAIVAMILSSCEGCPMRGVPSDESITPFIARGFSDHNARVLQGVRKAWDAAVRTQGLDWLPNLKTVRDDEVKASEESDEVQVLKAELERAWVVEEKFKAAIVSSNSEEVKGIITGQRHDLEGRAKGLP

SEQ ID NO: 219603 - protein, 145 aa, Glycine max
  Coding DNA Sequence Number=SeqID_102825
MKREKHASYCSHNSCKSLSEELRDYYEGMHRSHLRPHSHRREKERKPQEANINLSYFHGKDNVEANLDWEIRVEQQLKKKSTSKSYGSHSYPKKRPRGHITSQCPTTKTMIMTGQDIYSSQDKATTSPSSSESEEAKGEESSEEF

SEQ ID NO: 219604 - protein, 123 aa, Glycine max
  Coding DNA Sequence Number=SeqID_102826
MGESSELAEKEKGGERELVTDHGKRVQIADGQGRGFCIRNYQSLLAVQSAFVETESIMSTGIRQQFLHYLPQLVILVFFCLLPNSPTHKLARPKGLNIAVSRKEHLLCIPNSQLLLDFKVESQ

SEQ ID NO: 219605 - protein, 760 aa, Glycine max
  Coding DNA Sequence Number=SeqID_102827
  Gene Ontology: Mol. function=protein binding; Biological process=DNA repair
  Homolog annotation: Hit_ID=Q7Y1C4; Match level="QueryCoverage=86%, HitCoverage=56%, E-value=1e-139, Identity=44%"; Hit description =Breast cancer susceptibility protein 2b
  Pfam annotation: Domain name=BRCA-2_OB1; Domain location=519-649; Score=153.9; E_value=4.1e-43; Accession=PF09103.1; Description=BRCA2, oligonucleotideoligosaccharide
  Pfam annotation: Domain name=BRCA-2_helical; Domain location=331-516; Score=-34.0; E_value=0.0002; Accession=PF09169.1; Description=BRCA2, helical
  Pfam annotation: Domain name=BRCA2; Domain location=148-182; Score =32.7; E_value=1.2e-06; Accession=PF00634.9; Description=BRCA2 repeat
  Pfam annotation: Domain name=BRCA2; Domain location=54-88; Score =29.2; E_value=1.5e-05; Accession=PF00634.9; Description=BRCA2 repeat
  Pfam module annotation: Pfam domain module=BRCA-2_OB1::BRCA-2 _helical::BRCA2::BRCA2; Domain location=519-649::331-516::148-182::54- 88
  Subcellular localization annotation: CTP_CleavageSite=43; ConfidenceScore=5.17e-01
MCTWQILSNSPNNFHWQRITTTTTHQHASPPSFPLPSMQDLLRQGEERVLDDGFGFSNSLFTTGSGKKVTISSSGLVRAKTLLDTIDSSIQSPHRTNKLHAIGEKRKQRQEEEDESPQLKLHRVIDSPSVGGGCRALKKNGFEETDAYKQAPIKFHTAGGRSISISKDALQRAQSLLGDVGDLFEGGDAGSSMFSFPFERQADTAASSQRGDCNTPLVRRVLTPARSNCTAKSFTFPLQSSRQRELPPKFPCEGDGNNLITEFDAVGEESGYNSLKSTNACGQKKPLYGWNQAPHSAVHDSSLNGFSSKIDTHAVSIRRPLVDVSNTTNPDQTNNRQPASGKRRLGLRVTVSPFKKPRSSQISVPLEQDIGKSPHDLSQLSSGVSGCKREVSIRYPFQYPRMHIKDFFVVPPLQEKAHFPNLSRQVTSVNAEKYVFYERSGDNGMGAEAFVHLLAHHGASMHFATKEWVTNHYKWIVWKLACYERYYPASSAGKFLTVTNVLEELKYRYEREVNHGHRSTIKKILEGDAPPSSMMILCISSICSSHATESGTCFETQNGTQKAAAVKVELTDGWYLMNAILDVPLSKQHAAGRLFVGQKLRISRAGLCGWNGPVSPLEVSSTVSLLLHINGTYRAHWAERLGFCKIAGPPLAFRCIKSNGGLVPQTLAGITRIYPILYMERLSSGRSVVMSERMENKMMELYNQRNPGPAITLIHAYMSINESRLSSVSFSDTYQLVSELSILGASIVIMRATMESRMEG

SEQ ID NO: 219606 - protein, 96 aa, Glycine max
  Coding DNA Sequence Number=SeqID_102828
DRKGIESDALCWYTVLSHHVGQLDELPEVPYRIFLVAPLNELFSNICGNPCLNSDVTKLDGIGFPRGKSEVRPEEELEDDVIAEDVSEGDKRAVVV

SEQ ID NO: 219607 - protein, 153 aa, Glycine max
  Coding DNA Sequence Number=SeqID_102829
GGVASNTEIQFDEHVPFSIYWRSKINGGARSLGMVVVRVVSRSKDRKGERLRGRNEGSYPYLYYSTFTMNGGDYLYPRGTSFVVQVEGTSTWVVVTENKREYISCGSILVEGTSTRLFKENKGGYIPCGSLLVKDFTRLKRNLKDRRSLGDWM

SEQ ID NO: 219608 - protein, 389 aa, Glycine max
  Coding DNA Sequence Number=SeqID_102830
  Gene Ontology: Mol. function=[ribulose-bisphosphate carboxylase] -lysine N-methyltransferase activity; Cellular component=chloroplast
  Homolog annotation: Hit_ID=O65218; Match level="QueryCoverage=98%, HitCoverage=88%, E-value=1e-143, Identity=62%"; Hit description =Putative methyltransferase
  Pfam annotation: Domain name=Rubis-subs-bind; Domain location=291 -384; Score=16.1; E_value=0.004; Accession=PF09273.1; Description =Rubisco LSMT substrate-binding
  Pfam annotation: Domain name=SET; Domain location=70-282; Score =100.3; E_value=5.8e-27; Accession=PF00856.18; Description=SET domain
  Pfam module annotation: Pfam domain module=Rubis-subs-bind::SET; Domain location=291-384::70-282
  Subcellular localization annotation: CTP_CleavageSite=47; ConfidenceScore=5.32e-01
MAMAMAEASRITLHSTLLPFFTPKTHVGHRHLSLSSSRKHQVQCSVSAGAAAQTNPVAWGCEIDSLENSSALQRWLSESGLPPQKMGIERVEVGERGLVALKNIRKGEKLLFVPPSLVITPDSEWSCPEAGEVLKRNSVPDWPLLATYLISEASLMESSRWSNYISALPRQPYSLLYWTQAELDRYLEASQIRERAIERINNVIGTYNDLRLRIFSKYPDLFPDEVRLPSMGGNVALVPWADMLNHSCDVETFLDYDKTSKGIVFTTDRPYQPGEQEGANPSDSVELSLSLKKSDASYKEKLELLKNYGLSASQCFPIQITGWPLELMAYAYLAVSPSSMRGDFEEMAAAASNNTTSKKDLRYPEIEEQALQFILDSCKWITGSGCDFS

SEQ ID NO: 219609 - protein, 202 aa, Glycine max
  Coding DNA Sequence Number=SeqID_102831
MDEDQKNWNEMAKVMMMVNKKPTDMFNTIHIKDQSYGEVSRSFVVRWKDELEHTWHLLDSNDKIHSIKYNQDLQNPTIVPGWTELGDYYGLTVNPKQCHLSAPLSPSLHILLATPSSPLSVMPAPPMTLISSFFGYDSFGDCRFFPWKLPFTPSRTLARALQRGSSKGLDRLMGIQNCTLVILGLAKLLGELKECGHGIPKF

SEQ ID NO: 219610 - protein, 61 aa, Glycine max
  Coding DNA Sequence Number=SeqID_102832
MSLIADRGNPNEAIDVSSKERLSVEAPCSDNTGLAAKSRIATLSIFVATRRMPMRGRIRCS

SEQ ID NO: 219611 - protein, 191 aa, Glycine max
  Coding DNA Sequence Number=SeqID_102833
AFSEDLAKCAYRAKRVHPLRMNTHPLAELPELVPLSATVKELSAYPCSRCQLSGPYGFQKKKEYLYKAHNLVEIYHTERDEFKPKLESHNFHKRLTNLVESSIDLALVKEFYANLYSSKGPSPKHVRVRGHLVRIDVDNLNTFLKTLVVLAEGHPGKILRKYLTTLAQMDMNVGALISGQITSMAQSNSSR

SEQ ID NO: 219612 - protein, 129 aa, Glycine max
  Coding DNA Sequence Number=SeqID_102834
  Gene Ontology: Mol. function=RNA-directed DNA polymerase activity; Cellular component=chromatin; Biological process=RNA-dependent DNA replication
MAPEDMEKTTFVTLWGTFYYKVMSFGLKNTRATYQQAMVTLFHDMMHKEIEVYVDDMIAKSKIEDEHLVNLRKLFERLHKYRLRLNPAKCTFRVKSGKLLSFIVCQKGIEVDLDKVKVILEMPEPCIEK

SEQ ID NO: 219613 - protein, 175 aa, Glycine max
  Coding DNA Sequence Number=SeqID_102835
  Subcellular localization annotation: CTP_CleavageSite=56; ConfidenceScore=5.27e-01
MRSDCLVQFSILILFRSPRNCVFVHVSSTFEFGAMRSDCLVQFSILNLFRSPMNCVFVHVSSTFEFGAMRSDCLVQFSILNLFWSPMNCVFIHVSSTFEFGAMRSDCLVQFSILNLFRSPMNCVFVNVSSTFEFGCMRSDCLVHFSILNLFRSPMNCVFVHVFSTFEFGASVVIA

SEQ ID NO: 219614 - protein, 380 aa, Glycine max
  Coding DNA Sequence Number=SeqID_102836
  Gene Ontology: Mol. function=nucleoside-triphosphatase activity; Cellular component=membrane; Biological process=protein complex assembly
  Homolog annotation: Hit_ID=Q3RH35; Match level="QueryCoverage=93%, HitCoverage=92%, E-value=1e-123, Identity=61%"; Hit description =Cytochrome oxidase assembly protein precursor
MESVRGTQTGQQADQHEQQGNGHAVVGHRHFQRQRQLHIEDAEGDLQHQQRDQRTGPATHARQAEQAHAQPQQVDSHHHREQAVRHLDGDTRGAIQHTAFVVHADAAPQGEAFDEVVLRPPLVGATREVVQRGAAAAAGQRRVVGTDPAPQCDLGDQHRHTDAQHPLQLRCFGQGDRHVRCAPGHPHQQREHQHAAQQVAHHHDGFQQQGHRPHAQQGLEDHHRQGQQGSARQVDVAPAQRRDQQDRLAYQGQGAGGAVPAHHVQRYAGGHQYAGGHHRRASESPLARGQQRQGQDLDAQRAGQEAMHLFTPGLVGFQRADLRRGVADGLFHVLRPGGLAIAGGPVRAAQAGIGQAHEGTEHDRARGHDHGEPRQAVEIA

SEQ ID NO: 219615 - protein, 74 aa, Glycine max
  Coding DNA Sequence Number=SeqID_102837
MSVKNLVGRLGVHDMTNHTLASESGSQCFARMLQLCGIDTGLKEHSNQVTPKAYTPKSPSGPLPPNSGPIQKTF

SEQ ID NO: 219616 - protein, 81 aa, Glycine max
  Coding DNA Sequence Number=SeqID_102838
MEAFGLLAGNSKEKMKKNHFSYLLRLVGPRPIVRVHLVGCVQSRMSYCPTVSGDDRSNGHCVAPESYPHACPVRVRRGTRR

SEQ ID NO: 219617 - protein, 83 aa, Glycine max
  Coding DNA Sequence Number=SeqID_102839
MDPATAERLSQIDQEIQNIDTEKAQRQQTLAAFWEHLPPIDPALVAAAMQRILDRIRGLEKGGGPSSKNNETSFCVAGLSMCA

SEQ ID NO: 219618 - protein, 59 aa, Glycine max
  Coding DNA Sequence Number=SeqID_102840
  Subcellular localization annotation: CTP_CleavageSite=18; ConfidenceScore=5.39e-01
MEQSSLDSSKADQYKPTRASSYPDNSSFTGFYLSFTGLFVPSFMMELPSANRHSTAAPS

SEQ ID NO: 219619 - protein, 72 aa, Glycine max
  Coding DNA Sequence Number=SeqID_102841
MENWRIALRNNFARLQTRRWGMHEQRYAMTFMGLRIKRSPKKVEKGELANSATNNFAGLQTPSGGHMNSAWK

SEQ ID NO: 219620 - protein, 43 aa, Glycine max
  Coding DNA Sequence Number=SeqID_102842
MAEPSKKRKGTSSQSQRHSGSQEAPIPSSIPSGSLFSSKEQRI

SEQ ID NO: 219621 - protein, 136 aa, Glycine max
  Coding DNA Sequence Number=SeqID_102843
MPISPCGSISWSMSFRHRDRARKTSSGPGEVQQGPGFPALITSLWITPARHSVDLEKSNRVLGFPALIMGICQFYGVPVTPSKVIKPPTNRAFIKKYCAPRQAQGETPQQPGDCRQRATNAPPPPLEFTLAHPQKG

SEQ ID NO: 219622 - protein, 69 aa, Glycine max
  Coding DNA Sequence Number=SeqID_102844
MQCGLTMEGFNIRQRTRLSARKPHSHPWLTPAVAAPEGARITQKLLSGEKLTTWMQGDEMICEVTHQDA

SEQ ID NO: 219623 - protein, 73 aa, Glycine max
  Coding DNA Sequence Number=SeqID_102845
MILLYLHLRDDFRIKQKGTHMGSANSKSGSAISNTVHTMDHDIGLVRHATFYIMGMDRLEYCQLALNIPQNTM

SEQ ID NO: 219624 - protein, 66 aa, Glycine max
  Coding DNA Sequence Number=SeqID_102846
MKGEECWQRHSIAEGFIIIRDENDITSRILEVAPKFLWDVESQMLENKEKKMETVLICRKKFWAIV

SEQ ID NO: 219625 - protein, 74 aa, Glycine max
  Coding DNA Sequence Number=SeqID_102847
MGVSLNGRVMDYVKDLTILIARFNILFQMYVCFCELTLALLHIWFVPMMITVLPGSKQLATSGSGSSRLKTQEF

SEQ ID NO: 219626 - protein, 99 aa, Glycine max
  Coding DNA Sequence Number=SeqID_102848
MKVKQKTYTNVNLPSLSGDEAKDRDDKQNSYMDKLFLKKQPVSFWSFGHRCFGKPGEEVPLPMVAEAYKERFKEAPISKEYQEWCKPWKGSLMIIVLGK

SEQ ID NO: 219627 - protein, 109 aa, Glycine max
  Coding DNA Sequence Number=SeqID_102849
MTIETPHPPPTTTGGHHQPSLLAVEPPHKDEHFNQSEILRIHLRDSVENKLSILSFIVSLSKYLQFLMRENTCTWGHATQFGTPLRLRLITIGRAELPMHDRVTSTLAA

SEQ ID NO: 219628 - protein, 92 aa, Glycine max
  Coding DNA Sequence Number=SeqID_102850
MELMLYFNLLLASNTQSNNEEVQTPNVTSGNSERQDESNNDGCSNVEKAQKKRKHGEVAPLPPPSTNPTPTNPIAGESGGGEELFVEIVKNV

SEQ ID NO: 219629 - protein, 250 aa, Glycine max
  Coding DNA Sequence Number=SeqID_102851
DTSKDIGGGVPKVQMKGKDRNGATKKQGAHARDKASSKHEVAQPSIPIIDNERKDRDSLEVILSLQNMNMGFVFGNNCQARCSSSIPPRINIDMKEMEVSTTMETESETINQSSKMEHDGDTYGNFGGIWCLWNFDLWKVEILHSEHQFVHMKIGLKKQPMWFITVVYGSPKLQERRSRAKWVAFGVRNTHYFHGVMTTKRRKRNTYEAIQDANGVCVANKVYLESVVFSMGNYKALGVDGFQSIFYKSK

SEQ ID NO: 219630 - protein, 373 aa, Glycine max
  Coding DNA Sequence Number=SeqID_102852
  Gene Ontology: Mol. function=electron carrier activity; Cellular component=integral to membrane; Biological process=electron transport
  Homolog annotation: Hit_ID=Q6WPM6; Match level="QueryCoverage=95%, HitCoverage=67%, E-value=2e-57, Identity=37%"; Hit description =Putative hemolysin activator HlyB
  Pfam annotation: Domain name=ShlB; Domain location=14-360; Score= -86.5; E_value=6.1e-11; Accession=PF03865.4; Description=Haemolysin secretionactivation prote
MQAGSSAYFRPDALFPIAAGDVLNLRSIEQGLENMGGIPGVISDIRIAPGERAGESDIEILRQQDKYWRFTAWADDAGVRSTGRYQTGGALYLDNLTALGDVLYLSMARSILAPPGKGNESRALYYSLPWGYWRFSALGGDSRYHQTFAGNFTDYRYNGRSQYWGLQADYTLARGMNEKTSLNAQLLQRHYRYYLNDTEIALQSARLTSLKLGASHLYYGARTQIALTADALAGVGKGSSHAEQQLRAGGSMLKPFNAFGHRLRYLGELSGQWASAAQPIQDKSFIGDRSTVRGFSGDSKLIGSSGGYLRNTLTLERDMLQPYIGFDYGQLAKQQGEGGQLAGSVIGLQVNQGRLAADIFRRHAGDQTRRAAE

SEQ ID NO: 219631 - protein, 178 aa, Glycine max
  Coding DNA Sequence Number=SeqID_102853
  Gene Ontology: Mol. function=DNA binding
  Homolog annotation: Hit_ID=Q1SP03; Match level="QueryCoverage=88%, HitCoverage=33%, E-value=1e-14, Identity=31%"; Hit description=IMP dehydrogenase/GMP reductase
MGSNQAPSFKKMFYPVKIKSLEVASLQELAQRMDQLQLFIESIASLAQYYDQLLRCFTFGDFQLIPIIEEFEGILGCPLGGRKSYLFSGLYPSMARIAKVVKVPIPRKHLEDKAKALVDQGEWTSFADVLALLVFGIVLFPNVDRLVDLAVIDAFLSYHHSKESLVIVVLADAYDTFD

SEQ ID NO: 219632 - protein, 805 aa, Glycine max
  Coding DNA Sequence Number=SeqID_102854
  Gene Ontology: Mol. function=GTP binding; Cellular component =monolayer-surrounded lipid storage body; Biological process=lipid metabolic process
  Homolog annotation: Hit_ID=Q1RUV0; Match level="QueryCoverage=99%, HitCoverage=96%, E-value=0.0, Identity=82%"; Hit description =Phospholipase, patatin family, putative
  Pfam annotation: Domain name=Patatin; Domain location=232-435; Score =94.7; E_value=2.9e-25; Accession=PF01734.12; Description=Patatin -like phospholipase
MDHISNEASVDPFAIGPSSILGRTIAFRVLFCKSISQLRYHILFVLSNIFKRFRGFWAPIVSWLHPRNQGILAMMTMIAFLLKRYTSVKVRANIAYKRKFWRNMVRAALTYEEWAHAAKMLDRETQKMNESDLYDVELVSNKLEELRHRRQEGSLRDIIFCMRADLIRNLGNMCNPELHKARLQMPRLIKEYIDEVSTQLRMVCNSDSEELALEEKLSFMHETRHAFGRTALLLSGGASLGAFHVGVVKTLVEHKLLPRIIAGSSVGSIMCSIVATRSWPELQSFFEDSLHSLQFFDQMGGIFTVVKRVTTYGAVHEIRQLQMLLRHLTSNLTFQEAYDMTGRILGITVCSPRKHEPPRCLNYLTSPHVVIWSAVTASCAFPGLFEAQELMAKDRSGEIVPYHPPFNLGPEKGSTSVRRWRDGSLENDLPMMQLKELFNVNHFIVSQANPHIAPLLRLKEFVRAYGGNFAAKLAHLAEMEVKHRCNQVLELGFPLGGLAKLFAQDWEGDVTVVMPATLAQYLKIIQNPSYVELQKAANQGRRCTWEKLSAIKANCGIELALDESVAILNHMRRLKRNAERVATASHGLPSTVKFSGSRRIPSWNIIARENSTGSLEDLHADAASSLHQGVISPSGATGKNWKSHRIIHDASDSESETADLNSWTRSGGPLMRTTSADMFIDFVQDLEFHKVNTELNRGKVTHTSPHDFQHHSSRHTTVNRWSESTENDQKENGNRIVMNESNIMVTEGDLLQPERIHNGIVFNVVKKENLTPNRNHDYNSYNNEVAECVQIDFPGKEVDAASSAS

SEQ ID NO: 219633 - protein, 203 aa, Glycine max
  Coding DNA Sequence Number=SeqID_102855
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=91%, HitCoverage=21%, E-value=3e-53, Identity=49%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=PAN_2; Domain location=127-195; Score =87.9; E_value=3.1e-23; Accession=PF08276.2; Description=PAN-like domain
  Pfam annotation: Domain name=S_locus_glycop; Domain location=1-110; Score=70.6; E_value=5.1e-18; Accession=PF00954.11; Description=S -locus glycoprotein family
  Pfam module annotation: Pfam domain module=PAN_2::S_locus_glycop; Domain location=127-195::1-110
MEWLAFKWSPQVKANLIYDFKFVSNKDELYYTYNLKNSSMISRLVLNATSYVRKQYVWNKSKQRWEVYTLVPLDLCDSYSLCGANANCVISYSPVCQCLQGFKSKLPEEGSSMDWSHGCIRNKELRCENKNNDGFNKLTLLKKSDTTHSWLDQIVGLEECKAKCLDNCSCMAYTNSDISGQGSGCAMWFGDLIDIRQFAAVGQ

SEQ ID NO: 219634 - protein, 62 aa, Glycine max
  Coding DNA Sequence Number=SeqID_102856
MGAVRRRDGAAMKSRVEIERMKKISHFFNAKTSFKNWPESPGLHKTGKVWLGYPGPNAWPIQ

SEQ ID NO: 219635 - protein, 46 aa, Glycine max
  Coding DNA Sequence Number=SeqID_102857
MVQAQHGHIIAVDLVLEALTARWPWRSESEKESKNRERQRIAGATY

SEQ ID NO: 219636 - protein, 161 aa, Glycine max
  Coding DNA Sequence Number=SeqID_102858
  Gene Ontology: Mol. function=transition metal ion binding; Cellular component=cytoplasm; Biological process=fucose metabolic process
MGDRLKEMICDFGQESFQQTLAPMYDTLQSDSKKPLYPGCKKSLTLLSMVLSLVNFKTRYGWSDKIFTSLLQGVQDIVLEENMLQKSYYKEKKILCPMGMEYQKIHACPNDCILYRNEFEEMHKCPRCGVSWYKLKDDDECSSDKSTNKGPDAILPPKGIG

SEQ ID NO: 219637 - protein, 108 aa, Glycine max
  Coding DNA Sequence Number=SeqID_102859
  Gene Ontology: Mol. function=DNA binding; Cellular component=nucleus; Biological process=regulation of transcription, DNA-dependent
  Homolog annotation: Hit_ID=Q8GT89; Match level="QueryCoverage=69%, HitCoverage=7%, E-value=5e-32, Identity=84%"; Hit description =Hypothetical transcription factor
MLKLILMQSFCFLVRGVRKTLNSELWHACAGPLVSLPQVGSLVFYFPQGHSDHVAASTRRTTTSQIPNYPNLPYQLLCQVQNVTLHADKETGSDCSRSSSFTLKLQGC

SEQ ID NO: 219638 - protein, 199 aa, Glycine max
  Coding DNA Sequence Number=SeqID_102860
QTCAKARVMSEIEEVQEQMKVDMEAMKEQMTTMMEAMMSIRKMMVVNTAIEVDPTHPSGLNQVNCPALDMVGQRGEALGSAGDPYFVQVQSKHSFPPYGLPPNYTPPNVAHAPDENVDNSALILIESQQPQSGATIWWRTPAKHFGGPSVSPTTTTLTFCDGNTASCHELCLVPDLVNPSKFKVSNFDKYKGLLALRII

SEQ ID NO: 219639 - protein, 269 aa, Glycine max
  Coding DNA Sequence Number=SeqID_102861
  Homolog annotation: Hit_ID=UPI00006BC445; Match level="QueryCoverage =35%, HitCoverage=22%, E-value=3e-13, Identity=47%"; Hit description =permease protein, putative
  Pfam annotation: Domain name=Multi_Drug_Res; Domain location=209-269; Score=7.2; E_value=0.0001; Accession=PF00893.10; Description=Small Multidrug Resistance protein
MGMGSGRVFTLFSLEAAFLGLLGSAIGAGIAILAGTGISSALSAGLLADLPGLTLIAFDPASIATIIVLVMIIAFLSGTLPAARAARKDPVDALRYDDVLDVCRRDRLRCLRDPVHPRLEGIPAMGVQCGRDRGLRGGDVHDGPAASAPAGRDRLRRLDGDCRGSPVADRPLRLPGEDPQAPARRHGRDHRGRGASRDGGAGMNPTLRRGWFHLSLTVVFEVVATLALRASDGFTVLIPSVIAVVSYAATVAVLAWALQRIPMSLAYVV

SEQ ID NO: 219640 - protein, 65 aa, Glycine max
  Coding DNA Sequence Number=SeqID_102862
NAKGKHRCTMGELLERENADKKLVKYGNCECNCRYTHLSSVRHSRLANLRAKRARETFGFSKRLA

SEQ ID NO: 219641 - protein, 277 aa, Glycine max
  Coding DNA Sequence Number=SeqID_102863
MRGAPSEESIAPFIARGFSDPNARIPQGVRKAWDAVQRKDKKLRGSSNGIIGGYWKWLRVRTQGLDWLPKLRPAREEKVEAPKESEEVQAVKAELEKVQAVKEKFKSTAIKVRKEYDELKNINIATAEALERETKRARKEEHGRNKFRGALWGNNSELKLRRDERDQSRVEGMILKDELKAYLRSKRSLSQQLRETKGNMLAIIDKYKEELNLAAAHEQRLGDEYAKVSPEKEARERVIDSLHKEAMMWMDRFAFTLNGSQELPQLLAKVKAMADVY

SEQ ID NO: 219642 - protein, 61 aa, Glycine max
  Coding DNA Sequence Number=SeqID_102864
MTGFFSSAKVERMSLYQDGQKIVLVQKGLLGHVRSFDIMAANGFVIATEKKLPSILVDETS

SEQ ID NO: 219643 - protein, 87 aa, Glycine max
  Coding DNA Sequence Number=SeqID_102865
MNTNKNSTNQAVLSPHGYPDGGPVLKFSSNNDDFAFLGDVVALINAEKGALIYMRNGKILETDKSVKALKRKYEEILDYYQKNWRDR

SEQ ID NO: 219644 - protein, 382 aa, Glycine max
  Coding DNA Sequence Number=SeqID_102866
  Homolog annotation: Hit_ID=Q1SDS1; Match level="QueryCoverage=24%, HitCoverage=21%, E-value=5e-09, Identity=34%"; Hit description=IMP dehydrogenase/GMP reductase
VRHACPLESHRSCTEKGGANWDRLLANKEGASVNWFPRWIEGRTRVLISCGGFLNVSLMGTRGCISYNPVLAIRQLGYPMRGASLEEELTPVRKAWEVVQKKDKELRGSNNGPIGGHRRWLKAHVQGLDWLPSLRTTKREEVEAPEEDEEVQALRTELEQAQIVKERFKSAALKIRKENAELRDINIALLFRWRIPSYGPHYWKTIWWWPYPGRSSSHHTPSEGPNVKTNPLASHGGASVNAIEKDRPSGSKRLEDVATSRRFIYQSLQEACMVSCGGDKSDESTLTAHGLGAARSVRGRNVIGSKSEYPPTVPKPTPFSYQSNKVVPWKYNPPAFGEGAATEVDSLSAKVTNITGLSGVTRSGRVFAPPHSAELPPKGNEP

SEQ ID NO: 219645 - protein, 75 aa, Glycine max
  Coding DNA Sequence Number=SeqID_102867
AAGPMTSRDKIWSFCTLVSSKGGGPDDTRRYLTVIRTLVSSRGGGPDDTRKYPSGYPYKHSFAICKTERLIACRG

SEQ ID NO: 219646 - protein, 109 aa, Glycine max
  Coding DNA Sequence Number=SeqID_102868
LMLVYNQQQLAHNRPILSMEQFLDKVAWPEAQLLLGRAPEVVLPSPIPTRTEPAPTESQPPVVDPPASLEVEILSPPLAPPAPPLILILDDSDAEAVAPSNSPAYYLED

SEQ ID NO: 219647 - protein, 97 aa, Glycine max
  Coding DNA Sequence Number=SeqID_102869
MKDKRDEEEKLEKQKKKKDSDIKRALLKQSFYLLLSRETSLSTAIPLKLEVIPKVKELVDEGLVCKSLNPCTLLVPKNRYYEAPNPYDRCYDECVEW

SEQ ID NO: 219648 - protein, 217 aa, Glycine max
  Coding DNA Sequence Number=SeqID_102870
  Gene Ontology: Mol. function=zinc ion binding
  Homolog annotation: Hit_ID=Q1LEG2; Match level="QueryCoverage=50%, HitCoverage=99%, E-value=4e-26, Identity=53%"; Hit description =Transcriptional regulators, TraR/DksA family
  Pfam annotation: Domain name=zf-dskA_traR; Domain location=147-213; Score=-4.8; E_value=0.038; Accession=PF01258.8; Description =Prokaryotic dksAtraR C4-type zinc fin
MGEREGKPEVYREAVQPLWRVQGRAPDALTSLNDSRTLFAQDCSGHCQARVRSPRRPASFGHPTLGEHASSACSPLRLRFRREARAIHVLYGDVVMLLDLERFRQRILDELEKVERSLQNSQQAAATVLLDQSSVGRLSRMDALQQQAIARGLTERLQLSKRKLQAARDRIDSGSYFLCCQCDEKIELSRLEHDPATVFCRACMQERDVLLQNRPRG

SEQ ID NO: 219649 - protein, 132 aa, Glycine max
  Coding DNA Sequence Number=SeqID_102871
  Gene Ontology: Mol. function=DNA binding; Biological process=DNA recombination
  Homolog annotation: Hit_ID=Q0Z036; Match level="QueryCoverage=81%, HitCoverage=19%, E-value=6e-16, Identity=45%"; Hit description=Phage integrase:Phage integrase, N-terminal SAM-like precursor
MIPEEAAQDFPGAAALAALRAWYAGMGITDAVAQYLPHSTDAGRSSPTVLGEIRRQLADRARRCRRDDLAQLILQPASERPKRVRAVMAAIDLLRGLSVPRPLVTDAVERWLPARIANPIQADGLRTLADLT

SEQ ID NO: 219650 - protein, 125 aa, Glycine max
  Coding DNA Sequence Number=SeqID_102872
VHLLGLLTENKRGYISCGSVLVEGTSTRLFKENKGGNTGVQTNVVGFTLVDLKKLTYQNDSFILAEQAKKVFYVQDPCYERCSVVLHGKTIGVNVEDDDSYLDTYVIPLSTQMSPNVVGEEEADD

SEQ ID NO: 219651 - protein, 76 aa, Glycine max
  Coding DNA Sequence Number=SeqID_102873
MVQPKPSAGLKGQPHQHALTHHAFLYFNKQKLGPPKPKSCENTIEAFHRALGGRTFGYQQQGNGAMWLAPSSQNTT

SEQ ID NO: 219652 - protein, 209 aa, Glycine max
  Coding DNA Sequence Number=SeqID_102874
  Gene Ontology: Mol. function=potassium-transporting ATPase activity; Cellular component=integral to membrane; Biological process =potassium ion transport
  Homolog annotation: Hit_ID=Q8PPD0; Match level="QueryCoverage=89%, HitCoverage=36%, E-value=4e-58, Identity=56%"; Hit description =Potassium-transporting ATPase A chain
  Pfam annotation: Domain name=KdpA; Domain location=2-209; Score= -294.3; E_value=8.2e-11; Accession=PF03814.6; Description=Potassium -transporting ATPase A subunit
MTEMLVIVAASLLLAWPLGLYLARVMRGTPMKVDVLFHWIEKPLYRMFGVDPARSMSWRGYVLAFVLSNVVVAVLTQAVFMTQAWLPLNPDQIPNMRWDTALHTMISFLTNTNQQHYSGQAQLSYLSQMTGITGLQVVTPMMGLALAVATLRALFSRAPQAAAATGSGDDRQVAVGNYYVDVVRLCVRFLLPLCLVWTLVLPSQGGGIL

SEQ ID NO: 219653 - protein, 72 aa, Glycine max
  Coding DNA Sequence Number=SeqID_102875
  Subcellular localization annotation: CTP_CleavageSite=48; ConfidenceScore=5.06e-01
MAPSLYSDVLCLSSTGKGQRSVSRDPILHLRPFLSTYKLETNNVRPIVTGSLSYLDWFSVFNLASTPDSSSR

SEQ ID NO: 219654 - protein, 124 aa, Glycine max
  Coding DNA Sequence Number=SeqID_102876
  Pfam annotation: Domain name=AT_hook; Domain location=5-17; Score =14.7; E_value=0.067; Accession=PF02178.9; Description=AT hook motif
MVGSKRSRGRPPKTVSPVPVNPPSPVAPPEMESEIHDEDEDGDLANSKQGPVNGSETMAQETLIEDQDGIGHKLWVDMISGNRNPAKGRVMQYVAPKVVDGEIDVKIEDEDVAPELKFWETTLI

SEQ ID NO: 219655 - protein, 130 aa, Glycine max
  Coding DNA Sequence Number=SeqID_102877
  Gene Ontology: Mol. function=DNA binding; Cellular component=nucleus
  Homolog annotation: Hit_ID=Q0PJJ0; Match level="QueryCoverage=97%, HitCoverage=46%, E-value=1e-22, Identity=73%"; Hit description=MYB transcription factor MYB118
MGLWHMCLLIQSAKLLILTHKRHQKMVQHFMHPCHATFWFSSFGATTSFRWLYFIKKYACTWSTFTYYTKWNCQPHIMLYDITNLDDIGSKGITKITNNSLRGVGNSTKTLPTSEIAKQGKQAPVLHGIF

SEQ ID NO: 219656 - protein, 143 aa, Glycine max
  Coding DNA Sequence Number=SeqID_102878
MIKGKNDLLVEMPINTSFKSTPQVNSKKKDAETYDTPVVSSNAKSVNKDKNELPLVDALAVIIPKPLVTNIPQSIDNLHNPISESEKGIEEPTVANQEKLYVGIVVATSIALQQSAKPPNLPLDFVQDNAYLIDVDPFTIIDV

SEQ ID NO: 219657 - protein, 63 aa, Glycine max
  Coding DNA Sequence Number=SeqID_102879
  Gene Ontology: Mol. function=protein binding
  Homolog annotation: Hit_ID=Q5PFQ2; Match level="QueryCoverage=100%, HitCoverage=37%, E-value=1e-24, Identity=88%"; Hit description =UPF0234 protein yajQ
  Pfam annotation: Domain name=DUF520; Domain location=7-63; Score= -33.1; E_value=7.3e-08; Accession=PF04461.4; Description=Protein of unknown function (DUF520)
MKGEEKMPSFDIVSEVDIQEVRNGVENATREVESRFDFRGVEASFELNDANKTIKVLSESDFQ

SEQ ID NO: 219658 - protein, 75 aa, Glycine max
  Coding DNA Sequence Number=SeqID_102880
MEATPFDFPQVLFNYFATQVMKDKSIEKDIYHKVVLTKVLGARGVIRKFLYKTPEEVQDKIYFDGVFLPKQEEPS

SEQ ID NO: 219659 - protein, 57 aa, Glycine max
  Coding DNA Sequence Number=SeqID_102881
MMDTSAGLVICTTSPSSDEAEGFLEVSKRRKRFWVQRFSEGKTMQRVSKRFDSERLR

SEQ ID NO: 219660 - protein, 76 aa, Glycine max
  Coding DNA Sequence Number=SeqID_102882
MVKKLAHLGELVTLGLRHDGGVLRGSKVQYLRELIKKKKKEEEMKPRCYRIATVIVPTSFLVRCSSHQSVSFIFRD

SEQ ID NO: 219661 - protein, 48 aa, Glycine max
  Coding DNA Sequence Number=SeqID_102883
MVQLSAHRYTKPNIFTVSCTLKSAKHRYHAKPQMLTGVYNFKLGIARG

SEQ ID NO: 219662 - protein, 129 aa, Glycine max
  Coding DNA Sequence Number=SeqID_102884
  Gene Ontology: Mol. function=nucleic acid binding; Biological process= DNA integration
MYLRKTTQNKTFIIRKLVNLKYKEWRSVEEHLSDFQDLVNQLVTVKLVLEDELQALIFLSSLPKSWKTLVVSLRNYGPNGQLTLFLVKDSMSNEESGRKDMGSSSSQSLVTDNKGRSKSRGQLSKAKDR

SEQ ID NO: 219663 - protein, 122 aa, Glycine max
  Coding DNA Sequence Number=SeqID_102885
MAKLPKPFRVFECKAFACVSKEQRQKLYDKAIPCIFLGYKNVEFGYKLWDPKKRGVIKSKDVVFHERQTMLVSDGLETSEQGGKVDLTPVTPARRIAIEGVDLDNELRVDDELAIKYGDDQA

SEQ ID NO: 219664 - protein, 78 aa, Glycine max
  Coding DNA Sequence Number=SeqID_102886
  Gene Ontology: Mol. function=RNA-directed DNA polymerase activity; Biological process=DNA integration
MDQLEGFEETRKENMVSKLKKSLYGLKQTPRQWYKKSDSFMTNHGYIRTNSDNFVYVKIFPNDMLIVGQDKKINIRGT

SEQ ID NO: 219665 - protein, 129 aa, Glycine max
  Coding DNA Sequence Number=SeqID_102887
MGGVVTMMHIPVSQEGKYLYLGACHSVWNSLETQVDHHGEEGVACASQGDLATCCLLFLSESIAWTCLGYFLMNGTTLHLRVKAMRNQNRGKVAGVVEYQGLDCFQRNNPSAFNEGYNPNGAHNWITGD

SEQ ID NO: 219666 - protein, 239 aa, Glycine max
  Coding DNA Sequence Number=SeqID_102888
MPKDTEERGKKVILWIFLDPSSPRLASGSPGPSNNFMGSEVKRIKRREKEEEERKRNEVEALPNHNRGDERAFLYMLSLSRREAKRQPGVGKCAKWTGEYGLVLNLVNEWEKEVVLASFLVKSPIVNAKCPVVGHSSRNQLIVLVFHNSDVRLLRNHLDGLASVHPMAFCGVFLEAKLHGESKNNSRVQDKNQEEFKTQEESLESRIKIQGSISQESRSRFKTQDSRIKRRLNQDKYEK

SEQ ID NO: 219667 - protein, 245 aa, Glycine max
  Coding DNA Sequence Number=SeqID_102889
MYNFTMFDDMVNGFANIDYLIDVIGEVVEIGHWNLHGKPKKVVFTMINECESIISCTLWEALAMELKECLDRHVVGPVVLLLSMTKIKEARDHFLHNARVKCFDEVSQVKKKCMCVIGATITKLLVDNGWIYDVCPRCNKKVDGEALSFICVSYGNESASTIPRSPFIKLYHRFCVDESVFDPRDILEALDHLFEDETLISPVLAKLLTLEHQDEAEPSISLMHENNDVIDSVNYLVLLIGLIVI

SEQ ID NO: 219668 - protein, 76 aa, Glycine max
  Coding DNA Sequence Number=SeqID_102890
  Gene Ontology: Mol. function=RNA-directed DNA polymerase activity; Cellular component=chromatin; Biological process=RNA-dependent DNA replication
  Homolog annotation: Hit_ID=Q1T2D5; Match level="QueryCoverage=98%, HitCoverage=4%, E-value=1e-21, Identity=64%"; Hit description=Chromo
MLVTSLIQLSQGSFSSPVLLIKKKDGSWHCCIDYHTLNAITIKDKFLMPTIDELLVELGRASCFSKLDLRQGFHQI

SEQ ID NO: 219669 - protein, 122 aa, Glycine max
  Coding DNA Sequence Number=SeqID_102891
MASIWPKLLESEVWYVEKNLETSRALENSSIHMASSSWKIENKNHCPLVQETSMHVLRDCSQTLWSWNHLVAIEFKSDFGSAWYSRAKQPPRTKRERETRAQGREWKFFLAFIKAGVNIYSH

SEQ ID NO: 219670 - protein, 104 aa, Glycine max
  Coding DNA Sequence Number=SeqID_102892
MEDCPIHGEVQILCYTGLDEVVGAPTIHEDHDIVEELKRKSGSRSCNGGQGYGRGMKSSTTTTSKNEAVEEKWCCEAHNSIGKPLKLREIIIHRPVLLEFEKAS

SEQ ID NO: 219671 - protein, 264 aa, Glycine max
  Coding DNA Sequence Number=SeqID_102893
  Gene Ontology: Mol. function=nucleic acid binding
  Homolog annotation: Hit_ID=Q1SXU5; Match level="QueryCoverage=32%, HitCoverage=30%, E-value=5e-38, Identity=85%"; Hit description=RNA -binding region RNP-1
  Pfam annotation: Domain name=RRM_1; Domain location=18-88; Score =77.6; E_value=3.9e-20; Accession=PF00076.12; Description=RNA recognition motif. (a.k.a. RRM, R
MAYPHYRSQFGDTTFTKVFVGGLAWETPTEEMRKYFEQFGDILEAVIITDKSTGKSKGYGFVTFRDPESARRACADPNPVIDGRRANCNIASLGRPRPSPPRGRGTFQGGAPVTAAASYGGVPAAGPPALAPPPPPLVYPPYGRNAGDNSYPTYTPDYGYHQASLYNPQIQQPQYYHQQLYGPSSSTMGSPYYYGYSVQAPRGTFSSTQPHRIPAGPSYLYYPTPMESSFSAYRPPPQLQQLPIRQPPPSPSGSFSFLFSNKLI

SEQ ID NO: 219672 - protein, 377 aa, Glycine max
  Coding DNA Sequence Number=SeqID_102894
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=68%, HitCoverage=20%, E-value=2e-48, Identity=39%"; Hit description=Chromo
MVKDRFPMPTIDELLNKLGRASWFLKLDLRQGFHQIRMAKEDIPKTTFQTHQGHYKMKPLLILPHVPSGSNGHHPFLGNQFHYLGHIVSDQGVALDPDKIQAMLDWPHPSSPTELRRFLGLTGFYHKFVRGYASIAGLLTTLLRKDQFLWNSDVELAFTQLKQLMNEAPVLATPDFAIPFVLETDTFGSAIRVVLIQSSHLIAFYSKCLVPCCPTIGWSTLHSVDAQFRLLGAERIWIPSDSPFISNLLAEFHTTPPEQSHGVSKTLHRLQTNFFWPHMRCDVCRYVSQIFICQQTKYQTRKPTKVASTPAHSNFSMEGPFFRFYYRGFSPIEVVDSLMAAHTTIHFTLERLLLKAQTTMKHSVDAHDRDVSYNAGD

SEQ ID NO: 219673 - protein, 174 aa, Glycine max
  Coding DNA Sequence Number=SeqID_102895
  Gene Ontology: Mol. function=GTP binding; Cellular component =intracellular
  Homolog annotation: Hit_ID=Q8L7L0; Match level="QueryCoverage=67%, HitCoverage=24%, E-value=9e-16, Identity=38%"; Hit description=GTP -binding protein obg-like
MNLKGKKPVLPVPGGGEATTYTRLPLKHDYSAPSPLSSPEIKLSETAPPITRLLRNRKPQNIKQDDVVFEYSDSEPESDNKYEAFDFSGYENVDEGEEETLSVREKGVPAVMRCFDRAKIYVKSGDSGNGMVAFLSLFKSHGERRSEYKHGVSRSTFREIEILRFLGEFHMTQF

SEQ ID NO: 219674 - protein, 55 aa, Glycine max
  Coding DNA Sequence Number=SeqID_102896
  Subcellular localization annotation: CTP_CleavageSite=5; ConfidenceScore=5.15e-01
MDRPRYSIESSSNIFAPSFMTSPLNATRMSPYKATYGVFSGGGRRFSTNKLCRAP

SEQ ID NO: 219675 - protein, 159 aa, Glycine max
  Coding DNA Sequence Number=SeqID_102897
MGKIPHVTEWSYNTAVHSATGLSPYQTVYAMLQALHKKLFKAQTAVKVQADKKRMEVSYSIGDWWLVLSPKDATWEPWDDLSQTFHLEDKVILLGDGNVSDTITTNNNTTSLREEETNLSLKEDSLNQLCSPSEKAHKEKSCDNSGMDGKSNVIRKTNL

SEQ ID NO: 219676 - protein, 79 aa, Glycine max
  Coding DNA Sequence Number=SeqID_102898
MVGMRNLSRIVIAFKAQKSKQQCQDEHWLERNWGEGEFGGQPVTGSLGVGSSWMWKKAEAAWVWTRLLTCWAEISNDGE

SEQ ID NO: 219677 - protein, 359 aa, Glycine max
  Coding DNA Sequence Number=SeqID_102899
  Gene Ontology: Mol. function=RNA-directed DNA polymerase activity; Cellular component=chromatin; Biological process=chromatin assembly or disassembly
MADQTCDTSIERLEESMKLLSMSQSDLASKVDSILTQLANLTPTPSSLPPLESRFAPSFYDRPCGALFKLTQHGTVTKYLIGFECLTNHIVGLPHPFLLSCFISCLQPKIRYKVQALQPMALPQAMALAKLQEDKLEDCCHFNCSKPLSNPLPPPLPPANPQPQLVPSTIAPIRSVAPSSLATPRPHYHRLSLNEITDCHEKGLCYNYDENFGPKHHCRAHFFLLITKNEDAHAPPRSPAKNRYLHKSVLMCCPTIPPTRLSVCKALSTTTLLRFSMMEKAHITSSRPGSLSYWVFLRKEIGPCGSWWVTASSSIACTVVLTFPLPFKGTILWPTSMICPSVELVWSWTSNVLRNWAQL

SEQ ID NO: 219678 - protein, 853 aa, Glycine max
  Coding DNA Sequence Number=SeqID_102900
  Gene Ontology: Mol. function=RNA-directed DNA polymerase activity; Cellular component=chromatin; Biological process=chromatin assembly or disassembly
  Pfam annotation: Domain name=Chromo; Domain location=786-837; Score =32.3; E_value=1.7e-06; Accession=PF00385.14; Description='chromo' (CHRromatin Organisation MOdifier
  Pfam annotation: Domain name=rve; Domain location=492-639; Score =75.3; E_value=1.9e-19; Accession=PF00665.16; Description=Integrase core domain
  Pfam module annotation: Pfam domain module=Chromo::RVT_1::rve; Domain location=786-837::37-206::492-639
MSQYKGAYSRTYLHRNAACASLEWGRYRVSLIRPSRSPFSSPVLLVKKKDETWRMCVDYRALNSITVRDRFPIPIIKELLNELGNASWFSKLDLRQGFHQILMADEDIPKTAFRTHHDHYEYRVMPFGLCNAPSTFQASMNEMLRPFLRKFAAVIFYDILIYSATLQDHVHHLDSIFSSLSKARYYLKRSKCLIGQCQLDYLGHVVSGRGVRPDPSKIQAIVDWATPRSPKDLRAFLGLTGFYRKFVKRYVAIAVPLTKLLYKNAFHWVSESQSAFENLKTTMIAASVLALLDFTIPFALETDASSTAIGVVLHQQGHHIAYFSKPFCPRLQQAFAYVRELHAIVVAVRKWRQYLLGHKFTIFTDHRSLHELMSQIIQTPEQQFYLEKLLGYDYDIQYKTRASNTLKGTLLASSEFHKQREAILSHPEAYPDFSISDDLIIFKGAIWLDSQDPFISALLHEYHATPLGGHFGVKKTLHRLRTNFQWINMLKDIKALFADLSLDFVTHLPSSHGFIVVLVVVDRFSKGVHLGTLPTQFIAFRVANLFMDTVCKLHGFSRSIISDRDTIFLSSFWKELFKMSGTTLRMSIAYHPQTDGQTEVLNRTLETYLRSFVHHQPAEWSYNTLQHSNTGLTPYEVTYGKPPPSVPSYLRGSSRNEAIDTILNTREETYATLRRKLLKAQDTMKHFADKMRRDVQYEVGQLVYVKLRPHRQLSLRSQPSNKLAKRYFGPFRVLERVGSVAYRLQLPEGSKIRPIFHCSLLRPHHGPSDLQATPLPPETLHNNLILEPLAILDSRVDSSTQPPTKLILVQWVSLAPEDSTWENWDDVRRSHHLEDKVIFLGEDIVSSTSSDEG

SEQ ID NO: 219679 - protein, 60 aa, Glycine max
  Coding DNA Sequence Number=SeqID_102901
MADAKFAGLLAPSHCLSFSMCPVVGFGPWLGLGKPLVEILPPGQLRGFCPLLAWLGSAVL

SEQ ID NO: 219680 - protein, 56 aa, Glycine max
  Coding DNA Sequence Number=SeqID_102902
MSRGSGDLGDVRWGAIAQNQAWPIPTQPGHSQKLASGNRLPFMGNRLQGLKMETGC

SEQ ID NO: 219681 - protein, 172 aa, Glycine max
  Coding DNA Sequence Number=SeqID_102903
  Subcellular localization annotation: CTP_CleavageSite=56; ConfidenceScore=5.36e-01
MRSDCLVQFSILNLFQSPMNCVFVHLSSTFEFGAMRSDFLVQFSILTIFRSPMKCVFVHVFSTFEFGAMRSDCLVQFSILTIFRSPMNCVFVHVAILHSLSFGSPMKCVFVHVSSTFKFGAMHSDCLVQFSILTHFQGPMNCVFVHVCTFVFGAMRSDCLVQFSILNLFGAP

SEQ ID NO: 219682 - protein, 138 aa, Glycine max
  Coding DNA Sequence Number=SeqID_102904
MAHFIACKKVDGACHVFDSFFKDVVRLHALPRSDDLVDLRPNIFQERGNDEDIKDQAQAQKEAQDLIQGIGGPMTRARTKKTKEALHHIMAVATYPSAGGRRETHGCVFQERNTRGVTTNVLFEENVEKTGKDVVYEL

SEQ ID NO: 219683 - protein, 293 aa, Glycine max
  Coding DNA Sequence Number=SeqID_102905
  Gene Ontology: Mol. function=specific transcriptional repressor activity; Biological process=regulation of transcription, DNA -dependent
  Homolog annotation: Hit_ID=Q82BE5; Match level="QueryCoverage=56%, HitCoverage=61%, E-value=1e-08, Identity=29%"; Hit description =Putative TetR-family transcriptional regulator
RVRDPGTALPAVQGAGRQPDDRLAVHAGHGRRGRRPAPGDRHPDRHRRRSRPHGPAAPRRVAEPQQPDRRRAPGLRPRPDRPRRHARRAPCEPRRALAATADRAEDRTPALTRARPRTRSSWHSGRRWAADPVVEDPADEDADGEIPSRLFIRLGEQRRGPPDTRESRRIRALVRGPHIRPFGGAPCGARPHGPLDRRGGGELGDEVHRQGGPVVRHTPHRHEREFVLGEPESTGERRDGAQRHRPEARVALQGADRVDDRLGERVLPPSLADVGEAYPRIGGVEDVLEQDVA

SEQ ID NO: 219684 - protein, 75 aa, Glycine max
  Coding DNA Sequence Number=SeqID_102906
MLRDEYLKITAAGFVHQVNQGVFQLLRRSLCPGGRMPDIFQVMGRPVQPQVQLSLAASIRLFVNGHPAGRKCGIL

SEQ ID NO: 219685 - protein, 241 aa, Glycine max
  Coding DNA Sequence Number=SeqID_102907
  Gene Ontology: Mol. function=calcium ion binding; Cellular component =membrane
  Homolog annotation: Hit_ID=UPI000067E0BB; Match level="QueryCoverage =100%, HitCoverage=47%, E-value=3e-83, Identity=63%"; Hit description= ATPas
  Pfam annotation: Domain name=DUF853; Domain location=1-241; Score =227.5; E_value=2.9e-65; Accession=PF05872.2; Description=Bacterial protein of unknown function (DUF853)
MANRHGLIAGATGTGKTVTLQSLAEQFSRIGVPVFMADVKGDLSGISQVGGGNAKIDARVQQLGLTDYANQAYPAMFWDMFGEQGHPVRTTLSEMGPLLLARMLNLNEVQGGVLNAIFKIADDNGMLLLDMKDLRAMAQHCAENSATYQTQYGNISTASVGAIQRALLQLETEGGDHLFGEPALNLEDMMQTDAKGFGYINILAADKLLNSPRVYATLLLWLLSELFEKLPEVGDMEKPKL

SEQ ID NO: 219686 - protein, 80 aa, Glycine max
  Coding DNA Sequence Number=SeqID_102908
  Homolog annotation: Hit_ID=UPI00006A261B; Match level="QueryCoverage =91%, HitCoverage=59%, E-value=2e-08, Identity=43%"; Hit description =UPI00006A261B related cluster
ADISGKGAEDIDISENGVDADIFGKGTDADIFGMGADVDIPGKAADTDISRKGADADISGKGAEDIDISENGVGDDDSHF

SEQ ID NO: 219687 - protein, 440 aa, Glycine max
  Coding DNA Sequence Number=SeqID_102909
  Gene Ontology: Mol. function=transporter activity; Cellular component= integral to membrane; Biological process=transport
  Homolog annotation: Hit_ID=Q7W5L6; Match level="QueryCoverage=74%, HitCoverage=73%, E-value=1e-135, Identity=74%"; Hit description =Putative integral membrane protein
STLEDPTLQQHHRLRGGHAGADPGRAGRRLAGAGRHRCLQLLLLRRRVRGGGVPARTGQAVGAGAGVGLGLELRLLRRHADPGPVAGGGETGRGRRARRRALRAARHPGDLRGVRAGGAALVLPAARTRAAIRRAAGGAGHAQAAGLRLARDRPAFSRVPPAADVHRLLSGRHLGRDHAGGGVCLRGHGVHHAADHAAGVHREHRRGGRRVLVRLCAGSHRPQAGAGDHAVRLDPDGAGGLRRGDGAGVLGGRDAGRPVHGHDPERGPRHDRRAGAGRAPGGVLLAVDVRGAAGRGHRTADLRSGDLGHAWQPPPGDPGDRTVLRRRPGPAVARGHGARPGAPRRVRARAVAATDILMKSRMPPRRLAARRHPAGCVLRCRLSMPLPSRLARVPAEYGLMARILRKVPVRARRYGCEWQSDKSGINNRITDWRQDHVECY

SEQ ID NO: 219688 - protein, 878 aa, Glycine max
  Coding DNA Sequence Number=SeqID_102910
  Homolog annotation: Hit_ID=Q1SRI1; Match level="QueryCoverage=23%, HitCoverage=40%, E-value=2e-28, Identity=30%"; Hit description=RNA -directed DNA polymerase
MENVKAIKAILQTFEMVSSLKINFAKSCFGAFGMSDRWKREAASCLNCSLLSIPFVYLGIPIGANPRRCHMWNPILEKIPKKVVEKLVSIQRRFLWGACLPKEKGGLGIKDINTFNIALLGKWRWNLFQHEGQLWARVLESKYGGWRGLDEAHRDNHESIWWRDLKMVVQNSQQGMELSNSIEWRLGCGDRIKFCEDKRPLFDNEIPMAINFLQHVENRDRERAGQRGRVSERVRENGRERATENRAETRRERGRTAVRDTPRARRRKEHSDGRNASRRGRYSFEANTIYEEDREHSDTRSNQQQGAWIQVRGRRKNEKKTLPEFGREVDGHYACGRNISRGRGSTLTWRDRPDEWGKVWEVFIPTKRNKQGHRYGFVHFKGVENEDRLERKLDNNIYINDMKMFVNKPKFQRGGYKADNTQTGTISRTGGQIMEDEPFHQPKHHHTLPSKTKTYAEVVKQHNLQEGKGVQGITSGEAITDDKIEPIVIQTEKSKTKWLDKVWVGHLKNEGMFDRVEEELQEMQGLGGTKVKSAYWGEDMVILHDLDEVTVNIINQRELVTGATPFSSIQKWTPMMVPSYRLTWLLIWGVPLQAWDAEYIADIVATCGELVELDPATEDKSRMNIARVLIRTKGKPLIAQKLSVIVDGCRHSLEVREDTVSGWGRKRRLKPNEGLFSSPFSTDMEDEDDEPNTYDHRWISPDGLTVSNVGASPTQRPSFGSCSRRRNDVRGSTADVSPRRSSTPPRVTKVSLPNPISDTVVETAAAGPLLNISRSMDAFDKTNDQGALEEYPSVNGSEGSPVVNQNSNLLGPADRDFAMFSHGVKEDEVNRKHWEIARQLGISFPVNIKNRGKEKLDVDNTGYSFAASAETGNNTNDP

SEQ ID NO: 219689 - protein, 785 aa, Glycine max
  Coding DNA Sequence Number=SeqID_102911
  Gene Ontology: Mol. function=RNA-directed DNA polymerase activity; Biological process=RNA-dependent DNA replication
  Pfam annotation: Domain name=Exo_endo_phos; Domain location=379-636; Score=-8.4; E_value=0.041; Accession=PF03372.13; Description =EndonucleaseExonucleasephosphatase family
MKSPQGDEGGLTSMHLEVSSEMKKRLGDAWECGVDISSKYMGDDMKWNLSLRPDYTLTWVQCWGIPILAWDSTKIRQIVSIMGEMVEVDDEVDECRKLDRARGCGNNSAMCQCRRSRGTGSSEEEIDSDGSFMASPTSVRTMMMEMEDGASQLGAQPNKEDPRQKEWRGAGNSAEDQSSQLPSGPPEGSSMGLPTSGRIIAPEMEDDAWQLRTQPNIMVPRRKQGKGEGDGVDDQPSRLPSGQTETQRPLGNGKSPRTKAQQQKSNEGQTKSGKGEERTAGGPRRSACTMFDEEKSEDGRGKSAGRDNGTARKEKSFKGESSLVDNRGYVAGNFRREEKGVKGRDGEELDSSTEMGFTTYTPIKTQSVKECSPQNKKTDSAISWKVYSRTRRYKKQVQDGNANYEAQTNGLVIHTTPTQQQQNKESTQQQQIMATDKGLEESKLQDAIELWELATKLGETKKESIEKSMCQALWGDADVAWEMQPANNTTAGGILCQWVKEAQQVHIMSVYSPCDTHNKRTLWEAIRQLKSSNQGGLWCISGDFNNIRDQSKRAGVCQRGVEESSIKEFNKWIEDMEKEEAPWVGRKFTWFRPNGEARSKLDRFMVSPKWLAKWLGCTQHPLDSNFSDHCSVLLRSKCIDWGPKPFRILDCWLLDKSFKSIVKECWTANHQRGWGGYVLKEKIKKLKERLKIWNREQYGDTFQKYKKIEKELNNLEVSTSDRLLSLQEVITRKQLQEDLWVAAQTHESLLRQKARSRWVKEGDCNSRYFHLLVNASRRSNSLNGV

SEQ ID NO: 219690 - protein, 159 aa, Glycine max
  Coding DNA Sequence Number=SeqID_102912
MVIVVMSATATPIEILVVVVEVALVVVTIQIVMALTMWCLVAMLVVVANGSNIGGSVSDGSHRGNISNSGNNVNYVGGNGGVSDGGGGSKWWCGGGGDNSHRGSISSGGSNVSYVGGDGGVIDSGSSNVGGGIVVVVTMTMTVTLVVVVTMTMVMAIKT

SEQ ID NO: 219691 - protein, 125 aa, Glycine max
  Coding DNA Sequence Number=SeqID_102913
EGSKKLVKKRKGNYARGEGVLRWKRKRCKASCREDEKENQCEREEGFYFLHLFVPAPSKKTHIPTKMMKPIITSSHPVLTLHFWVSLITMISTTSTSTQPLPSDVVICAINKKGIIALWGTRSKK

SEQ ID NO: 219692 - protein, 152 aa, Glycine max
  Coding DNA Sequence Number=SeqID_102914
MVTLRTPKRSCSLPASEEAIARPRLSRPKEKATWLTGASSFCASWPLNRLQRSICAAKHRNFARLIVHSTGGNMKDRAYESVSSGDEVCCIIGQAVIELSDEQQPVTRSTLSLKLLAMADRDRDDERVLLYWIARKAINQPHQLNIGVGGWR

SEQ ID NO: 219693 - protein, 471 aa, Glycine max
  Coding DNA Sequence Number=SeqID_102915
  Homolog annotation: Hit_ID=UPI00005F974D; Match level="QueryCoverage =41%, HitCoverage=73%, E-value=8e-29, Identity=37%"; Hit description =COG0188: Type IIA topoisomerase (DNA gyrase/topo II, topoisomerase IV), A subunit
MAIDNSPVAEKVIALTIEQALAQQAQVTVLCCVDPAYSSCNQPIEIDAGEDPDDFVVAQDEQNTAEMVVRHALAPMLRAGIDARGLILAGEAAETIVAQSEALHARLMSLHVLAFPAHAGRFCAAGDHHRDTAAHHRAARLAGCPAVAIQLSDAPGYRVLKVQEPALWQLLNRELQHKLAEGVPAEQALGDMRGWLMDLVNQRMARASDAAIINYIRVSVQEMQALQQQDTQRCFRFLYPQVSGGVNLQQVLSPELNQRDGEALEALLQNSTGDELAVDQPQAQRDLQRVVEKLYGKWGDKLQQLNMPADTAVDRGTMCAMSIDLYSGILALPDKQAANLLRKMACGVAFYTATSDEDTLMNKMLISALALFMLAGCSVSKPGGFERVDEDARSNTVQYRYDPQKLDKDALELDLANYCNQRGFDKVESLPAQDSNLPGLKKVCDDSRHGRDASRRRARGPSWDRVHGRAR

SEQ ID NO: 219694 - protein, 257 aa, Glycine max
  Coding DNA Sequence Number=SeqID_102916
  Gene Ontology: Mol. function=transporter activity; Cellular component= integral to membrane; Biological process=transport
  Homolog annotation: Hit_ID=UPI0000E68C12; Match level="QueryCoverage =87%, HitCoverage=56%, E-value=7e-69, Identity=59%"; Hit description =inner membrane protein YhjX
MTLSNCVKWFPERKGLISACSIGAYGLGSLGFKFICGALLSTQGLENTFVIWGVLAMTMIIAGALMMRDAPLQQAGSRQQQATQEFTLAQSVRLPQYWMLALMFLTACMSGLYVIGVAKDIGEGLVHLSTQTAANAVTIIAIANLSGRLILGVLSDKMARIRVISLAQLVSLSGMSILLFTHMNETTFFLSLACVAFSFGGTITVFPSLRAWLAGSFGIRRLHRDLQSDYDAAGDLAGAVAQYPSAKSSKPGRAGTA

SEQ ID NO: 219695 - protein, 282 aa, Glycine max
  Coding DNA Sequence Number=SeqID_102917
  Gene Ontology: Mol. function=binding; Cellular component =intracellular; Biological process=metabolic process
  Homolog annotation: Hit_ID=Q8W0Q5; Match level="QueryCoverage=87%, HitCoverage=71%, E-value=1e-36, Identity=30%"; Hit description =Putative vegetative storage protein
  Pfam annotation: Domain name=PPR; Domain location=126-160; Score =12.1; E_value=0.27; Accession=PF01535.11; Description=PPR repeat
  Pfam annotation: Domain name=PPR; Domain location=206-240; Score=0.9; E_value=5.9; Accession=PF01535.11; Description=PPR repeat
  Pfam annotation: Domain name=PPR; Domain location=8-42; Score=14.2; E_ value=0.15; Accession=PF01535.11; Description=PPR repeat
  Pfam module annotation: Pfam domain module=PPR::PPR::PPR; Domain location=126-160::206-240::8-42
MGYESGVVVSNALIDMYGKCKCVGDVLSVFEMMDEIYIFHGTRSCRVQPDLVIVTTILPACTHLAALMHGREIHGYMVVNGLAKEESHDVFDDVLLNNALMDMYAKCGNIRDARMVFVNMREKDVASWNIMITGYRMHGYGGEALDFFLVCVRLKWYLMKSVLLDCYLHAAMLAWSLLVACRLHNDIDLAEVAASKVIELEPYHCENYVLMPNVYGVVGRYEEVLEWRYTMKQQNVKKRPGCSWIELQFCKSMATSPLSSIWSAKKVRHEFMTTYVVGMDMC

SEQ ID NO: 219696 - protein, 51 aa, Glycine max
  Coding DNA Sequence Number=SeqID_102918
  Homolog annotation: Hit_ID=Q6FFM4; Match level="QueryCoverage=100%, HitCoverage=17%, E-value=2e-07, Identity=50%"; Hit description =Putative transcriptional regulator
MAGGVETAAQGNLGERQRAELQQLLRGFHTAAHHILVRRFAGATAEHTCKM

SEQ ID NO: 219697 - protein, 103 aa, Glycine max
  Coding DNA Sequence Number=SeqID_102919
  Subcellular localization annotation: CTP_CleavageSite=27; ConfidenceScore=5.18e-01
MSSPSTSLGRLRPLSRMHLAWVSRNVVCVAVVVTAVRALETAVGHTTEDCCVVLFVALFSRSKFPFAGETRVGLSQSEKKLEESQGTTRDATIAVGRHVSPLR

SEQ ID NO: 219698 - protein, 262 aa, Glycine max
  Coding DNA Sequence Number=SeqID_102920
  Homolog annotation: Hit_ID=UPI00005F6C65; Match level="QueryCoverage =54%, HitCoverage=95%, E-value=2e-57, Identity=77%"; Hit description =COG3518: Uncharacterized protein conserved in bacteria
  Pfam annotation: Domain name=GPW_gp25; Domain location=28-124; Score =84.3; E_value=3.8e-22; Accession=PF04965.4; Description=GPW  gp25 family
MPQGHNTPSLYEMLTGNFTGGLALDQVSEQNQVILSVLDNMQRILNCRAGTLAHLPDYGLPDMTKILQGMPGTAHELIGTLSAVLLRYEPRLKSIRVVLLEQAQPGELRYAIDAELKGLGLVRYGTEFMPEGRVLLRHLRQQQYLDVTLQAEAARGRKPCSGAKGGIAHCTSDGRFVCNDGSLSQSKKICSRYDSSESTQQAKSPLNSGKTQTKKIATSKKQPQPVAQDQNDLLPRKPTCAPLYMASKPGYTNLPICTGNQY

SEQ ID NO: 219699 - protein, 94 aa, Glycine max
  Coding DNA Sequence Number=SeqID_102921
MSVKNLVERLGVHDKTNHTLASQVTLTMFCENIPTIWDQHRLKGALKSGDPQGLHSEESGLDINSSPLKGLSINSSPLKELNINSSPLKGLIVA

SEQ ID NO: 219700 - protein, 56 aa, Glycine max
  Coding DNA Sequence Number=SeqID_102922
  Homolog annotation: Hit_ID=UPI00005F7D62; Match level="QueryCoverage =98%, HitCoverage=30%, E-value=7e-12, Identity=57%"; Hit description =COG3521: Uncharacterized protein conserved in bacteria
MVVTGFQNARLIRVKVFTPHHQLPGIVNPIRMAEQPCHGDKLRIFFHWHIEVRITA

SEQ ID NO: 219701 - protein, 48 aa, Glycine max
  Coding DNA Sequence Number=SeqID_102923
MTIVLLKSGHGGAMVEWRHGISKKCHQIAVALRVAYGGAMVVMAESRL

SEQ ID NO: 219702 - protein, 96 aa, Glycine max
  Coding DNA Sequence Number=SeqID_102924
MEIGVWVLVLPLLCQTFPEHHECTCAKKGRSLICRPSTYARKNAFTFPDVKIKRDIDAILSRNGSITRAMSKRIQEDWARDAEEGPRVLMNLRVDF

SEQ ID NO: 219703 - protein, 100 aa, Glycine max
  Coding DNA Sequence Number=SeqID_102925
  Subcellular localization annotation: CTP_CleavageSite=50; ConfidenceScore=5.10e-01
MYTWRKTSKKKKRAIKWSIIIGAAQQASKKGPSPGATSTSRGRGKGKEVQVDEETEFESSKSEEREELFNFEYEGEEEEGYTPLDKNEIKYVGIEEEPED

SEQ ID NO: 219704 - protein, 247 aa, Glycine max
  Coding DNA Sequence Number=SeqID_102926
  Homolog annotation: Hit_ID=Q1SB98; Match level="QueryCoverage=16%, HitCoverage=7%, E-value=5e-09, Identity=62%"; Hit description=Zinc finger, CCHC-type; Peptidase aspartic, catalytic
  Pfam annotation: Domain name=RRM_1; Domain location=83-153; Score =17.5; E_value=0.0034; Accession=PF00076.12; Description=RNA recognition motif. (a.k.a. RRM, R
MDFGATHHITNDLDNLHITNSYHGQDQLIVGDSIAFPIAHTSNTILHTHSHSLRHLSNQPRHLKRHPWLSLQHQRDHKDITSFYFTRFADDITEKELWHHFKKWRDVREIFIPNRGNYMGKRYGFVRFKGVRDIPYMTRQLDRIVIGGMKLYVNLPKYGRELPRKVDSGIKIHVHKDRTQTEDARARQACQINPASYVDALTRTISLLGQRVTSNNRVSSTSSVHIDIRPEDTKWLKMSYCGRQDWI

SEQ ID NO: 219705 - protein, 214 aa, Glycine max
  Coding DNA Sequence Number=SeqID_102927
  Gene Ontology: Mol. function=nucleic acid binding; Biological process= DNA integration
  Homolog annotation: Hit_ID=Q1RWP6; Match level="QueryCoverage=98%, HitCoverage=16%, E-value=8e-55, Identity=62%"; Hit description=Zinc finger, CCHC-type; Polynucleotidyl transferase, Ribonuclease H fold
MTSNTRSARINGSFMPMSHPLIQMHVITLLGNVQTSKQAWNTLNKRYASKTCARIMYLKECLTHFTKGSLSMTDYLHGIKSLTDELTIINAPLDDVDLVIHTLNGLGVEYKEVSVALHTREKPIDFEELHDLLSDFESYLKRDGNNNYTSFVAIAHASHKGKQPYHKKSYNPNHGSSSNRSTSPLLKEGALSILTNPAIQPRCARSFMDIPKEI

SEQ ID NO: 219706 - protein, 144 aa, Glycine max
  Coding DNA Sequence Number=SeqID_102928
  Gene Ontology: Mol. function=DNA binding; Biological process=DNA integration
MGLPCLCGQGEKTPYKIWARQKLSMSFLWIWGCHVYVKHMISNKLEPLSNKCLFVGYPKETKGYYFYNTFEDKMFVTRTRVFLEKEYISNGTRGRNVDIGEIQVTQSTDPPAMEQKSMPEMVVVPLSIQVAQKLLWKQCFPRLF

SEQ ID NO: 219707 - protein, 100 aa, Glycine max
  Coding DNA Sequence Number=SeqID_102929
MVPIRNFARNVREEETSLNAIPVRSDNKRLYVPYPILDYICVPATPPSSSSHSPSSMASIADIAMMDYTNDDREEEDLSEDASEVNVSLGIEEDPSKDSS

SEQ ID NO: 219708 - protein, 43 aa, Glycine max
  Coding DNA Sequence Number=SeqID_102930
MTYQDAIIGPEYEKWLEAMESEMESIVLMLKTYPTQDPSSEWV

SEQ ID NO: 219709 - protein, 109 aa, Glycine max
  Coding DNA Sequence Number=SeqID_102931
MRAVAMTQTPPLSRSATPDHQQPICSSDEAICCHRDSGCIATKGRAADLKHGHVRSDLAAEVSYSTVEGRQRVVVVVVEGCSAEDGGGWGGENGITLLRKDGDILVKNH

SEQ ID NO: 219710 - protein, 109 aa, Glycine max
  Coding DNA Sequence Number=SeqID_102932
MVEDTDVGGFLFSRPQEKNSTSNIKEKRVCLLLSLGFGGRVKGLQPRVKAKRASTAMRNFSALSATEEFGRASASRPHTKCEISALSTTGVFIQAQRTIGVKPESTYPR

SEQ ID NO: 219711 - protein, 223 aa, Glycine max
  Coding DNA Sequence Number=SeqID_102933
MQYFILIPISSGASFCTILHQFFESQPFDAIEDHPHPYISTPTIYPSSSTRPNKLEFTAESGLLNEELNPFGKDEDKVLHNQPQEEDKEEEARPISPIKIVPPCYIPLKMNILKNPIFKILNTGIAWITKKSNIWALYILASKQWEIRKLCESYTCSNPSISQDHAKLFYLMISKNILKLIENDPSTSLSTLIAYIKRIKGYTTTYRKAWLEKQKAIEGIYDN

SEQ ID NO: 219712 - protein, 108 aa, Glycine max
  Coding DNA Sequence Number=SeqID_102934
MGTPSEVSRARSGSDERCILSSDSKEGFVKRATLVLHLPVNNFERKRLMRVHTFLTVGAHIYSGSRNNTFRGRDCRSKGLRRRRGIMKNMLQTIATNSLASLRFKRRY

SEQ ID NO: 219713 - protein, 86 aa, Glycine max
  Coding DNA Sequence Number=SeqID_102935
MVSGVGDSDDENEDINDLFDILCYDAKSSGMSIEKKIEFLESLTGKLMQSYPASALDRRLEVDWARDAREAPRVLISLRVDFGPMG

SEQ ID NO: 219714 - protein, 253 aa, Glycine max
  Coding DNA Sequence Number=SeqID_102936
  Homolog annotation: Hit_ID=Q47336; Match level="QueryCoverage=15%, HitCoverage=43%, E-value=5e-14, Identity=92%"; Hit description=LacZ -alpha peptide
AIGAGLFAITPAGERGMCCKAIKLGNARVFPVTTLANWSSTAVAAALELVDPPGCRNSMLLRIPVKLTARQPFDFQPHKYDIGILTGLKRGYEDNLFIRKLMDLPESEYPLYYRHHLEYFLSKEPDGEQEFFTFVWQIVQRRIKFIEQKDPFHSSHARDVELIAILTRFQKYLRSIDQWHTEKTLPEIIAEQYEQIKRQSQEIANLKEELKEARKLETKEFIDIADGGARYQLLFPLVRVNFELGVIMVIAVS

SEQ ID NO: 219715 - protein, 370 aa, Glycine max
  Coding DNA Sequence Number=SeqID_102937
  Gene Ontology: Mol. function=transporter activity; Cellular component= integral to membrane; Biological process=transport
  Homolog annotation: Hit_ID=Q13NC6; Match level="QueryCoverage=36%, HitCoverage=48%, E-value=2e-48, Identity=69%"; Hit description =Putative outer membrane lipoprotein
  Pfam annotation: Domain name=Lipoprotein_9; Domain location=238-370; Score=68.3; E_value=2.4e-17; Accession=PF03180.4; Description=NLPA lipoprotein
MKRSPDAGHLCAIASRTGRSSRPDLPDAGHRAGRVDPAGWPARRAGVPDRPGPVAGPPAGAPAAELDGQYRALFPLHHPAGGAGAVHPRHRRHLDRPGGGGGAAVVRGDSVLRPAGRAMPARSAARRHRGRARRRRIRTADRAPGAAGGSAVRAGAGPDRAGREFPVVFRGGRRGGRRRHRRPGHPLWLLPLPDRRDGADRGAARGAGADHPVRWQYRRATHRQTLIPRGIPCPSNEIVFGATAGPYSDQIKLGIKPILEKQGYTVRIVEFNDYVQPNFALAQGALDANAFQHIVYLQNFAAKNKLELSELVKVPTAPIAIYSRKYKSVDAAPEGVSVAVPNDPTNQARALVVLQELGWIKLREGYDPLR

SEQ ID NO: 219716 - protein, 64 aa, Glycine max
  Coding DNA Sequence Number=SeqID_102938
  Gene Ontology: Mol. function=helicase activity; Biological process =protein amino acid phosphorylation
  Homolog annotation: Hit_ID=Q9LTU4; Match level="QueryCoverage=88%, HitCoverage=3%, E-value=1e-10, Identity=54%"; Hit description =Helicase-like protein
MFFLYGFRGTGKTFIWRTLASSLRAENQIVIIVASSGIASQLLPGGRTAHSRFKIPVPIFEDST

SEQ ID NO: 219717 - protein, 88 aa, Glycine max
  Coding DNA Sequence Number=SeqID_102939
MLDVPGVELQVASWSSWSVGVDELEVELQVVAVGGWSRGKRAVESSMGVESVFRESFNVVELLVVEQLSSRNLPDEQCLSSSYDTVRA

SEQ ID NO: 219718 - protein, 105 aa, Glycine max
  Coding DNA Sequence Number=SeqID_102940
MEEKVKQKINGGLGSTYLKLLCSDYHLMEACLWSFYGVWIFELQCGPSMAYENPRAFPWISGPIYLESSIQCPCGVGLHHSLHLGKDLTSNIEVLHSLGSFPQHL

SEQ ID NO: 219719 - protein, 76 aa, Glycine max
  Coding DNA Sequence Number=SeqID_102941
  Homolog annotation: Hit_ID=Q1SN45; Match level="QueryCoverage=97%, HitCoverage=4%, E-value=2e-12, Identity=46%"; Hit description=AAA ATPase
MNKPEQVWDQTWHWMVDDIVYNYKKSSTSPALQLDDRTLQNLVLLEIEQLLQTNQRSLTDYPSMPYPEDANCPTYL

SEQ ID NO: 219720 - protein, 202 aa, Glycine max
  Coding DNA Sequence Number=SeqID_102942
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=21%, E-value=1e-103, Identity=82%"; Hit description=DNA -directed RNA polymerase beta chain
  Pfam annotation: Domain name=RNA_pol_Rpb2_6; Domain location=1-111; Score=-129.4; E_value=1.9e-06; Accession=PF00562.18; Description=RNA polymerase Rpb2, domain 6
  Pfam annotation: Domain name=RNA_pol_Rpb2_7; Domain location=113-190; Score=144.1; E_value=3.6e-40; Accession=PF04560.10; Description=RNA polymerase Rpb2, domain 7
  Pfam module annotation: Pfam domain module=RNA_pol_Rpb2_6::RNA_pol _Rpb2_7; Domain location=1-111::113-190
DMPYLQDGRPVDMVFNPLGVPSRMNVGQIFECSLGLAGASKQTSNPWIFEPEYPGKSKIFDGRTGNSFKQPAIMGKPYILKLIHQVDDKIHGRSSGHYALVTQQPLRGRAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 219721 - protein, 223 aa, Glycine max
  Coding DNA Sequence Number=SeqID_102943
MVLEEGEFLPTYSRFCRLRTNPQEIEARLCIPRKGFVLNAKGQPWKLLINDLTTLAQTWSVFSYSNLAPTSHTSDLNMDRARLVYGLVTNMDINIGALISGQISSIAQSSSSRLGFPALITALCRARGVTSNSLTYESLSPTINLAYIKKKCWNVDDLTINFRGREEGKAPSTSATPTPAPPGSSTQDSQCFESMLQSLHQGQILLMHCLQVVAPPGSILTVE

SEQ ID NO: 219722 - protein, 117 aa, Glycine max
  Coding DNA Sequence Number=SeqID_102944
MDRYFNNASFTYIHAFHWLHCSLHSFLENQTVIIVIIPKERALRCPYQMRFRARVMGEVEEVQEQMKADTEALKEQMATMMEAMMSIKEIMEVNAAAIAATSTIVEVDLTPYMASTK

SEQ ID NO: 219723 - protein, 620 aa, Glycine max
  Coding DNA Sequence Number=SeqID_102945
  Gene Ontology: Mol. function=methyltransferase activity; Cellular component=cellulose and pectin-containing cell wall; Biological process=metabolic process
  Homolog annotation: Hit_ID=Q6Z692; Match level="QueryCoverage=79%, HitCoverage=71%, E-value=1e-167, Identity=59%"; Hit description =Putative early-responsive to dehydration stress protein
  Pfam annotation: Domain name=DUF248; Domain location=165-620; Score =156.8; E_value=5.7e-44; Accession=PF03141.7; Description=Putative methyltransferase
  Pfam annotation: Domain name=Methyltransf_11; Domain location=289 -409; Score=0.4; E_value=0.05; Accession=PF08241.2; Description =Methyltransferase domain
  Pfam module annotation: Pfam domain module=DUF248::Methyltransf_11; Domain location=165-620::289-409
MSRPLQRGVLGGVRVPERGYDLWDSQSKDKIEKEDLDKRGSADHSPFALRFPLRVLLGNNSESKYGNVKAENGFASDPFMVGTPRSLLKLMLLSLKFSLVFIVVLALTGSFWWTLSISSSSRGHIYHGYRRLQEKLVSDLLDIGEFSRGPLRLKESEFCSEEFENFVPCYNVSENVELGVSDGNEVDRQCGRELRQNCLVLPPVNYKIPLRWPTGKDVIWVANVKISAQEVLSSGSLTKRMMMLDEEQISFRSASHMFDGIEDYSHQIAEMIGLRNESYLIQAGVRTILDIGCGYGSFGAHLFDSQLLTMCIANYEPSGSQVQLTLERGLPAMIASFTSKQLPYPSLSFDMLHCARCGIDWDQKVDWLLFSSGPFNYAKYLALSHSDEKNGLLLIEADRLLKPGGYFVWTSPLTNARNKENQKRWKFIQDFTLTLCWELLSQQDETVVWKKTSKKSCYASRKSGSGPSLCGRGIDVETPYYRELLNCIGGTQSSRWVPIEKRERWPSRANLNNNELAIYVLQPDELTEDSDSWKIAVQNYWSLMSPLIFSDHPKRPGDEDPSPPYNMFRNVLDMNAHFGGFNSALLQARKSVWVMNVVPISGLNYLPLIQDRGFVGVLHD

SEQ ID NO: 219724 - protein, 144 aa, Glycine max
  Coding DNA Sequence Number=SeqID_102946
  Gene Ontology: Mol. function=nucleic acid binding; Cellular component= nucleus; Biological process=DNA integration
SFDMKDLDEAFFVLGIKIHKDRSHHTLELSQKTYIDRVLGRFNIQNCKPRDVSVVKGDKFNKDQCPENEIERAEMNEKPFQSALVPKKVMRYLQKTKEYMFVYRRVDNLEVVGYTNSNLGGCPDNRRSTYGYIFMMDGVLMLFG

SEQ ID NO: 219725 - protein, 208 aa, Glycine max
  Coding DNA Sequence Number=SeqID_102947
  Gene Ontology: Mol. function=nucleic acid binding; Biological process= DNA integration
MWHKHLGHISKEKVERLTKTYILPSLAFDDLERFEALEKFKIFKTEVEKELRKVIKIVRFNRGYGKYGSARQHIGPFALYLQDYGIVPQYTMPMTSKQNGVAKRRSTRERRSAIDDDFQVYLSEDAYDVGDIVDPKSSQEVVSCPQPEIWMHAMNGEMQSMSINGVWEPVELPNNFKTIGYKWVFKTKKDLNGNIEIFKARPVAKDFI

SEQ ID NO: 219726 - protein, 90 aa, Glycine max
  Coding DNA Sequence Number=SeqID_102948
MQRGRTLKSRTATLIKTLSDSICAFVLESSKALGCQMAIIKSVGMVCEKERSEIEEVKVVWCSHVMSCMRCKPKEQKTLEKERVSTSEVT

SEQ ID NO: 219727 - protein, 214 aa, Glycine max
  Coding DNA Sequence Number=SeqID_102949
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=Q0TBE9; Match level="QueryCoverage=78%, HitCoverage=52%, E-value=5e-81, Identity=93%"; Hit description =Putative PTS enzyme-II fructose
  Pfam annotation: Domain name=PTS_IIB_fruc; Domain location=1-64; Score=-20.4; E_value=0.00021; Accession=PF02379.7; Description=PTS system, Fructose specific IIB subunit
TENELTTEDIAAADVVILAVDVKIKGEERFKNKRIVRVKTEGSTMSENKPPVSQEIKKHLLTGISWMIPLIVAAGICIALGQVLGGTNVAEKVGTIPWMLNQIGGWGMGLIVPLICAAIAYSIADRPGFAPGLIVGFVCGQIHTALRAVAKIDARADAHYGAAGIKHHYQRSVDDDPDRQADCLAAGGLDSSVGVDAGRFTIPVGGHSWRDGHL

SEQ ID NO: 219728 - protein, 262 aa, Glycine max
  Coding DNA Sequence Number=SeqID_102950
MDMNLGSFISSQITLRAQHDSSRLGFPTLITALCKARGVRSDFLTLESLSPAINLAYIKKNCWNLDDPIVTFRGPRKARGKRSEAPSTAPSEALAPSSSTLPPSSSIEIPVIPPAPTQIPLPTPISTGPANSLFTPQMLHSMLQSIHRGQSIVMQSLQGLGLPSIMSMEEFDSQEPVTEEPPAVAEDEDELTPPKPFDFDAGTYTAQEEEATPEQIPEPSPAPTHAPDDATPVVEPKQTIQDSLAAPTLDLNEDQPQEELDV

SEQ ID NO: 219729 - protein, 167 aa, Glycine max
  Coding DNA Sequence Number=SeqID_102951
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=10%, E-value=5e-50, Identity=59%"; Hit description=Chromo
MQHTHAIAKLLTLQYSRLDGPQDPLLDIPVDMEPELVMILYTYRLVFDVPSGLPPSRTHNHSILLVEGVGPVKVKPYRYPHSRKNQIEVMIVDMLKEGIIAPSASSFSSPIILVKKKDDTWRFYTDCRALNAITIKDSFPIPTVDELIDELHGAVYFSKLDLRSGYH

SEQ ID NO: 219730 - protein, 77 aa, Glycine max
  Coding DNA Sequence Number=SeqID_102952
MDKECIRQEARSRIVSGHGQKSRQINGRNQPRYIGTDVSGARVTTDRSLPLPGAKQAENIATRQPKMAPRKLASKRS

SEQ ID NO: 219731 - protein, 153 aa, Glycine max
  Coding DNA Sequence Number=SeqID_102953
MNHDHPKLTFVYPTFIRVGMSAIGPFPPDIGWQVSQFPAKMMFYVSVGLMLNSKRPYSYDIDVLYDGKSLTPEDAPAIESRFINTAVSNRDDFVAISTNLLEDVVMPEGGLYTIKARLFAGKANSSEKELIDEGLGYFTLAEDWMNNEMKKTD

SEQ ID NO: 219732 - protein, 140 aa, Glycine max
  Coding DNA Sequence Number=SeqID_102954
  Gene Ontology: Mol. function=RNA-directed DNA polymerase activity; Cellular component=cell wall; Biological process=RNA-dependent DNA replication
MIIIKTSKAIASTSERYTYRCKSKEGQLWEPIIKKCERALSKWKQRHLSFGGRVTLIKIPKKVNDKLVCLQCRFLWGGGSDTNKIGWIKWDTVCLPKEKGGLGIKDISTFNMAMLGKWRWNLFHDEGQLWAKILVSKYGG

SEQ ID NO: 219733 - protein, 143 aa, Glycine max
  Coding DNA Sequence Number=SeqID_102955
  Homolog annotation: Hit_ID=Q8TGM5; Match level="QueryCoverage=26%, HitCoverage=56%, E-value=5e-07, Identity=71%"; Hit description =Uncharacterized protein ART3
WLITIYHGEVGMNQIQPTTRRVLAGGRRALGLMASGATCVQRLDGSRDSAIHTKYRISLRSSSMQEPRYPLPRVIDEEAGRTGRRGHPLPPDGSVDFSQRRGQRTAHVAAIRTLHRTIQSVGATGGVYKGQGRSQRELMTRAY

SEQ ID NO: 219734 - protein, 46 aa, Glycine max
  Coding DNA Sequence Number=SeqID_102956
MASFRDLEQKWCAKVEALMELQCLHAVSLVPVPRVSLHSSGPVFEG

SEQ ID NO: 219735 - protein, 375 aa, Glycine max
  Coding DNA Sequence Number=SeqID_102957
  Homolog annotation: Hit_ID=Q8XWF1; Match level="QueryCoverage=40%, HitCoverage=50%, E-value=5e-38, Identity=47%"; Hit description =Putative transmembrane protein
AVAAQRVGVVVDGGIVVGGFALVLDGHRPDQALRAAVVLGRLDPAVHHQLGEAALLALDVGLFGAIAQAVQQFADVPVLGVVVLDVAGLVEIDGDDPVVIVALGHDHAQQRGILAVAVGRHQAVGLDARHEEHRFRQVHHGLIAQLDVGRAFLGGGVGCLHGGLDFLLRGGILGRGAEGQEQQGTGGGQGQAGKESAHDNYWSVCERGPIVFARDFQLSESQRLIRRTILPVASDSCRSTGLLALRRVAQAGAEQAVVQELAVRIEPGPDEDRERRGHDEHVHRGPAGGAGGGPHHGGARQHQRPRQHVAQDQAGGGRRVAIAIDQPDVPCLHRQRLAAAAPAQHEIGANGHEQPGLAGGPQFQRVLALGQGIHE

SEQ ID NO: 219736 - protein, 325 aa, Glycine max
  Coding DNA Sequence Number=SeqID_102958
  Homolog annotation: Hit_ID=UPI0000E68DE4; Match level="QueryCoverage =50%, HitCoverage=22%, E-value=3e-54, Identity=57%"; Hit description =conserved hypothetical protein
QHAFRQRAFVRCRAQHLFHRPPMVRCIGVQAYPAVRRRVVAGQGVPGGRQRPTQRAQRPAEPERGQALIDPDLRRFGCLAAKQFGAGQTGGAPGGGSQFGDGKSRRQCTGFAKSRRAECGSEASSATPCGRNVERAAVGQFGAQAVGRYAGERLRAEVGGQRRTVAEGRLLHPAVPIEPAEVGQRFVPQGLMQRPEGGVGAFDRRQAGRQGGAAQMEHRRGVVQLAEQTAGGLNVAELQIVVIPVVAADDRIVENGLVQRQAIARIEFDGAVGLLHLGGAEEKRRLGVGPPGAEIIGRGFILIHLLVAPAESPGFHAVGEHQLRA

SEQ ID NO: 219737 - protein, 342 aa, Glycine max
  Coding DNA Sequence Number=SeqID_102959
  Gene Ontology: Mol. function=chitin binding; Cellular component =extracellular region; Biological process=chitin metabolic process
  Homolog annotation: Hit_ID=UPI0000DBF0F4; Match level="QueryCoverage =95%, HitCoverage=93%, E-value=2e-29, Identity=40%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
MSSPSKDYTSSPSKGYTPSPSEDYMSSPSEDYTPSPSECYTSSPSESYTPSPSEGYAPSPKEDYTSSPSEVYTPSPSKGNTPSPSNDCTSSPSEDYTSLPLKDYTSSPLEGYMPSPSESYTSSPLEGYTPSHSEDYTSSSSEGYTPSLSDDYMSSPLEDYTSSPTEGYTPSPSEDYTSSPLEGCTPSPSEDYTFLFLEGLHALAFRGLRAHAFRGLHVLAFKGLHVLTYRGLHALTFRGLHFLTFRGLHSLAFRVLHVFTFKGLHVFTFRGQRVPAFRGLGALAFRGLGALTFRGLHVLAFRGLHALAFRGLHALAFRGLHVLTFRGLRLQRATRPRLQRTT

SEQ ID NO: 219738 - protein, 392 aa, Glycine max
  Coding DNA Sequence Number=SeqID_102960
  Homolog annotation: Hit_ID=Q1SW50; Match level="QueryCoverage=29%, HitCoverage=41%, E-value=1e-23, Identity=60%"; Hit description =Lipocalin
MAEKKNKRIKSIRHRPITPRMEKEKETTKSGPSRRGKWIAHFPSPPTTPKETPWEGFAFPELIKYHRLKKLVEMKSTYYNNLVKGQQIMMTQMVWLDIDGLSSKEVMAYQLGLKEARFAFNKHKLLAYVVAWIITLRGSNHAQLTEEDLLLISLMQRKLKINWVNIIIDIMLKTKRIDSSKYPYVVLISRIIDYFGVDNQEEVFGFVEAEFEVKTKSLEAKRMMLAKMDEPMRVHKEDYAELKECFESILERLDAMGAAHYSMFVHDTSSVAYPVDHREFNTIMEIEDVSTTHCATVRTFKGSGGGHVEDVGVGKDGVGEGGGIEEVNGEEGEVGGGEGEEVKEMGGVRAREDGGVDGVVWVLLLQEVRCMNDPIAKSARLGHWIPVGLSDH

SEQ ID NO: 219739 - protein, 49 aa, Glycine max
  Coding DNA Sequence Number=SeqID_102961
MADLASATSEEEWQERLKDVNSTQSVDLEDEASSSPKNVLQDNEDDCYG

SEQ ID NO: 219740 - protein, 172 aa, Glycine max
  Coding DNA Sequence Number=SeqID_102962
  Gene Ontology: Mol. function=RNA-directed RNA polymerase activity; Cellular component=mitochondrion; Biological process=RNA-dependent DNA replication
  Homolog annotation: Hit_ID=P92567; Match level="QueryCoverage=45%, HitCoverage=38%, E-value=9e-18, Identity=53%"; Hit description =Hypothetical mitochondrial protein AtMg01410
MRDSYPLCQSQVEEKRVYGIPSFGSPGRLAQSTDSGAGKRRIFAIGNYVNQRLLKPLHDWAPHRKGGRGDPVEYPFARGRPVVSFETGQPLGYLSSWPLFTLSHHLVLQSCAEKVYPGRYFDRYAILGDDICIADRKVASVYHQVVTDLGVDLSIPKSLVSDSGGAEFSKRF

SEQ ID NO: 219741 - protein, 122 aa, Glycine max
  Coding DNA Sequence Number=SeqID_102963
MSTRFLLGHCGLTDQWPSYPPDIHIGRTTTIKFVPELIALRLPPLDLRKKKGKYFTRDVAMKIVALNSNVEFDQIDVMLFYFKDMQEGDNEFHQHFKAAMRRAIVNAWARFTALKEHPFSPD

SEQ ID NO: 219742 - protein, 135 aa, Glycine max
  Coding DNA Sequence Number=SeqID_102964
  Subcellular localization annotation: CTP_CleavageSite=24; ConfidenceScore=5.11e-01
MPPPSLRPHNHSQTHLKLSGRLPLQALVSADLHTTKSLKLSGTWTFLSLELSRHAEASRKGQTPFQNLISGLNRMALRSANMHSSSFFQILSCAQSRSVALSGWLAKLTGWLSEKVKISTIQTRLINLKLRENDY

SEQ ID NO: 219743 - protein, 307 aa, Glycine max
  Coding DNA Sequence Number=SeqID_102965
MKTKACIKITDNIVSETKQEALYQDDELVGLQEVLEVYPDIINESLADVDGGGEKIDANLLKQPNLVEPNEDECILSENEIESRGGGYRIFNHPRSHGVSLGAPITPTFPPLPFIYQSTSESMSIPTTPVGDASPSAPNDSLTLEYPLDPNCEHIANQRPFIRAYRGYSCFLFMLKEYRWYPAKERAIVHDWPEGTSTQDSPNIATSVNDNEIYVNVVGGPNYNGNVFGLGALSKRFSCSKSAPSTSIAPVEDQIEEMRETITKLNVELLAKADKERTLEEKMFPSTTRADGTEYHVHDAQVDHPHD

SEQ ID NO: 219744 - protein, 64 aa, Glycine max
  Coding DNA Sequence Number=SeqID_102966
PNYNGNVFGLGALSKRFSCSKSAPSTSIAPVEDQIEEMRETITKLNVELLAKADKERTLEEKML

SEQ ID NO: 219745 - protein, 236 aa, Glycine max
  Coding DNA Sequence Number=SeqID_102967
  Gene Ontology: Mol. function=protein kinase activity; Biological process=protein amino acid phosphorylation
  Homolog annotation: Hit_ID=Q1SN45; Match level="QueryCoverage=98%, HitCoverage=13%, E-value=5e-60, Identity=47%"; Hit description=AAA ATPase
  Pfam annotation: Domain name=DUF889; Domain location=2-236; Score =393.4; E_value=3.4e-115; Accession=PF05970.5; Description=Eukaryotic protein of unknown function (DUF889)
MVFGGDFRQILPVILRGSRSDIVNATINSSYLWNHCHVLTLSKNMRLEANTDATDREETTAFAEWILNIGDGIAGQQNDGYGSIEIPKDLLITEYDDPLSTIVNSTFPNLSHHHTNPEYFQTKAILASTNETVQRINDYILSLIPGDQMEYLSADYVDKSETLESSHFRSLTTEFLNSLTTSGLPNHNIKIKIGSPIMLLRNLDQTQGLCNGTRLIVTKLAKHVIAADIIAGQNIV

SEQ ID NO: 219746 - protein, 94 aa, Glycine max
  Coding DNA Sequence Number=SeqID_102968
MEKTTWASLMVIRMKTNSIRPRKDILDDITDTLEDTHIHEEVHKDKEDGNSRDSQSKENQINVDLPTEWRTSRYHPLDNIIGDISKRGNNSTLS

SEQ ID NO: 219747 - protein, 164 aa, Glycine max
  Coding DNA Sequence Number=SeqID_102969
QQKVYTDNYSGISARQRDSKVSMTDLVSAEDDRDSKVSMTDLVSAEDDGAEDDISLYVLSGFSSYRQQKVYTDNHSGISARQRDSKVSMTDLVSAEDDVNLRVSTGFSSYRQQKVYTDNHSGISARQRDSKVSMTDLVSAEDYVNLRVSTGLSAAIEEGRRRRH

SEQ ID NO: 219748 - protein, 79 aa, Glycine max
  Coding DNA Sequence Number=SeqID_102970
MICLRVSSDLPSLDDKGADNHEMTMICLRMSLDLPSLDDKGVDNHEVSPRAIRLDCLWIARAADDHMLSPRVIELAVSG

SEQ ID NO: 219749 - protein, 79 aa, Glycine max
  Coding DNA Sequence Number=SeqID_102971
MRPRRYRIAIVIDFYIVLRLVFFICHPEVEVDPWSCLVSNSLDDSEVSSRVFLFDDTLSLVVPTATMYDIKEDDISRNL

SEQ ID NO: 219750 - protein, 187 aa, Glycine max
  Coding DNA Sequence Number=SeqID_102972
  Subcellular localization annotation: CTP_CleavageSite=70; ConfidenceScore=5.27e-01
MTFFFLVKNYVGLSSSSHLRIRRSKGNALVDPKKDAPLNLASPSRRRVVNVEVTLSCTSNSLPNGDQLVSQGSSKPSDMPQSTSTPFHQKLQRCLKHFNHSISSTKDIHHGHCTLSQPTLLRVSEARLTGASSKGGKCVESPPTFICGKHRKNRRKPVMKNIPDSGVVFTFEEGISTSHVCPKGQQP

SEQ ID NO: 219751 - protein, 102 aa, Glycine max
  Coding DNA Sequence Number=SeqID_102973
MPAEHFFRKCQWKKNCGRTFFRGTTQKNFFRESQRKKLHTLQSHTSSSLHFSNSDHAIGVGLIAFSVEMTNKAKGKGKEVAGKGSADKRKGAFDDDKTGGGR

SEQ ID NO: 219752 - protein, 155 aa, Glycine max
  Coding DNA Sequence Number=SeqID_102974
  Homolog annotation: Hit_ID=Q6K796; Match level="QueryCoverage=69%, HitCoverage=2%, E-value=4e-07, Identity=31%"; Hit description =Vacuolar protein sorting 13C protein-like
MQSSGHFLACSRGVFLSGKTVHIYSADIRNPLFLSLLPQRGWLPIHEAVLISHPHENPSKTISLRSSISGRVIQIILEQNYNKEHTLLAKTIRVYAPYWLEVARWIKLSYLAIAAATSVPHDSYIRMLVAKSAIIITVADDFYDLEGLTDAVRSY

SEQ ID NO: 219753 - protein, 98 aa, Glycine max
  Coding DNA Sequence Number=SeqID_102975
MVGYTPSSFADMVFAGKRIEVGLERGKFGHPALIKTGANEEDESEGETLDVAAIPIWPSFPPTQKCHYSTNNNPSPYPPPSYPQRSSLSQTTKPTYQC

SEQ ID NO: 219754 - protein, 159 aa, Glycine max
  Coding DNA Sequence Number=SeqID_102976
  Gene Ontology: Mol. function=transporter activity; Cellular component= integral to membrane; Biological process=transport
  Homolog annotation: Hit_ID=Q7VXX0; Match level="QueryCoverage=76%, HitCoverage=22%, E-value=2e-30, Identity=54%"; Hit description =Putative inner membrane component of binding-protein-dependent transport system
MQQVEIGEGDDVGRHRQRQQQRPGQGAPRGEFVGRHQPCRACAQQCHQHADAGQQHGGVGQRLRYHIGGQVSPVRQIAAQRPPDQGEHRRQHRQADQGGAGQPAGAAFSPAQTQWPGQGICMHASEGLLRGRRRAGGAYSSVKACRRPSGCFPGERGQA

SEQ ID NO: 219755 - protein, 153 aa, Glycine max
  Coding DNA Sequence Number=SeqID_102977
  Gene Ontology: Mol. function=transporter activity; Cellular component= outer membrane-bounded periplasmic space; Biological process=transport
  Homolog annotation: Hit_ID=Q2L0E1; Match level="QueryCoverage=99%, HitCoverage=44%, E-value=5e-68, Identity=82%"; Hit description=ABC transporter, substrate-binding protein precursor
MARKAAGGDRDVARDILDGICDIGLANAYYVGHMKNAEPGTDARKWGDAIKVVRPTFANEKSGGTHVNVSGAAVAAHAPNKANAIKLLDFLVSEPAQALYAQANYEYPVRKGVKLDPVIASFGELKVDPLPLTEIAKYRKQASELVDKVGFDN

SEQ ID NO: 219756 - protein, 82 aa, Glycine max
  Coding DNA Sequence Number=SeqID_102978
MRGESVALGSLVREQATHCHGDNKCLNNPCYSVSPKNDFKIKFKIKINFKFHQEDSRFKNNQDQDSRLKDSRIKRRLNQDKY

SEQ ID NO: 219757 - protein, 100 aa, Glycine max
  Coding DNA Sequence Number=SeqID_102979
MVDQTKSIHNLSTERSIEHKKHSQLDIKGSFLEIGTVVCSGILCKSSAFRVYPNSAQGKLQIGSEFATLCLAPPSRLAQVSGFELSASRALSLAEDNCCA

SEQ ID NO: 219758 - protein, 106 aa, Glycine max
  Coding DNA Sequence Number=SeqID_102980
MGFHDKWLSWIRLCLRTIHYSINLNGDSVGHISPGSGGFFGCFPDEDMAMTKGKEPLEGLGGPMARARTKKAKEALQQVLSMLFEFRPKLQVEKLQIVNYTMFQEE

SEQ ID NO: 219759 - protein, 201 aa, Glycine max
  Coding DNA Sequence Number=SeqID_102981
MADKEAIKKKNRGLALKTSIPSSDKSEDENAEGSNIENLNLLWKKTSHIKVDCPIYQKKQQEYKKNKGLFKKKKKTYITWDGTESTTSNDNNEKEEANLFLMTNNEAKSEGTIFDSKDYYNYDQLLDAFNEMHQEAQKLAIVNNLLKGSPKESSPARERVVNNNPLEGHLLQHNCLPKEWKKPKDLSINNILGDTAKGVST

SEQ ID NO: 219760 - protein, 126 aa, Glycine max
  Coding DNA Sequence Number=SeqID_102982
  Gene Ontology: Mol. function=nucleic acid binding
MLIGKSIHTSIENDPSTSVSALIAHVKSIDEHTITYQKAWLVKKKVIENIYDNWKKSFHDLPRLLQAMQEFLPGLVIEKETLSMFPKRKSNSIWFCEIPSFFRPCIDGFQYCKLVVQVDKTWLYKK

SEQ ID NO: 219761 - protein, 72 aa, Glycine max
  Coding DNA Sequence Number=SeqID_102983
MTKYDPKIKRALHRNNAKTRRRKMVAVNDEQPDSTCRITLPLMWESLQVKKRLSFELQKVAVGPSSTVGLSA

SEQ ID NO: 219762 - protein, 121 aa, Glycine max
  Coding DNA Sequence Number=SeqID_102984
  Gene Ontology: Mol. function=nucleic acid binding; Biological process= DNA integration
MEKQTQLLRHDLLGVCLEVDKQLWYLNSDYSRHMTRDKSKFMSLKARKGGFVTYVDNNKGTILCVYVDDIIFGSTNKSLYEDFVHKMQGEFEMSMMGELNYFLGLQVKQMNHGTFLHQTKY

SEQ ID NO: 219763 - protein, 120 aa, Glycine max
  Coding DNA Sequence Number=SeqID_102985
MEDLKVVSTRSGRPHAEYKKKEKSSSLEKEKEVPIEEGPTKDKEAPTKRSSETWKQNGLLYDLIVNFFKSCLVGVYMEEGELDRSKEAEWRRRKTDWRRHFKEKMSQEQAHHHRKSWIRA

SEQ ID NO: 219764 - protein, 153 aa, Glycine max
  Coding DNA Sequence Number=SeqID_102986
  Gene Ontology: Mol. function=transporter activity; Cellular component= integral to membrane; Biological process=transport
  Homolog annotation: Hit_ID=Q7CHC8; Match level="QueryCoverage=80%, HitCoverage=31%, E-value=1e-49, Identity=75%"; Hit description =Bicyclomycin resistance protein; transmembrane protein
MAGRNPMTLRGETPRVGRTSGCAIARPAGVNVEQHRHDAAQRHRGDHWPGAFARRHRQHRPHQRADAEAQRAGQGRRGARHMRKIIQDHRHGVGGNHRDAPQVDRYADHQRPEAQADGAHRQQPQPHRQLYQQPQLEHLDRAEPPHVAAVDQR

SEQ ID NO: 219765 - protein, 127 aa, Glycine max
  Coding DNA Sequence Number=SeqID_102987
  Homolog annotation: Hit_ID=Q7N356; Match level="QueryCoverage=89%, HitCoverage=100%, E-value=6e-35, Identity=57%"; Hit description =Similar to unknown protein yejG of Escherichia coli
MARHRQARGQGFHVESIQLSVVHRLPQSYRWLSGFTGVKVEPIPFNGIDEDNNLIGLKLLSHEGAEAWQVMQQLNLSLQEIQVDCAIVEWEGEPCLFVQRSDESATMCRLKNVGAAIAEPLSAQYPF

SEQ ID NO: 219766 - protein, 248 aa, Glycine max
  Coding DNA Sequence Number=SeqID_102988
  Gene Ontology: Mol. function=alcohol dehydrogenase activity; Cellular component=membrane; Biological process=electron transport
  Homolog annotation: Hit_ID=Q2XF97; Match level="QueryCoverage=99%, HitCoverage=20%, E-value=3e-99, Identity=70%"; Hit description =Aldehyde dehydrogenase family protein, putative/cytochrome c family protein, putative
  Pfam annotation: Domain name=Ald_Xan_dh_C; Domain location=11-97; Score=-33.2; E_value=0.037; Accession=PF01315.12; Description =Aldehyde oxidase and xanthine dehydrogenase, ab hammerhead domain
SARVDIPAKATGELTWVHDLRVPGMLHGRVIRPPYAGYDTGSFVGTSLLSIDESSIAHLEGIVKVVQIADFVGVVAEREEQAIAAMDALQVRWKPWEHSLPDLRDIEQAIRDNPRTSRVVHDSGEVDAALANVAQRFTRSYVWPYQLHASIGPSCAVADYQPDSLQVWSGTQNPHLLRADLAWLLERPEETIEVNRMEAAGCYGRNCADDVAADAALLSRAVGQPVRVQLTRAQEHVWEPKGTAQLME

SEQ ID NO: 219767 - protein, 63 aa, Glycine max
  Coding DNA Sequence Number=SeqID_102989
MSALKEQMVSMMDAMLGMKQLMERGPPQAAKGKGKLDLIEERLRAVEGFGDYPFVDMTGLCLV

SEQ ID NO: 219768 - protein, 94 aa, Glycine max
  Coding DNA Sequence Number=SeqID_102990
MCAEKGKANWEQLLAGMVGASINWFLSQRALRGRARARLTGALSKGGKMRGVATKVDKSGAFAPTYPPSKRKSDLRSSFLCVNQVILLLEGRSF

SEQ ID NO: 219769 - protein, 197 aa, Glycine max
  Coding DNA Sequence Number=SeqID_102991
  Gene Ontology: Mol. function=catalytic activity; Biological process =peptidoglycan catabolic process
  Homolog annotation: Hit_ID=Q8YI83; Match level="QueryCoverage=97%, HitCoverage=69%, E-value=1e-101, Identity=84%"; Hit description =LYSOZYME M1
MKQNLPLFPRIGVTCEDVDVGVALDAGNGAGTGILPERPRMRSVFFVRMTGDGAQPERIVRHLPQIVVIEEIDRRVDDRALAVMFFQRLQEDAHFLAHDRCVGAQLAGWRLRVPFHVENGRKRAGVTRHILDVPARLLDRRTAEIIEMIGAPRDACLTGAVPMFLKAVIDPVAAFGRLDEGKGNATGANGAPVNIGL

SEQ ID NO: 219770 - protein, 343 aa, Glycine max
  Coding DNA Sequence Number=SeqID_102992
  Gene Ontology: Mol. function=transferase activity, transferring glycosyl groups; Cellular component=integral to membrane; Biological process=peptidoglycan metabolic process
  Homolog annotation: Hit_ID=Q8YI84; Match level="QueryCoverage=53%, HitCoverage=45%, E-value=7e-95, Identity=91%"; Hit description =MEMBRANE-BOUND LYTIC MUREIN TRANSGLYCOSYLASE B
  Pfam annotation: Domain name=COX17; Domain location=141-203; Score= -17.9; E_value=0.087; Accession=PF05051.3; Description=Cytochrome C oxidase copper chaperone (COX17)
  Pfam annotation: Domain name=Glyco_hydro_25; Domain location=1-92; Score=16.9; E_value=3.5e-08; Accession=PF01183.11; Description =Glycosyl hydrolases family 25
  Pfam module annotation: Pfam domain module=COX17::Glyco_hydro_25; Domain location=141-203::1-92
MEWNPQSPTCKLRPNAAVVRKEMRIFLQALEKHYGKRPIVYTTVDFFDDNDLRQMADYPFWLRSVAGHPDEKYGPHPWTFWQYTGTGSIPGIKGDADINVFAGDANTWKKWLESNKQNNPRKGATAPVIAAALLASTAMSNAQAAASPAPAAAPAENAVNLPKPECEIDFGQWMDNLTKEARDAGVGEKGIAELHKAMLEQKVLDRDRKQTVFNLTFTEFSKRLISEARLKKGRDNLVKYADVFKKVEDTYGVPGPVLAAFWGLETDYSAIQGDFDTLNALVTLSYDCRRPDLFRPQLIALLKLFDQGVVDAATTGAWAGEIGMMQLLPRDYLERGVDGDGDG

SEQ ID NO: 219771 - protein, 158 aa, Glycine max
  Coding DNA Sequence Number=SeqID_102993
  Subcellular localization annotation: CTP_CleavageSite=31; ConfidenceScore=5.33e-01
MPISPCGSISWDRARKTPSGPRGAQQGPGVSSSSYGPLSVLQGARPSLQGIAPARHPVDPEKSNRVLGFPALITGLCQFYGVPIAPSKVIKPPTNRAFIKKYCAPRKAHGETPQQPREGRQRATDAPPPPLKPLSSSTKARALPTTRGRPAGDQVQSQ

SEQ ID NO: 219772 - protein, 73 aa, Glycine max
  Coding DNA Sequence Number=SeqID_102994
MTIIVGVGITNHSLRIHLVQVPKTGDDTEEDDTTNGSTAMITTKPKKGKATLPLKRDKLMSKIGISECPVLIW

SEQ ID NO: 219773 - protein, 369 aa, Glycine max
  Coding DNA Sequence Number=SeqID_102995
MIAPRLPRPQNARSVWSSNSTKKKMQEEEERPLVRKRKSPETSTKSAVQTEAGDSQAQMPKKKKKVKQIEPEPSVTVEGGEPIRKKKKKTKSSKEQGENQPVDVQPPSTDVGGAETETTPSIAEMGNLVEQPDLPQEHPTVEVQQNVSVEEIPSCARTSPAPETDAVNVEEQGEGQGIGPSSPQGSSQRSSSEEHFPDEEAIQEAEAGGSDIFPVSSTSKLSASIGIAEDTFIQMQDEDPAAALRLLLNTSQANTSSEKNPGASSSSDADITSTVRQDCLLLKLSMEYARADVLKSIEENPSAAFGHLNFLKKLHNPLTSDEILGKVIQIESIIDQFANTVQKKRENGARLDAQKQAHILLLEKARAAQ

SEQ ID NO: 219774 - protein, 152 aa, Glycine max
  Coding DNA Sequence Number=SeqID_102996
ELVLPPEPEVGPSVAHINIKENCVDPLGNDLDTDEPEKCGLYVKKNPPCLVAIGRLYEGSTTILNIPLANDQVKVGVEKVRDADAHIPVMWDAIVFGVHNDNFPLYIKCEDLSEIAHSGQCLNISIIQLWILHMNETSMRAGNANVYGFLEP

SEQ ID NO: 219775 - protein, 118 aa, Glycine max
  Coding DNA Sequence Number=SeqID_102997
  Homolog annotation: Hit_ID=UPI00006A117A; Match level="QueryCoverage =44%, HitCoverage=81%, E-value=9e-07, Identity=71%"; Hit description =UPI00006A117A related cluster
MGGGAWPFLVGGAICLVNSVNERDLSLLNSYVEVCDALRCSGPHARYTDVFNESIALADRSGNPSKRESSARVDYVPALCTHRPSLLPIEWSGEVFGLRRRERFAARDVVRSPLNLII

SEQ ID NO: 219776 - protein, 178 aa, Glycine max
  Coding DNA Sequence Number=SeqID_102998
KWALVIDKDDVDDIVCEKYGISKEKCAQFCQTRRDPSWEDVWKKAQAIQKQNTAPHVLSRGGYEYLEQKLMTEKTKKRLEEAAQSGSTKGVIDPPSPIRRHVKWKLARTKKTGQMTSEAAKEIAETIDSLDEQASQGSFISHGRHDVLTAAIRRPEHPGRVRAAGAGVTIKQYFGLAP

SEQ ID NO: 219777 - protein, 98 aa, Glycine max
  Coding DNA Sequence Number=SeqID_102999
MIASFGYRKEHDGSWVKKSAQPADDEDNLPVEDNSSLLRRLLDKFDGLQTFVGDKFDAMELQVDMRFDAMDSRITKVEKDVSFIRTCFDPPPPPPSSS

SEQ ID NO: 219778 - protein, 77 aa, Glycine max
  Coding DNA Sequence Number=SeqID_103000
MTTGDPPQQKTSQGNEKKKEDQNITQAEFYAFKQYFSLLEEELKNITKGDPPKQKRSQGNAKKTEDDNITEGKCDFS

SEQ ID NO: 219779 - protein, 248 aa, Glycine max
  Coding DNA Sequence Number=SeqID_103001
NTDVRIDDIGFTLIDLKKLGYHNDPFIMAKQARQGKTVGVNVEDDDSYMDTYVSPLTAQITRNVVGEEEADDVHANRNDHDEGELINIDFIQLMFVTSFIIHHPFLLCLLTVVYKSKGETKDIELVEEEQAQIGADPSSETSNKSENYKEEARNATQKHKPKKVESVNDDAEAFGDHWKISIAQCILKLNHLNIRRKEIQAIKTGDSAVLKIGNSGKVVIKQDMKGRRHKYGFNNNKREKGREENGGG

SEQ ID NO: 219780 - protein, 266 aa, Glycine max
  Coding DNA Sequence Number=SeqID_103002
MLSRKHKKTYAQKETHRSKNTHRKWEVKKHRACKQHKDDWKDLDITLQIDNPSWLQKCWVAWLIEPMKASCINERFILEGTKKGENIMLLLVDGEKRLEDIIDAKQERWSNMFHSIKPWKPGESTRAKRSTKSKDESSIAGLDLGALSLSISKCLNFREGFEDEGEWLGVQRDDSGGENTASSVIGSRARRVGMDYGIDKSYEGKNVWKEAQDVEKQRPMEDKSGTEEGFMLAIPTMDINKCIDDQRSDFKRRHAKGRRARNIKAL

SEQ ID NO: 219781 - protein, 212 aa, Glycine max
  Coding DNA Sequence Number=SeqID_103003
  Gene Ontology: Mol. function=RNA-directed DNA polymerase activity; Cellular component=membrane; Biological process=RNA-dependent DNA replication
MIIKEGFRWKVGSGAEIRVWNEPWLRLESNLYLETRIIDALSGSWNPSLIHQLFCPRDANAILRFPIIDPYTMDERVWRFANNDDNVNNDGDWQWIWKLEDPPRVKLFLWRLCKECLPRKANLRTHVVDCTLECPLCCIKCNVDTSFREHLNLNGAGICLQDHQGNIMAIRTNFRHPCLKVAEGEAWALEEAMVFQNVTFETDIEVTVNKDQ

SEQ ID NO: 219782 - protein, 76 aa, Glycine max
  Coding DNA Sequence Number=SeqID_103004
MVDIVAAKPYLKAKEREEDDNLANMTGKTRMNGWMMDDDDDGGLMAWPWCFTPSSMAETLLLYAISNGGTFGCFTA

SEQ ID NO: 219783 - protein, 177 aa, Glycine max
  Coding DNA Sequence Number=SeqID_103005
  Gene Ontology: Mol. function=RNA-directed DNA polymerase activity; Biological process=RNA-dependent DNA replication
  Homolog annotation: Hit_ID=Q1SP50; Match level="QueryCoverage=70%, HitCoverage=16%, E-value=1e-31, Identity=57%"; Hit description=RNA -directed DNA polymerase
MAMRHRSSCRVVGVDREMCKGRMGEGSHVVVVDGGGVARSGSGRGWDCTEEGGGRYLGFPAVVGRSKRANFNFIKDRVLQKISSGSGRMLSMARIEVLIKSMVQSIPTYCMSIFQKPQSTGDEIQKTVNYFWWGKSTRGVKGIHLLKWDFMGLQSRLGIQKSVRFQFGHVREGGLEN

SEQ ID NO: 219784 - protein, 97 aa, Glycine max
  Coding DNA Sequence Number=SeqID_103006
MVRTKGLGHALGRVIGRALGREDNRHLDDVPEQQRSTTSACRQLEAAAVAEDAPHVADVTEDVFQHAEDVVDDVEGFPGGPRDPSVLTAYCDHVAII

SEQ ID NO: 219785 - protein, 101 aa, Glycine max
  Coding DNA Sequence Number=SeqID_103007
MTHTDQLIRIRYTNYITHTDHTIRMKPQQTKLQQQPLMESKKLTSTVEEQNEAAGPQCRQGKQPMAAPPKKNQQEDEGAEAWSQMKKMNAQGGRVKATYER

SEQ ID NO: 219786 - protein, 79 aa, Glycine max
  Coding DNA Sequence Number=SeqID_103008
MSGIVWSNLWTLSTKISLVAFLGRFTEQSECQWVAYGVVMVLPWFLLSAIYTTSPILSQKAPARIRDLSRNFYLRQGNI

SEQ ID NO: 219787 - protein, 141 aa, Glycine max
  Coding DNA Sequence Number=SeqID_103009
MSRQEKWRYALRTFSHSYLVYPARRNGDTPACPAIATSGTHYPAIATGGSCFPPVSMAAPTYPCDCRYFIGSMWCWSFRPSLRFSMYLTLPSPLTIILTTIKSLFLPTALSTVHERSCTLSSPGQANTCRLVHSTTLSNWS

SEQ ID NO: 219788 - protein, 77 aa, Glycine max
  Coding DNA Sequence Number=SeqID_103010
MEREMCWWVYIVGGVESKSIRLSAGASLITCLWFGMWSYKSWGRRLRGDSVWPAKVSVGVDNNNTGTGQEDKAVYPL

SEQ ID NO: 219789 - protein, 338 aa, Glycine max
  Coding DNA Sequence Number=SeqID_103011
  Gene Ontology: Cellular component=cellulose and pectin-containing cell wall
  Homolog annotation: Hit_ID=O82161; Match level="QueryCoverage=92%, HitCoverage=99%, E-value=1e-131, Identity=73%"; Hit description=Phi -1 protein
  Pfam annotation: Domain name=Phi_1; Domain location=35-313; Score =637.8; E_value=8.8e-189; Accession=PF04674.3; Description=Phosphate -induced protein 1 conserved region
MSTFMLKIFLLISIFQISFATRRLNELVQDQTQLLRYHNGPLLSGKISINLIWYGHFKPSQKAIVSDFITSLSPSSPHSTQPSVATWWKTTEKYYHHLSNTKKTSPLSIPLNKQILDENYSLGKSLTSKHLIQLASKGDHKNAINVVLTSADVAVEGFCTSRCGTHGSSSAGHAKNKNYKFAYIWVGNSEAQCPGQCAWPFHQPIYGPQSPPLVAPNNDVGIDGMVINLASLLAGTVTNPFGNGFYQGPAEAPLEAATACPGVYGKGAYPGYAGNLNVDSSTGASYNAHGANGRKYLLPALYDPATSSCSTLVPFGIGDAEHDLVVSPPSSTMRSGPP

SEQ ID NO: 219790 - protein, 507 aa, Glycine max
  Coding DNA Sequence Number=SeqID_103012
  Gene Ontology: Mol. function=nucleic acid binding; Cellular component= chromatin; Biological process=DNA integration
  Homolog annotation: Hit_ID=Q1T010; Match level="QueryCoverage=94%, HitCoverage=48%, E-value=3e-98, Identity=33%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=180-342; Score =51.4; E_value=3e-12; Accession=PF00665.16; Description=Integrase core domain
  Pfam annotation: Domain name=zf-CCHC; Domain location=14-31; Score =14.4; E_value=0.0042; Accession=PF00098.13; Description=Zinc knuckle
  Pfam module annotation: Pfam domain module=RVT_2::rve::zf-CCHC; Domain location=420-506::180-342::14-31
MEKGGKKKFDKRKIQYYNCYKWGHFADECKSGKGEKGKFNNEAKLALDDGSNSNPMLSMVTISTKVESTSSWYLDIECSTHMIGKRDWFISFDELTKNKVRFVNDSSLKARGIGKVLIKRKDGKQSFIFDVLYVPGMKSNFLSLGLLLEKGFMMNIENNVLKVFDSKRRFVLKAYISQNKTFKHNMVYGLPLMEVPSEVCEECLECNKTRSSFNKQVPTRANDKLGVIYSDSDVFEVFKKFECLVEKQSGKSLKVLRTNGGGEYVSNEFNSLCEKKGIIHKVTPPYTPQHNGTIEKNKTIMNMVRCMLKSKGLLDYLWGEATSTVVYALNISPTKRLEGKHQRKLGLESNPVLLISGSFDPFALSISTRVRQLPSNMNDYDIVPDSTVDSEGELVHYALMAKVETIEFEKAIQEPKWINAMKEGISSIEKNQTCKLVSLPNDKKPIALKWLYKVKVNPNGEVIKHKTRLVAKGFLQKLRIDYGEVYAPVCKDENNEIGGCNCQPERL

SEQ ID NO: 219791 - protein, 48 aa, Glycine max
  Coding DNA Sequence Number=SeqID_103013
MEFSPRAKENEKTYVVEERGEHGLGIAWRGLMKCYMAVTCCGYPRKQA

SEQ ID NO: 219792 - protein, 124 aa, Glycine max
  Coding DNA Sequence Number=SeqID_103014
MQINPVKFGRVEAQNYMGEKKQLSYVKESKWRVNAHERRQRRCQGNTAARQGSVTYGGDASLQGRVNAQKRLATTEYELRFRAHPMHVTIKCLNNDGPLEKPPLKLTNQFTRLPLCARLVLVTV

SEQ ID NO: 219793 - protein, 386 aa, Glycine max
  Coding DNA Sequence Number=SeqID_103015
  Gene Ontology: Mol. function=metalloendopeptidase activity; Cellular component=proteinaceous extracellular matrix; Biological process =peptidoglycan metabolic process
  Homolog annotation: Hit_ID=Q93Z89; Match level="QueryCoverage=63%, HitCoverage=69%, E-value=1e-104, Identity=76%"; Hit description =Matrix metalloproteinase MMP2
  Pfam annotation: Domain name=PG_binding_1; Domain location=136-198; Score=34.0; E_value=5.2e-07; Accession=PF01471.9; Description =Putative peptidoglycan binding domain
  Pfam annotation: Domain name=Peptidase_M10; Domain location=223-383; Score=47.1; E_value=5.9e-11; Accession=PF00413.14; Description =Matrixin
  Pfam module annotation: Pfam domain module=PG_binding_1::Peptidase _M10; Domain location=136-198::223-383
MKPYLRPIFLLFLILLHQSISASASNSRFIEFFSKLKNSFNPKSEELKSKDIKKLPSVEYLKKIHEGVKDLSQDLFIPKIPFLNPKNPKLPRIPLFKSPPPPMYRLQLKSDPPPPMYRLQPKSPPPLPNAPPKQINIKGLSVVKDYLSDYGYIESSGPFNDSFDQEIISAIKTYQKFSNLQVTGGLNKQLIQQMLSIRCGVPDVNFDYNFTDDNISYPKAGHRWFPNRNLTYGFLPENQIPDNMTKVFRDSFARWAQASGTLSLTETTYDNADIQVGFYNFTNSRIEVYGGSLIFLQPDSSKKGVVLLNGNMGWLLPSENATLSKDDGVLDLETAAMHQIGHLLGLDHSHKEDSVMYPYILSSQQRKVQLSNSDKANIHLQFAKHD

SEQ ID NO: 219794 - protein, 70 aa, Glycine max
  Coding DNA Sequence Number=SeqID_103016
  Gene Ontology: Mol. function=metalloendopeptidase activity; Cellular component=proteinaceous extracellular matrix; Biological process =peptidoglycan metabolic process
  Homolog annotation: Hit_ID=Q93Z89; Match level="QueryCoverage=74%, HitCoverage=15%, E-value=6e-15, Identity=75%"; Hit description =Matrix metalloproteinase MMP2
MSTSRKGSEYSTIFGTSENESLSWEDGVLDLESAAMHLLGLDHSNKEGSVMYPNVLPWQQRKVELSVSDM

SEQ ID NO: 219795 - protein, 163 aa, Glycine max
  Coding DNA Sequence Number=SeqID_103017
  Homolog annotation: Hit_ID=Q1RYJ7; Match level="QueryCoverage=42%, HitCoverage=6%, E-value=5e-19, Identity=58%"; Hit description =Timeless protein; Timeless C-terminal
MGKPVRINCQKAILMMKCSALFSRPLSTSPNQLDGDKITGATNHKSVNLEGSLLVQHLFKDHRRCSYMIANALDKDGKFTTAQVSQKLKQLGLYLPLPKDAIGIDVPARTMQVSINSALMSLHFDPFLYLFGQKDAKENEKATPLVCGTPFLEDSDGMPLHQC

SEQ ID NO: 219796 - protein, 96 aa, Glycine max
  Coding DNA Sequence Number=SeqID_103018
  Homolog annotation: Hit_ID=Q1SII6; Match level="QueryCoverage=63%, HitCoverage=28%, E-value=5e-08, Identity=43%"; Hit description =Transposase
MRSDTNAGVRGRALFLLTACKRSGECLNNVVWALQRFWGVFMKVDAFPVVIVIDKDLSLMNAVKTIFPDAMNLLCRFHIDKNVKAKCKTLVAQKNA

SEQ ID NO: 219797 - protein, 68 aa, Glycine max
  Coding DNA Sequence Number=SeqID_103019
MSASDTMSDSDDIGFNTMRVRVRVTKGFRGVDSEAGSVTQQKEGYEKSKSFKDVIPLESSRASKNKRK

SEQ ID NO: 219798 - protein, 98 aa, Glycine max
  Coding DNA Sequence Number=SeqID_103020
MCRVRRQAENSNRKGYRKWFLISTLYTKVAIGSQKKSHVIAKLGSINTANCKLNQDDDVPQPPKNTMENVNPNESNISEESHSFDEEGLPEVDPILAP

SEQ ID NO: 219799 - protein, 79 aa, Glycine max
  Coding DNA Sequence Number=SeqID_103021
MSQEVGNQEDNSKKSLSSMKSLALIAIFVDYSATSKIIVANYYPCPKMMETKVGGLLCELKFDPMVELVFDLTYVTTET

SEQ ID NO: 219800 - protein, 362 aa, Glycine max
  Coding DNA Sequence Number=SeqID_103022
  Gene Ontology: Mol. function=metal ion binding; Cellular component =nucleus; Biological process=regulation of transcription, DNA -dependent
  Homolog annotation: Hit_ID=Q9LSL6; Match level="QueryCoverage=80%, HitCoverage=76%, E-value=5e-31, Identity=32%"; Hit description=Dof zinc finger protein DOF5.7
  Pfam annotation: Domain name=zf-Dof; Domain location=23-85; Score =135.1; E_value=2e-37; Accession=PF02701.6; Description=Dof domain, zinc finger
MAAPKDQDATQGRKITTTTTRPAPEQGVKCPRCDSSNTKFCYYNNYSLTQPRHFCKTCRRYWTNGGALRSVPIGGGCRKNKRAVVKPSSSSSSSSPRLSTTEFSLRGLNVPPSVEFNLGALPFPSRLNTNHHIPTIINTGLFNNNQLSPFLDVKSALFQLDAPPAALSNSLMGIAPPSAQNNNFWALGRSQSSTLSDPLNSTMQSMQQSLNVHSSLASSIESLSCVNRDLHLKMQQQRYATMMSGGDTHHKGDENSGVSFPQTVNGFENQKLVMNPVMFQKPVESLPAGSAVTEGPSGASVTTVAPPTEWFFGNSSFPSTGNGGGNGNNNINININDANNNWSDALAWGNFQQQQQQYSALP

SEQ ID NO: 219801 - protein, 64 aa, Glycine max
  Coding DNA Sequence Number=SeqID_103023
  Gene Ontology: Mol. function=transporter activity; Cellular component= membrane; Biological process=oligopeptide transport
  Homolog annotation: Hit_ID=Q5VPM1; Match level="QueryCoverage=91%, HitCoverage=13%, E-value=1e-14, Identity=76%"; Hit description =Putative nitrate transporter NTL1
MVACLLPPFFWFMHFSPSTYANIVTNFMGTTFLLAILGGFLADAFITTYSLYLISAGIEFKEKA

SEQ ID NO: 219802 - protein, 190 aa, Glycine max
  Coding DNA Sequence Number=SeqID_103024
  Gene Ontology: Mol. function=RNA-3'-phosphate cyclase activity; Cellular component=nucleolus; Biological process=biological_process
  Homolog annotation: Hit_ID=Q683I1; Match level="QueryCoverage=98%, HitCoverage=59%, E-value=4e-49, Identity=48%"; Hit description=RNA 3'-terminal phosphate cyclase-like protein
  Pfam annotation: Domain name=RTC; Domain location=1-128; Score=-16.8; E_value=2e-09; Accession=PF01137.12; Description=RNA 3'-terminal phosphate cyclase
  Pfam annotation: Domain name=RTC_insert; Domain location=98-188; Score=14.9; E_value=0.00011; Accession=PF05189.4; Description=RNA 3'- terminal phosphate cyclase (RTC), insert domain
  Pfam module annotation: Pfam domain module=RTC::RTC_insert; Domain location=1-128::98-188
MGGRQHSAHDCGVSWSIGYFLEPRIMLCLFAKQPLTIRLKGITNDSKDPSVDTFKSTTLPILKRFGVPSEGLEIKVESHGLPPNGGSEVLLSVPVVQSLTGFVRKIRGTSFSTRMSVQFEYGMIKVARGIINPLVSDVHIFSDHRSGPEAGKDNDTCGLADDARRDLMPPNDNGVGIASALLGEIAQSGV

SEQ ID NO: 219803 - protein, 91 aa, Glycine max
  Coding DNA Sequence Number=SeqID_103025
MVTGFVDFDVAIVADDFEESEERNVVFVEARPCLIGANVLDENGSGGEKLGSCCRWWKSGWWRWWSPCAKIMVLAQRGAARKNSRNVLGTL

SEQ ID NO: 219804 - protein, 65 aa, Glycine max
  Coding DNA Sequence Number=SeqID_103026
  Subcellular localization annotation: CTP_CleavageSite=28; ConfidenceScore=5.03e-01
MAFSPFSERRWKKKRRAWAKTRDKRGVRSSRRGSSWERNEFAEALKSSTIRVQCMMRILLILDNF

SEQ ID NO: 219805 - protein, 48 aa, Glycine max
  Coding DNA Sequence Number=SeqID_103027
  Homolog annotation: Hit_ID=Q9STA6; Match level="QueryCoverage=69%, HitCoverage=8%, E-value=2e-08, Identity=82%"; Hit description=RAD23 protein
MECDYKYLWSDCFKLVVGSNLEKTIQQIMDMGGGSWDRDTVSHALRAA

SEQ ID NO: 219806 - protein, 197 aa, Glycine max
  Coding DNA Sequence Number=SeqID_103028
MDRTRLVYGLVMKMDMDMGAMISSQISHIAQSNSSRLSFPALITTLCEARGVVSDSLTFESLNLATIHLHSQELLEPRRSIYHLFEVPQGQGQGFNRSTPSWSSTSSVVSTFSSTSSDELEPMLQSIHHGLCLVIQNIHHLSQQQPVISLPDFMEGGEAQDPVDAGVEMAQEPADDADAGATDAEMDTYYVVDINSA

SEQ ID NO: 219807 - protein, 61 aa, Glycine max
  Coding DNA Sequence Number=SeqID_103029
MGGGSEVGVLEDTPGMAIMGVLRLALPRRKNHRGLQKSIQGGGIKFDQLPPNSALPRREIL

SEQ ID NO: 219808 - protein, 124 aa, Glycine max
  Coding DNA Sequence Number=SeqID_103030
  Subcellular localization annotation: CTP_CleavageSite=84; ConfidenceScore=5.29e-01
MYPYLFSRNNQVDVPSTRTDPQEMYPLLFTVTTTQVDVPSTCTTKDVPSNVLRQSSQAVSPSKLCEGGNQRNLTRKPENFRKLLAKEEEEEDVQEDVQRDSKVVKEYVEKLFAKVVKDCIYCYE

SEQ ID NO: 219809 - protein, 89 aa, Glycine max
  Coding DNA Sequence Number=SeqID_103031
MTHDSDGEWSTTLLVCFTMTTNLEKQSLRAQKYSDNFIPNLPISIPNFLILNPSLHDYLPLSSSHYGLRLSLSTTVTDTFTVPLLLRGT

SEQ ID NO: 219810 - protein, 269 aa, Glycine max
  Coding DNA Sequence Number=SeqID_103032
MGECERFKAVTTTPLLQKVDVVAYPHNIMGEKCMHTSYTNGANQYYETRKENPCTVSTHFLEKIEEPDYSCSDQSSVGNCNLFHHLIIIDKSTTFSRASVGGLHTLLPMAKYDARVVNHTGFLSHGLPMMHKQMCGALTWQQIVAAIVLCGCYSRLGLHECLLIANVIRRWHFVNLATLLSLCKPCNLIIILRCNPGKTPLSRGNNTSYGVVIREDKNPRNCSSNAIASSSDGAFKLDEARGNGNAIVSNVFTFAELSMEAPAVVATRP

SEQ ID NO: 219811 - protein, 166 aa, Glycine max
  Coding DNA Sequence Number=SeqID_103033
  Gene Ontology: Mol. function=nucleoside-triphosphatase activity; Cellular component=membrane
  Homolog annotation: Hit_ID=Q7XJI8; Match level="QueryCoverage=47%, HitCoverage=18%, E-value=1e-23, Identity=70%"; Hit description =Katanin
MESARRGRRTERQRDGKNDGRDNENGECEKRKKERMPETTMKRWRQRNNARTTTRNCCIKWFPFILALSYLTDAQVVVVRYNAKSKKPQYEGPDPELAAMLERDMLETSPGVRRDDFAGLTDAKRLLEEGIRRPWKGALMFGPPGRHFLLKQMLLNVGPLSILLLV

SEQ ID NO: 219812 - protein, 179 aa, Glycine max
  Coding DNA Sequence Number=SeqID_103034
  Gene Ontology: Mol. function=transition metal ion binding; Cellular component=cytoplasm; Biological process=electron transport
MGDRLEDMIHDLGQESFQQAHAPMYDTLQIDSKKPLCPGCKNLLTLLSVVLSLVNVKAIYGWSDKSFSSLLQVVHDMLLRENMLPKSYHQAKKILCPMGMKYQKIHACPNDCILYRHEFQKIPKCLRFGVSRYKVKDDDECSSDENSKKGSSAKVLWYLPIIPRFKRMFANGDDAKDLT

SEQ ID NO: 219813 - protein, 51 aa, Glycine max
  Coding DNA Sequence Number=SeqID_103035
MYSWHDKAMLYEQCPWKQARKKNQPYEFMWNKTWDKNHREHYYYNWPIYFP

SEQ ID NO: 219814 - protein, 93 aa, Glycine max
  Coding DNA Sequence Number=SeqID_103036
MPLIQLRVKLQPSYLATRAFVLGIYVFCFDAIVHVMLLQHALRGRARARLTGAFSKGGKMRRVATNVYLWKTSEKPNETGQNENSKFGSCIYA

SEQ ID NO: 219815 - protein, 58 aa, Glycine max
  Coding DNA Sequence Number=SeqID_103037
  Homolog annotation: Hit_ID=Q1RYJ5; Match level="QueryCoverage=97%, HitCoverage=10%, E-value=4e-15, Identity=70%"; Hit description=WD40 -like
MELVREFLVFHDFTNTLESYEAELRTGIGKGFDVDKNLDLIFSLYFPKFHADSLLSLL

SEQ ID NO: 219816 - protein, 123 aa, Glycine max
  Coding DNA Sequence Number=SeqID_103038
  Gene Ontology: Mol. function=nucleic acid binding; Biological process= DNA integration
  Homolog annotation: Hit_ID=Q1RXN8; Match level="QueryCoverage=64%, HitCoverage=6%, E-value=5e-22, Identity=67%"; Hit description =Peptidase S8 and S53, subtilisin, kexin, sedolisin; Integrase, catalytic region; Zinc finger, CCHC-type
MSEGSFMVKKDDWCIGNCTKLCDNQSVIHLANHQVYHERMKHIDVRLHFIRDMVESEKVRFMKIMSEDNLVDVFTKSLTSSNIVLEVGEQHYGGRTFISDLESRWRIVVYDLKFVVQSNGSSV

SEQ ID NO: 219817 - protein, 35 aa, Glycine max
  Coding DNA Sequence Number=SeqID_103039
MVLAQKACRTAGYDICQGVGLASGSGIKECPTLFP

SEQ ID NO: 219818 - protein, 73 aa, Glycine max
  Coding DNA Sequence Number=SeqID_103040
MTEDIFVFEMCADYRIGCLRMLPDFSQSLDRKGAGDNIIETFSRSRPEDADISGKCADDHIGLYVSTGSLASG

SEQ ID NO: 219819 - protein, 54 aa, Glycine max
  Coding DNA Sequence Number=SeqID_103041
MRPPNLSQKNEDLGLIHHWIAVKFGHHVRNSIPRILTVGNFDIVPELREIPLTL

SEQ ID NO: 219820 - protein, 114 aa, Glycine max
  Coding DNA Sequence Number=SeqID_103042
  Gene Ontology: Mol. function=transferase activity, transferring nitrogenous groups; Cellular component=intracellular; Biological process=regulation of transcription, DNA-dependent
  Homolog annotation: Hit_ID=Q6F766; Match level="QueryCoverage=96%, HitCoverage=22%, E-value=1e-29, Identity=58%"; Hit description =Putative transcriptional regulator
MTHIRRMRKLYSQRRRFMMTLIERYLGAAFMPVVNHEAGLHLVLNLPPGCDDVAIAALALRRGVKVRPLSQYYMHPQERRGLLLGYACVDERQCQDAFGVLKACLMEAGIAGRG

SEQ ID NO: 219821 - protein, 54 aa, Glycine max
  Coding DNA Sequence Number=SeqID_103043
MDEYCRIKILMFSTNANVIVWSIMQGTKPDDNIFLWQNDHHLSMCTALEKNKLL

SEQ ID NO: 219822 - protein, 82 aa, Glycine max
  Coding DNA Sequence Number=SeqID_103044
MERYLQHLVRQQAANHRGQGQGSAPFVCPTPEQFGAQVAWPRDWPEAQAGEEPAGSPDEAEEARMDEDMTDLLSFLGGSGAT

SEQ ID NO: 219823 - protein, 85 aa, Glycine max
  Coding DNA Sequence Number=SeqID_103045
  Gene Ontology: Cellular component=integral to membrane
  Homolog annotation: Hit_ID=Q8S8N9; Match level="QueryCoverage=98%, HitCoverage=14%, E-value=2e-11, Identity=44%"; Hit description =Golgin-84
MVEALAAKNAEIEALVSSMDVVKSQAAMSQGNLASLQALREEVESVERRAEEKRAAYIATKMVAMERKVELEHGAVESSTALSRI

SEQ ID NO: 219824 - protein, 88 aa, Glycine max
  Coding DNA Sequence Number=SeqID_103046
MEREMITMLVDTLLVFYYEKMVGYMPSSFADLVFAGERIEVSLKRGKFDYAASMNSSNKRPGANKGNKKEGETHVVAIVPTWPNFPLA

SEQ ID NO: 219825 - protein, 132 aa, Glycine max
  Coding DNA Sequence Number=SeqID_103047
  Gene Ontology: Mol. function=phosphoglycolate phosphatase activity; Biological process=metabolic process
  Homolog annotation: Hit_ID=Q1T1G8; Match level="QueryCoverage=41%, HitCoverage=19%, E-value=1e-14, Identity=76%"; Hit description =Haloacid dehalogenase/epoxide hydrolase
MDKRYGYFTVQRVWNTSNLAIRYRSSGQGMHLNLLNQLVFYLTLRTCSVKAWHLNDPSAEVVFTALRKSGVKLDVVSNFDTRLKPLLRALNSVNRFDAVAVLAEGVSISDVQRLDNLIGCQPFQGHEFNDFE

SEQ ID NO: 219826 - protein, 47 aa, Glycine max
  Coding DNA Sequence Number=SeqID_103048
MHTIDKSNPLLSVGNVVSKITAVVGRSLLGFRYLRGWSKGHPKASNP

SEQ ID NO: 219827 - protein, 249 aa, Glycine max
  Coding DNA Sequence Number=SeqID_103049
  Gene Ontology: Mol. function=RNA-directed DNA polymerase activity; Cellular component=chromatin; Biological process=RNA-dependent DNA replication
  Pfam annotation: Domain name=rve; Domain location=1-145; Score=23.7; E_value=6.3e-05; Accession=PF00665.16; Description=Integrase core domain
MKLDVERIFGRCITCKKEKSRVLPQALYTLLPVPNEPWVEISMDFILGLPGSRGDEIQFLWDTRFLSHFWKVLWGKLDTKLLFSTSYHPQTNGKIEVVNRTLTQLLRVVVQKNLKNWEECFPFVEFPYNKSVRSSTSYFPFEVVYGFNPLTLVDLIHFPVDERASLDGKKKVEMVKRLHENVRQFQKKNDQYASHANKGRRRVIFEPGEDLRMNPLEEKGDDENQRLEQAHSSTLRDHLQILVDLLQEQ

SEQ ID NO: 219828 - protein, 72 aa, Glycine max
  Coding DNA Sequence Number=SeqID_103050
MEISGPENSKLVYGIKSVRYDNNDSNKARIHEDESPYCCNCDNTTCRAHRIKMSHDLKLRESKSIMKISGGT

SEQ ID NO: 219829 - protein, 180 aa, Glycine max
  Coding DNA Sequence Number=SeqID_103051
  Gene Ontology: Mol. function=nucleic acid binding; Biological process= DNA integration
  Homolog annotation: Hit_ID=Q0KIN0; Match level="QueryCoverage=92%, HitCoverage=11%, E-value=5e-24, Identity=39%"; Hit description =Integrase core domain containing protein
MPSSGPVFSFSGTPTITTAKLNWKNYMSWSASVELWFLGQGYHDHLEKGVDAVPNDKRAEWEKLDFQLCAVLWQSVEPDVLEILRSFKTCCSFWKKAQEIFANDIQSLFDATQKVAALKQTSHDMIAHVGKARAAVEELKRFLAAKSLEEVNRKLDKFYMVTKSRQWTPSLLDFFACLKP

SEQ ID NO: 219830 - protein, 91 aa, Glycine max
  Coding DNA Sequence Number=SeqID_103052
  Gene Ontology: Mol. function=identical protein binding; Biological process=negative regulation of enzyme activity
  Homolog annotation: Hit_ID=O65757; Match level="QueryCoverage=79%, HitCoverage=53%, E-value=7e-09, Identity=48%"; Hit description =Putative Pi starvation-induced protein
MVTSNTNNTILKISKLAILLVLFASVCNVAMSDSTAKPLDQHATTGSDPTAPAVHIVYTERPQNEEPEAYHIRTLTSVLGRVLLFVLTTRN

SEQ ID NO: 219831 - protein, 103 aa, Glycine max; identical to SEQ ID NO: 192132
  Coding DNA Sequence Number=SeqID_103053
  Gene Ontology: Cellular component=integral to membrane
  Homolog annotation: Hit_ID=Q6D2T9; Match level="QueryCoverage=99%, HitCoverage=64%, E-value=4e-19, Identity=46%"; Hit description =Putative membrane protein

SEQ ID NO: 219832 - protein, 1250 aa, Glycine max
  Coding DNA Sequence Number=SeqID_103054
  Homolog annotation: Hit_ID=Q5N730; Match level="QueryCoverage=99%, HitCoverage=86%, E-value=0.0, Identity=44%"; Hit description =Erythroid differentiation-related factor 1-like protein
MEACDCPPTHHVPSEEQSNSSVLPGGKPPHIVVQNDDVHAEGYNCHSEYSQVEKEGFYWGSKKNRRNKNHSPVKKVSQVGEKPGSSILESEKQRKVGNDSFLRILFWQFHNFRMLLGSDLLLFSNEKYVAVSLHLWDVTRQVTPLTWLEAWLDNVMASVPELAICYHHNGVVQGYELLKTDDIFLLKGISEEGTPAFHPHVVQQNGLSVLRFLRDNCKQDPGAYWLYKGAGEDDIQLFDLSIIPKNCSSDHSDDASRSLRSSISRGRSDAVYSLGTLLYRIAHRLSLSMAATNRARCVRFFRKCLEFLDDSDHLAVRAVAHEQFARLILNYDDELNLTSESLALECELTVTEVEESSWDAENSNSERGAHELFYLHANDKSAEHGNMIEHLESECPAKMVSEAYKPTSGELIAVSSTELSNQEGDAPSLYPDDSSLACEVCPVSTPVVQTVADPISSKLAAVHHVSQAIKSLRWMRQLQSTEPEVMDQFNENRDRPSSFNVSVCACGDADCIEVCDIREWLPTSKLDHKLWKLVLLLGESYLALAEAYKEDGQLHQALKVIQLSCSVYGSMPPHLEDTKFISSMVSGSSLERKLIDLNEKTWQDDVKDETVNGYIERKSSTYLFWAKAWALVGDVYIEFHRIKGKEISIKDLKKPATRELKMSSEVVKEVKRLKKKLVQMNHNCSSCSLVNCSCQSDRASSGNSASSSSADASFMTHGRKHSKRLSAKNANYFPPKDPVDEFIHDKENGKDFDSKYIEHSSYGGDLNLRDTLENRIEIESLAATNSRIVEGSSEMDVSCSSVVSQTENTSKETGKVKIGGIFEYLVEPVVGDVESNLLSALKCYEEARQALLKFPTSLSELQSVVKKKGWVCNEFGRIRLENKELSKAELAFTDAIDAFREVSDHTNIILINCNLGHGRRALAEEMVSKIENLKLHNIFHNAYNHALETAKLKYIESLRYYGAARLELNAINEHDDSVTSSLKNEAHTQFAHTFLRFGMLLARENTTAIYETGSLEGTWVSHTTPHDRKARKDLRKHEISANEAIREALSVYESLGELRKQEAAYAYFQLACYQRDCCLRFMNSGNKKSILSKGENSAVQRVKQYASLAERNWQKALDFYGPKTHPNMYLTILMERSALSLSLSSHLHSNVVLESALAHMLEGRHVSDTNADTFGTSYPELHAKYWSQLQMLLKKMLATILSSSANKSPCQPSSTSSRFGDGGKIRELYKMSLKGTNMIQLYNMYNLWIS

SEQ ID NO: 219833 - protein, 110 aa, Glycine max
  Coding DNA Sequence Number=SeqID_103055
MLVHSNKESHLNAPEAPVRDNRTAHETRKGITEARRTQTYGVVAAPETHYVLLPFRLRLLLPQTPLHAIFDHSTTLVCNGNVVIQTVKMRTILPIQSNSPPMTQAIVHQN

SEQ ID NO: 219834 - protein, 83 aa, Glycine max
  Coding DNA Sequence Number=SeqID_103056
MVAQRLRIHVSTLMLDGYWLHDKDYHCDGFVGILCATMRDMDDVEFEVEVESVIPEVEVEGDILEVEVEDAEPEVEIIEILEA

SEQ ID NO: 219835 - protein, 366 aa, Glycine max
  Coding DNA Sequence Number=SeqID_103057
  Homolog annotation: Hit_ID=Q5N730; Match level="QueryCoverage=23%, HitCoverage=5%, E-value=6e-12, Identity=51%"; Hit description =Erythroid differentiation-related factor 1-like protein
MTARDGHRWSWVVEKEVLGFGWRFGKRRVKNRVFHTGEHIYNLQISLSELVSLSGSPVFLLTAQILTQRNFLCTMARSAGQFSLSAIHSRVGIVLSAPFALRETSKVVILKIPTVRLWGNVLRSSRQNLKTIQRLMNPGSRFYWNRFRVLQFLSSPCEAPSLGSIMLGTYYVIVGMYKDYLEKHQCLKLRLRKRMDMAKLLSSLPSSSSSNSENSKELVCVGTLEIATPKPVGFLCGSIPVPTDKSFHHAFHSALLPTPQTVNAPRYRYRMLPTETDLNTPPLLANFPDKVLPVGAVHSKATGGEFWYDTNCSSATRLIPFQSLCSQDPLLLLICTTVPSTVNEVYRLTTERDETFEELLANLLKA

SEQ ID NO: 219836 - protein, 80 aa, Glycine max
  Coding DNA Sequence Number=SeqID_103058
MGAKHLTRTKERSHVIKQRSPDEIRFGIIKAKKGEIVGDKGATTWNSLRLKLGNSNVARKDVSNKKQTKKSLIWMNFPFC

SEQ ID NO: 219837 - protein, 126 aa, Glycine max
  Coding DNA Sequence Number=SeqID_103059
MSRGSGDLGDVRWGAIAQNQACPIPTQPRHSQPVKTCDVPKQASSWQSTNKGTKVHEAGRLVWRLASYLSCVLSEKFPLIVMAVQLIHDRVVMECLEGVWETLECNERCRFRGTVQLTATSLVHPE

SEQ ID NO: 219838 - protein, 132 aa, Glycine max
  Coding DNA Sequence Number=SeqID_103060
  Homolog annotation: Hit_ID=Q8LPN1; Match level="QueryCoverage=33%, HitCoverage=12%, E-value=5e-07, Identity=60%"; Hit description =Knotted-1-like protein 1
  Pfam annotation: Domain name=ELK; Domain location=108-129; Score =18.1; E_value=0.031; Accession=PF03789.4; Description=ELK domain
MNDSHLKAPFLEENGFNKALQSSVNSSLEWLAVSIQPAAGFSSHSSWNYDNMSSLDSRPIDKQFQKMLNIQAIVISHMPRIQGQSETSSQNKVDVHENNLDSQVEDRELKVQLLHKYSGYLGSLEGIFEEEK

SEQ ID NO: 219839 - protein, 113 aa, Glycine max
  Coding DNA Sequence Number=SeqID_103061
  Gene Ontology: Mol. function=catalytic activity; Biological process =metabolic process
  Homolog annotation: Hit_ID=Q01CB8; Match level="QueryCoverage=82%, HitCoverage=30%, E-value=2e-08, Identity=36%"; Hit description =Homology to unknown gene
MRVKENECKEKRRYSWCVVLLKRRILMRHGKSQENRDTTAYTTILDHNIQSTVQGMTQAIRTNEHLRRVMGSNGCSPDLRVQFYMPPYAHTRSMLHKLKRCFLKKRIIGVREE

SEQ ID NO: 219840 - protein, 114 aa, Glycine max
  Coding DNA Sequence Number=SeqID_103062
MVTSFFNFGRGGCGYDGGNRGRSNAGRGDGRGRGRFLKRFSSRGWWDKMATMPLHQNGVIERKHKHIVDMLIGHHILGLDQWVDALIKPFSPTRFQLVKGKLNVMDPSSKSQPP

SEQ ID NO: 219841 - protein, 338 aa, Glycine max
  Coding DNA Sequence Number=SeqID_103063
  Gene Ontology: Mol. function=DNA binding; Cellular component =intracellular; Biological process=DNA integration
MNVTQFRLNKNFWAEYLVNCSSSTTIDFKTPTKIWSNKPVKYTMLKVFRCPTYYHVNEDVVFDKLSMLHSKYDEDLGKAKDVTKQNLAPVEGTDWMSQNDLKQPKTITPRKLQRKIKAPKNYGFDMVSYALQVVEEINSFKPTTYQDLVELPKGKGVVGFKWIFKKKHGSSVEEVIYYKAHMVTKGYMGTLDMELEKLDVKTIFLHGRLEENIIMQQPKGFEVKGKENFVYRLKMSLYGLKQSPRKWYKRFDEFIVSHWYIGNPGKEHWQAVKRIFRYLKGTTDVGLIQHGDTSYAFAVALSTGKEKYITLEKVAKEGIWLKGLENDDGTHKPKGGEL

SEQ ID NO: 219842 - protein, 190 aa, Glycine max
  Coding DNA Sequence Number=SeqID_103064
  Homolog annotation: Hit_ID=Q1S7C5; Match level="QueryCoverage=62%, HitCoverage=9%, E-value=3e-25, Identity=47%"; Hit description =Integrase, catalytic region
MAVPIHQPIPMVVPIPDPVSMEIPQSILTLTPILVVATPLHAVLSPWRLCIHNHILLACDFYEQVEPVLREVLPWFLGCQTSWHLWDKIHSHFRSLIHAKMRQLQIELHSMQLENRSVSEYLLQIQTIVDSLSSIGVTISSYEHLDVILEGLPREYECTMSLICSKFEPLSIDEVETLLLGDEVSRLDKF

SEQ ID NO: 219843 - protein, 452 aa, Glycine max
  Coding DNA Sequence Number=SeqID_103065
  Gene Ontology: Mol. function=motor activity; Cellular component=cell outer membrane; Biological process=ciliary or flagellar motility
  Homolog annotation: Hit_ID=UPI00005F72E7; Match level="QueryCoverage =66%, HitCoverage=74%, E-value=1e-95, Identity=61%"; Hit description =COG3455: Uncharacterized protein conserved in bacteria
AGVDQRGGLAGAGRADDHIPRQLVQVLAAKAGHPAVFAVALARCEARLFQQLRRFVEALRQLIVLFDLGLAVFRRHRFGGAQVAQQAAVEPGAVEARDQAAQEPDQVDNADGDLAVEFRLQRAIVADGHQRADHPDDERQRGNADKAPQQAAAVDFRLGIFRGDQQRNFYPAVQRAVHFVIVRRDGVAFAAALSLDPLRVGEVLLQPGADRFGARQRQLPVGGETGAADRHVVAVAGDQDLAADAVHGGGDAVDNRNIVGAHRGGGGVEQPVAFEDHHALLRFVAHHHQPFGYLFAQEAFQAQRRRCGRRRVTDRHLRQIGLINRRQHRAGVVAQPPVEGDEQQRSQEAGQRHAGPQRHQRAPQFLLYRQIQRMGRQRRGIAAAHRPDQLQQALFHGFQLRAAVFHHPVAAFKAQQQAIIDQLQQVDVLARALRQLGQQLEEFLAAPGFVME

SEQ ID NO: 219844 - protein, 109 aa, Glycine max
  Coding DNA Sequence Number=SeqID_103066
MSLEYLAVETFVEGQWKIVSIYPPPMQKAVSFVATFTIWIDYHKKHVVNINVLTRFLIPRPPSDRGRHTLMQSYPPRALDRRLQENWAKDAREGPRVLMSLTVDFGPMG

SEQ ID NO: 219845 - protein, 84 aa, Glycine max
  Coding DNA Sequence Number=SeqID_103067
MDKNLKVGEDEWTERERRSTEFCASNEPWHMGSEIYPEVHENPKVFFSSSNPILLEPFAHGSGDWSLPREDCISGILREPLWLV

SEQ ID NO: 219846 - protein, 113 aa, Glycine max
  Coding DNA Sequence Number=SeqID_103068
  Gene Ontology: Mol. function=tryptophan synthase activity; Cellular component=chloroplast; Biological process=tryptophan metabolic process
  Homolog annotation: Hit_ID=Q5KT13; Match level="QueryCoverage=95%, HitCoverage=26%, E-value=6e-48, Identity=80%"; Hit description =Tryptophan synthase beta subunit
MEIFLDFELQTELAGILKDYVGRESPLYFAERLTEHYKRPNGEGPHIYLKREDLNHTGAHKINNAVAQALLAKRLGKKRIIAETGAGQHGVATATDMERQALNVFRMRLLGAE

SEQ ID NO: 219847 - protein, 146 aa, Glycine max
  Coding DNA Sequence Number=SeqID_103069
  Gene Ontology: Mol. function=tryptophan synthase activity; Cellular component=chloroplast; Biological process=aromatic amino acid family biosynthetic process
  Homolog annotation: Hit_ID=P25269; Match level="QueryCoverage=58%, HitCoverage=19%, E-value=1e-20, Identity=60%"; Hit description =Tryptophan synthase beta chain 2, chloroplast precursor
  Subcellular localization annotation: CTP_CleavageSite=47; ConfidenceScore=5.72e-01
MAASIPFTGLNSSRVLPIPKEPYHPFSHFPSSMPKFASLRIPSSSVSCSLTRDSSSVVPLEEHDKMGNGSVLLQRPDSFGRFGKFGGKYVPETLMHALSQLEAAFYSLAADEEFQFSIFGNVVLSIELKSLVVEVGHSQKLNCARF

SEQ ID NO: 219848 - protein, 104 aa, Glycine max
  Coding DNA Sequence Number=SeqID_103070
MAGGANFVQRVLSYVVNEVVVNGLANSILTLQPVNATGCKHCVFFYVVPTAAANSMIYAQGPAFQRFAVRTSKRIGDISNKAVQKRQELAEQIKDISKNMEVVC

SEQ ID NO: 219849 - protein, 55 aa, Glycine max
  Coding DNA Sequence Number=SeqID_103071
MKVLMASSSSSSSNIKIKSDPVDGDMLWMQDKHVSQHICVGPCGLNNLKRDRFRI

SEQ ID NO: 219850 - protein, 837 aa, Glycine max
  Coding DNA Sequence Number=SeqID_103072
  Homolog annotation: Hit_ID=Q1SKN4; Match level="QueryCoverage=40%, HitCoverage=82%, E-value=1e-138, Identity=64%"; Hit description =Glycoside hydrolase, family 1
  Pfam annotation: Domain name=DUF1723; Domain location=96-145; Score =14.7; E_value=0.0093; Accession=PF08330.1; Description=Protein of unknown function (DUF1723)
  Pfam annotation: Domain name=Glyco_hydro_1; Domain location=513-836; Score=225.2; E_value=1.4e-64; Accession=PF00232.9; Description =Glycosyl hydrolase family 1
  Pfam module annotation: Pfam domain module=DUF1723::Glyco_hydro_1; Domain location=96-145::513-836
MVKTRGLGHALGRIVARGLGRGEDGDDTDDAAPAAQDIGAETDAHDTGAQDRGDKPEGFPGGPRDPSVHTEYADHVAANVWSGQERPELKLSSHGRKVHNLGSPVLAIEDMETSSFHLPVGEISITLDDVATLLHLPIVGALHDFQPLHSDKAVLLLVELLMVSPEVAMTETGQCGGPYVRLQWLRDIYQYRYQMQHWTAAARAYLLHLLGCTLFANKNATHVHVVHLQALRDLTLAGRYAWGVAGLVHMYNQLNDASLSTSRQLAGYITLLQCWIYEHFPSIAECNANLDYDEVSPRACWWIATKKTMKKVSAAMHKQRLDHLRILDVCWMPYSEHRPVQDFHPISCFSGQLCWGPVVVRYRPERVMRQFGYVQCIPAHPVHPWVSYDDVDDTWMHYSDHLAAAGDPCVMPGQCALDYIDWFFQSDIPQVPDDPARSDVDELRHALEACDVIAERLERHLSLGVVTPGTSTHEVIEECLKIARSVTQDRIVYVFAVIELVLLIVYPGAHGLSRDDFPPGFVFGASTSAYQVEGAANEDGRKPSIWDTFSQAGNGNMYAGNGDVACDQYHKYKEDVQLMADMGLEAYRFSISWSRVIPDGRGQVNPKGLQYYNNLINELISHGIEAHVTLHHWDLPQTLEDEYGGWVSPRIVYVPKLLVFNSVDILKDFTTYADVCFREFGDRVRYWTTVNEANVYAVFGYDVGMLPPQRCSPSPIFNCSRGNSTTEPYLVAHHMLLAHASAVRLYRKKYQVMQHGLIGFNLLPFGVLPRTNSIEDVRATQRVQDFFIGWFMNPFTFGDYPDIMKKNAGSRLPSFTQKESNLKEDRDYIADLSVEIE

SEQ ID NO: 219851 - protein, 232 aa, Glycine max
  Coding DNA Sequence Number=SeqID_103073
  Gene Ontology: Mol. function=identical protein binding; Cellular component=cellulose and pectin-containing cell wall; Biological process=negative regulation of enzyme activity
  Homolog annotation: Hit_ID=Q2HV71; Match level="QueryCoverage=82%, HitCoverage=25%, E-value=6e-72, Identity=69%"; Hit description =Protease-associated PA; Proteinase inhibitor I9, subtilisin propeptide
MHLMLKVFGLVQLPLAALLPVAYTLHKDEFLLTLCLAHQLQPTSVVLSSEELKANKNTHGFVAAYPDRNVTIDTTDTSEFLSLDSSSGLWHASNFGEDVIVGVIDIGVWPESEGFKDHGMTKKIPNKWKGSCEEVQDFNTSMCNFKLIGARYFNKGVIAANSKVKINMNSTRDTSGHGTHTSSIVAGNYVNGASYFGYAKGVARARLSMYKVIFYEGRVALDVLAGMDQLHY

SEQ ID NO: 219852 - protein, 101 aa, Glycine max
  Coding DNA Sequence Number=SeqID_103074
  Gene Ontology: Biological process=response to abscisic acid stimulus
  Homolog annotation: Hit_ID=O82464; Match level="QueryCoverage=68%, HitCoverage=62%, E-value=1e-30, Identity=90%"; Hit description=Late embryogenic abundant protein
  Pfam annotation: Domain name=LEA_5; Domain location=5-101; Score =79.8; E_value=8.3e-21; Accession=PF00477.8; Description=Small hydrophilic plant seed protein
MLISFSSHVFEQLAAIYHHNLIALVAIARRNRGGQTRKQQLGSEGYHEMGTKGGQTRKEQMGREGYQEMGRKGGLSTMDKSGVERAEEEGIDIDESKFKNK

SEQ ID NO: 219853 - protein, 70 aa, Glycine max
  Coding DNA Sequence Number=SeqID_103075
MSCQVVLGARRGFSLKMVNQHMISYMLEMEMLSLCQGNALIDVISGHEDVARCTQHLRASIDPHRDLGLP

SEQ ID NO: 219854 - protein, 49 aa, Glycine max
  Coding DNA Sequence Number=SeqID_103076
MGAGSKMWDAGSKDHFNVVQGSRVGGGCKGDGGSVNVQGEGGGIEEEEG

SEQ ID NO: 219855 - protein, 390 aa, Glycine max
  Coding DNA Sequence Number=SeqID_103077
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q10MX4; Match level="QueryCoverage=80%, HitCoverage=78%, E-value=8e-90, Identity=46%"; Hit description =Expressed protein
  Pfam annotation: Domain name=DUF231; Domain location=251-390; Score =134.5; E_value=2.9e-37; Accession=PF03005.6; Description=Arabidopsis proteins of unknown function
MKYPRGKLPLPIIVITTCVLVFVAILYVERLSFLSSKSIFKFKPCPRKTTKTKSSDKKADEEVVVVNASTWIDDRFDFDPEECNVANGKWVFNHSIKPLYSDISCPYIDRQFSCVKNGRNDSDYRHWEWQPEDCTLPRFNPELALRKLQGKRLLFVGDSLQRNQWESFVCLVEWVIPHKHKSMQLGRVHSVFTAKAYNATIEFYWAPYLVESNSDIDIIDIKKRIIKVDAIAERAKDWTGVDILVFNTYVWWMSGIRIKTIWGSFANGQEGYEEFDTPVAYNQDWGNMEGVKCFNETKPVRKKKHWGTGSDKRIMSVVAKVTKKMKVPVTFINITQISEYRIDGHCSVYTETGGKLLTEEERANPQNADCIHWCLPGVPDTWNQILLAML

SEQ ID NO: 219856 - protein, 709 aa, Glycine max
  Coding DNA Sequence Number=SeqID_103078
  Homolog annotation: Hit_ID=Q5W6H5; Match level="QueryCoverage=40%, HitCoverage=84%, E-value=1e-113, Identity=66%"; Hit description =Putative chlorophyll synthase
  Pfam annotation: Domain name=AhpC-TSA; Domain location=166-299; Score= 21.6; E_value=8.3e-06; Accession=PF00578.11; Description=AhpCTSA family
  Pfam annotation: Domain name=SCO1-SenC; Domain location=128-315; Score=219.4; E_value=8.2e-63; Accession=PF02630.5; Description =SCO1SenC
  Pfam annotation: Domain name=UbiA; Domain location=463-705; Score =139.4; E_value=9.7e-39; Accession=PF01040.9; Description=UbiA prenyltransferase family
  Pfam module annotation: Pfam domain module=AhpC-TSA::SCO1-SenC::UbiA; Domain location=166-299::128-315::463-705
  Subcellular localization annotation: CTP_CleavageSite=75; ConfidenceScore=5.04e-01
MAYIVSSKVNQFRYSTRLLFSHLLRHGRPSTLLPPFSSHLQPLHHPHQVGNQGYGNGSLGLCPRLLSSSSSSDASAANVSGEKPALDSDQSAKDGSGKERESGSGGGQDQKSDAGKSVRGGPVSWLSFLLLVLTGAGLVFYYDREKKRHIEGIRTNTEAVKQGPSAGKAAIGGPFCLINHHGKHVTEKDFMGKWTLLYFGFTHCPDICPEELQKLAAAVDKIKEKAGIETVPVFISVDPERDTVEQVGEYVKEFHPKLIGLTGSPDEVKNVARAYRVYYMKTAEEDSDYLVDHSIVIYLMSPEMEFVKFFGKNNDVDSLADGVIKEASSSSESAMASLLNMVSVPPRISPTSHTRIASLQARPVLPPFSVSFSSRWLTPPLSGCSFSQLFGFEILGVFMDIAGRRLSIRATETDTNEVQSQAPGAAPSKDGSSFNQLLGIKGAAQETNKWKIRLQLTKPVTWPPLVWGVVCGAAASDNFLKSSIYYDLRSGNFHWNFEDVAKSIVCMMMSGPFLTGYTQTLNDWYDREIDAINEPYRPIPSGAISENEVITQIWVLLLGGLSLAEDLDWFLTDRWAGQALFGTLTPDIIVLTLLYSIAGLGIAIVNDFKSVEGDRALGLQSLPVAFGSETAKWICVGAIDITQLSVAGYLLGADKPFYALALLGLIIPQVFFQFKYFLKDPVKYDVKYQASAQPFLVLGLLVTALATSH

SEQ ID NO: 219857 - protein, 98 aa, Glycine max
  Coding DNA Sequence Number=SeqID_103079
MGGVPPLRMATCMCMCFANGDGETHGGLAGRNGDMHGHICLKRQRFSSPLHKMLTFSLILSDEVRSFFFLWEYEAQSKKKKGDTPYHEQCQHHQQRRR

SEQ ID NO: 219858 - protein, 283 aa, Glycine max
  Coding DNA Sequence Number=SeqID_103080
  Homolog annotation: Hit_ID=Q8TGM6; Match level="QueryCoverage=42%, HitCoverage=97%, E-value=1e-09, Identity=43%"; Hit description =Protein TAR1
MAHLELSIPWRGSTEQPHRPTYLNYPEGNFGGNQLLDGSISLSPLYPSQTNDLHVCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFS

SEQ ID NO: 219859 - protein, 118 aa, Glycine max
  Coding DNA Sequence Number=SeqID_103081
MWLVVLCFILQILLHHGDEDDDDDDDYLVSNSYVEKSLDEDDSIDGISDTDDEVTDMIQPVYKEFKIHFGMMLYIITISTGIILMKRTFVVWRCHRVLMLANNYMLAWILIVKMRSKM

SEQ ID NO: 219860 - protein, 582 aa, Glycine max
  Coding DNA Sequence Number=SeqID_103082
  Gene Ontology: Mol. function=RNA-directed DNA polymerase activity; Cellular component=chromatin; Biological process=chromatin assembly or disassembly
  Pfam annotation: Domain name=rve; Domain location=371-527; Score =89.9; E_value=7.6e-24; Accession=PF00665.16; Description=Integrase core domain
  Pfam module annotation: Pfam domain module=RVT_1::rve; Domain location=78-294::371-527
MDDPQWSNCIMYEDPTGALFKLTQSESVNDYLFEFETLANRIIGLPSPFLLSYFVFGLSPEIHREVQALQPLSLIQAATLARLQEEKFNDNRHALRDGTWRFCVDYRTLNAITVKDHFPIPTVDELLDELSGACWFLKLDLLQGYYQILMKDKDVEYLGYLVSEHGVEPVQAIQQWLAPHSLKALRCFLGLMGFYWLFIKGYATVVTPLTQLLTKDQFGWSYDMQRAFDALKDAVSKASVLLLPNFFVVCLRNTCMGGITSPFSNHRSLKELMSQVVQTPEQQMYLARLIGFTFLQELKRELYYNADFISFQEAIQHDPAAHPDFTVTQELILQKGRIREDVQQFVAACLDCLHTKYETQKTAGLLCPLPIPSSPWEDLSLDFIVGLPAYHGHTTILVVVDRFSKGIHSGMLQPHYTAHKVALLFMDIVGKIHGMPRSLVSDRDPLFISHFWQDLFKISGTKLCMSSAYHPLSDGQTEVLNRVVEQYLRTFVHNKPSSWGKFLIWSEWSYNTSRHSDTGTSPFEITFGKKPPSIPQYLVGASTIEAVDDFLASRDAVFTSLKKKLMKAQESMKQFADTHRRE

SEQ ID NO: 219861 - protein, 79 aa, Glycine max
  Coding DNA Sequence Number=SeqID_103083
MGEKLATQLAQASKDFIYCATKDAKYLKAANQRLHVIKQASPLTRKDQCGHLHPSRRCRRLPAETAKKSHLYYLDSRVR

SEQ ID NO: 219862 - protein, 263 aa, Glycine max
  Coding DNA Sequence Number=SeqID_103084
  Gene Ontology: Mol. function=transmembrane receptor activity; Cellular component=membrane; Biological process=defense response
  Homolog annotation: Hit_ID=Q2HS00; Match level="QueryCoverage=58%, HitCoverage=16%, E-value=4e-38, Identity=50%"; Hit description=TIR
  Pfam annotation: Domain name=TIR; Domain location=46-177; Score=2.1; E_value=3.6e-05; Accession=PF01582.10; Description=TIR domain
MVGEASELTSNLVVTPIPPRIKCISESIRGVRSICSPQHMDQLRSLCLSQDGDDEIWILTLPNPNDRICSQGPRNEDVGQPANENILDSNYYNSSNESCNSSSNGDDKNYALSKWCLEELNRILDSKRHQGKIVILVFYNIDPSDMRKQKGSHVKAFAKHNGEPKNESEFLKDIVGDVLQKLPPKYPIKLRGLVGIEEKYEQIESLLKLGSSEVRTLAIWGMGGIGKTTLASALYVKLSHEFESGYFLENVREESNKLGLKFM

SEQ ID NO: 219863 - protein, 81 aa, Glycine max
  Coding DNA Sequence Number=SeqID_103085
MDVGKLIKQIQWFLFSFGDGDPVQRRLFQDSVVRANSDTMEPGESNSGVMEPINTLTLKSINILDWVVTNLNSFISCDPYV

SEQ ID NO: 219864 - protein, 468 aa, Glycine max
  Coding DNA Sequence Number=SeqID_103086
  Gene Ontology: Mol. function=nucleic acid binding; Cellular component= nuclear pore; Biological process=DNA integration
  Homolog annotation: Hit_ID=Q2HSG0; Match level="QueryCoverage=73%, HitCoverage=73%, E-value=1e-123, Identity=53%"; Hit description=IMP dehydrogenase/GMP reductase
MTEADSLSFASYDTARSLWVAIEAQYANTSRSHALKSSDWRDAMSKEFDALVQQRTWDLVPRPPNINLIGCKWTFSPVVKPTTVRLVLSLALRNNWPLPQLDVNNAVLHGSLSEEVYMQTASRLYPSRNVLSSLAKTFSFKDLGNLHYFHGVEVIPTIMGLFLSQHKYIIDLLERTKMDEAKSVLTPMSTSIPLCKDDGSPSTDVTFYRSTIGSLQYLSMTRLDITFSGTVFHGLLLQKPRSSSLIAYSDADWAGNKDDFISTSAHLVYYGSNLISWKSSKQRRLNIELLQIPELLWIHSLLTELGVTIPKSPSLLCDNLSATYLTHNPQGKIKIHHVCTADQLADCLTKPLSKTHHQQLRNKIGVTDGTPLLRGIYLPLVMVCIKTTGNKKKRGGGFQPSTTEIPHAFGTPQSTTNMGPPPVDNSATHQRECLRDIKIDPSLDEILEVARSMMDFPQYMEFSSSQDC

SEQ ID NO: 219865 - protein, 139 aa, Glycine max
  Coding DNA Sequence Number=SeqID_103087
MVQSELDSENVEFTVIDDVGSESLGPGIRRELSFSRWCDDDGRIHLDQQLGNEDAGVEDDSDFELPFPEKNELQSRSLDRERFFHQKFQLRNMQMNGIGTMDDDSVHRRGNGSEKYVSFDIEDKSERGTKGVDSYISVG

SEQ ID NO: 219866 - protein, 241 aa, Glycine max
  Coding DNA Sequence Number=SeqID_103088
  Homolog annotation: Hit_ID=Q8H184; Match level="QueryCoverage=60%, HitCoverage=35%, E-value=2e-30, Identity=50%"; Hit description =Integral membrane protein, putative
MVQSELDSENVEFTVIDDVGSESLGPGIRRELSFSRWCDDDGRIHLDQQLGNEDAGVEDDSDFELPFPEKNELQSRSLDRERFFHQKFQLRNMQMNGIGTMDDDSVHRRGNGSEKYVSFDIEDKSERGTKGVDSYISVGGDGSLGKSFQNPIHAANILKTLFLILMWYTSSLFLTLYNKSLLGDHMGKFPPPFLMNTIHFTMQAVLSKFITWFWSHKFETNVVISWGDYFLREWHQLHLHC

SEQ ID NO: 219867 - protein, 109 aa, Glycine max
  Coding DNA Sequence Number=SeqID_103089
MARSPDKIKSIDGSKETLKLSVRISDLWFIGTPNKSEQAEMVFVDSDGDEIHAVCKQDQLKECVLEDIPFRKYRFAGFADVVAGQFEPRLLVDVIGVVEEVVFRQVSGK

SEQ ID NO: 219868 - protein, 185 aa, Glycine max
  Coding DNA Sequence Number=SeqID_103090
  Gene Ontology: Mol. function=nucleotide binding; Cellular component =intracellular; Biological process=small GTPase mediated signal transduction
  Homolog annotation: Hit_ID=Q84LH2; Match level="QueryCoverage=93%, HitCoverage=57%, E-value=5e-71, Identity=74%"; Hit description =Putative Septum-promoting GTP-binding protein 1
  Pfam annotation: Domain name=Miro; Domain location=12-112; Score =65.1; E_value=2.2e-16; Accession=PF08477.3; Description=Miro-like protein
  Pfam annotation: Domain name=Ras; Domain location=12-167; Score= -44.6; E_value=6.3e-06; Accession=PF00071.12; Description=Ras family
  Pfam module annotation: Pfam domain module=Miro::Ras; Domain location= 12-112::12-167
MTPELVMKNCYSFNIKYVGDEQEKRSLQMKGLNLMDKTLFVQGARISFSIWDVAGDTGSLYQIPMACKDSVAILIMFDLTSRCTLNSVVGWYSKARKWNQIAIPILIGTKFDDFVKLPPDVQWTIVTQCIQARAYARAMNATLFFSSATHNINVNKIFKFIMAKLFNLPWKVERNLTLGEPTIDF

SEQ ID NO: 219869 - protein, 141 aa, Glycine max
  Coding DNA Sequence Number=SeqID_103091
MPALSFTPSLRDQVVNVFKELQEILFKFLTLLIALVSVKNSESGKLLFTEQHKLMMYLILTIVLYFFCATIGTIFLIYKGSLLRLIIWVMLIVGAVVSVLALNFVSTIVSWITLAMWLGIFAVVAYDYGVPQKIKNWIKDP

SEQ ID NO: 219870 - protein, 84 aa, Glycine max
  Coding DNA Sequence Number=SeqID_103092
MHQIEGTISFSSVRVDNYGAMLIVGGAASFLALTIISFAVAIIILALWIGILTLFVYIYVVPQRNSGCSIIFPVKCLNGDMNAK

SEQ ID NO: 219871 - protein, 115 aa, Glycine max
  Coding DNA Sequence Number=SeqID_103093
MDEVGDGVRRGKLVGFLKQGGVMLKKMGEYMGEVGNVSIEGNGLAQERDDGDRSKCLQPLDPEDDIGATDGEPGIALDGAAITNHYMHGSGENLLQLEEEGQARLNEIMRTPTIY

SEQ ID NO: 219872 - protein, 99 aa, Glycine max
  Coding DNA Sequence Number=SeqID_103094
MYLILTIVLYFFCATIGTILLIYKGSLLPLIIWVMLTVGAVVSVLALNFVSTIVSWTTLAMWLGIFAVVAYDYGVHQKIMNWIKGTSHLSKNHYRFFTQ

SEQ ID NO: 219873 - protein, 839 aa, Glycine max
  Coding DNA Sequence Number=SeqID_103095
  Gene Ontology: Mol. function=RNA-directed DNA polymerase activity; Cellular component=chromatin; Biological process=chromatin assembly or disassembly
  Pfam annotation: Domain name=Chromo; Domain location=764-817; Score =29.0; E_value=1.7e-05; Accession=PF00385.14; Description='chromo' (CHRromatin Organisation MOdifier
  Pfam annotation: Domain name=rve; Domain location=462-618; Score =93.3; E_value=7.5e-25; Accession=PF00665.16; Description=Integrase core domain
  Pfam module annotation: Pfam domain module=Chromo::RVT_1::rve; Domain location=764-817::12-181::462-618
MLEADLIRPSHSMFSSLVLLVKKKDGSWHCCVDYRALNAITIKDRFPMPTIDELLDEIGKASWFSKLDLRQGFHQIRMHEDDIPKTVFRTHHGHYEFKDIPFGLTNAPSTFQASMNKLLRPFLCKFVAIFFDDILVYSPSFDTHLDHLEVVFTSLQQHSFYLHRSKCDFAERQLIYLGHVISAVGIAPDPDKIQAMLSWPVPTSPTDLRSFLGLTRFYRRFIRGYAATAAPLMTLLCRDKFQWSTDAQKAFDHLKTPNLSPSLANNFALACNKLPLMFASCTQSLRRCVIQTPEQQHYMVKLLGFNYMIQYKSGAQNVVADSLFRVPPPSTMLLLSIPHSLFMDQLRKSCATNTAYQEMLHKILHHPIDHLGFIVKNGMIFSQDKTWLPASHDLSRVLMDEYHLTPTGGHMGVAKTFCRINQHFCWPQMRHDIKQYIRQCATFQTTKHSTLKPAGLLQPIPPPSSLWVDLSMDFVTGLPISQGYTTILVVVDRYSKAIHLGPLPQHYTAHKVVVLFLDIVCKHHDFPDNIISDRDPIFLSAFWRNLFCLSRTKLRFSIAYHPQSDGQTEVINRVLEQYLRAYVHDHPRQWSHFLSLVEYSYNTSVHSGTSLSPFEVMFGKPPPALPLYGAGTSPIEAVNTILSSRETIHSTLTRRLQKYQANMKRIADAHCRDICFNVGDWVYIHLRPYRQTSLQPTYSKLSKHFYGPYPIVERIGQVAYRLQLPSSSKINPVFHISLLKLHQGPHPTAVPDLSAFTIDHHPLVHPLRILDWKMDESTTPPTLMTLVQWAGLPPEETTWENWSKLQKVYNLEDKEARTEEPARGNNRTRTRPGYLRDYV

SEQ ID NO: 219874 - protein, 171 aa, Glycine max
  Coding DNA Sequence Number=SeqID_103096
  Gene Ontology: Cellular component=nucleus; Biological process =regulation of progression through cell cycle
  Homolog annotation: Hit_ID=Q6T2Z7; Match level="QueryCoverage=61%, HitCoverage=30%, E-value=1e-27, Identity=60%"; Hit description =Cyclin d2
MAPSFDFASSLLCTEDNTVFDESHNNGGTMMSMMGMCEDAWSPRKRHFDEEPDELPLLSDESLAMMVEKECQHWPGLRCLNKLQTGDLDFGARMEVVDRILKGFGGESWGQWWHREEGGEMTLGRGEREREKEKKKMKMKDDEEEAQGLSATLDGLRDTKLPTMHFTNGIT

SEQ ID NO: 219875 - protein, 182 aa, Glycine max
  Coding DNA Sequence Number=SeqID_103097
MIESFQQQQMSVLELYVEKDVVGGSMFHSANFVTSCGHNLSHHESELSRNINNLHDDENDDDDYLASNSYVEESLDEDDSVEGISDTDDDCTDIIEPVSIVHPTEGVPGIQNPFWNDALNYNNINWSHPDEEDICGLDMPTTFNVGQELYVGMNFDSKDALNYRHDQRRSINKNFFDSRKDK

SEQ ID NO: 219876 - protein, 105 aa, Glycine max
  Coding DNA Sequence Number=SeqID_103098
MGTCIVARSGLYLGSLVEPISFFNCREINWHECEWACGYDDDVRGVAGEWEGEAIVVVVDEGVFMENKGGGRGLRCGSWVLKCLRQWRMVIGEFCREKVERSSIN

SEQ ID NO: 219877 - protein, 55 aa, Glycine max
  Coding DNA Sequence Number=SeqID_103099
MAARGSHRRSMMVDEEVGGVGALQLEPFLGLFPILMVVALVLNPWPKFIPRSICE

SEQ ID NO: 219878 - protein, 55 aa, Glycine max
  Coding DNA Sequence Number=SeqID_103100
MPKLVKENTNARFMWHWCRYGSIHASTLMAWERKKKVEEIVGEKRDKMEANNMTI

SEQ ID NO: 219879 - protein, 118 aa, Glycine max
  Coding DNA Sequence Number=SeqID_103101
MVAALEVEEAVVAEVVATLSPTSAKSLVMMLQTVGIGLHLLMAPMPQQMQPSPTFVQQSMPQPMQPMQQQPQIFWGTLPQNAMSQQVPSSTSMPPLMPTSSPMSSHNPHAMTIEIMHF

SEQ ID NO: 219880 - protein, 87 aa, Glycine max
  Coding DNA Sequence Number=SeqID_103102
MDTSEPYTGAMKGTMHEPQVNLGAGQKFSPVDVFKQKKGSDKPWDFSGLIKQLHRRHSKIVKCPTSNVQSFEFGMTDPLDESISCFS

SEQ ID NO: 219881 - protein, 143 aa, Glycine max
  Coding DNA Sequence Number=SeqID_103103
MAGFPPVEIGTRGTVGSLLMQEIEYYSRQEFNSQDWSQKNKSQTINMGSSVSTNSRPTTVSRVESTKKKQSSKLLPKMCSVVDVLVTKNGYLMGMFAIKFCFGANPRTYMHYHSKLKFEVYLLKILPGVEQKTSDPIPLSSTS

SEQ ID NO: 219882 - protein, 102 aa, Glycine max
  Coding DNA Sequence Number=SeqID_103104
KNVKNEHIDMICIQEPKKEGVWESNIREFNEWIEELEVEEVPWVERKFTWFRPNGAAKSNQNNFGEASMENVKAIKTILRTFELGGGQVGDLTTKIPVKWQI

SEQ ID NO: 219883 - protein, 58 aa, Glycine max
  Coding DNA Sequence Number=SeqID_103105
MNRSTNPPDGDERLRTRDAEMYAVYRRSESKRCQIQREDEEMKKREEWSLESEEKERF

SEQ ID NO: 219884 - protein, 489 aa, Glycine max
  Coding DNA Sequence Number=SeqID_103106
  Gene Ontology: Mol. function=ATP-dependent helicase activity; Cellular component=nucleus; Biological process=metabolic process
  Homolog annotation: Hit_ID=Q1S5T4; Match level="QueryCoverage=95%, HitCoverage=61%, E-value=0.0, Identity=81%"; Hit description =Helicase, C-terminal
  Pfam annotation: Domain name=DEAD; Domain location=57-227; Score =233.7; E_value=3.9e-67; Accession=PF00270.19; Description=DEADDEAH box helicase
  Pfam annotation: Domain name=Helicase_C; Domain location=297-373; Score=117.1; E_value=5.2e-32; Accession=PF00271.21; Description =Helicase conserved C-terminal domain
  Pfam annotation: Domain name=ResIII; Domain location=53-222; Score= -27.1; E_value=0.0086; Accession=PF04851.6; Description=Type III restriction enzyme, res subunit
  Pfam module annotation: Pfam domain module=DEAD::Helicase_C::ResIII; Domain location=57-227::297-373::53-222
EDYRPEEEDEEEGNDGDSKSFFAPSDGTSFHADSFLQLNLSRPLLRACEALGYSKPTPIQAACIPLALSGRDICGSAITGSGKTAAFALPTLERLLFRPKRMRAIRVLILTPTRELAVQVHSMIEKLAQFTDIRCCLVVGGLSTKVQEAALRTMPDIVVATPGRMIDHLRNAMSVDLDDLAVLILDEADRLLELGFSAEIQELVRLCPKKRQTMLFSATMTEEVDELIKLSLSKPLRLSADPSTKRPATLTEEVVRIRRMREVNQEAVLLAMCSKTFTSKVIIFSGTKQAAHRLKIIFGLAGSKAAELHGNLTQAQRLEALEQFRKQQVDFLVATDVAARGLDIIGVQTVINFACPRDLTSYVHRVGRTARAGREGYAVTFVTDNDRSLLKAIAKRAGSKLKSRIVAEQSIHKWSHIIEQMEDQISEVLQEEREERVLRKAEMEATKAENMIAHREEIFSRPKRTWFVTEKEKKLASKASKVFKKVLGK

SEQ ID NO: 219885 - protein, 45 aa, Glycine max
  Coding DNA Sequence Number=SeqID_103107
MVASFLREVDCLKIQAQQGDQWVWKEVVDGNLDGALEELRKLKIP

SEQ ID NO: 219886 - protein, 99 aa, Glycine max
  Coding DNA Sequence Number=SeqID_103108
MVCGEGEAVNEGEYVVVAQGDAYSDSLACKVEFFDTVAEDRAMLVDEGVDIEENRNNKEAVEEEEDDDGDQRFMRLLAAEVDMKSPVSEAPDNNDVGYP

SEQ ID NO: 219887 - protein, 117 aa, Glycine max
  Coding DNA Sequence Number=SeqID_103109
  Homolog annotation: Hit_ID=Q1S7C5; Match level="QueryCoverage=72%, HitCoverage=7%, E-value=6e-16, Identity=42%"; Hit description =Integrase, catalytic region
MASALSNIVSQSFPNSIAEKLDDSNYTDVNIVSSSIPLFHLGISRRTIEFPITSTLTMKLGRFKMKCSLFGFNLLFRNQYYCVFLGRITPIKFGRRFISTLACIRSPVLDSFALRCA

SEQ ID NO: 219888 - protein, 312 aa, Glycine max
  Coding DNA Sequence Number=SeqID_103110
  Gene Ontology: Mol. function=DNA-directed RNA polymerase activity; Cellular component=chloroplast; Biological process=transcription
  Homolog annotation: Hit_ID=P69243; Match level="QueryCoverage=94%, HitCoverage=32%, E-value=1e-137, Identity=77%"; Hit description=DNA -directed RNA polymerase 3A, chloroplast precursor
  Pfam annotation: Domain name=RNA_pol; Domain location=43-312; Score =185.2; E_value=1.6e-52; Accession=PF00940.10; Description=DNA -dependent RNA polymerase
MKDEEGFYYPHNLDFRGRAYPMHPHLNHLGSDLCRGLLEFAEGRPLGKSGLRWLKIHLANLYAGGIEKHSYDGRLGFIEDHIHDIFDSADHPINGNRWWLTAEDPFQCLAACINLSEALRSSSPNSFISHLPIHQAAAVNLVAKEKPADVYTEIAVRVYDIMRRDSNKDPDTFPNALLAKVLLGQIDRKLVKQTVMTSVYGVTYIGAREQIKRRLGEKGLITDDRLLYAASCYAAKVTLAALGEVFEAARGIMGWLGDCAKVIACENQAVRWTTPLGLPVVQPYCKTERYQESTSTNSGTEGLEVTGKRGNH

SEQ ID NO: 219889 - protein, 866 aa, Glycine max
  Coding DNA Sequence Number=SeqID_103111
  Gene Ontology: Mol. function=binding; Cellular component=nucleus; Biological process=cell cycle
  Homolog annotation: Hit_ID=O65567; Match level="QueryCoverage=90%, HitCoverage=73%, E-value=0.0, Identity=63%"; Hit description=Puative protein
  Pfam annotation: Domain name=PPR; Domain location=138-171; Score =13.7; E_value=0.18; Accession=PF01535.11; Description=PPR repeat
  Pfam annotation: Domain name=PPR; Domain location=172-206; Score =30.3; E_value=6.8e-06; Accession=PF01535.11; Description=PPR repeat
  Pfam annotation: Domain name=PPR; Domain location=241-275; Score =33.8; E_value=5.9e-07; Accession=PF01535.11; Description=PPR repeat
  Pfam annotation: Domain name=PPR; Domain location=276-310; Score =20.8; E_value=0.005; Accession=PF01535.11; Description=PPR repeat
  Pfam annotation: Domain name=PPR; Domain location=311-344; Score =19.9; E_value=0.0091; Accession=PF01535.11; Description=PPR repeat
  Pfam annotation: Domain name=PPR; Domain location=347-381; Score =30.3; E_value=6.6e-06; Accession=PF01535.11; Description=PPR repeat
  Pfam annotation: Domain name=PPR; Domain location=382-416; Score=2.1; E_value=4.3; Accession=PF01535.11; Description=PPR repeat
  Pfam annotation: Domain name=PPR; Domain location=451-485; Score =11.9; E_value=0.29; Accession=PF01535.11; Description=PPR repeat
  Pfam annotation: Domain name=PPR; Domain location=486-520; Score =15.1; E_value=0.12; Accession=PF01535.11; Description=PPR repeat
  Pfam annotation: Domain name=PPR; Domain location=521-555; Score =17.1; E_value=0.062; Accession=PF01535.11; Description=PPR repeat
  Pfam annotation: Domain name=PPR; Domain location=556-590; Score=3.3; E_value=3; Accession=PF01535.11; Description=PPR repeat
  Pfam annotation: Domain name=PPR; Domain location=627-661; Score =26.0; E_value=0.00013; Accession=PF01535.11; Description=PPR repeat
  Pfam annotation: Domain name=PPR; Domain location=662-695; Score =19.1; E_value=0.016; Accession=PF01535.11; Description=PPR repeat
  Pfam annotation: Domain name=PPR; Domain location=696-730; Score =26.7; E_value=8.2e-05; Accession=PF01535.11; Description=PPR repeat
  Pfam annotation: Domain name=PPR; Domain location=731-765; Score =29.7; E_value=1.1e-05; Accession=PF01535.11; Description=PPR repeat
  Pfam annotation: Domain name=PPR; Domain location=766-800; Score =36.0; E_value=1.3e-07; Accession=PF01535.11; Description=PPR repeat
  Pfam annotation: Domain name=PPR; Domain location=801-835; Score =49.2; E_value=1.4e-11; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR; Domain location=138-171::172-206::241-275::276-310::311-344::347-381::382 -416::451-485::...
  Pfam module annotation: Domain location=486-520::521-555::556 -590::627-661::662-695::696-730::731-765::766-800::801-835
  Subcellular localization annotation: CTP_CleavageSite=77; ConfidenceScore=5.01e-01
GSTTGNNHYPHAMASFFRFSLSLDASDSLQSNLHPPFKIKTKLIEANLNSKPQLRASKPTPKPNRQHPKTKPSYLPKNTEKQKLFFSRDADVDFSPELSTEHCNAILKRLEASAAAADKTLSFFERMRATGKLERNAAAYNVMLRFLSRRQDWEGAEKLIYEMKGSELISCNAFNTLIYACCKQSLVQLGTKWFRMMLDCGVVPNVATIGMLMGLYRKGWNLEEAEFAFSRMRGFRIVCESAYSSMITIYTRLRLYEKAEGVIELMRKDEVVPNLENWLVMLNAYSQQGKLGDAERVLEAMQEAGFSDNIVAFNTMITGFGKARRMDAAQRLFMRITRCLEVDPDETTYRSMIEGWGRADNYEYATRYYKELKQMGFKPSSSNLFTLIKLEANYGDDEGAVGILDDMVDCGCHYASIIGTLLHVYERAAKVHKVPRLLKGSFYQHVLVNQSSCSTLVMAYVKHRLVEDALKVLNDKKWQDPRYEDNLYHLLICSCKEAGLLEDAVKIYSRMPKSDDNPNMHIACTMIDIYSVMGLFKDAEVLYLKLKSSGVALDMIAFSIVVRMYVKAGALKDACAVLDAIDMRPDIVPDKFLLCDMLRIYQRCNMATKLADLYYKISKSREDWDQELYNCVLNCCAQALPVDELSRLFDEMVQHGFAPSTITFNVMLDVFGKAKLFNKVWRLYCMAKKQGLVDVITYNTIIAAYGKNKDFNNMSSTVQKMEFDGFSVSLEAYNSMLDAYGKDGQMETFRSVLQKMKDSNCASDHYTYNTLINIYGEQGWINEVANVLTELKECGLRPDLCSYNTLIKAYGIAGMVAEAVGLIKEMRKNGIEPDKKSYTNLITALRRNDKFLEAVKWSLWMKQMKI

SEQ ID NO: 219890 - protein, 202 aa, Glycine max
  Coding DNA Sequence Number=SeqID_103112
  Gene Ontology: Mol. function=helicase activity; Biological process =viral genome replication
  Homolog annotation: Hit_ID=Q9LTU4; Match level="QueryCoverage=98%, HitCoverage=16%, E-value=1e-56, Identity=47%"; Hit description =Helicase-like protein
MAICCHVGFPYLFVTFTCNPCWPKIERLLKSMDLKAPDWPNIVSRLFRIKFKELLADLTKKHILGKVVAFEIPSEQDEPKLYNLVKAHMIRGPCGSSNKSSPCMKGGKCSRYYPKKFQNSTIVDQDGYPVYMQRDNGHTILKNGVIVDNRTIVSYNAMLLLKFQAHINMEWCNQSTSIKYLFKYINKGYDRITVATIPTEHQ

SEQ ID NO: 219891 - protein, 619 aa, Glycine max
  Coding DNA Sequence Number=SeqID_103113
  Gene Ontology: Mol. function=DNA binding; Cellular component=beta -galactosidase complex; Biological process=DNA integration
  Homolog annotation: Hit_ID=Q2HRM8; Match level="QueryCoverage=52%, HitCoverage=36%, E-value=2e-90, Identity=44%"; Hit description =Polynucleotidyl transferase, Ribonuclease H fold
MQAELQALRLNNTWTLTTLPPHKTAIGCRWIYKIKHHADGSIERYKARLVAKGYTQMEGLDYLDTFSPLTEEVYMQVPPGLLVENPNLVCRLQRSLYGLKQASHSGNSIDEIQSITTLLDQTFKIKDFDNLKFFLGLEIARTSQETPLPADYSSSYRRLVGRLIYLTNTRPDIAHAVQQLSQYMSNPTNTHHQDAFRCRDSRRSITGLFVYFGSSLISWQLKKQSTISRSSSEAEYRALASTTCEPQWLTYVLQDFCVPFIQPATLYCDNLQIGTNPVFHERTKHIEIDCHIVRHKVNSGLIKLLPVSSSQQLAGLFTKALSPAGPEQGWVLLLDVPIFRYDGLFLMCYVPNGTIMMTHPLDITMTLKEMTYTLGHIPFAIPCRTSHARDYRGLFHGRGCGRDFGRGRGGFGGPIGNDGPSFPPCCPYSGYEVDAILSSILRIWMCGPDEEEWFPPLGIVLGRNKSGATVCYLASPFGSFGEIETNLPSMTTIDRPLWFGYVGNWIAGFSGNCGSNTNMATGLFGIYHGLNLAGHKGFCLVICESDSKMALQFIEEGVVDCHPHAPLVAAIRLLMGLNWDVSFLHTFREGNFCADALAELGATNTSPLFLSLITALLQL

SEQ ID NO: 219892 - protein, 103 aa, Glycine max
  Coding DNA Sequence Number=SeqID_103114
MGLSNWSEEQKNSECTHKVEKVCVSLKTSLPRGELGLQLESSKESHPTGSDPSNRGTSSFIQYGGTGGEGDGGCAKEETKECWVDSITANFWHRSSNLVDINN

SEQ ID NO: 219893 - protein, 350 aa, Glycine max
  Coding DNA Sequence Number=SeqID_103115
  Gene Ontology: Mol. function=DNA binding; Cellular component =membrane; Biological process=DNA integration
  Homolog annotation: Hit_ID=Q1SS72; Match level="QueryCoverage=96%, HitCoverage=24%, E-value=4e-63, Identity=35%"; Hit description =Integrase, catalytic region
  Pfam annotation: Domain name=zf-CCHC; Domain location=224-241; Score =13.1; E_value=0.0068; Accession=PF00098.13; Description=Zinc knuckle
  Pfam annotation: Domain name=zf-CCHC; Domain location=262-279; Score =5.4; E_value=0.13; Accession=PF00098.13; Description=Zinc knuckle
  Pfam module annotation: Pfam domain module=zf-CCHC::zf-CCHC; Domain location=224-241::262-279
MESYLYLHPSENPTIALVSLVLDSTNYHSWSRSMITALSAKNKVEFVDGSVPEPLKTDRTYGACADVTTWQNILWMDKAEQIWRDLKLRYSQGDLLRISDLQQEASTMKQGALSVTEHFTRLRIIWDEIENFRPDPICFCNIRCSCSALAIIAQRKLEDQAMQFLHGLNEQYANIRSHVLLMDPILAISKIFSYVAQQECQFLGNVSSNLNLESRDISINAAKVVCDFCGRVGHMENVCYKKHGMPPNYDGKSKSNNMRYGKMCAHCGKNGHTIDVCYRKHGFPPGYKTYNGRTTANNVVVVDSKATDDQTQHHKSQDIVRFSPEQYKALLALIQHPSSWNAASNQSQTK

SEQ ID NO: 219894 - protein, 45 aa, Glycine max
  Coding DNA Sequence Number=SeqID_103116
MGTDLKGSEVERNGGSVNSEGKKGLVLAQGDSVPIFVEKHSSTAR

SEQ ID NO: 219895 - protein, 1598 aa, Glycine max
  Coding DNA Sequence Number=SeqID_103117
  Gene Ontology: Mol. function=RNA-directed DNA polymerase activity; Cellular component=chromatin; Biological process=chromatin assembly or disassembly
  Pfam annotation: Domain name=HEAT; Domain location=916-952; Score =25.4; E_value=0.0002; Accession=PF02985.12; Description=HEAT repeat
  Pfam annotation: Domain name=rve; Domain location=551-700; Score =31.1; E_value=3.9e-06; Accession=PF00665.16; Description=Integrase core domain
  Pfam annotation: Domain name=zf-H2C2; Domain location=485-533; Score =9.3; E_value=0.021; Accession=PF09337.1; Description=His(2)-Cys(2) zinc finger
  Pfam module annotation: Pfam domain module=HEAT::RVT_1::rve::zf-H2C2; Domain location=916-952::185-424::551-700::485-533
MRREKELCFNCDEKFIRDHHCSSKLFLLIADDDEVSQEEISLDDAFLVAKEHDDQSPAQISFHAISGHERFVTTLGLHAQPIQPLCIMVGNGNEIDSLQVCRDVLIQVQEHKLTVDFHVLPLCGADLVLGVQWLKLLGPILTDYTDLTMKFMHQGPYRYPHFQKQEIEVQVEAMLSSGIIRPSQSPFSLPALLVKKCDGSWCFCVDYMALNASTIKDRFPIPTVNELLDELGGACWFTKLDLLQGYHQILMREEDVHMTAFRTHQGHYEFRVMPFGLCNALSSFQALMNTTFKPYLHKFIIVFFDAQQQIEYLGHVVSATSVQLVHEKALAIQLWPRPTSLRALRALKDVVSTALMLRLPDFSLPFTLETNASGFGMVKKWRQFLLGHSFVILTDHRSLKELMAQIIQTPEQQKYLTRLMGYDFTIQYRSGRSNVVADVLSRTFEPHKGMVFTLSMPHFTFLAKLKGELADNQEFITLWRDLQEHPANHSDFTYNDGVYMGITKTLARLQENFTWSSIRNDVCRFVEQCLDCQHTKYVTRKPAGLLELLPLPARLWEDLSLDFIVGLSSYRGNTTILVVIDRFLKGIHLGLLPTQYFAYQVANLFLDIVAKHHDMPKSLVSDRDPLFISKFWQELFKLSGTKLRLSSAYHLQSDGQTEVMNCIIENTSTDTTPFEVTFGKKPPTIIQYISGSSTVEEIDTLLSSREAIFDSLCRKLLKAQARMKHFADNNRREVSFQECDWVMVKLRPYRQSSVIGPNPTKLSKRYYGLFKVLDRIRTVAYKLLLPEGSHIHPIFHCSLLKPFLHDAANEPRPLLLLGKDMENHPVITPLAILSTRWEGPKEALCLQVVVQWAGLHVGDTLWEDWASLKEDYQLEDKVIFDGFVSDRPSRMQEAQNERSKRKITPPQCFHVGAIAPQSLEHLLPSIHECLSSTDWATRKAAAEALSSLALHSSSLVTDRAAPTLAVLEACRFDKIKPVRDSINEALQLWKKIAGKGDGSPDDSKPSSDGGNESAISSEASDPKKVNLDERKTDSPVKGSSTSSSNMDSTKAKAASISEKAVVILKKKPPVLSDKELNPEFFQKLERRGSDDLPVEVVVPRRGLNSSNSNNEEESEANAKDSKERINSVGNIPNDDHGSSSNKYRIFERGNDGNSKQRNYDDFGHDRFSERRVNTKELRTKAYDTDGRTENDQRDGSANAAGFSKTDGQSEVPFSNNRANWLAIQRQLLQLERQQVHLMNMLQDFMGGSHDSMVTLENRVRGLERIVEDMSRDLSISSGRRNFAGFEGSSNRPSSKYNGFNDYSSSKYGRGGDGRIPFGERFAQSDGNSLGMRGRGPSWRSDMSEGWDHSGYGASRNGQMSSRRAFGGSSADGRSPKSVHENDQAGNRRAWDKAAMPIRLGEGPSARSVWQASKDEATLEAIRVAGEDNGTSRATRVAIPEMTAEAMADDNVGQERDAIWTSWSNAMDALQVGDLDSAFAEVLSAGDDILLVKLMDKTGPVIDQLSSEVACETVNAIGQFLLDQNMYDICLSWIQQLLEIVLENGPDTFDIPMEVKKELLLNLHEASTDPAETWEGVQPDQLLLQLASAWEIDLQQHDK

SEQ ID NO: 219896 - protein, 815 aa, Glycine max
  Coding DNA Sequence Number=SeqID_103118
  Gene Ontology: Mol. function=zinc ion binding
  Homolog annotation: Hit_ID=Q10PC5; Match level="QueryCoverage=90%, HitCoverage=95%, E-value=1e-159, Identity=43%"; Hit description =Tropomyosin, putative, expressed
  Pfam annotation: Domain name=DUF1423; Domain location=307-789; Score =724.0; E_value=1e-214; Accession=PF07227.2; Description=Protein of unknown function (DUF1423)
  Pfam annotation: Domain name=PHD; Domain location=462-524; Score=0.3; E_value=0.053; Accession=PF00628.19; Description=PHD-finger
  Pfam module annotation: Pfam domain module=DUF1423::PHD; Domain location=307-789::462-524
MIGSKDRSADFEGENSRSKLSRHNFEANKEYPDEKGVEFLRDSSEVGGCGGSSGLQELTLSYLCDNPKFNLAEKEIPGKSLLEKMSHKGKEVVVCENSYQDGKWVERDFLSLSEPREDSSKRSLEEVVERESNREKKPKLEILNLSLALPDVSLSLTASNALQNGGDHQQQVRTNPCRPSSTTHTSYSNDYTAASLSYSYSHPFSHNPSCSLTHNSTDMFDYSVSKDDQIWNCGEGTNGSVHSRFKPIRDGLVGLSNHGGGGGISSFMQGNNNSQYKTTTSSDNHSFFPSELPARPRFEAQSGDSRGRNSENLRVLDDGKARKISRPERIVREIVSESIPVMTLTIQELTDDVIASTKEYLRNLIEKPEKKEELVSLQSRLERRSDLTKESLSKCHKVQLEVLVAVKMGLASFLSSQIQLSEMVEVFLFKRCRNVTCKHLLPVDDCDCKICSGNKGFCSSCMCPVCLNFDCASNTCSWIGCDVCSHWCHATCGIQRNLIKPGPSLKGPSGTSEMQFHCIGCGHASEMFGFVKDVFVCCAKDWGLETLMKELDCVRKIFMGSEDRKGKELHVKTDDMLLKLQTRMISPSDASSYIMQYFSYADSMPDFPASGISSKDLSASQSNLTKDTPSLSKPNSLLPKYGYDMGYSRSHPDAMSCDLLQKDLKASILSELKNEADFHLGALLRKGGLESLESIVRIKEAEARMFQTKADEARREAEGFQRMIRTKTAQMEEEYAEKLSKLCLHETEETQRKKLDELKVLENSYFDYYKMKKRMQDEIDGLLRKNGGNKAAMGLNLYFGCFSLCFLIEDTAKCV

SEQ ID NO: 219897 - protein, 110 aa, Glycine max
  Coding DNA Sequence Number=SeqID_103119
  Gene Ontology: Mol. function=metal ion binding; Cellular component =integral to membrane; Biological process=electron transport
  Homolog annotation: Hit_ID=Q9ZSR3; Match level="QueryCoverage=96%, HitCoverage=52%, E-value=7e-25, Identity=54%"; Hit description =Cytochrome
MVNWEDVTSLHSWIGIGTFCLVGLQWLMGLGFMLQGSAQSRSTMAPWHVAAGRALFFMAICAALTGLMEKYTMIKLVTHHRESHLINFTGLAILLFGVFVDMSVGLPRYA

SEQ ID NO: 219898 - protein, 713 aa, Glycine max
  Coding DNA Sequence Number=SeqID_103120
  Homolog annotation: Hit_ID=Q2QUQ6; Match level="QueryCoverage=61%, HitCoverage=40%, E-value=8e-55, Identity=32%"; Hit description =Expressed protein
  Pfam annotation: Domain name=DUF1723; Domain location=111-160; Score =69.3; E_value=1.2e-17; Accession=PF08330.1; Description=Protein of unknown function (DUF1723)
MESSEDPIIQVKDEQLMVSPLSGENPVHRTAYFIKPCVEDSATLPHSMFSSGRTATVNSDHAKLLEVRYKGWHYPSAEWNTWVQQMQHKYECVWMKAGIDQAIKASTFQIRRNDELIIELAQRWCSKTNTFVFPWGEATITLEDMKVCWGYSVMGAPISSPLVSGEEREIEQKLIGVFRMFFKSKARRADHTPWMKHFMSNESRVEHEAFLSLWLSRFVFPGRSYTTILKSTFPIAIHLARGLKLALAPAVLASIYRDLSLLNNKIRIVATVELEVTLWAPFQLVQVWALERFPALQPLPDVIEQGQLLMTKWHAVKMLKGDNLKLILDSVGAENGFIWHPYENSPALQLYNENDMWVCDNPNFDDELESFARCLRVSELVGMECIEQYLPNRVAMQFGMDQDIPGMLAHYNDNPWISYSQPVMDTNLYTALCACHQPNVTSRYYRWWKQSNPSKEGDMHDHCVVSSPEHLLPTSSSMKKESGGSYGPPPGFTSKINAKQEKDFDEEGKLSIIELSDSSNEVRCLGDEEVGNGKALSSPPSDVFPSASVEGARTVKDNGNEVKIEHSFCDRNDVNDKEGEDASHRIANIASNLESRIWKLERVIAKLKAAKFGHKLLTLLFLSALNLSLRSPDTLASKERGAKKVVSFEIDEATVTTVDGDSSVLSSVTTLSAHGTRDLREVVEEIQDEFMTASNFGKEVALLLELELVDGDE

SEQ ID NO: 219899 - protein, 116 aa, Glycine max
  Coding DNA Sequence Number=SeqID_103121
  Subcellular localization annotation: CTP_CleavageSite=13; ConfidenceScore=5.14e-01
MCHSSLAQKPLIVVNVIAAVIMLKLLSSPRLLSLLLSSFLQLGSSTIHLKRHCIVRSGSMKDSQHLRVQASDEEAVLQLGTEVEALIPMFEEIRDMNKDTLPEDTSNVILFFKEAL

SEQ ID NO: 219900 - protein, 77 aa, Glycine max
  Coding DNA Sequence Number=SeqID_103122
  Subcellular localization annotation: CTP_CleavageSite=32; ConfidenceScore=5.05e-01
MLSNANHCIFVEVNASTTINLGSGLNNGPSLRSSQRFQKRNKGMEGEGDEEEMVNGDRERDLGDEVKNQKRRASHQG

SEQ ID NO: 219901 - protein, 88 aa, Glycine max
  Coding DNA Sequence Number=SeqID_103123
MYKAKLQELCHQRKWGLPRHFAMKDGPDHIPSFKLLIMSIVSPSLLVPLVPLKKLITKLPCLLSSASLLCFLLAGDDGLEVGNYGFVK

SEQ ID NO: 219902 - protein, 560 aa, Glycine max
  Coding DNA Sequence Number=SeqID_103124
  Gene Ontology: Mol. function=phosphoinositide phospholipase C activity; Biological process=intracellular signaling cascade
  Homolog annotation: Hit_ID=Q2QUQ6; Match level="QueryCoverage=69%, HitCoverage=36%, E-value=4e-55, Identity=35%"; Hit description =Expressed protein
  Pfam annotation: Domain name=DUF1723; Domain location=106-155; Score =75.0; E_value=2.4e-19; Accession=PF08330.1; Description=Protein of unknown function (DUF1723)
MMEVREDFMVSPIGDSEPSLRTAYFLKPLAKSLDGSVSEVLSSSKTMQLPPVFEPKEWPLVVHFKGWPKLKRKWVEWVDALQVRYGSVWKKVGIFDAIMSTKCSIVKDENLCFGVAEKWCPKTNTFLFPWGEATITLEDVMVLGAYPLVGDPIFTPLQSQEMIEVEKKLIHARQQPLRKNGAKVTTSLWMNLFLNSGSEIEHEAFLATWLTMVGFSHNGLMSKFVFPIAIHLARGNSIALGPAVLASIYKDLSLLKKTIVDFTNDKLELEVTLLSPFYLVQIWVWERFMNLQPQPMLINQEDPMLFRWHKVNTLKIDNVRLALDSAMEHFRWRPYVQYAGKFKVFYPENETLVLIDTNLDKEPTGLLVSFVTCLRVSVLVGIQSTIKKYLPHRVAMQFGMDQDVPGRVPTFHGTEAIAWKNYCRTISDRSLYFPARLFEGDVTTRYAMWWKQSVLCRHHDFAKNIVQRKRSLRPPPHGPHVLKANKKGYDADVPPGFSHLKTAPSGNSGEDNGEPLMGGLEEDFGDANGRKESRLSSESCSCASGIKVKYLEQRINRLET

SEQ ID NO: 219903 - protein, 341 aa, Glycine max
  Coding DNA Sequence Number=SeqID_103125
  Gene Ontology: Mol. function=hydrolase activity, hydrolyzing O -glycosyl compounds; Cellular component=cell wall; Biological process= carbohydrate metabolic process
  Homolog annotation: Hit_ID=Q9AT33; Match level="QueryCoverage=84%, HitCoverage=86%, E-value=1e-132, Identity=75%"; Hit description =Endoxyloglucan transferase
  Pfam annotation: Domain name=Glyco_hydro_16; Domain location=34-219; Score=314.1; E_value=2.5e-91; Accession=PF00722.11; Description =Glycosyl hydrolases family 16
  Pfam annotation: Domain name=XET_C; Domain location=246-298; Score =59.1; E_value=1.4e-14; Accession=PF06955.3; Description=Xyloglucan endo-transglycosylase (XET)
  Pfam module annotation: Pfam domain module=Glyco_hydro_16::XET_C; Domain location=34-219::246-298
MEGSHMGLLLFFCSSMLFAAFAAASSRNLPIIPFDEGYAPLFGDSNLVIHRDGKSVHLSLDERTGSGFVSHDLYLHGYFSASIKLPSDYTAGVVVAFYMSNGDMFQNNHDEIDFEFLGNIRGKDWRIQTNVYGNGSTNIGREERYGLWFDPADDFHQYTIVWTDSQIIFYVDNVPIREVTRTESMGGDFPSKPMTLYATIWDASDWATNGGKYRVNYKYAPYVAEFSDLVLHGCAVDPIEQHVAKCDNAPQSSEATTTIPSSGVTPAQRIKMENFRKKHMTYSYCYDKVRYKVPPSECVISSQEAERLRRFDPVTFGSGRRHHGKRHRRSRGSQTEAAASF

SEQ ID NO: 219904 - protein, 98 aa, Glycine max
  Coding DNA Sequence Number=SeqID_103126
VTLTQIARKSCEELKHLRVLENNSSTVPAEFSLCNCEKMFNQMSEMTNSWMMKLIIPNPGSVNNNKIISSLPQSEPKEHPSDVKSRNHSESKFVMKFN

SEQ ID NO: 219905 - protein, 125 aa, Glycine max
  Coding DNA Sequence Number=SeqID_103127
MVKEECKEASVSSKRTLVSTIKPLELEVIPQVKELLDEGLVRKSLNPRALLVPKIGIIKHQIPKIGVMKNVLSGATLFCKITHTPNIFMIRVHRSSLGSHQGVSTNPKRIKVIPEWPTPPCIREI

SEQ ID NO: 219906 - protein, 80 aa, Glycine max
  Coding DNA Sequence Number=SeqID_103128
MDEDQWRYDFAMSQEVHMDYDYDNQEECGVNESHVDCSNAFNTSQVFATRNDVLPWPRIVAHENGFVAVIMRSDTETGSR

SEQ ID NO: 219907 - protein, 262 aa, Glycine max
  Coding DNA Sequence Number=SeqID_103129
  Gene Ontology: Mol. function=RNA-directed DNA polymerase activity; Cellular component=intracellular; Biological process=RNA-dependent DNA replication
  Pfam annotation: Domain name=RnaseH; Domain location=157-262; Score= -8.0; E_value=0.00032; Accession=PF00075.14; Description=RNase H
MGCVLGQQDETGRKEHAIYYLSKKFTDCESRYSLLEKTCCALAWAAKRLRHYMINHTTWLISKMDPIKYIFEKPALTGRIARWQMLLSEYDIEYRTQKAIKGSVLADHLAHQPIEDYQPIKFDFPDEEIMHLKMKDCDEPLLGEDPDPESKWGLIFDGAVNVFGNGIGAVIITPEGNHLPFAARLQFDCTNNVAEYEACILGIEKAIDLKIKNLDIYGDSALVINQIKGEWETRHPGLIPYKDYARRLLTFFNKVELHQHPS

SEQ ID NO: 219908 - protein, 110 aa, Glycine max
  Coding DNA Sequence Number=SeqID_103130
EAVEAALRESEVDIAAFQHVKRIKLLNESLASDWARGAGVAIPTSAFPLCLRGVGVVDINGNLGMAPHSSECSRDTPLVVARCKREAPSRAKAWFLASFASFVPVACNFL

SEQ ID NO: 219909 - protein, 97 aa, Glycine max
  Coding DNA Sequence Number=SeqID_103131
  Gene Ontology: Mol. function=binding
MDLARKVFNEIPERDVVAWTALIIEHVHNGEPQKGLRCLRHMHCEDAPMPNARTWEGGFLACGSLGAVKRGCFSHTVFGFGCVFQMWGSLRSVSILL

SEQ ID NO: 219910 - protein, 516 aa, Glycine max
  Coding DNA Sequence Number=SeqID_103132
  Gene Ontology: Mol. function=binding; Cellular component=ubiquitin ligase complex; Biological process=protein ubiquitination
  Homolog annotation: Hit_ID=Q1SXA3; Match level="QueryCoverage=92%, HitCoverage=100%, E-value=1e-163, Identity=67%"; Hit description=IMP dehydrogenase/GMP reductase
  Pfam annotation: Domain name=Arm; Domain location=165-206; Score =21.1; E_value=0.0039; Accession=PF00514.13; Description =Armadillobeta-catenin-like repeat
  Pfam annotation: Domain name=Arm; Domain location=208-247; Score=6.3; E_value=2; Accession=PF00514.13; Description=Armadillobeta-catenin -like repeat
  Pfam annotation: Domain name=Arm; Domain location=251-298; Score =14.3; E_value=0.2; Accession=PF00514.13; Description=Armadillobeta -catenin-like repeat
  Pfam annotation: Domain name=Arm; Domain location=299-337; Score=2.7; E_value=5.7; Accession=PF00514.13; Description=Armadillobeta-catenin -like repeat
  Pfam annotation: Domain name=Arm; Domain location=338-380; Score =11.2; E_value=0.48; Accession=PF00514.13; Description=Armadillobeta -catenin-like repeat
  Pfam module annotation: Pfam domain module=Arm::Arm::Arm::Arm::Arm; Domain location=165-206::208-247::251-298::299-337::338-380
METKKVNSNRRYMQQPPVLLCGVMGELLSNAAKLLQQMAKCHKNNVGSIALDHRHSTKNATTGGHFRVLRRLIFDAVSCGGTSRYRYRQRGGADNDDGDFNSAASHTEKEERSEKLSDLLNAAESKTATEEALAELKQVVKELREEDFTKRRIAAARVRSLAKEDSEARANLAVLGAIPPLVGMLDDSEDAHSQIASLYALLNLGIGNDANKAAIVKIGAVHKMLKLIESSGSDSSVSEAIVANFLGLSALDSNKPIIGSSGAIPFLVRTLKNLNESKIESKSQMKQDAMRALYNLSICQSNVSVVLETDLVLFLVSTIGDMEVSERSLAILSNLVSTPEGRKAISSVSDAIPILVDALSWTDSPECQEKASYVLMIMAHKAYGDRRVMIEAGVVSSLLELTLVGTTLAQKRASRILECLRVDKGKQVSGSYGGNFNLGVSAPICGSSSSNGGKGCLVVDDGMMSEEKKTVKQLVQQSLQSNMMKIVKRANLRQDFLPSGNFASLTSTSTSKSLPF

SEQ ID NO: 219911 - protein, 446 aa, Glycine max
  Coding DNA Sequence Number=SeqID_103133
  Gene Ontology: Mol. function=nucleoside-triphosphatase activity; Cellular component=mitochondrion; Biological process=protein metabolic process
  Homolog annotation: Hit_ID=Q9LLI0; Match level="QueryCoverage=99%, HitCoverage=49%, E-value=0.0, Identity=83%"; Hit description=ClpB
  Pfam annotation: Domain name=AAA; Domain location=172-396; Score= -9.9; E_value=0.0012; Accession=PF00004.19; Description=ATPase family associated with various cellular activities (AAA)
  Pfam annotation: Domain name=AAA_2; Domain location=168-326; Score =350.6; E_value=2.5e-102; Accession=PF07724.4; Description=ATPase family associated with various
  Pfam annotation: Domain name=AAA_5; Domain location=172-313; Score =24.0; E_value=2.6e-05; Accession=PF07728.4; Description=ATPase family associated with various
  Pfam annotation: Domain name=Mg_chelatase; Domain location=163-337; Score=-157.0; E_value=0.093; Accession=PF01078.11; Description =Magnesium chelatase, subunit ChlI
  Pfam annotation: Domain name=Torsin; Domain location=172-361; Score= -183.5; E_value=0.057; Accession=PF06309.2; Description=Torsin
  Pfam module annotation: Pfam domain module=AAA::AAA_2::AAA_5::Mg _chelatase::Torsin; Domain location=172-396::168-326::172-313::163 -337::172-361
MEITSKPTELDEIDRAILKLEMEKLSLKNDTDKASKERLSKLENDLSLLKQKQKELTELWDNEKVLTTRIRSIKEEIDRVNLEMEAAERDYDLNRAAELKYGTLMSLQRQLEEAEKNLTDFRKSGQSLLGEEVTDLDITEIVSKWTGIPLSNLQQTEREKAGLSDPNRPIASFMFMGPTGVGKTELAKALAGYLFNTENALVRIDMGEYMEKHAVSRLIGAPPGYVGYEEGGQLTEVVRRRPYSVVLFDEIEKAHHDVFNILLQLLDDGRITDSQGRTISFTNCVVIMTSNIGSHYILDTLRNERQVVELARQTFRPEFMNRIDEYIVFQPLDSEQISKIVELQMERVKNRLKQKKIDLHYTEEAVKLLGVLGFDPNFGARPVKRVIQQLVENEIAMGVLRGYFKEEESIIVDADVTPSGKERSPLNKLLIKKLDSSVADAMVVND

SEQ ID NO: 219912 - protein, 123 aa, Glycine max
  Coding DNA Sequence Number=SeqID_103134
MEKAGFGSEEVDVRWAAAETRMGETFEARMWEKREEGFEKELKRNVSWEGKEWKERSTLKQRRGSWKRQRDSRVVLPPPCLVVFHSPRKSALSLSLAAPMLMVHSSLSDVAQVCLPALLVAIF

SEQ ID NO: 219913 - protein, 47 aa, Glycine max
  Coding DNA Sequence Number=SeqID_103135
  Gene Ontology: Mol. function=nucleoside-triphosphatase activity; Biological process=protein metabolic process
  Homolog annotation: Hit_ID=Q9LLI0; Match level="QueryCoverage=93%, HitCoverage=4%, E-value=1e-16, Identity=97%"; Hit description=ClpB
MGSLLAGAKYRGDFEERLKAVLKEVTASSGQIILFIDEIHTVVGAET

SEQ ID NO: 219914 - protein, 195 aa, Glycine max
  Coding DNA Sequence Number=SeqID_103136
  Gene Ontology: Mol. function=RNA-directed DNA polymerase activity; Cellular component=chromatin; Biological process=RNA-dependent DNA replication
MVVKYQSIPQHVTYLEEVFGELCKYDMRLNPEKCTFGIGDDKFLGFMMTHRGIEANPDKCIAILEMCNPTNIQEVQKLNGRLASLSKFLPKFVEKAKPFYKLLKKTEPFSWDKTCEQAFLAFKKTIATLPVLSRPRPRAPLLLFLSVPDETVSSALVQEEEKHQVPIYFTSRILHDAEMCYQMIEKVMLALVTSA

SEQ ID NO: 219915 - protein, 119 aa, Glycine max
  Coding DNA Sequence Number=SeqID_103137
MGIAPTKTPSGPEEIQQGPGVSSSGYEPLSVLQGARTPPARSRHHRECLSPLAKSSDPPTNRAFIQKYCAPRQAQGEAPQQHWDGRECLSPPAKSSDPPTNRAFIKKYCAPRQAQGEAP

SEQ ID NO: 219916 - protein, 301 aa, Glycine max
  Coding DNA Sequence Number=SeqID_103138
  Gene Ontology: Mol. function=nucleic acid binding; Cellular component= chromatin; Biological process=chromatin assembly or disassembly
  Homolog annotation: Hit_ID=Q9S775; Match level="QueryCoverage=97%, HitCoverage=20%, E-value=1e-116, Identity=71%"; Hit description=CHD3- type chromatin remodeling factor PICKLE
  Pfam annotation: Domain name=Chromo; Domain location=19-69; Score =57.8; E_value=3.5e-14; Accession=PF00385.14; Description='chromo' (CHRromatin Organisation MOdifier
  Pfam annotation: Domain name=DEAD; Domain location=128-300; Score= -36.1; E_value=0.0063; Accession=PF00270.19; Description=DEADDEAH box helicase
  Pfam annotation: Domain name=ResIII; Domain location=110-295; Score =7.8; E_value=1e-05; Accession=PF04851.6; Description=Type III restriction enzyme, res subunit
  Pfam annotation: Domain name=SNF2_N; Domain location=116-301; Score =49.4; E_value=1.2e-11; Accession=PF00176.13; Description=SNF2 family N-terminal domain
  Pfam module annotation: Pfam domain module=Chromo::DEAD::ResIII::SNF2_ N; Domain location=19-69::128-300::110-295::116-301
MASVNTSDEDFVAIRPEWTTVDRILACRGDDDEREYLVKWKELPYDECYWEFESDISAFQPEIERFNRLRSRSSKFSSGKQKNSVKDDAELKKQQKEFQHYEQSPEFLSGGTLHPYQLEGLNFLRFSWSKQTHVILADEMGLGKTIQSIAFLASLFKEGVSPHLVVAPLSTLRNWEREFATWAPHMNVLMYVGSAQARSVIREYEFYFPKKQKKIKKKKSGHLISESKQDRIKFDVLLTSYEMINFDTASLKPIKWECMIVDEGHRLKNKDSKLFSSLKQYSSRHRVLLTGTPLQVHFKLS

SEQ ID NO: 219917 - protein, 514 aa, Glycine max
  Coding DNA Sequence Number=SeqID_103139
  Gene Ontology: Mol. function=nucleic acid binding; Cellular component= chromatin; Biological process=chromatin assembly or disassembly
  Homolog annotation: Hit_ID=Q9S775; Match level="QueryCoverage=98%, HitCoverage=35%, E-value=1e-142, Identity=53%"; Hit description=CHD3- type chromatin remodeling factor PICKLE
  Pfam annotation: Domain name=CHDCT2; Domain location=365-503; Score= -70.1; E_value=0.074; Accession=PF08074.2; Description=CHDCT2 (NUC038) domain
  Pfam annotation: Domain name=DUF1086; Domain location=231-358; Score =164.9; E_value=2e-46; Accession=PF06461.2; Description=Domain of Unknown Function (DUF1086)
  Pfam annotation: Domain name=DUF1087; Domain location=125-186; Score =32.9; E_value=1.1e-06; Accession=PF06465.4; Description=Domain of Unknown Function (DUF1087)
  Pfam module annotation: Pfam domain module=CHDCT2::DUF1086::DUF1087; Domain location=365-503::231-358::125-186
MARAHRLGQTNKVLIYRLITRGTIEERMMQMTKKKMVLEHLVVGRLKAQNINQEELDDIIRYGSKELFADENDEAGKSRQIHYDAAAIDRLLDRDQVGDEEATLDDEDEDGFLKAFKVANFEYVDEAEAAAEEAAQKRAMETLNSSERTHFWEELLRDKYQEHKVEEFNALGKGKRNRKSDFVPDGVGRCVIQVADFTKWDKALVVVFMVSVEEDDLAGLEDVSSDGEDDNYEAELTDGDSNSTGITTARRPYKKKARTDSTEPLPLMEGEGKAFRVLGFNQNQRAAFVQILMSYGTLFLSHIAEDITDSATFTDGVPKEGLRIQDVLVRIAVLLLIRDKVKFVSQHPQTPLFSDDILLRYPGLKGAKIWKEEHDYVLLRAVLKHGYGRWQAIVDDKDLKIQEVICQELNLSFINLPVPGQVSSQAQNGANLTNAEVSNNQSKENGGSDIAADGAQGSGDARNQAQLYQDSSILYHFRDMQRRQVEFIKKRVLLLEKGLNAEYQKEYFDSSSKN

SEQ ID NO: 219918 - protein, 114 aa, Glycine max
  Coding DNA Sequence Number=SeqID_103140
EKAKGLERSNDGHEGAVVTEELPLVLAIKLVVAQHRHRHRHRHRHRTTVLVDSRSRDDGVRRISTMSQKNVSNTFAEVSTVHNNVQCWCFELLGSYGSVSNEGIGVGKVTKYMQ

SEQ ID NO: 219919 - protein, 765 aa, Glycine max
  Coding DNA Sequence Number=SeqID_103141
  Gene Ontology: Mol. function=two-component response regulator activity; Cellular component=nucleus; Biological process=two -component signal transduction system (phosphorelay)
  Homolog annotation: Hit_ID=Q6K8X6; Match level="QueryCoverage=57%, HitCoverage=63%, E-value=1e-100, Identity=49%"; Hit description =Putative response regulator 9
  Pfam annotation: Domain name=Myb_DNA-binding; Domain location=206 -253; Score=35.7; E_value=1.6e-07; Accession=PF00249.21; Description =Myb-like DNA-binding domain
  Pfam annotation: Domain name=Response_reg; Domain location=18-131; Score=98.6; E_value=1.9e-26; Accession=PF00072.14; Description =Response regulator receiver domain
  Pfam module annotation: Pfam domain module=Myb_DNA-binding::Response _reg; Domain location=206-253::18-131
MTVEKKMNDSGDEFPVGMRVLAVDDDPTCLLVLETLLRRCQYHATTTNQAIKALALLREHKDKFDLVISDVHMPDMDGFKLLELVGLEMDLPVIMLSANGDTKLVMKGISHGACDYLLKPVRMEELKNIWQHVIRRKKFDSKEKNKTRNIDKPTSNSSNGLGSSGTGNSDHNEKLTKKRKDQDEDEDEEQENDHDNDDPSAQKKPRVVWSVELHRKFVAAVNQLGIDKAVPKKILDLMNVEKLTRENKYRLYLKRISCVANQQTNMVVALGGADPSYLRMNSVSGVGHIQSISGSGQLHNNAFRSFPPSGIINRLNTPAGLNVHGFPSGVLQLSQSQNLKNTNDNLKFQSAIVPANQNGVHGMTVSVGLDQLQNNKGVMSVQNLTTVFDAKTTFPISNKLPDPRPKITNSGSHTPDVSFSNNALMLEPRPQGTQGSVRIETLSSSVASQHSEFSLSLLDQGRYSDNWASTVQPSVIQTNSYPPSECFGQTNIPPTDNMASVPLQGGNLSGASITSLSRQSYDSMTDMHSEGVTFTNRPGHISSNVPYQGWHDNNQDATHHSNILSINSLTPVNGAAVPAGHAAMNSALHRNLDFNYCDPLQMKHEGFVELTDEALSKQHQGNIMNLPKSQQSHFSNNLGSLEDLVSSMMKQYHVHAMQENDKMKLLDGNLICNNYSGGLSRCDSSPAMQYGVLLITLFNLLRYVGLQIGPRSSVTATLAARRETQGPGGAHHTNGIHLNPVSFSCLDAWCRCGSLREIRDCKFKC

SEQ ID NO: 219920 - protein, 222 aa, Glycine max
  Coding DNA Sequence Number=SeqID_103142
  Homolog annotation: Hit_ID=Q9S775; Match level="QueryCoverage=51%, HitCoverage=8%, E-value=5e-11, Identity=32%"; Hit description=CHD3 -type chromatin remodeling factor PICKLE
MGDPKANEVTNEELKSETKATNFPGDKLGDTDTQMIDQLPQVQTIASEEISAECDSDPTRLELVRLYNEMCKAVEEDSMDLVQTSLAREPAELNVVKNFPPLETLCEDINKILTPTQEQPIAEMPISNSDNKSEAMSHGENLGSKSPPISQDCKPKDSEDNENKDMKIESESIKESCSSLLEEKNETPTLPDKEESKTEMDETMNDAELNENPEKSDAVLEG

SEQ ID NO: 219921 - protein, 379 aa, Glycine max
  Coding DNA Sequence Number=SeqID_103143
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=94%, HitCoverage=30%, E-value=1e-53, Identity=56%"; Hit description=Chromo
  Pfam annotation: Domain name=RVP_2; Domain location=220-338; Score= -63.7; E_value=0.091; Accession=PF08284.2; Description=Retroviral aspartyl protease
  Pfam module annotation: Pfam domain module=RVP_2::Retrotrans_gag; Domain location=220-338::79-169
MQTETDNKFTQIHNAFDLLLNQSPKKSSHDDSNLSKQSFRVRNIKLEFPRFNDKNVLEWIFRAKQFFDYYGTLDLDQLTIASVHLDKEVVPWFQMMQRSHPFHSWVEFTRALELDFGPSIYECPRATLFKLSQTGTVADYYLQFTSLANRVYGLSNDALIDYFISDLIPEIRREDAQPEPEKTQLDMTYTEPDLATNDHHLSLNAMKGTDSIGILRFTGQIGQIRVQVLVDGGSSNNFLQPRIAEFLKLPVEPGPCFKVLVGNGQSMTAEGVVPNLSIILQGHELIVPVFLLPVAGADIILGSSWLATLGPHVADYAASTLKFFYKGKFVTLQGEKGTPPKLAQFNHYRRMQNTNAIADSFTVQLFQFHTKDDVLKDLP

SEQ ID NO: 219922 - protein, 628 aa, Glycine max
  Coding DNA Sequence Number=SeqID_103144
  Homolog annotation: Hit_ID=Q1T2D5; Match level="QueryCoverage=38%, HitCoverage=16%, E-value=4e-93, Identity=64%"; Hit description=Chromo
  Pfam annotation: Domain name=rve; Domain location=1-135; Score=32.8; E_value=1.2e-06; Accession=PF00665.16; Description=Integrase core domain
  Pfam annotation: Domain name=zf-C2H2; Domain location=444-466; Score =20.4; E_value=0.0063; Accession=PF00096.16; Description=Zinc finger, C2H2 type
  Pfam module annotation: Pfam domain module=rve::zf-C2H2; Domain location=1-135::444-466
MDFITGLPNSYGFNTILVVVDRLSKYGHFIALKGDYTSRSVVELFMTHVVKLHGMPKSIVSERDKVFTSNFWRNLFQLQGTTLAMEMFLRCLEMFLRCFTFHNPKAWYKALNWAEFWYNRSFHTSIGMTPFKALYGRDPPALTRYNPQASNPVTLQEQLINRDNILQQLKQHLERAQVYMKNQVDKKRTDVSFAMGDLVLVKLQPYRQHSVTLRRNQKLGMRYFGPFPVVAKIGSVAYMLQLPNDNTTPAEATWEDFNEMLDNFLNFNLEDMVVINGDGIAMKENREGMFSTKSAKGDPHGEKGNNVVSIGPEMMGQRKGMRNRMTNTKLRDYVGFMNLPITRARGEYSAMETLSHESPFYDNNLSAEKTPPSPSTPLQNPQEKKQLSVKEQEEAKTDTLLDLNASGDDSAVGCSPVLNLITCLDTDLPSTSSENQHGSEPRVFSCNYCQRKFYSSQALGGHQNAHRRERSITKRGHHRSGSRGMMASATTAFGIPFLHNHLHHYATMASLPLHGGCSNNKPLGIKAHSIIHKPSSNSSHISFNGFGTTFGHHGWSRPLIDQQPRIGKLTMESCHKTSRGNVGKFDAVKTTMINSATIEEISGYNMISGVTRFKTNQEEMKHLDLSLK

SEQ ID NO: 219923 - protein, 171 aa, Glycine max
  Coding DNA Sequence Number=SeqID_103145
MMDYIAIKITTCPSNFTAQNYPCHVMKLLVEDHRDYPCLFDDEYESWDVQGNTQYQYSLMRAQIQGYQWFFSEEEKREFDLIKETHDTKLFLPLYNGKFFIPFSVDHNNKLVQFFQKEKKDKEIYEACGRHGQEAPPTPSTEMPMEDSSDIFCSGNIQDEEDVTITKSTKS

SEQ ID NO: 219924 - protein, 85 aa, Glycine max
  Coding DNA Sequence Number=SeqID_103146
MRLHCHQPSQRPNMTTDSPLLLMAHIDLGIRPNISICQLSQPTLRREGDAGLTGASSKGGERAESPPTFIREKHKKKPERVVYKL

SEQ ID NO: 219925 - protein, 57 aa, Glycine max
  Coding DNA Sequence Number=SeqID_103147
MLLKGNELAIQNTRNKCGTSLLSLNHWPNQHPDIHHVWPFCKPFEPRPQTTINLDPG

SEQ ID NO: 219926 - protein, 229 aa, Glycine max
  Coding DNA Sequence Number=SeqID_103148
  Homolog annotation: Hit_ID=Q9LUA7; Match level="QueryCoverage=60%, HitCoverage=45%, E-value=3e-16, Identity=32%"; Hit description =Arabidopsis thaliana genomic DNA, chromosome 5, P1 clone:MIF21
  Pfam annotation: Domain name=DUF868; Domain location=24-229; Score= -6.6; E_value=1e-11; Accession=PF05910.3; Description=Plant protein of unknown function (DUF868)
  Subcellular localization annotation: CTP_CleavageSite=9; ConfidenceScore=5.30e-01
MMSSSPFPSCFRPSPNAESHPPPPPPPHSTISNLTIYHTDTGPVSLTWSRSIVGRSLHIQLHQNPLDSPPYPNPNPNPSPSTTLSFHLHIRPFLFWKKHGSKKLAPNTHLFWNLSRAKFGATPEPLSGFYVALVVHNHMTLLIGDAARDAFSKSKARHPNTPQLLLLKKERVFADRLYTTRARFGGKAREIQIDCGYHDHSELCFSVDGEKVLQIKRLMWKVQEERAVQ

SEQ ID NO: 219927 - protein, 35 aa, Glycine max
  Coding DNA Sequence Number=SeqID_103149
LYPPYGKTLKCARDVVFVPTEVSQNEAHAWGTVQN

SEQ ID NO: 219928 - protein, 231 aa, Glycine max
  Coding DNA Sequence Number=SeqID_103150
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=P56761; Match level="QueryCoverage=61%, HitCoverage=40%, E-value=2e-73, Identity=99%"; Hit description =Photosystem II D2 protein (Photosystem Q(A) protein)
  Pfam annotation: Domain name=Photo_RC; Domain location=1-129; Score= -33.1; E_value=3.8e-05; Accession=PF00124.9; Description =Photosynthetic reaction centre protei
MGVAGVLGAALLCAIHGATVENTLFEDGDGANTFRAFNPTQAEETYSMVTANRFWSQIFGVAFSNKRWLHFFMLFVPVTGLWMSALGVVGLALNLRAYDFVSQEIRAAEDPEFETFYTKNILLNEGIRAWMAAQDQPHETLYSLRRFYHVETLFNGTLALTGRDQETTGFAWWAGNARLINLSGKLLGAHVAHAGLIVFWAGAMNLFEVAHFVPEKPIIGLWRYLSCTFGT

SEQ ID NO: 219929 - protein, 42 aa, Glycine max
  Coding DNA Sequence Number=SeqID_103151
GSGKGILFSPTYDVLLFPKIKVAQANLIGKVPANFCAIPGMK

SEQ ID NO: 219930 - protein, 114 aa, Glycine max
  Coding DNA Sequence Number=SeqID_103152
MNLRGRQVEISDPMCPLCNNSEEVAAHLFFNCSKVFPLWWESLSWVNSVGAFPKEQKDHFMQHSRRNATRTKDIRWSYWWIALTRTIWQHRNKVVFDNQTFNASKLMDEALLLV

SEQ ID NO: 219931 - protein, 120 aa, Glycine max
  Coding DNA Sequence Number=SeqID_103153
  Pfam annotation: Domain name=zf-CCHC; Domain location=48-65; Score =26.6; E_value=4.1e-05; Accession=PF00098.13; Description=Zinc knuckle
MQEENEEEDEEDLSLFVKKFQKLVKKRRIERRQNFNNGRRSQEDSQILRCNKCNQLGHIKANCPSNEEWPEKSNKKRYEERRTKKAYIAWDGNDLSDGSEKEINLLTKDYESDENISQEN

SEQ ID NO: 219932 - protein, 74 aa, Glycine max
  Coding DNA Sequence Number=SeqID_103154
MTLRRKVQGLIDTGWLKFEENRLLNHNIDKQHHTWGNSGSCCYDSSGFSKRSELSRIGCWTNGLSYLEKKRGLN

SEQ ID NO: 219933 - protein, 141 aa, Glycine max
  Coding DNA Sequence Number=SeqID_103155
  Gene Ontology: Mol. function=ATPase activity, coupled to transmembrane movement of ions, phosphorylative mechanism; Cellular component=membrane; Biological process=metabolic process
  Homolog annotation: Hit_ID=Q7CH63; Match level="QueryCoverage=100%, HitCoverage=51%, E-value=5e-54, Identity=69%"; Hit description =Putative phosphatase
  Pfam annotation: Domain name=Hydrolase_3; Domain location=6-141; Score=-29.1; E_value=1.7e-05; Accession=PF08282.2; Description =haloacid dehalogenase-like hydrolase
MSYRVIALDLDGTLLTPNKTILPESLEALARAQQAGVQVLIVTGRHHCAIHPFYQALQLTTPAICCNGTYLYDYQAQRVLAADPLEKSQAARVIEMLDQENIHGLLYVDDAMLYQEATGHVTRTLNWAQSLPEAQRPLFVQ

SEQ ID NO: 219934 - protein, 98 aa, Glycine max
  Coding DNA Sequence Number=SeqID_103156
MGVYLVKKGVQIAARPTWAFQDVPPEGGCFWRKKPGSPGRAWWQAPPLFPINRGRSERERENPSRGASVTFPWVISRRFSTVLRRSSFVLRRSSVFNW

SEQ ID NO: 219935 - protein, 75 aa, Glycine max
  Coding DNA Sequence Number=SeqID_103157
  Gene Ontology: Mol. function=protein-N(PI)-phosphohistidine-sugar phosphotransferase activity; Cellular component=organelle inner membrane; Biological process=phosphoenolpyruvate-dependent sugar phosphotransferase system
  Homolog annotation: Hit_ID=Q2NUP1; Match level="QueryCoverage=100%, HitCoverage=11%, E-value=4e-35, Identity=97%"; Hit description=PTS system N-acetylglucosamine-specific IIABC component
MVPVATLPAAAILMGVGYWIDPVGWGGDNALAAFFIKSGSAIIDNMSVLFAIGVAYGMSKDKDGAAALTGFVGFL

SEQ ID NO: 219936 - protein, 113 aa, Glycine max
  Coding DNA Sequence Number=SeqID_103158
  Gene Ontology: Mol. function=glucosamine-6-phosphate deaminase activity; Biological process=N-acetylglucosamine metabolic process
  Homolog annotation: Hit_ID=Q8ZDE1; Match level="QueryCoverage=100%, HitCoverage=42%, E-value=4e-56, Identity=89%"; Hit description =Glucosamine-6-phosphate deaminase
  Pfam annotation: Domain name=Glucosamine_iso; Domain location=15-113; Score=65.7; E_value=1.5e-16; Accession=PF01182.11; Description =Glucosamine-6-phosphate isomerases6-phosphogluconolactonase
MRLIPLKDTAQVGKWAARHIVQRINAFKPTAERPFVLGLPTGGTPLEAYKHLIAMHKAGEVSFKHVVTFNMDEYVGLPQEHPESYHTFMYRNFFDHVDIPRENINLLNGNAAD

SEQ ID NO: 219937 - protein, 292 aa, Glycine max
  Coding DNA Sequence Number=SeqID_103159
  Homolog annotation: Hit_ID=Q1SFS3; Match level="QueryCoverage=46%, HitCoverage=25%, E-value=8e-12, Identity=30%"; Hit description =Lambda repressor-like, DNA-binding
DFQLVPTVEEFEEILGCPLGGRKPYLFSGFYPSMARISKVVKILAQELNWVKKSRNGVVGVPRRCLEEKAKALANQDEWASFIEILALLIFGVVLFPNVEGLVDLAAIGAFLSLHHGKESPIVTILSNMHDAFDQRCEKSGPSVRYKVTARALRKERRIGTNSLLVWKRHPLIGSLAGRKEELGFCPRAKGVPSKESITPFIARGFNDPKVRVVQGVRKARDAVQRKDKELRGNPHVTVFLTFSTNKRWWRLHTFSSLGRCTHDSRVALPLKGQRKRKTTMVFMPSNLVASG

SEQ ID NO: 219938 - protein, 147 aa, Glycine max
  Coding DNA Sequence Number=SeqID_103160
MAPPYSIPTVEQFSEMVAWPRTQPSLHKEDEGPTAQVPQHMEDESSEATIPKPFNIGEEAEETQVRQVAATTPERSLEATSEPSALVVNLPLPHPVADPSTPLLQMPEDPTTPVLAVDTSPPTIVVLQLTDEEDGQTQDTQDQSQEF

SEQ ID NO: 219939 - protein, 236 aa, Glycine max
  Coding DNA Sequence Number=SeqID_103161
  Gene Ontology: Mol. function=succinate dehydrogenase activity; Cellular component=membrane; Biological process=tricarboxylic acid cycle
  Homolog annotation: Hit_ID=Q82SG7; Match level="QueryCoverage=54%, HitCoverage=55%, E-value=1e-55, Identity=73%"; Hit description=SdhB; succinate dehydrogenase (Iron-sulfur subunit) oxidoreductase protein
  Pfam annotation: Domain name=DUF339; Domain location=148-230; Score =83.6; E_value=6.2e-22; Accession=PF03937.6; Description=Protein of unknown function (DUF339)
MTQFFDNYHSVMPYLQNHDTPPETERVQSPEDRAKLDGLYECILCGACTTSCPSFWWNPDKFVGPAGLMQAYRFIADSRDQEQEARLENLEDPYRLYRCHNIMNCTDVCPKKLNPNAAIAAIKDLKIEKAKAHSEAKPGKKIFGIKILREAEQRRLAWRCRRGMLELDIVLQRFVSEHFSGLTLAEMEQLDALLELPDNVFWDLIQGVNPQPGMAQSTAILQKLRASRPAAEQETA

SEQ ID NO: 219940 - protein, 101 aa, Glycine max
  Coding DNA Sequence Number=SeqID_103162
MGQSIIMQNLQGLGLPSIMSMEEFDAQVAWPGDQPSSSGGGGASIAQELVTEEPPAAAAAEEETTLDQTPQPSPSSAPAPEETQPAALDLNEDQPQKEQDV

SEQ ID NO: 219941 - protein, 80 aa, Glycine max
  Coding DNA Sequence Number=SeqID_103163
MECSICGVKIKYARPANTRVGNGIFEGAGGIIGISVEEEGGSVEEKGLPVSSAEVEGASDLFPLAFLSPLKVTIGSSRFQ

SEQ ID NO: 219942 - protein, 79 aa, Glycine max
  Coding DNA Sequence Number=SeqID_103164
MGDRLEDMIGDLGQESFQQAHALMYDTLQTDSKKPLYLRCKKVVRDMLLEVNTLPKSYLSGEEDFVFDGYEVLENSCMP

SEQ ID NO: 219943 - protein, 319 aa, Glycine max
  Coding DNA Sequence Number=SeqID_103165
  Gene Ontology: Mol. function=alcohol dehydrogenase activity; Cellular component=membrane; Biological process=electron transport
  Homolog annotation: Hit_ID=Q2XF97; Match level="QueryCoverage=99%, HitCoverage=26%, E-value=1e-121, Identity=66%"; Hit description =Aldehyde dehydrogenase family protein, putative/cytochrome c family protein, putative
  Pfam annotation: Domain name=Cytochrom_C; Domain location=208-295; Score=27.2; E_value=5.7e-05; Accession=PF00034.11; Description =Cytochrome c
MRQGISRDGHHLYPAFPYTSFRQLSEGDMQALYAWLMSQPAVQQAPPENQMRFPYNLRFLMAGWNALYLGRGEYQPDPRKSAEWNRGAYLVNGAGHCGACHSPRNLLGAEKRGDNFLAGGWVDGWEAPALNQLSKAPQPWTAQSLYNYLRSGYDAQHGVAAGPMAPVVSHLATLPEADVRAMASYLADINGQAARPVAVPAAKPAWNTAAGERLFKGACQACHSASEGGPQLFGVSPSMANSSSITSATPDNLLQVVLHGIDKPATDALGYMPGFAASLSDKQVADIAAWLRQRYAPDQPAWQNLSEKVAQVRANPGSH

SEQ ID NO: 219944 - protein, 85 aa, Glycine max
  Coding DNA Sequence Number=SeqID_103166
  Gene Ontology: Mol. function=oxidoreductase activity, acting on the CH-OH group of donors, NAD or NADP as acceptor; Biological process =malate metabolic process
  Homolog annotation: Hit_ID=Q3SJM0; Match level="QueryCoverage=96%, HitCoverage=20%, E-value=3e-30, Identity=78%"; Hit description =Malate dehydrogenase
  Pfam annotation: Domain name=malic; Domain location=17-85; Score= -20.7; E_value=2e-06; Accession=PF00390.9; Description=Malic enzyme, N-terminal domain
MDDLKQRALDYHQFPKPGKLSVESSKPCATQQDLSLAYTPGVAEPVREIEADPANAYKYTNKGNLVAVITDGTAVLGLGNVGALA

SEQ ID NO: 219945 - protein, 75 aa, Glycine max
  Coding DNA Sequence Number=SeqID_103167
  Gene Ontology: Mol. function=transcription regulator activity; Cellular component=intracellular; Biological process=regulation of transcription, DNA-dependent
  Homolog annotation: Hit_ID=Q5NYB1; Match level="QueryCoverage=97%, HitCoverage=30%, E-value=2e-15, Identity=50%"; Hit description =Transcription regulator protein
MYSMYESQFGIRMIRAEERIKAVAADAEVAKALGLKEGYPLLSIERVSFTYGDKPMEWRLGLCLTDDHHYMSELE

SEQ ID NO: 219946 - protein, 352 aa, Glycine max
  Coding DNA Sequence Number=SeqID_103168
  Gene Ontology: Mol. function=oxidoreductase activity; Biological process=metabolic process
  Homolog annotation: Hit_ID=Q46TN1; Match level="QueryCoverage=98%, HitCoverage=97%, E-value=1e-102, Identity=54%"; Hit description=MaoC- like dehydratase
  Pfam annotation: Domain name=MaoC_dehydratas; Domain location=9-133; Score=31.4; E_value=1.4e-06; Accession=PF01575.9; Description=MaoC like domain
MSTKINTGRFFEHFVLGETIQHATPRTITAGDTALYIALTGARNPLHCSEPLAKSLGYTQMPIDDLLAFHIAFGKTVPDISVNAVANLGYADVRFIQPVYIGDTLSTSSEVIGLKQNSNGKSGVVWVRSTTVNQHQQPVLSWVRWVMVHKKNQEAPAPETVIPELPEFVSHESLAVPAHFTLNSDLGTATGGQYWWDDYEVGECMRHPSGLTINESDHTMATHLYQNNARLHFDAHLMQSTPQGQCLVYGGVVISACRALSYEGLENAISIVAINGGTHANPSYSGDTIYCMTKVLDKWSLPHPELGALRLRMVGVKNMPPATLENIKTTQGYHPHVVLDLDYTVLIPRKGN

SEQ ID NO: 219947 - protein, 468 aa, Glycine max
  Coding DNA Sequence Number=SeqID_103169
  Gene Ontology: Mol. function=transferase activity, transferring nitrogenous groups; Cellular component=intracellular; Biological process=regulation of transcription, DNA-dependent
  Homolog annotation: Hit_ID=Q1I2V1; Match level="QueryCoverage=68%, HitCoverage=64%, E-value=1e-133, Identity=73%"; Hit description =Putative transcriptional regulator, GntR family
  Subcellular localization annotation: CTP_CleavageSite=41; ConfidenceScore=5.49e-01
MVFDSHSTRSPSISTGTRPLGFSARNAGSCVERKPLPQSSRASGNPSSWQVHNTLRTLIDEALPNNFSIRFPYPLQNGLSPSRRASARVRPISANCLSFSSSNSLRVLRRNKYQRQRDQPTRRHVVMPSNSAIICTGFLILHPDKRPLYDTLRHSGRHSQPTHSARAVSRRPSPAFGARAEPGARRQHQHGAASLPAAGRTAPGGGAAEVGLLRAYAARAGRAARHDGAGAAAGGHFAMGAGAGAGAQPAARGPDPAGARHAGYRRADDETADRRPAQRRPPRRSAQPVLRQHSGRGRAARAGRPPAAGFRLPNRPRSVADHHRLPGGDLRRAARRLPTRRHRGGRFALLPRHHADAEGPGHQGAGNPHRSAHRRQPGGAGDGAGTVADQSDSADAQLQQSAGLHHARRPQTAVADAGAAPRRGDHRGRRLRRHRLSLPAAAHHQVVRRRRPRAAVQLVFQNAGAGAA

SEQ ID NO: 219948 - protein, 85 aa, Glycine max
  Coding DNA Sequence Number=SeqID_103170
MKLIIWGISPEAISTQVDFQDFRTTNSINSRDSGKITLVGQLAKQLAERPSSNFTANTEKNPKEECKAVVTRSRMAIQAEEGRAD

SEQ ID NO: 219949 - protein, 132 aa, Glycine max
  Coding DNA Sequence Number=SeqID_103171
  Gene Ontology: Mol. function=transporter activity; Cellular component= integral to membrane; Biological process=transport
  Homolog annotation: Hit_ID=Q8XWW8; Match level="QueryCoverage=54%, HitCoverage=16%, E-value=1e-18, Identity=61%"; Hit description =Probable permease transmembrane protein
ACAQAVDGLAELQVVQHLQLGETDVDAVYPGQDEEQDQKRDQAPGDLAVGGVHVEGRGLAGACALCEGMCGGCRAAHGVSPVFESAAGTRARPLGPGPCVVGTSGVWRLQRFLWRQYRKAGQGCPTRNYEQA

SEQ ID NO: 219950 - protein, 305 aa, Glycine max
  Coding DNA Sequence Number=SeqID_103172
  Gene Ontology: Mol. function=N-acetyltransferase activity; Cellular component=membrane; Biological process=transport
  Homolog annotation: Hit_ID=Q2X8I1; Match level="QueryCoverage=87%, HitCoverage=91%, E-value=9e-80, Identity=56%"; Hit description =Membrane protein, putative
QDGGRQHRRGRDRFLPLAGGGRAVHAFPFAVHLAPARRHPAAAAAPHRAGDAGHGDLPEPGLLRGPYDIGHAHGPDRLAHAHDGAGPVHRHAGPGAEPGRRAGLHAGDCGRGPGGVFGAACHLAHPGPQWRRCADVRGHAGLCGLQHPAQALAHAAPGHGATAVPADPGGRDRAAAAVPDGAAHGAERDQPAAGGLCGHHGLHRRAAAVDDVGGAHRAGPLQHVLQPGTHLHGRDRLHGIGRAPGGLPRRGRRADHRRPAAGRAVEAALACAACRRHRMKKSGFSRAQMVHACRMPVRRPHHCCP

SEQ ID NO: 219951 - protein, 49 aa, Glycine max
  Coding DNA Sequence Number=SeqID_103173
MDAEFTKRCVPKSLLEWYTWMFLLISALKGFNDNQGSKSKAAARWIVVK

SEQ ID NO: 219952 - protein, 136 aa, Glycine max
  Coding DNA Sequence Number=SeqID_103174
  Gene Ontology: Mol. function=transition metal ion binding; Cellular component=cytoplasm; Biological process=electron transport
  Pfam annotation: Domain name=Transposase_21; Domain location=83-135; Score=-130.2; E_value=0.0017; Accession=PF02992.5; Description =Transposase family tnp2
HDMLLEENKLPKSYYQAEKILYRHEFQEMPKCPRCGVSRYKVKDDAEYSSHENSNKGPPVKVLLYLPIIPRFKHMFANRDDVKDLTWHADGRNCDGMLHHPADSSHWKKIDRLYPDFGIDARNLRLGLATDRGKKS

SEQ ID NO: 219953 - protein, 197 aa, Glycine max
  Coding DNA Sequence Number=SeqID_103175
  Gene Ontology: Mol. function=transferase activity, transferring glycosyl groups
  Homolog annotation: Hit_ID=UPI000068B15F; Match level="QueryCoverage =50%, HitCoverage=32%, E-value=2e-18, Identity=46%"; Hit description =Beta-1,3-N-acetylglucosaminyltransferase
MKLHEDTEFLFRLSYYLELYPGIIEQAIAMRGVHESNRITKVDSNKTKPAISRTILWNETYKWAKDEATISDDIKIHIKRMQRSFEIANAPKLKKWENYISQAVQSALQFEEVFEVILVEDKSPDNALVVCQRLVEEHDRVKLYQHPDKQNHGAGASRNLGIQNATGDFIAFLDADDYYLPNRFDAEKELFQNPDVR

SEQ ID NO: 219954 - protein, 279 aa, Glycine max
  Coding DNA Sequence Number=SeqID_103176
SINVAIVKEFYANLYVPEEKKPKQVRVRGHLIKFDADSLNTFLKTLVVLEEGESLPSYSRFCRLRPDPQELASRLCIPGRGFFLNAEGLPWKLLRKDLTTLAQTWTLIAALCKARGVTSNSLTFESLSPAINLAYIKKNCWNLDDPSIIFPRTQKSRARRSEAQSSSAAPAPPTSAFPSAPTDPILPDVVQQQLVMSIEEFLQKVAWLGVQPSPLGGGEASAAQELQSYQEDDSSEATPTPPEPFIFEDDPVTAEGTPTLDLTEEAMDQDPPPPQDQDH

SEQ ID NO: 219955 - protein, 246 aa, Glycine max
  Coding DNA Sequence Number=SeqID_103177
  Gene Ontology: Mol. function=transporter activity; Cellular component= membrane; Biological process=transport
  Homolog annotation: Hit_ID=Q56R06; Match level="QueryCoverage=93%, HitCoverage=43%, E-value=1e-117, Identity=87%"; Hit description =Putative permease I
MAYLVFLNGGWRLWLSSGAFIAVYRYASATPLPPSILSRGIGWQGVGILLSGLFGTGNGSSVSVENAGLLALTRVGSRRVVQISAGFMIFFSILGKFGAVFASIPPPIVAALYCLFFAYVGAGGLSFLQFCNLNSFRTIFVLGYSIFMGLSVSQYFNEYTAINGYGPVHTKARWFNDIINVPFQSKAFVAGCVAYFLDNTLHKKEAAIRKDRGKHWWDKYRSFKTDTRSEEFYSLPFNLNKYFPSV

SEQ ID NO: 219956 - protein, 139 aa, Glycine max
  Coding DNA Sequence Number=SeqID_103178
  Gene Ontology: Mol. function=catalytic activity; Biological process =trehalose biosynthetic process
  Homolog annotation: Hit_ID=Q2TSD5; Match level="QueryCoverage=100%, HitCoverage=28%, E-value=6e-22, Identity=64%"; Hit description =Trehalose 6-phosphate synthase
MDEALDIGSESPLTNALVISEFIACLPSLSGAIRVNPWDINAVADALNLAITMPSGEKQLRHEKHYRYGKTTLSEWFDQCETLGIAAEHGYYLKWSQQSAWEMNHISTGSSWKEIVEPVMRLYTEATNGSYIETKESAL

SEQ ID NO: 219957 - protein, 183 aa, Glycine max
  Coding DNA Sequence Number=SeqID_103179
  Homolog annotation: Hit_ID=Q19VG3; Match level="QueryCoverage=72%, HitCoverage=74%, E-value=3e-27, Identity=49%"; Hit description =Expressed protein
MPGPGPHLMYAMGSGLCLTSISNGRFGPHHTLFYTINAFFGPDVGSFTEWLGSLFGGSAHALGSSLEDLIHHPFFYILLLGLPLSFLYSRISSYLLHTQLLDSVSRVPLTRMQCFLLISAGSFTHFFLDHLFEIYWISPPRPAVGEEADLGVLVFLAIYFFLPYGLCIMSMSPKDHDPNQIPL

SEQ ID NO: 219958 - protein, 571 aa, Glycine max
  Coding DNA Sequence Number=SeqID_103180
  Gene Ontology: Mol. function=aldehyde dehydrogenase (NAD) activity; Cellular component=mitochondrion; Biological process=metabolic process
  Homolog annotation: Hit_ID=Q84V96; Match level="QueryCoverage=94%, HitCoverage=93%, E-value=0.0, Identity=85%"; Hit description =Aldehyde dehydrogenase 1 precursor
  Pfam annotation: Domain name=Aldedh; Domain location=69-561; Score =821.5; E_value=4.4e-244; Accession=PF00171.12; Description=Aldehyde dehydrogenase family
  Subcellular localization annotation: CTP_CleavageSite=44; ConfidenceScore=5.48e-01
MAARSLCRLLSRSLSSSNSSGAASLLHSLGRNPGGWRNINRFSTAAAVEELITPQVSIRYTQNLINGQFVDAASGKTFPTYDPRSGEVIANVAEGDVEDINRAVSAARKAFDEGPWPKMTAYERSRILLRFADLVEKHSDELAALETWNNGKTYEQAAKTELPMFVRLFHYYAGWADKIHGLTVPADGDYHVQTLHEPIGVAGQIIPWNFPLVMFAWKVGPALACGNTIVLKTAEQTPLTALFVAKLFHEAGLPDGVLNVVSGYGPTAGAALASHMDVDKCIIFASMIGPDPMWLACFCIKEQVGWQSVKLAFTGSTDTGKVVLELAARSNLKPVTLELGGKSPFIICEDADVDKAVELAHFALFFNQGQCCCAGSRTFVHERVYDEFLEKSKKRALRRVVGDPFKKGVEQGPQIDVEQFEKVLRYIRSGIESHATLECGGDRLGSKGFFVQPTVFSNVQDDMLIAQDEIFGPVQSILKFKDIDEVIRRANKTRYGLAAGVFTKNVSTANTLMRALRAGTVWINCFDVFDAAIPFGGYKMSGIGREKGIYSLHNYLQVKAVVSPVKNPAWL

SEQ ID NO: 219959 - protein, 73 aa, Glycine max
  Coding DNA Sequence Number=SeqID_103181
  Homolog annotation: Hit_ID=O81903; Match level="QueryCoverage=75%, HitCoverage=4%, E-value=5e-09, Identity=48%"; Hit description =Putative transposable element
MYLEHTKHIYIRLDCIRDVVEYGSMKVVKIHTSDNPTDMINKLIPLVKFKFCLDILNVKSVGVDEGAEQVGGN

SEQ ID NO: 219960 - protein, 220 aa, Glycine max
  Coding DNA Sequence Number=SeqID_103182
  Gene Ontology: Mol. function=RNA-directed DNA polymerase activity; Biological process=RNA-dependent DNA replication
MAETCMAGLSLDEDKEDLVVLVDTAEGEGNNTFLCVVGRFLTYKPIRVKIMKERMTEILHPLKGVSIKEVEQGLFLYQFFHKFYDFCGRANYWQIPGRISPICRQEQFEFLDKKIRRPGGEAKEVAFKYERLGHFCYLCGMLGHIDDYCELLFSMKEDNGEQRWGPELRAEPRNVVASSGSKWLRREGAVWKTPTNAPQSVTGNQSMGINGDIISDQKTE

SEQ ID NO: 219961 - protein, 76 aa, Glycine max
  Coding DNA Sequence Number=SeqID_103183
LLLQEEGVGWIEKPKEGENATKATEEKPISPLELMMMLKVDKLMRMHKEGYGELNECFETISKRVDDMGASRADDL

SEQ ID NO: 219962 - protein, 234 aa, Glycine max
  Coding DNA Sequence Number=SeqID_103184
  Gene Ontology: Mol. function=transition metal ion binding; Cellular component=nucleus; Biological process=cytoskeleton organization and biogenesis
MGIRAQFHPRSDDKKIYLPPACHTLSRWEKMSFCQCLRRVKVPHGYSSNIKSLVQLKDIKLVGLKSHNCHVLMQQLLVVAIRDIFPNKVRHAITRLCFFFNAICSKVLDPIKLDKLENEAAIILCQLEMYFPLCVLRHHGSLNCSYVRHKGLMKESNPKISKNRVLKEHNKTFLNWFKDTIFGDDNAFVTLRKLADGPKRNVITWKGYGINKYSFYTKAQDDKITMQNSGGGIL

SEQ ID NO: 219963 - protein, 83 aa, Glycine max
  Coding DNA Sequence Number=SeqID_103185
MSGFTRDSPQISASPHQLDLAPYASKPYNAQWNAQGLLRDKHTLRSSRILGEMEVDEPWLGLWLPLNYQVVFVIGSAVDRLSG

SEQ ID NO: 219964 - protein, 148 aa, Glycine max
  Coding DNA Sequence Number=SeqID_103186
  Gene Ontology: Mol. function=transporter activity; Cellular component= membrane; Biological process=transport
  Homolog annotation: Hit_ID=Q9FM07; Match level="QueryCoverage=100%, HitCoverage=31%, E-value=1e-57, Identity=65%"; Hit description =Permease 1
  Subcellular localization annotation: CTP_CleavageSite=35; ConfidenceScore=5.17e-01
MRATQGALIVASTLQIVLGFSGLWRNVARFLSPLSAVPLVSLVGFGLYELGFPGFVPHVLHAGKHVFDRFAVLFTIAIVWLYAYLLTVGGAYNHAAPKTQSTCRTDRAGLIESAPWIRVPYPFQWGAPTFDAGEAFAMMMASFVALVE

SEQ ID NO: 219965 - protein, 121 aa, Glycine max
  Coding DNA Sequence Number=SeqID_103187
MWSDMHEDAFMIKSESEGHIFSSLWVLHYLYMLLMNFKCGKRINWSHPSKVPRLRLHSRKKNHRLNLSYVDPDRTRTKYHKNTVDNFLLKKTPINIVHRAFLIYFYIGNACILIPKGQRCE

SEQ ID NO: 219966 - protein, 177 aa, Glycine max
  Coding DNA Sequence Number=SeqID_103188
  Gene Ontology: Mol. function=nucleotide binding; Cellular component =intracellular; Biological process=small GTPase mediated signal transduction
  Homolog annotation: Hit_ID=O82481; Match level="QueryCoverage=93%, HitCoverage=77%, E-value=3e-87, Identity=92%"; Hit description=Rac -like GTP-binding protein ARAC10
  Pfam annotation: Domain name=Miro; Domain location=10-123; Score =50.1; E_value=7.2e-12; Accession=PF08477.3; Description=Miro-like protein
  Pfam annotation: Domain name=Ras; Domain location=10-175; Score =207.9; E_value=2.3e-59; Accession=PF00071.12; Description=Ras family
  Pfam module annotation: Pfam domain module=Miro::Ras; Domain location= 10-123::10-175
MAATASRFIKCVTVGDGAVGKTCMLICYTSNKFPTDYIPTVFDNFSANVVVENTTVNLGLWDTAGQEDYNRLRPLSYRGADVFVLAFSLVSHASYENVLKKWVPELQHFAPGVPVVLVGTKLDLREDKHYLADHPGLAPVTSEQGEELRKLVGATYYIECSSKTQQKHCSTLSPVHY

SEQ ID NO: 219967 - protein, 1427 aa, Glycine max
  Coding DNA Sequence Number=SeqID_103189
  Gene Ontology: Mol. function=DNA binding; Cellular component=nucleus; Biological process=transcription
  Homolog annotation: Hit_ID=Q53J12; Match level="QueryCoverage=99%, HitCoverage=88%, E-value=1e-158, Identity=44%"; Hit description=BAH domain-containing protein, putative
  Pfam annotation: Domain name=TFIIS; Domain location=153-234; Score =37.7; E_value=3.9e-08; Accession=PF08711.1; Description =Transcription factor S-II (TFIIS)
  Subcellular localization annotation: CTP_CleavageSite=27; ConfidenceScore=5.74e-01
MQPGGRSPKPVSSPTSTSQLKSGSDSVQNSVSSFSSHVKGRKRERVDKGQESVKRDRSTKIDDGDSGHFKQDSILKTEIAKVTEKGGLIDTEGVEKLVQLMVPDGNEKKIDLASRSMLAAVIAATDKFDCLSRFVQLKGLPIFDEWLQEAHKGKIGDGLGSRDGDKSVDDFLFVLLRALDKLPVNLQALQACNIGKSVNHLRTHKNLEIQKKARGLVDTWKKRVEAEMIINDARSGSVQTVPWPARQRLSEVAQGGNKHSSGSADVAMKSSVTQLSASKTASAKIVPGENTRSTSASPGSTKSVPSPAPATANLKDGQPCVATASGSFDLPVANARDEKSSSSSPSHNSQSYSSDHVKAGGLSGKEDARSSTAMSVNKVSGGSSRHRKSMKGFPGSTPSRRQRETGSRQNSSHKNLISEKISQSGLREKANDGTTLEGHTPKLIVKIQNRSRSPAQSATAGSSDDPAIMNSRASSPVLSEKHDQFDRCSKEKSDFYRANIGADIYTESWQSNDFKDVLTGSDEGDGSPEAITDEQCRTGEDCKKVLDVSKAASSSSGNESRARNLQDASYSSINALIEGVKYTEADDVGMNLLANVAAGEISKSELGMPVGSPEKDTTTIEQSYAGDAAVVKSSEEYLVQDKCYTNVEHSKQDSRPGDLGADDDILASEGKATGEHNTSSMDLWVTETSLESKGKLIEKSSGTSSAGIPESTIQEVRDSDSSKLVKEKKVVVRVDAVGNVDVKVNVVASESETEAIENFSCTCEVVDVKCDNRASEGLSGDKETAGKSPAIRMSSDYVIATDENAPQSSGDIVDKVLEHVNERESEKNDDMVAQDHAKESIKQKNESENDAIMVPKNRGLCSGATGLDAEYVEENSGTKEVCDQVAGAGQIVHTDLPSFPSREMDQCSGHKDSKLTAMESEEAEECTSTTGDTSSASVAGVSEVDTKVEFDLNEGFNADDGKCSEMPGSTPAARLVSPVPFSASSMSFGILSITVAAAAKSPFVAPEDLLKSKKELGWKGSAATSAFRPAEPRKVMEIPLDMSTTPIPNDEARKQSRAPLDFDLNVSDEVILDDVSSQNCARQTDCGTHSDNGHDPNKSMASHVSCSGGLGLDLNLVDGASDVGNCTLSSSHKMDVPLMQVKSAASGPPNGEMSFRRDFDLNDGPVVDEVTSEPLMSTQPARNSVPSQPPISGLRMSNAEVGNFSSWFPSTANTYSAVTISSIMSDRGDRSFSIVAPNGPQRMLGPATGSNPFGPDIYKGAVLSSSPAVPYQSAPFQYPVFPFNSSFPLPSASFSGGSTPYVDTTSGGRLCFPAVNSQLIGSVGNVSVHYPRPYVVSLPDGSNSSSAENCRRRTRQGLDLNAGPGSNLEGRDDSSPLVPRQLSVASSQAQLEEQARIFHLSSDVLKRKEPDGGWDGYKQTSWQYHNL

SEQ ID NO: 219968 - protein, 561 aa, Glycine max
  Coding DNA Sequence Number=SeqID_103190
  Gene Ontology: Mol. function=serine-type endopeptidase activity; Cellular component=chloroplast thylakoid membrane; Biological process=proteolysis
  Homolog annotation: Hit_ID=Q6Z806; Match level="QueryCoverage=99%, HitCoverage=98%, E-value=0.0, Identity=72%"; Hit description =Putative DegP2 protease
  Pfam annotation: Domain name=Trypsin; Domain location=110-291; Score =53.4; E_value=7.8e-13; Accession=PF00089.16; Description=Trypsin
MGDNKRKRGRKPKTPATETLDHPATSPSSTAMDDVFSVGNVELIDTTASPHHRRLRGRPNKPHALPPGRRHARPLDTNGGGDFSVPGDVVGVSPAVSTEADPAAWEARVLPAMDSVVKRKRQYSSSSSGFVIGGRRVLTNAHSVEHYTQVKLKKRGSDTKYLATVLAIGTECDIAMLTVDDDEFWQGMSPVEFGELPTLQDAVTVVGYPIGGDTISVTSGVVSRIEILSYVHGSTELLGLQIDAAINSGNSGGPAFNDKGNCVGIAFQSLKHEDAENIGYVIPTPVIMHFIQDYEKNGGYTGFPILGVEWQKMENPDLRMATGMKPDQKGVRIRRIDPTAPESKVLKPSDVILSFDGVDIANDGTVPFRHGERIGFSYLISQKYTGDNAAIKVLRNSDILKFDIKLDSHRRLIPAHSKGKPPSYYIIAGFVFTTVSVPYLRSEYGKDYEYEAPVKLLDKLLHSMPQSPDEQLVVVSQVLVADINIGYEDFVNTQVLAFNGQPVKNLKSLATMVESCNDEYLKFDLDYDQIVVLRTKTAKAATLDILSTHCIPSAMSDDLKS

SEQ ID NO: 219969 - protein, 120 aa, Glycine max
  Coding DNA Sequence Number=SeqID_103191
  Gene Ontology: Mol. function=carboxypeptidase activity; Cellular component=membrane
  Homolog annotation: Hit_ID=Q8L9I2; Match level="QueryCoverage=81%, HitCoverage=30%, E-value=2e-14, Identity=43%"; Hit description =Nodulin MtN21-like protein
  Subcellular localization annotation: CTP_CleavageSite=31; ConfidenceScore=5.02e-01
MGVRSNLVEWSPFIAMVTVECLNVGLSTLSKAAMSRGVNHFVLVVYSNNKAIPFFLASLQVLPPRHSRICSITVMQNCVFIGINYSSPTLGSTMSNLSPAITFVLAVTLRTAAQQDTEKC

SEQ ID NO: 219970 - protein, 134 aa, Glycine max
  Coding DNA Sequence Number=SeqID_103192
  Subcellular localization annotation: CTP_CleavageSite=100; ConfidenceScore=5.24e-01
MEKLNIGSSISQIKVMGTVLSIAGALLVTLYKGSPIISFRTQPSPSQPLPSLLAATSNWVIGGLFFATAAFSTVVFLGETLHVGSVIGAVVIAIGFYTVLWAQSKEENAKGLQVDRLSSPSAQASPLLETVPRK

SEQ ID NO: 219971 - protein, 160 aa, Glycine max
  Coding DNA Sequence Number=SeqID_103193
  Gene Ontology: Mol. function=small conjugating protein ligase activity; Cellular component=cytoplasm; Biological process=protein modification process
  Homolog annotation: Hit_ID=P42748; Match level="QueryCoverage=99%, HitCoverage=66%, E-value=7e-42, Identity=55%"; Hit description =Ubiquitin-conjugating enzyme E2-21 kDa 1
  Pfam annotation: Domain name=UQ_con; Domain location=1-159; Score =77.8; E_value=3.5e-20; Accession=PF00179.16; Description=Ubiquitin -conjugating enzyme
MSDYAVETINDGLNEFNVEFHGPKESLYEGGVWKIRVELPDAYPYKSPSIGFVNKIFHPNVDELEMIFLRSIKSQKQLAIGWCFVCTWIMTDSALYGSSTADLALYAWMSLTNLGVQYLLNVFEVFLPQLLLYPNASDPLNGDAASLMMKDKKLYDQKVK

SEQ ID NO: 219972 - protein, 319 aa, Glycine max
  Coding DNA Sequence Number=SeqID_103194
  Gene Ontology: Mol. function=metal ion binding; Cellular component =integral to membrane; Biological process=ubiquitin cycle
  Homolog annotation: Hit_ID=Q8GW38; Match level="QueryCoverage=80%, HitCoverage=72%, E-value=5e-54, Identity=47%"; Hit description=RING -H2 finger protein ATL1D
  Pfam annotation: Domain name=PHD; Domain location=137-179; Score=0.7; E_value=0.049; Accession=PF00628.19; Description=PHD-finger
  Pfam annotation: Domain name=zf-C3HC4; Domain location=135-176; Score= 34.2; E_value=4.4e-07; Accession=PF00097.15; Description=Zinc finger, C3HC4 type (RING finger)
  Pfam module annotation: Pfam domain module=PHD::zf-C3HC4; Domain location=137-179::135-176
  Subcellular localization annotation: CTP_CleavageSite=30; ConfidenceScore=5.14e-01
MRSINGNLKYSSYYPQSPNDVNMSSSNNKEATTASSLSRISPLILLVIIVLAVIFFVYGLVHLILWFFMKRPLSPSSLYNSNRFHEYSTRSRVLLQRQLQQLFRLHDSGLDQAVIDALPVFCYQDLLGSKEPFDCAVCLCEFSEDDKLRLLPMCTHAFHMNCLDTWLLSNSTCPLCRASLSEYMENQNPMFNVGNSSSLVLPNRFRVEEENNGCSDSQRVFSVRLGKFRNGEVGGDGGCSLSERRCYSMGSYRYVVRDLNLQVVLSHSQSQDDDDDVLENGNVEGKRIGDSTKGESFSVSKIWLWSKKTRFHGSNAPFP

SEQ ID NO: 219973 - protein, 1120 aa, Glycine max
  Coding DNA Sequence Number=SeqID_103195
  Gene Ontology: Mol. function=RNA-directed RNA polymerase activity; Cellular component=nuclear RNA-directed RNA polymerase complex; Biological process=electron transport
  Homolog annotation: Hit_ID=Q647I4; Match level="QueryCoverage=98%, HitCoverage=98%, E-value=0.0, Identity=60%"; Hit description =Putative RNA-dependent RNA polymerase RdRP2
  Pfam annotation: Domain name=RRM_1; Domain location=12-88; Score =15.1; E_value=0.0058; Accession=PF00076.12; Description=RNA recognition motif. (a.k.a. RRM, R
  Pfam annotation: Domain name=RdRP; Domain location=532-921; Score =645.7; E_value=3.7e-191; Accession=PF05183.3; Description=RNA dependent RNA polymerase
  Pfam module annotation: Pfam domain module=RRM_1::RdRP; Domain location=12-88::532-921
  Subcellular localization annotation: CTP_CleavageSite=69; ConfidenceScore=5.12e-01
MGTTTTPLSHTVRVSNIPQSATAKDLLDFLESTLGSSTVFALEIFSDNPNWKSRGFGRVQFETLDARSRALSLSQLNQLLFNRHFLRLSETDSDIIFRPQHRLQNGVLYAGFMLSDHRMSVLESWEGIAGWVLPQRKRLDFWVWHNGDCYRLEFLFEDILESHGYCLGEDARLNALLLKMKFGPRIYKKKTGTDVAANFRGDRYRFLKEDFEFLWVRTTDFSPLKSIGHSTSFCWEIVEEHLASDVFTSFPLYKENLRDLALEDREELCSLTEAVPLVKHATQSKLPYEAVFQLNSLVHTQKISLASVDDELIDLLADLDEETRAVVFQKLHKMSFTCYEPLKFVKTQLHVLSNKKKGLLQSPQNRLTDSNIMSCHRALITPTKIYCLGPELETSNHVVKHFASLASDFMRITFVEENWNKLPTNAVSTGVQKGIFSKPLKTEIYKRILTILRDGIVIGSKRFEFLAFSASQLRSNSVWLFASNDNLKAADIREWMGCFNNIRSVSKCAARMGQLFSSSMQTFEVASEDVEMIPDIEVTSDGVSYCFSDGIGKISQCFARQVAQKLNLDHTPSAFQIRYGGFKGVIAIDRHSFRKLSLRSSMLKFESNNRMLCVTKWSESMPCFLNREIISLLTTLGVKDEVLLAMQQDQLDLLGRMLTDSKAALDVLESLNGADSKSILVKMLHEFNEPNSEPYLSMMLKAYYAYQLSDLKSRCRIFVPKGRVLVGCLDETGLLNYGQVFVRITVAKTRENFGDENLRKVDGDDSTRIIVGKVVVTKNPCLHPGDIRVLDAIYSKELEENGLRDCLVFPQKGHRPHPNECSGGDLDGDLFFLSWDKDLIPCQTEAPMDYTGRRPRIMDHKVTLEEIQQFFVDYMINDTLGAISTAHLVHADREQDKAKSRKCLELAELHSMAVDFAKTGAPAAMPRVLKPREFPDFMERVDKPMYISKGVLGKLYHAIIESQMQIRYSFVWSEKHAEEAYDRSLEVNGFEAFLETASTHKEMYAEKMSSLMDFYGAETEDEMLLGNVQNRASYLQRDNRRYGDMKDRILLSVKNLQREAKEWFETSCQPREYKPMASAWYHVTYHRSHYCQESPCFLSFPWIVGDILLQIRSVNSFVNR

SEQ ID NO: 219974 - protein, 96 aa, Glycine max
  Coding DNA Sequence Number=SeqID_103196
MLEGEVRECDDPYGFRNDVVIKCHYMMTVPSDSNCCTKLLPRITLVLICNNGKMWNPEKKPEIVISDPLDMTVSLEWYDNAVNVSRKKGVRKNKLT

SEQ ID NO: 219975 - protein, 222 aa, Glycine max
  Coding DNA Sequence Number=SeqID_103197
  Gene Ontology: Mol. function=ribonuclease III activity; Cellular component=intracellular; Biological process=RNA processing
  Homolog annotation: Hit_ID=Q1XG54; Match level="QueryCoverage=53%, HitCoverage=61%, E-value=1e-16, Identity=35%"; Hit description =Similarity to ribonuclease III
  Pfam annotation: Domain name=Ribonuclease_3; Domain location=111-198; Score=12.3; E_value=0.0005; Accession=PF00636.16; Description=RNase3 domain
MTMSSNLDGGGSVGGDPLEEEEVGPGDGDSRKTVSQSFLVMEFKIIKIFMTNPPTHGHATTPTSKLRLKPLSSPFSTALETLQKQLGYTFKSIDLLRRAMTHASFSEENNKAFAILGASVIETSVSFHLLSRDVDLSSKELNRRLSQITNVDSSCAVDGTRLGLHKVVRVSPKTNSSAPAVVCGAFRAIFGAVAIDTGKSDDAGNVFWNLHGGGDLGVAVAL

SEQ ID NO: 219976 - protein, 131 aa, Glycine max
  Coding DNA Sequence Number=SeqID_103198
MGGRKPYLFSRFYPSTTRVCQGSEKSQHKSWIQESPVVAILAMYDTFDRGCEKSDARIVCCALALYVWLVSHLFLQQGRPVYPLQRHRSRVKQGKANWDQLLASMEGRLLIGSLARRKEESGFYLHAKDVP

SEQ ID NO: 219977 - protein, 58 aa, Glycine max
  Coding DNA Sequence Number=SeqID_103199
MSEQFSPLVAIAQNPGKIRDDALVDFCGKLLHHFLACLHIILKYKCGYFFRKKSCNEK

SEQ ID NO: 219978 - protein, 74 aa, Glycine max
  Coding DNA Sequence Number=SeqID_103200
MTSRRMCLQSVKLGLGHALKNVALEFTKLVLHECKTTTNMIEQFATLAAIAQNPGKIRDDDVLADFCGKLLHHF

SEQ ID NO: 219979 - protein, 51 aa, Glycine max
  Coding DNA Sequence Number=SeqID_103201
MGNVLSIDTEELGFLVEAIEREGEEFGDVGQKKFTVQFGAIKLTNLRGNLL

SEQ ID NO: 219980 - protein, 85 aa, Glycine max
  Coding DNA Sequence Number=SeqID_103202
  Gene Ontology: Mol. function=ribonuclease H activity; Biological process=RNA-dependent DNA replication
  Homolog annotation: Hit_ID=Q1RYI2; Match level="QueryCoverage=94%, HitCoverage=12%, E-value=3e-21, Identity=55%"; Hit description =Ribonuclease H
MDKVHQRLSAWKSRTLYFEGRVTPAKFVLQPLPTYIMQTTWLPKSMCDDIDKTCRKFIWGDTENSKKFHLVSWGTVCTPKAKGEL

SEQ ID NO: 219981 - protein, 116 aa, Glycine max
  Coding DNA Sequence Number=SeqID_103203
  Gene Ontology: Mol. function=DNA binding; Biological process=DNA integration
  Homolog annotation: Hit_ID=Q1SIT1; Match level="QueryCoverage=76%, HitCoverage=30%, E-value=1e-15, Identity=45%"; Hit description =Integrase, catalytic region
MKTCNFSMDQAGEERKLQLSDLDEICLEAYENAKFYKEKTKKFHDSMIIKKNIMVGLKVLLYNSRLGLMSVEIKSDSTNKSFKVNGHRLKPFLTNPSLVDVVDGSLLVGLLWRLDL

SEQ ID NO: 219982 - protein, 225 aa, Glycine max
  Coding DNA Sequence Number=SeqID_103204
  Gene Ontology: Mol. function=transporter activity; Cellular component= integral to membrane; Biological process=transport
  Homolog annotation: Hit_ID=Q6D5S3; Match level="QueryCoverage=96%, HitCoverage=50%, E-value=1e-104, Identity=87%"; Hit description =Putative hexuronate transporter
VDSRGSHIRQDNEPPAVKLPFFKALKTVSRNKRFYGIAIPAFMAEPAWGVLSFWVPLYLAKDLGMDLKQIAMFAWLPFLAADLGSAASGYLTRIYTRLFGFRQVNSVVASSVTGAFLMLSLALVAMTKDPYVAIALISIGGFGHQIISCMLSALVVEKFDKGQMATVNGMRGSFAWISSFLFSLVIGVTADKIGFNPLFVAMGFFDLIGAVFLIAFIAERRSATQ

SEQ ID NO: 219983 - protein, 342 aa, Glycine max
  Coding DNA Sequence Number=SeqID_103205
  Gene Ontology: Mol. function=hydrolase activity, hydrolyzing O -glycosyl compounds; Cellular component=endoplasmic reticulum; Biological process=carbohydrate metabolic process
  Homolog annotation: Hit_ID=Q3Z3W5; Match level="QueryCoverage=98%, HitCoverage=42%, E-value=1e-161, Identity=78%"; Hit description =Putative glucosidase
QAGFDVGRQAQAGIVKRLTHRFWLRHFVVVPVEHIALVIDGGIARRELEGVARNSVLFAQADEVHQLVLRVRRIGVVHGRAAVSQTPFGAEQRFAGQAYEGFGDIQHPLTDKQVVINIATLRLPAAIRLVIVIQLVTQIEPAGAEVIVEQAKADVVTPREGEGHMFVERIGGGGVVTHSIQITHLIAFAVALQIAGFFAQTVVAVVRHAALIVCHAVAVCVDLIGAGGAIAGQQLPVACGITVLPLQRQRLTHHHAQRVGANGQTTGFFLQRKAGQAKPGQAVARTPFPWNILFRCNAPGAVQTVVAVALDHHAEQTFFQHVQAQMVFAIDVKHHMVMIRMG

SEQ ID NO: 219984 - protein, 382 aa, Glycine max
  Coding DNA Sequence Number=SeqID_103206
  Gene Ontology: Mol. function=hydrolase activity; Cellular component =outer membrane; Biological process=lipid metabolic process
  Homolog annotation: Hit_ID=Q1XN58; Match level="QueryCoverage=90%, HitCoverage=44%, E-value=1e-52, Identity=35%"; Hit description =Patatin precursor
  Pfam annotation: Domain name=Patatin; Domain location=9-199; Score =107.3; E_value=4.3e-29; Accession=PF01734.12; Description=Patatin -like phospholipase
MTKDTKFGLALSGGGAKGFAHLGILKTIDSLGIKIDYITGTSMGGILGGLYAMGYNGEELKKMVYGMNWKRILSNKIPYNKVNISEKDEYNKYILEFPVNDGRPSLPGSFIEGQYMGEVLNTLTFPAKHINDFSKLPIPVQLTSSDIVNGGLVMQKKGSLALAIRSTLAIPAAFAPVYIDGKLLVDGGLDRNFPVKEVKDMGADYIIGGYTGFRLFTKDEIKNPMKMIYQTHAFHSVQDFNEQKKMSDIMVDFVTPLNDYTTKDFRKYKEIIKIGEAEAKRHLPEFIALANEQRRLGIIYEHKLVEEVKKPTIQFTYSEDNGTPITNPSEIETIKNLMGLKEGVYYDAKTVNAAIDKVFGIRQFGKRFNYEHFRKEIHTKHA

SEQ ID NO: 219985 - protein, 69 aa, Glycine max
  Coding DNA Sequence Number=SeqID_103207
MRSSLMVMVDRFWVRLLQGGPWRSGDCCERSWLKVARGPPNTRGTPPGTKIHASTLRVSPGIGARTSIP

SEQ ID NO: 219986 - protein, 274 aa, Glycine max
  Coding DNA Sequence Number=SeqID_103208
  Gene Ontology: Mol. function=phosphogluconate dehydrogenase (decarboxylating) activity; Biological process=pentose-phosphate shunt
  Homolog annotation: Hit_ID=O22111; Match level="QueryCoverage=49%, HitCoverage=26%, E-value=1e-50, Identity=75%"; Hit description=6 -phosphogluconate dehydrogenase
  Pfam annotation: Domain name=6PGD; Domain location=172-274; Score= -88.3; E_value=9.4e-11; Accession=PF00393.9; Description=6 -phosphogluconate dehydrogenase, C-terminal domain
MPTPPPMVFSHLHPRWPPLLLLQPLKPASHHQPMVLFHLLSCSHPSPPSLFIAYCDIVWHLFDGWVADACQLCDDTGWVTVVTFVCTFNWRFYSGATRSKNLTHAQQNPHERHKHHPAFHDSAFPKRKLGWEFLVVRKAFKYMEDILLKVVAQVPNSGPCVTYIGKCGSSKFMKMIHNGIEYANRQLIAEAYDVLKSVGKLSNKELQSVFLEWNKGELLSFLIKIIADIFGIKDDKGDGYLVDKVLDKTNMKGIGKWTVQQAAELSIVAPTIEA

SEQ ID NO: 219987 - protein, 245 aa, Glycine max
  Coding DNA Sequence Number=SeqID_103209
  Gene Ontology: Mol. function=acyltransferase activity; Cellular component=integral to membrane
  Homolog annotation: Hit_ID=Q1SWP9; Match level="QueryCoverage=82%, HitCoverage=45%, E-value=5e-64, Identity=56%"; Hit description =Chalcone and stilbene synthases, N-terminal
MGAAETSGNRDEFVIHEARVPILGDVIDADDGGIGVAVKLKHVLDEINDDDTSAVAHVTKIEAFDVVTELVLVDHHGREGRGRVEEARVDDEDSDVFKLVVGVGEEVVKGAKHDLLGLFPSGGLEGASRDGVHGLGDVGVFTKAEAEENLALEVKGGGEEVADEGGVVHELAKEDAKVLRGKVARVVQEIDEVGPEVLDVVAFHLGGLEENYGHEREKAICVTSSIVTLASCSFINGNGQKLTDG

SEQ ID NO: 219988 - protein, 76 aa, Glycine max
  Coding DNA Sequence Number=SeqID_103210
MAKGAEDEVSLCASMGSIAPSLTKGAEIDRAKKLLMYLRTSPDFRVSVTESIKDDVNLRVSTSSLAAIDKGCRRRR

SEQ ID NO: 219989 - protein, 284 aa, Glycine max
  Coding DNA Sequence Number=SeqID_103211
  Gene Ontology: Mol. function=calcium ion binding
  Homolog annotation: Hit_ID=O82659; Match level="QueryCoverage=42%, HitCoverage=79%, E-value=2e-43, Identity=68%"; Hit description =Centrin
  Pfam annotation: Domain name=efhand; Domain location=133-161; Score =28.8; E_value=1.9e-05; Accession=PF00036.22; Description=EF hand
  Pfam annotation: Domain name=efhand; Domain location=169-197; Score =27.7; E_value=4.1e-05; Accession=PF00036.22; Description=EF hand
  Pfam module annotation: Pfam domain module=efhand::efhand; Domain location=133-161::169-197
MQAGSPHMPTFFSTVEVEGVEFHGKGGRSKKQSEENATKIAYIALKEYELLDLDLNETSLANVKVSNEMHNPPFIQSPEEEMMINRSSSSCEPVFGSSPKSSPLSQIDVSWESKRYNNIPRGHHHLTTQKKQEIREAFELFNTDGSGTIDAKDLNVAMRALGFEMTEELINQMKADLDKDGSGAIDYEEFEYMMTTKIGERDSKEGKISASDIKCIAKEPGQNFTNRDIQEMVDEADQDTRVCRAVVKVASKIGSGRGIDLNKDAMVGIGEHGTKIFVLAMATL

SEQ ID NO: 219990 - protein, 208 aa, Glycine max
  Coding DNA Sequence Number=SeqID_103212
  Homolog annotation: Hit_ID=Q1S238; Match level="QueryCoverage=36%, HitCoverage=16%, E-value=2e-24, Identity=80%"; Hit description=IMP dehydrogenase/GMP reductase
MLDTVPIFVNPKSPFIYAVGEEASRQPRSDRRVRSGGDSNSAALVQRFVDAGTRGDGVAEPVSFGREQGAYNECGCGEVANIRAEKRDEDFEAERDLLAELARREKEAEIFPEAELDLFMKAVRIILTTDNDPLGQALAEELARRLGRERLYILSSSDHVKQSVCNAFTDMENPSPCKCLPDGSKRVRVPHLVNTKSEEGIVILEEAQ

SEQ ID NO: 219991 - protein, 111 aa, Glycine max
  Coding DNA Sequence Number=SeqID_103213
  Homolog annotation: Hit_ID=Q1RWA2; Match level="QueryCoverage=34%, HitCoverage=16%, E-value=5e-07, Identity=66%"; Hit description =Peptidase T1A, proteasome beta-subunit
MAVDMGGMIFNLVFAYFFALIFVLTLRYPYVTGSSVVAIKYKDGILMAADMGGQIFNLVGSRRLEKELLKFVGPSLYFGNFCCAWKVQDVESECNHNNDDGACEQFEYLVI

SEQ ID NO: 219992 - protein, 501 aa, Glycine max
  Coding DNA Sequence Number=SeqID_103214
  Gene Ontology: Mol. function=monooxygenase activity; Cellular component=membrane; Biological process=electron transport
  Homolog annotation: Hit_ID=Q1WCN7; Match level="QueryCoverage=95%, HitCoverage=95%, E-value=0.0, Identity=70%"; Hit description =Cytochrome P450 monooxygenase CYP83G2
  Pfam annotation: Domain name=p450; Domain location=33-496; Score =382.9; E_value=4.8e-112; Accession=PF00067.12; Description =Cytochrome P450
MDQNMLLFILLAFPILLLFFFRKHKTSKKQCLPPGPRGLPFIGNLYQFDSSTLCLKLYDLSKTYGPIFSLQLGSRPTLVISSPKLAKEVMNTHDLEFCGRPSLISSMKFSYNGLDMAFSPYRDYWRHTRKISIIHFLSLKRVLMFSSTRKYEVTQLVKKITEHASCSKVTNLHELLTCLTSAIVCRTALGRTYEGEGIETSMFHGLLKEAQDLISSTFYTDYIPFVGGVIDKLTGLMGRLENLFKVLDGFYQNVIDEHLDPERKKLTDEEDIIDALLQLKDDPSFSMDLTPAHIKPLMMNIILAGTDTSAAAVVWAMTALMKSPRVMKKAQEEIRNVFGEKDFIGEDDIQKLPYLKAVIKETMRMYPPLPLLIHRETIKKCSIEGYEIPEKTLVYVNAWAVHRDPETWKKPEEFYPERFLDSKIDFRGYDFEFIPFGTGRRICPGINMGIITVELVLANLLYSFDWEMPQGMERKDIDTDMLPGLVQHKKNPLCLVAKKRG

SEQ ID NO: 219993 - protein, 399 aa, Glycine max
  Coding DNA Sequence Number=SeqID_103215
  Gene Ontology: Mol. function=hydrolase activity, acting on ester bonds; Cellular component=cellular_component; Biological process =lipid metabolic process
  Homolog annotation: Hit_ID=Q7Y1X1; Match level="QueryCoverage=98%, HitCoverage=97%, E-value=1e-149, Identity=64%"; Hit description =Esterase precursor
  Pfam annotation: Domain name=Lipase_GDSL; Domain location=41-375; Score=331.7; E_value=1.2e-96; Accession=PF00657.12; Description=GDSL- like LipaseAcylhydrolase
MEFPNPAKLHNQHVSLFAILSIATIVPNPAFATKECVFPAIFNFGDSNSDTGGLAASLIAPTPPYGETYFHRPAGRFSDGRLVIDFIAKSFGLPYLSAYLDSLGTNFSHGANFATSASTIRLPTSIIPQGGFSPFYLDIQYTQFRDFKSRTQFIRHQGGVFASLMPKEEYFDKALYTFDIGQNDLGAGFFGNLTVQQVNATVPDIVNAFSKNIKFIILVIKDIYDLGARSFWIHNTGPIGCLPYILANFLSAERDAYGCAKTYNDIAQYFNHKLKEVVVQLRKDLPLAAITYVDIYSVKYSLFSHPKKYGFKLPLVACCGYGGEYNYSGSVGCGENIEGNGTEIFVGSCGRPSARVNWDGIHYTEAASKFIFDQISTGAFSETAIPLNMACHRSYTKSY

SEQ ID NO: 219994 - protein, 229 aa, Glycine max
  Coding DNA Sequence Number=SeqID_103216
  Homolog annotation: Hit_ID=Q1SXA1; Match level="QueryCoverage=37%, HitCoverage=24%, E-value=3e-08, Identity=35%"; Hit description=Zinc finger, SWIM-type
MLKFTAVQLVDDEDVRGSRTFANTEDQPHPYLSTLVVEPTSSTQPNGPEFAVESGLPNEELNPFNEDEDKVLYNQPQEEDHEEVELVSLITIVPPYYIPQHMQNFKESNFQDFEYGHSLDHEEVQHLVGTLFEVSALIAHIKSAKGYTTTYHKAWLAKQKVIDNIYDNWERSYHNLPRLLRLQTQERFGLLKISQSSWMKGGVTMATSKNYRGLVLMLLLLVRMLTMSI

SEQ ID NO: 219995 - protein, 286 aa, Glycine max
  Coding DNA Sequence Number=SeqID_103217
GNLGVAGSGVKGVVEPEGLMVVLLHENCNGGPSIYLPRIWPTPLLGEEIKATKPAPRSPFEFRKVFVHSATLLELEQGTLWVIVEGGWSLHVEGGHCEPLVVKNSLVIENWGGGVDMVDDLGEKGIVVTIVRCSSMESILEEREDYVWVKLACVWARQTINDITYSHHNKKKWSEETLGEIEKLKISEFSESSVLLGVNLDFVFGLFASDDKVFHGMGEREEEEEGLLVVEAMLFHLVIFLCLLLRQIGIRIGIGESSNDERRGLESGFGMTTTVTIVMTMAGMRG

SEQ ID NO: 219996 - protein, 119 aa, Glycine max
  Coding DNA Sequence Number=SeqID_103218
MNNTIQETVKDRNNFIVNDAIQLIAKQLTNFNVSIYITFNVNCFQQRKDLQAQLEDKFTIVSSGLATLKEHVHLYSVTSPRSVPVQAAKITLSPSDGSNHLDWIFKVERYFELTKTPSI

SEQ ID NO: 219997 - protein, 92 aa, Glycine max
  Coding DNA Sequence Number=SeqID_103219
MAQTSFAELAEMLAMITGVELEGMGMELAMEGETGVRRVRMSSSFRDMVCMVSPKRARTSARDLQHKDKGKGRRQLKRKTPPVPRYDHSAAI

SEQ ID NO: 219998 - protein, 66 aa, Glycine max
  Coding DNA Sequence Number=SeqID_103220
WEGNVQMRTSGVTAAPAVEGGMSHHNQAKDILEAGLTTPSSHVVVEVRIIPWRLQSHLVLKVVVLA

SEQ ID NO: 219999 - protein, 509 aa, Glycine max
  Coding DNA Sequence Number=SeqID_103221
  Gene Ontology: Mol. function=RNA-directed DNA polymerase activity; Cellular component=chromatin; Biological process=chromatin assembly or disassembly
  Pfam annotation: Domain name=RVP_2; Domain location=160-304; Score= -57.9; E_value=0.032; Accession=PF08284.2; Description=Retroviral aspartyl protease
  Pfam module annotation: Pfam domain module=RVP_2::Retrotrans_gag; Domain location=160-304::1-74
MTSNAQFTSWPTFLQALQTRFAPSQYDDPTGTLFKLTQKGTIAEYLSEFEDLANRIISLPPPFLLACFISGLSSEIHREVQAHQPLTLVQAADLARLQEEKLLDYRPPSRPRPPPLPLPPGHPPALPPLLPSPPQEDEPSWVNIEPGDPNPAPDPPDSPSQYQAQINLNSLSGYLALEALRLTGLIFGHHVTVLVDGGSTHNFVQPQVATQLGLPCRQAESPLRVMVGNDQYLECTNHCEDVSVVIQDTYFTLHLYILPISGANIVFSVQWLKTLGPVLTNYNTLAMQFFYQDCLVVLQGEHETQSGRLTHNQLRRICHHQSNTSYFHITMLTDPLSSPTNYNTLAMQFFYQDRLVVLQGEHETQSSRLTHNQLRRIFRHQSDTLYFHITMLTDPLSSLTNSDLPPEIQHLLHKFELLFHQPQTLPPARTTDHHIHLLPHSLSVNIRPYQYPHYQKQEIEAQVDSMLQKGLIQPSTRPFSSSVLLVHKSDGTWQFCVDYRSLNVVTIRD

SEQ ID NO: 220000 - protein, 539 aa, Glycine max
  Coding DNA Sequence Number=SeqID_103222
  Gene Ontology: Mol. function=RNA-directed DNA polymerase activity; Cellular component=chromatin; Biological process=chromatin assembly or disassembly
  Pfam annotation: Domain name=rve; Domain location=211-367; Score =83.3; E_value=7.6e-22; Accession=PF00665.16; Description=Integrase core domain
  Pfam annotation: Domain name=zf-H2C2; Domain location=152-193; Score =10.7; E_value=0.014; Accession=PF09337.1; Description=His(2)-Cys(2) zinc finger
  Pfam module annotation: Pfam domain module=rve::zf-H2C2; Domain location=211-367::152-193
MASSMIHQGSKKFPRTRRILQEIHSRAAFDNLKQALSIASVLALPDFTKPFIVETDASGVGMGAVLSQKGNPIAFFSKSFTSKLLGASTNVRELCAITIATKKWRIRVIPVHHPLSAILKLPGGTSSVVGQQPGVSHSTDIPIAPLLLAEYHTTPTRGHTDVTKTLAHISENFHWAGQREDVKRFVANCIDYQVTKYEAQKMAGLLCPLPMPHRPWEDLSLDFIVGLPPYQCNTTILVVVDRFSKGIHLGTLPTAHTAHMIASLFVNIVVKLHGILRSLVSDRDPLFISHFWQKLFRVSGTLLCMSSSYHPQSDGQTEVLNRVTKQYLRAFVHHRPSLWGKLLPWVGWSHNTSWNVDTGATPYEVTFGRKPFNFPEYIVGSSNIAAAIRNKLLKAQANMKRQADAKQREMQYEIGDWVLLKLRPYRQTLAKGAKVLTGKLAQRYYRPFQVIEHVGPVAYKLQLPEGVKIHHVFHCSKMKPFKGSPDSMAGIELPTDCLNDQPLVYPLAILDYRRASQKDPWEVLVEWNGLSPDDTSWES

SEQ ID NO: 220001 - protein, 142 aa, Glycine max
  Coding DNA Sequence Number=SeqID_103223
MDRCLMIWTACCGTCGYELNLSSSNRNTASIGSKYGKSIKRGIISFFSIDLSRFTQVDEIQCVPHFDKHSWGLFRRRTKLLCRKCGNHIGNAYNGYTSSFPLVSDGAESSPSSKVVSHTKYDIRICALQPSSSEESGIPVFA

SEQ ID NO: 220002 - protein, 312 aa, Glycine max
  Coding DNA Sequence Number=SeqID_103224
  Gene Ontology: Mol. function=nucleic acid binding; Biological process= DNA integration
  Homolog annotation: Hit_ID=Q1RSG2; Match level="QueryCoverage=47%, HitCoverage=12%, E-value=9e-20, Identity=42%"; Hit description =Integrase, catalytic region; Zinc finger, CCHC-type
MVLLREEIEQFLTWSEGITPKEAWPGNRPGVSHFRIFGSLSFRHVLEPTRRKLDDCAEQMVLLGYHPTGAYKLYDPRIRKVVINKDVMDETRCWNWETNTARSIEKTVVVNLKDDQHKESDVKVGNQPRRIRQGPDEPLREYLTKFNKEARLVGNLRPEVVQMLAKHNMKEGSPLYVSISKTLLATLEEFLKKAEKYINYENILEVGKMKAIKNKASQKKEIMPKLERSPRVDSRDQYRPRMEELDTPKSIRSEQGGRDLSKYCRLDIRVETKIDPFNDLKDLHNDKLRRDMLEGGPQTMLEEGMPRRYLPS

SEQ ID NO: 220003 - protein, 74 aa, Glycine max
  Coding DNA Sequence Number=SeqID_103225
MRIMKDYELRMPYRTELICDKLNLFSMRVPMFKDILLKLLEEGEDNKGGQEFKMMLKKWERDEMLSTLTPRLII

SEQ ID NO: 220004 - protein, 63 aa, Glycine max
  Coding DNA Sequence Number=SeqID_103226
MSVKNLVGRLGVHDKTNHTLASQVTLTSTSLKEHSNQVTPKANTPKSPLGPFPPDLGPTQKTF

SEQ ID NO: 220005 - protein, 130 aa, Glycine max
  Coding DNA Sequence Number=SeqID_103227
  Gene Ontology: Mol. function=transferase activity
  Homolog annotation: Hit_ID=Q1SPY9; Match level="QueryCoverage=97%, HitCoverage=17%, E-value=1e-37, Identity=60%"; Hit description =Ankyrin
MEQYIKDLVPYHFSFINNKKDETPREIFEQNHKGLMKESYEWIKETSNPCSVVAALIGSVCLATSSTAPGSTNKGKPKLEGQPAFDAFAIASLIGLSFSITTLTMFLAIPTSRKQVEDFRKSLSLKHFLA

SEQ ID NO: 220006 - protein, 90 aa, Glycine max
  Coding DNA Sequence Number=SeqID_103228
  Gene Ontology: Mol. function=protein serine/threonine kinase activity; Cellular component=nucleus; Biological process=protein amino acid phosphorylation
  Homolog annotation: Hit_ID=Q9SYP4; Match level="QueryCoverage=70%, HitCoverage=17%, E-value=6e-16, Identity=70%"; Hit description =Putative cdc2 kinase
ILTLWYRAPEVLLGATHYSTVNKWSVGCIFGKNMRIQGSSAEFVTKQPLFLGDFELRQLLRIFRCSFSYFFDSCFHFGPCCSSSQKIDLN

SEQ ID NO: 220007 - protein, 173 aa, Glycine max
  Coding DNA Sequence Number=SeqID_103229
  Gene Ontology: Mol. function=transferase activity
  Homolog annotation: Hit_ID=Q1SPZ0; Match level="QueryCoverage=67%, HitCoverage=24%, E-value=4e-24, Identity=50%"; Hit description =Ankyrin
MGVKEECSKVAADCSPGKKPKKEHDVNKKETAFLAAAKNGIIEIVFELQKAIPSTIHETNYNNENVLLVAVKNRQTEVIEVLQKNLEKELFDSLIFDVDNMEITVLHLAPSKRERTWQIAGAMQMMWDIKWYKRTTINIECQKNSEDNEIWNNYDLGLIHDRQPATESLEKNG

SEQ ID NO: 220008 - protein, 996 aa, Glycine max
  Coding DNA Sequence Number=SeqID_103230
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=92%, HitCoverage=90%, E-value=1e-122, Identity=46%"; Hit description =Chromo
  Pfam annotation: Domain name=Chromo; Domain location=910-964; Score =21.0; E_value=0.0033; Accession=PF00385.14; Description='chromo' (CHRromatin Organisation MOdifier
  Pfam annotation: Domain name=rve; Domain location=633-763; Score =43.4; E_value=7.5e-10; Accession=PF00665.16; Description=Integrase core domain
  Pfam annotation: Domain name=zf-H2C2; Domain location=574-615; Score =21.8; E_value=0.00046; Accession=PF09337.1; Description=His(2) -Cys(2) zinc finger
  Pfam module annotation: Pfam domain module=Chromo::RVT_1::rve::zf -H2C2; Domain location=910-964::230-520::633-763::574-615
MAHNPQCKGVRHSTRLRRENIRLKDYTFSNTSQPTGSPSNNGSLLVPPINASLPIKEISLGFPHFDGTTPVMEWIFKAKKFFTYYNTPDASRVDIVVMHFDKDSQFGPSPFDCPMAELFKLQQTDSVSDYYLKFMSLANRSLGLSPPLRSSNVKRITPVEMQLRREKGLCYFCDEKLSFNHRCPNRHFLLLQMKDDNEDPISTTVSQGAREDEIVEPKDHHLSFNALKGGRGVGTIKFIAYIEKLHVTVLIDGGSSDNFLQPRMAKFLKLPMEPTTQFRVMVGNDNYMSVEGLVKQLKTIGSHIADYDALQLKFLWKVYTLQLMEPNVVPKSMLDLPVKMEPKLALVLHTYKVVFDTPSSLPPQRSHDHSIPLLKGSQPVKVKPYRYLHGQKEEIERLVLGMLDEGIIQPSKSPFSSPIILVKKKYGSWKVCTDYRTLNAITIKDSFLIPTSLKNDIFARLLRKLVLVFFDDILVYNANWKDHLHHLEVVLSILKQHQLFARFSKCCFGVQQIDYLGHTLSGSGAAMEETKLEAIQKWPEPSNLKQLRGFLGLIGKIVLPHDVMLLHQIMEEFHSFKIGGHFGVNRTTTRIGAQFYWNGMRSDISKFVREGVICQQAKVDHVLPAGLLQPLPIPQQIWEDIAMDFIVQLPPSQGFTTIFMVVDRLSKFGYFIPIKSECNNTVMAKAFITNIVKIHGTTLAMSSSYHPQSDGQTKNFNKTLEMYLRCFVFEYPKSWVAMLPWAQFWYNTSFHQSLGMTPFQAVFGIPPPSVMHYEADPKDPGPLKDLLQLRDQLLIKLKGNLLKAQQYIKMQADKKRRDLQFKVSDLVLVKLQPYKQHSVALRKHQKLGMRYFGPFPVIERIGKIAYKVQLPESAKIHHVFHIALLKPFHGKSPPPYLPFPLTYSGLGPMLYPWKVLDVQVVKCLEVTVLQLLIQWEATEAKDATWEELQDIRESYLQFNLEDNVVFDGEGNVTCIKNEEVLASNSISSEGHVAHDP

SEQ ID NO: 220009 - protein, 50 aa, Glycine max
  Coding DNA Sequence Number=SeqID_103231
MGCSSRFDVCICGSCEGGVKGDEGWFCLSKEAVVVVVDMRVVETMVVVEE

SEQ ID NO: 220010 - protein, 168 aa, Glycine max
  Coding DNA Sequence Number=SeqID_103232
MVESGGWSMGVKMEMEVAYISMGIETSGTGGRTISEINFNSSKKMWVKVVSWKEQMFVWKGKDVCDRVVECRSYYVPINLFFECTVATKVWESCLKWYWGITMVRQRHPNKFNFFDLWGWWIVRRNTGSVPSKNSRLSPLPPEPYDCGATIDIPLDNAKVGWIMKSLK

SEQ ID NO: 220011 - protein, 77 aa, Glycine max
  Coding DNA Sequence Number=SeqID_103233
MPLTQVLFGGEPIQGESPDENGYKGWNMHVPKAFFNKIRSSSCCLNEILSKSTKNSFTKGNSHSSQALLHTRSSKIP

SEQ ID NO: 220012 - protein, 157 aa, Glycine max
  Coding DNA Sequence Number=SeqID_103234
FIGGLTRRISTNLCLFLLYQLNIFRFTFAFVNYTVIYKTKVERKDIELVDEEEAQIGADRSSATSNKSEIYKEEARNATQKHKPKRVESVNADAEAFAEALEHTMKRDTSHQSVSLENKTGDSTVLKIGNSAKVVIKQDMKGRRHKYGFNNNKREKA

SEQ ID NO: 220013 - protein, 47 aa, Glycine max
  Coding DNA Sequence Number=SeqID_103235
MEGIRDSVQECGHNHDNTLILHVNCWVFNVRIEKLQELHQIEEFYPD

SEQ ID NO: 220014 - protein, 285 aa, Glycine max
  Coding DNA Sequence Number=SeqID_103236
  Gene Ontology: Mol. function=transferase activity
  Homolog annotation: Hit_ID=Q1SPY9; Match level="QueryCoverage=97%, HitCoverage=40%, E-value=1e-96, Identity=63%"; Hit description =Ankyrin
MAAAKNGIVEIVFALQTAIPSAIHETNCNNENVLLVAVKNRQTEVVEELRKSLNKKLFVSLILVVDNKENTVLHLAAGTTSNSQMTWQIAGTAMQMMWHIKWYEDGETPWEIFEQKHKDLIKDSSEWLKETSNSCSVVAALIAGVSFATSSTVPGGTDQGKPTLEGQPAFDAFAIASLIGLSFSVTALIMFLAILTSRKQAEDFRKSLPLKLLFGLTSLFVSIASMLVSFCAAHFFVLKDKYKNILFPIYGATCLPVTFYAVIQFPLYVDLLKAIFKKVPQRAKR

SEQ ID NO: 220015 - protein, 238 aa, Glycine max
  Coding DNA Sequence Number=SeqID_103237
  Gene Ontology: Mol. function=transferase activity
  Homolog annotation: Hit_ID=Q1SPY9; Match level="QueryCoverage=87%, HitCoverage=28%, E-value=6e-48, Identity=50%"; Hit description =Ankyrin
  Pfam annotation: Domain name=Ank; Domain location=101-137; Score =22.1; E_value=0.0019; Accession=PF00023.20; Description=Ankyrin repeat
  Pfam annotation: Domain name=Ank; Domain location=138-172; Score=6.5; E_value=3.5; Accession=PF00023.20; Description=Ankyrin repeat
  Pfam annotation: Domain name=Ank; Domain location=56-86; Score=2.9; E_ value=12; Accession=PF00023.20; Description=Ankyrin repeat
  Pfam module annotation: Pfam domain module=Ank::Ank::Ank; Domain location=101-137::138-172::56-86
MTTTESTATIIEGTEVDNVNRDSLFRRCVLQGAWEEYVIPAYKNNSDFHKIKINESRGTALHVAVNDGRMELVNKLVGAILEHEGREVVSDESALKSTNERGDTPLHLAASRGFIDMCKCIIGKHGERKELIKVKNNKGETPLFRAVATYHKKTFVYLYHASKDLDVSLTNNEGDTILHRAIWGELFDLAIIITHCYPGRLVDTRNKDGATPLKVLASKPSAFKSGRSLPWWKQILYY

SEQ ID NO: 220016 - protein, 78 aa, Glycine max
  Coding DNA Sequence Number=SeqID_103238
MSNNEDYIAEYSNDDESRLKPRQRGNYFHSKYYRRISLAPNKTFKIQAERGPPLESSSSTTAVTSPDQTCDQEKGSQT

SEQ ID NO: 220017 - protein, 127 aa, Glycine max
  Coding DNA Sequence Number=SeqID_103239
  Gene Ontology: Mol. function=zinc ion binding; Cellular component =integral to membrane
  Homolog annotation: Hit_ID=A0FK64; Match level="QueryCoverage=89%, HitCoverage=44%, E-value=1e-36, Identity=64%"; Hit description=PHD4
MASKPGTVEEIFKDYSARRIAIIRALTHDVDKLYGLCDPGKENLCLYGHPNKAWEVTLPSEEVPPELPEPTLGINFARDDVSRRDWISLVAVHSDSWLLSLAFYLGIRLNHNERYYLNYFDGDAYIL

SEQ ID NO: 220018 - protein, 344 aa, Glycine max
  Coding DNA Sequence Number=SeqID_103240
  Homolog annotation: Hit_ID=Q58IU5; Match level="QueryCoverage=32%, HitCoverage=21%, E-value=6e-20, Identity=49%"; Hit description=Non -intrinsic ABC protein
MASACVMNATRATACRDNMVVAHLKVMLIFVVFVTSMAGMSSLAILVEIFRGKPLYDKAIIVINYFEAEVILSTSPVLSLPSATDVEPTVVAKPIGVKRSRSRSEKPSLQSPDDVNLELLCYFDKLTVPLNKQKHLANIAVDVVLDNVSIATTHRKTLEKDDVIFCSIFEAIKKLLKEQNEESGHFRQSIASRVLHQGSAEIPNKSFSLPWQVITFQLQYGVLEAKFRLHSGGDVSSTSRNLEITLKPRILLKAEIFGAFLPWLSVLEGSLSAIFTLSANSLPDSSNPLSEQSASLSGCYSLSAYASLSETPIISILEVVAGISLIIFRGMERPASHEESFSNW

SEQ ID NO: 220019 - protein, 97 aa, Glycine max
  Coding DNA Sequence Number=SeqID_103241
MVNAKDLWAMRYMVQLILFFIMQIPKNSTQQSASGEISAQLDSHACKILVGVVVVIADLYIVLWGKAKEFAENKPEVAPQSSNLQDDHDISSRIDLE

SEQ ID NO: 220020 - protein, 464 aa, Glycine max
  Coding DNA Sequence Number=SeqID_103242
  Homolog annotation: Hit_ID=Q10I34; Match level="QueryCoverage=55%, HitCoverage=64%, E-value=2e-16, Identity=27%"; Hit description =Expressed protein
MDESLLSMKEVREDFMVSPIGDSEPVLRSAYFLKPLAKSLDGPVSEVLSSSMTMPLPPVFEPKDWPLVIHFNWRCHTKKKCVEWVDSLQLRYESMWKKIGIFEAVMSTKCNDHVGGCDGVGGYPVVGDPVLAPLQSQEMREVKNKLILAREQPWRRTKAKASLSAWMDVLINSGSEVEHEAFLATWLSMIGFSSIGLVSTLVFPIAVHLGRGNPIALGPAVLASLYKDLTLLKNTVVGMTEQLVLGYKLELEVTLQSPFYLVQIWVWERFKNLQPQPRLNNHEDPMMFRCHKVKALKIDNVRLALDSAMKKYAGKFKVSKANKNGNDADVPPGSPPKLGTTVCLGKSGDDDSNARKCKNDVDVPSGFLFKSLKTVHSRNSAQDDYENVKRISPLTKLVAKDTVEPLMGGLEEDFEDTNRSKDSRLSSDRVSLSGTQGESYTFASGINVMDLEQIIYRLETVIKN

SEQ ID NO: 220021 - protein, 279 aa, Glycine max
  Coding DNA Sequence Number=SeqID_103243
  Homolog annotation: Hit_ID=Q2R2L5; Match level="QueryCoverage=26%, HitCoverage=11%, E-value=5e-21, Identity=55%"; Hit description=AMP -binding enzyme family protein, expressed
MAGEDDVYFSFLPIAHVYGQIMETYCISKGSSIGSWQGDVRFLLEDIQELKPTIFCGFPRVFDSIYVDVTHLESGEDPCPSIATDWLEVTKYVGLVCAQPHREELIQDLFKCWKDPHHGIVYGGVIRRECLVCAIIMCKILVYGYQPLQPPAAPPAPPPTLQTADSYFWIISLIDSDIHKRKKPSSSYMDNAVKAACTKPSKPQNIVEVYALVSGLLREETNRIQDVEGSFIEYVEGLTYELSSSYVCLESWTSSSMYSVKFPIIKTSPEHSLVELVIA

SEQ ID NO: 220022 - protein, 90 aa, Glycine max
  Coding DNA Sequence Number=SeqID_103244
  Homolog annotation: Hit_ID=Q6Z841; Match level="QueryCoverage=41%, HitCoverage=24%, E-value=3e-08, Identity=63%"; Hit description =Pollen Ole e 1 allergen and extensin family protein-like
MEKQKTLMSLILLLLLFTSDVSAWTGEIHGRVVCDVCGDSSLGPEDHILEALSFFANCSTWLKTLCMYVSMAWLLSARPGGTWDGTRKMF

SEQ ID NO: 220023 - protein, 123 aa, Glycine max
  Coding DNA Sequence Number=SeqID_103245
  Gene Ontology: Mol. function=nucleic acid binding
  Homolog annotation: Hit_ID=Q1SU57; Match level="QueryCoverage=62%, HitCoverage=38%, E-value=3e-24, Identity=60%"; Hit description=Zinc finger, CCHC-type
  Pfam annotation: Domain name=zf-CCHC; Domain location=60-77; Score =11.2; E_value=0.014; Accession=PF00098.13; Description=Zinc knuckle
MLLTIASAIGAPIKVDQNTLNMNRGRFARVCVQINLNVPIEGKFNLNGSWYKVEYEGPHVLCVACRCYGHVARACPTIPLSQWVVDNQGTQIKQGAGVTPNPNHNTEKVSPPATEFHEVATHG

SEQ ID NO: 220024 - protein, 108 aa, Glycine max
  Coding DNA Sequence Number=SeqID_103246
MKTTQVGISLTAQGDSMCDNNIVTLPMTMHAPHGNSDVSGQEIMNVDPRAKPNVASITSMESSQVPDGAPLHDGAVNAKGRRRIKELVRHLVEASGHVAGHELKCIAV

SEQ ID NO: 220025 - protein, 77 aa, Glycine max
  Coding DNA Sequence Number=SeqID_103247
MQHSAASSMRSLSTQNLPLWNPFYDDDAGVFGEGTTISAFPPNGFDIRQCGSYSLFDGFLPSSYGLDVRCNGGYFRH

SEQ ID NO: 220026 - protein, 49 aa, Glycine max
  Coding DNA Sequence Number=SeqID_103248
MSASYSTEMKIGESKSSKVLRSDIINLSYFSIPTSNKLVLNAILLLTQK

SEQ ID NO: 220027 - protein, 46 aa, Glycine max
  Coding DNA Sequence Number=SeqID_103249
  Homolog annotation: Hit_ID=Q9FHN0; Match level="QueryCoverage=99%, HitCoverage=5%, E-value=2e-08, Identity=60%"; Hit description =Similarity to endopeptidase
YLNTNLDLYGQVKKAEQECHMLSEEAQRGVRNLRVDFERGGIHLCP

SEQ ID NO: 220028 - protein, 251 aa, Glycine max
  Coding DNA Sequence Number=SeqID_103250
  Gene Ontology: Cellular component=membrane
  Homolog annotation: Hit_ID=A0DEZ4; Match level="QueryCoverage=48%, HitCoverage=24%, E-value=1e-12, Identity=33%"; Hit description =Chromosome undetermined scaffold_48, whole genome shotgun sequence
MADVVVDAMIAEASVIKYLPCWSGHHLQEISSRYLGLLWLWEEYVGEKSENTKAEPEDSIVRDSHMNGSTLDEDSPLSKKSHSSTRRRKKGKKNAKGRAVNSSKSKIYKKGDSLALKWFHSLKEAIYDLCRAFRQPMIWRPMSWFFLAHVTIPNLSTVIFYYETEVLKLEASFLGTSRVVGWLGLMMGTFIYNRHLKYMTLRKILMCAHIGLAFLNLLQIAVVSRKNIAFGISDKIMVLFGSALADGINQF

SEQ ID NO: 220029 - protein, 108 aa, Glycine max
  Coding DNA Sequence Number=SeqID_103251
  Homolog annotation: Hit_ID=Q6Z841; Match level="QueryCoverage=88%, HitCoverage=62%, E-value=1e-36, Identity=69%"; Hit description =Pollen Ole e 1 allergen and extensin family protein-like
MTQKTEQRTCHSSTGAEVAVLCITKSGEVLNYQAFTDAKGIYTVAETMPESDRWDACLARPISSFHEQCTQLGEGSIGVKFSYNHPSGHSHTVRTFVYRPTSVPTYCI

SEQ ID NO: 220030 - protein, 57 aa, Glycine max
  Coding DNA Sequence Number=SeqID_103252
MWWGKGMRVVIEFSKKLGEKLVYFSPESIQLLKATNRGRSRHGRYMVRTKEIEMEVV

SEQ ID NO: 220031 - protein, 40 aa, Glycine max
  Coding DNA Sequence Number=SeqID_103253
MQGARDMFAATDLQRQIFYALVGEQPFPHTPGNSVPRQHV

SEQ ID NO: 220032 - protein, 88 aa, Glycine max
  Coding DNA Sequence Number=SeqID_103254
  Gene Ontology: Mol. function=glycine hydroxymethyltransferase activity; Biological process=L-serine metabolic process
  Homolog annotation: Hit_ID=Q2QT32; Match level="QueryCoverage=51%, HitCoverage=8%, E-value=1e-09, Identity=65%"; Hit description=Serine hydroxymethyltransferase, mitochondrial, putative, expressed
MREKIRRIKGGGGEKEWEEEEVDENFIRQRSKEEKTWGERERPLVPWLVVGLRSHKTIWFFVAPVTRLYSFLITEFPSAIALALTCLA

SEQ ID NO: 220033 - protein, 129 aa, Glycine max
  Coding DNA Sequence Number=SeqID_103255
MYVYQKGILDQVICKLFFSIYGSPDPLFQINLIRKRLTDQVIRKQPSNFPIAVSAIAGNNGGRRRNAKEKRTSKKKKKHKEEAFHLIPTTMAAMKMRKKQKREEEDFTWEEEAARRRRRTKKMQNEAEE

SEQ ID NO: 220034 - protein, 88 aa, Glycine max
  Coding DNA Sequence Number=SeqID_103256
  Gene Ontology: Mol. function=unspecific monooxygenase activity
  Homolog annotation: Hit_ID=O04892; Match level="QueryCoverage=97%, HitCoverage=21%, E-value=4e-17, Identity=52%"; Hit description =Cytochrome P450 like_TBP
  Subcellular localization annotation: CTP_CleavageSite=21; ConfidenceScore=5.25e-01
ALRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 220035 - protein, 99 aa, Glycine max
  Coding DNA Sequence Number=SeqID_103257
SMRDTQVALMDTIYEKLECSLRRSPGYQQDKTYHMATSSFLTQTDPKRAQWQDFDVGNAEKGCLLMKGVVVTRPVRLFTKSTGLCNVVRPCMGADAYQV

SEQ ID NO: 220036 - protein, 37 aa, Glycine max
  Coding DNA Sequence Number=SeqID_103258
KLSSSRNGLWWLERLQGFNPDHLTPASVEATYFSIIN

SEQ ID NO: 220037 - protein, 502 aa, Glycine max
  Coding DNA Sequence Number=SeqID_103259
  Gene Ontology: Mol. function=transition metal ion binding
MKMLKGYTKNLRCPEASVVERDIAEEAIEFCSGYIEKVKPIGLLESRLDKRVGGKGSQGLNVISLCVKELNQGYDINKYLFNKKSQDDKSIVQNSGCMWVDSNIDGWIDDFIFTWLDLKKLSYKNEFFIMQNKLNRHMATPLSSPSPKLAHSPPMSEKTRKVTQLRSLSARLVGLERPLVHVDPNNGKVVSPYRKKLRTYLGVIAQDKVDVTYINYKQTPASQNDLIWEDIQHEFDILKVFDKRMKKKILQAIGMRWRQFKSDLTSKWALAKGKDDDDDETVCKKYGISKDKWNQFFQSYRDPSWEDVKKKAQSIQKQNIAPLVLSSGGYDFLDENLMNKKLKKQLEQATQYGSSDAIVDPPSPIRRHVKWKLTRTKKLGQMTSKVTYQIVDRIVKIRWKSSPHKVALLPMNVRMCWLLPLAPFGACVSTKGSCIDPSGEDPDTDTSDRCVDDNPPRLVSLGRAYEGSSTVHHVPLANDTWKVGVKEVRDADARVLVLIEEV

SEQ ID NO: 220038 - protein, 498 aa, Glycine max
  Coding DNA Sequence Number=SeqID_103260
MANGKVVGPDVILIMDKNHRFMALDCLHRVLRFYLSVHAANQAPNRIWDNLDSVTSQLLAVLRKGLLTQDVQHDKLVEFCVTIAEHNLDFTMNHMILELLKQDNPSEAKVIGLRALLAIVMSPSSPDIGHYIPKVKAAIESILRSCHKTYSQALLTSSRTTIGFRAKRAFRLLRAKRELAAKQNALNLSCALNAVTKEKSQGYLFRSVLKCIPNLIEEVGRTDKITEIIPQHGISIDPGVREEAVQVLNRIVKYLPHRRFAVMKGMANFILRLPDEFPLLIQTSLGRLLELMRFWRSCLIDDRIQLEADVKSLGHETERFRKSSIQQSGEAIEFRASEIDAVGLIFLSSVDSQIRHTALELLRCVRALRNDIRDLKMHEQPNHTLKYEAEPIFIIDVLEEHGDEIVQNCYWDSGRPFDLKREPDAIPPEVTLQSIIFESPDKNRWARCLSELVKYAAELSPSSVQEAKKIMGKEIQRAIERGLVFLVKPRKDTKFLYV

SEQ ID NO: 220039 - protein, 1297 aa, Glycine max
  Coding DNA Sequence Number=SeqID_103261
  Gene Ontology: Mol. function=steroid hormone receptor activity; Cellular component=nucleus; Biological process=regulation of transcription, DNA-dependent
  Homolog annotation: Hit_ID=Q4WM65; Match level="QueryCoverage=70%, HitCoverage=28%, E-value=4e-30, Identity=22%"; Hit description=Cell morphogenesis protein (PAG1), putative
MALGRSHLEACEIMFSELSSFIDEVSSETEGKPKWKSQKARREELRVHIANIYRTVAENIWPGMLTRKPVFRLHYLKFIDETTRLISTSIESFQDMQPFRFALACVLRSLAPEFVDSKSEKFDVRTRKRHFDLLLSWCDDTGSTWGQDGVSDYRREVDRYKSSQNARSKDSVDKISFDKELNEQVEAIQWASMNAIASLLYGPCFDDNARKMSGRVISWINGLFLEPTPRAPFGFSPADPRTPSYTKYQGEGGRGNAGRDRLKGGHHRVSLAKLALKNLLLTNLDLFPSCIDQCYHSNSSVADGYFSVLAEVYMRQEIPNCEIQRLLSLILYKVVDPSRQIRDDALQMLETLSVREWAEDGIEGSGSYRAAVVGNLPDSYQQFQYKLSCKLAKDHPELSQLLCEEIMQRQLDAVDIIAQHQVLTCMAPWIENLNFWKLKEGWSERLLKSLYYVTWRHGDQFPDEIEKLWSTIASKNKNISPVLDFLITKGIEDCDSNASTEISGAFATYFSVAKRVSLYLARICPQRTIDHRVFQLSQRLLEDSIEPVASKGDASANFVLEFSQGPAVAQMTSVMDNQPHMSPLLVRGSLDGPLRNVSGSLSWRTTGMTGRSVSGPLSPMPPELNIVPVSTGRSGQLLPALVNMSGPLMGVRSSTGSLRSRHVSRDSGDYLVDTPNSGEDGVHAGSAMHAVNAKELQSALQGHQQHSLTHADIALILLAEIAYENDEDFRQYLPLLFHVIFVSMDSSEDIVLEHCQHLLVNLLYSLAGRHLEQYEVENNDRENKQQVVSLIKYVQSKRGSMMWENEDPTVVRTGLPSAALLSALVQSMVDAIFFQGDLRETWGEEALRWAMECTSKHLACRSHQIYRALRPSVTSGACVSLLRCLHRCLGNPVPQVLGFVMEILMTLQVMVENMEPEKVILYPQLFWGCVAMMHTDFVHVYRQVLELFSHVIDRLSFRDRTTENVLLSSMPRDELNTSDLGEFQRTESKSGYEPLQEGSLPTFEGVQPLVLKGLMSSVSHSVSIDVLSRITVHSCDSIFGDAETRLLMHIIGLLPWLCLQLSKDIVIGPASPLQHQYQKACSVAANVAIWCRAKSFDELATVFMIYSRGEIKSVDNFLACVSPLLCNEWFPKHSTLAFGHLLRLLEKGPVEYQRVILLMLKALLQHTPMDATQSPHIYAIVSQLVESTLCWEALSVLEALLQSCSSLTGSHPYEPGSLENGIGGTEEKLLAPQTSFKARSGPLQYGFGSGLGSVSTPGQVGSTESGMSPREVALHNTRLIIGRVLDRSVLDVGIATG

SEQ ID NO: 220040 - protein, 92 aa, Glycine max
  Coding DNA Sequence Number=SeqID_103262
GSRPQETQWTRRSPTGSWSCQALITGLCQFYGVPVAPSKVIRPSTNRAFIKKYCVPRQAQGETPQQPGDGRQWATDAPPSLLEFTSAHPQKG

SEQ ID NO: 220041 - protein, 78 aa, Glycine max
  Coding DNA Sequence Number=SeqID_103263
MGLVIPWSITLLVVDAYSVFIQYLPVQRRLIMIIFFGDMLQHVLQPASQIFYLMLEDHTVHQSYVINEKGANDKVICS

SEQ ID NO: 220042 - protein, 171 aa, Glycine max
  Coding DNA Sequence Number=SeqID_103264
MKAGSAAKLIVDALLQRFLPLARRRIETAQAQDGQYLRPSDPAYEQVLDSLAMVARHTPVPLLEALLRWRESESPKGANDASTFQRKLAVECIFCSACIRFVECCPQEGLTEKLWSGLENFVFDWLINADRVVSQVEYPSLVDLRGLLLDLVAQLLGALSRIRYPTYQSCI

SEQ ID NO: 220043 - protein, 447 aa, Glycine max
  Coding DNA Sequence Number=SeqID_103265
  Gene Ontology: Mol. function=methyltransferase activity; Cellular component=intracellular; Biological process=protein amino acid phosphorylation
  Homolog annotation: Hit_ID=Q8RZK3; Match level="QueryCoverage=66%, HitCoverage=55%, E-value=3e-47, Identity=32%"; Hit description =Selenium-binding protein-like
  Pfam annotation: Domain name=PPR; Domain location=199-232; Score=9.6; E_value=0.54; Accession=PF01535.11; Description=PPR repeat
  Pfam annotation: Domain name=PPR; Domain location=299-333; Score =49.5; E_value=1.1e-11; Accession=PF01535.11; Description=PPR repeat
  Pfam annotation: Domain name=PPR; Domain location=334-368; Score=0.3; E_value=6.9; Accession=PF01535.11; Description=PPR repeat
  Pfam annotation: Domain name=PPR; Domain location=400-434; Score =29.6; E_value=1.1e-05; Accession=PF01535.11; Description=PPR repeat
  Pfam module annotation: Pfam domain module=PPR::PPR::PPR::PPR; Domain location=199-232::299-333::334-368::400-434
MTSVVSEARVLEAYSAHPSHVSIVKGNMLPIINDIMTVDSIADDLSTDNLVPLLGSAIRISFLKLKEDANKDEVLSAVKGILENFKQISEGRKLDLMFSALKLKPASVGSRLFCVGSLQTKINKIIWHQLKSPSHQTLHHLLDQCFSMRQLKLVHAQIILHGLAAQVVTLGKLVSLCVQAGDLRYAHLLFDQIPQLNKFMYNHLIRGYSNIDDPMSLLLYCQMVRAGLMPNQFTFPFVLKACAAKPFYWEVIIVHAQAIKLGMGPHACVQNAILTVYVACRFILSAWQVFDDISDRTLVSWNSMIAGYSKMGFCNEAVLLFQEMLQLGVEADVFILVSLLAASSKNGDLDLGRFVHLYIVITGVEIDSIVTNALIDMYAKCRHLQFAKHVFDRMLHKDVVSWTCMVNAYANHGLVENAVQIFIQMPVKNVVSWNSIICCHVQEEQKL

SEQ ID NO: 220044 - protein, 159 aa, Glycine max
  Coding DNA Sequence Number=SeqID_103266
  Gene Ontology: Mol. function=protein disulfide oxidoreductase activity; Cellular component=chloroplast thylakoid membrane; Biological process=cell redox homeostasis
  Homolog annotation: Hit_ID=Q7Y0D4; Match level="QueryCoverage=80%, HitCoverage=48%, E-value=3e-62, Identity=87%"; Hit description =Putative thioredoxin
  Pfam annotation: Domain name=AhpC-TSA; Domain location=16-112; Score=- 11.5; E_value=0.0068; Accession=PF00578.11; Description=AhpCTSA family
  Pfam annotation: Domain name=Thioredoxin; Domain location=25-125; Score=27.5; E_value=9.6e-07; Accession=PF00085.10; Description =Thioredoxin
  Pfam module annotation: Pfam domain module=AhpC-TSA::Thioredoxin; Domain location=16-112::25-125
MPSNSSSLHCKFQTLACQTNPNLDQKDTPTTALSNGKPTVVEFYADWCEVCREFAPDVYKVEQQFKDQVNFVMLNVDNTKWEQELDEFGMEGIPHFAFLDKIGNEEGNVVGRLPRQYLLENVDALARGETSVPHARVVGQYSNAEARKVHQVADPRRHG

SEQ ID NO: 220045 - protein, 181 aa, Glycine max
  Coding DNA Sequence Number=SeqID_103267
  Gene Ontology: Mol. function=protein serine/threonine kinase activity; Cellular component=integral to membrane; Biological process=protein amino acid phosphorylation
  Homolog annotation: Hit_ID=Q6QLL5; Match level="QueryCoverage=71%, HitCoverage=18%, E-value=8e-52, Identity=77%"; Hit description=WAK -like kinase
  Pfam annotation: Domain name=Pkinase; Domain location=3-178; Score= -32.5; E_value=1.3e-06; Accession=PF00069.15; Description=Protein kinase domain
  Pfam annotation: Domain name=Pkinase_Tyr; Domain location=1-153; Score=-91.1; E_value=7e-07; Accession=PF07714.7; Description=Protein tyrosine kinase
  Pfam module annotation: Pfam domain module=Pkinase::Pkinase_Tyr; Domain location=3-178::1-153
MNEIKLLSSVSRPNLVCLLGYCIEKGEQILVYEFMQNGTLSQHLRRQRSKGLPWTIRLAIATETANAIAYLHSAIHPPIYHRDIKSSNILLDYGFKYKIADFGLSRLALTETSHISTAPQGTPASGVLNPKTLATRTGRESKQKEDANIVENIKDNHNVGSRLASGNNANNICQFKFLSRG

SEQ ID NO: 220046 - protein, 187 aa, Glycine max
  Coding DNA Sequence Number=SeqID_103268
  Gene Ontology: Mol. function=ATP binding; Biological process=apoptosis
  Homolog annotation: Hit_ID=Q8LJ95; Match level="QueryCoverage=87%, HitCoverage=33%, E-value=3e-32, Identity=41%"; Hit description=NBS -LRR resistance protein RGH1-like
  Pfam annotation: Domain name=LRR_1; Domain location=152-174; Score =1.5; E_value=1.5e+02; Accession=PF00560.23; Description=Leucine Rich Repeat
  Pfam annotation: Domain name=LRR_1; Domain location=33-55; Score =12.4; E_value=1.3; Accession=PF00560.23; Description=Leucine Rich Repeat
  Pfam annotation: Domain name=LRR_1; Domain location=57-79; Score =11.9; E_value=1.7; Accession=PF00560.23; Description=Leucine Rich Repeat
  Pfam module annotation: Pfam domain module=LRR_1::LRR_1::LRR_1; Domain location=152-174::33-55::57-79
MEGREDTEERRREAAATEGNRHWLPPSIAQLGNLEILDLKACHNLEALPSDIASMRSLTHLDVSECYLLDSMPKGIEKLTQLQVLKGFVIGNSSKTPCRITDLANLKKLKRLSIHIGSEAVIFPSSLEKLELEGFPGFTIPEWLKPSRLPQKLKKLYIKGGKLKSLDHGEICHKWHVEILRLQYLNQ

SEQ ID NO: 220047 - protein, 136 aa, Glycine max
  Coding DNA Sequence Number=SeqID_103269
MFFLACLHRWDSCHYVGYLVATLHLVSMMLNTLPWCQICCQWCYISRDGLELEAKKMRATESASQISDLTVEGDEAIVHGVNDGGNIMGCCHHQESSKEAHGKEFAIANVTDVGGCNHCIFTSTKVVADVSINAMI

SEQ ID NO: 220048 - protein, 564 aa, Glycine max
  Coding DNA Sequence Number=SeqID_103270
  Gene Ontology: Mol. function=signal transducer activity; Cellular component=membrane; Biological process=response to light stimulus
  Homolog annotation: Hit_ID=Q9FJY3; Match level="QueryCoverage=96%, HitCoverage=92%, E-value=1e-173, Identity=59%"; Hit description =Photoreceptor-interacting protein-like
  Pfam annotation: Domain name=NPH3; Domain location=161-410; Score =347.4; E_value=2.4e-101; Accession=PF03000.5; Description=NPH3 family
MSKSRKLQQLIAEHETNHSSEAEEKEKHRHLVFTDFPGGSETFELAAKFCFGAKIDLSSSNVVPLRCAGEFLEMTEQHSKENLISKTETFLSHSVLNSIKNSIIALKSCERLLPLADTLAITRRCVDSIVSETLFRLPVSDSASTLLLPTGGRRSRRTGEDDSWFEELRLLGLPMFKQLILAMKGSDSALKSEIIETCLLQYAKKHIPALSRSNRKALTSSSSSEAEQKELLEIVITNLSSKHSTPVRFLFGLLRTATVLKASEACNDVLEKKIGSQLDEVTLDDLLIPSYSYLNETLYDIDCVARILGYFLEEERNVAAIDGRAPRSPGLMLVGKLIDGYLSEIATDANLKPSKFYDLAISVPDRARLFHDGLYRAVDVYLKAHPWVSKSDREKICAVLDCQKLTLEACSHAAQNERLPLRAVVRVLFFEQLQLRRAIAGKLGAAEEPSRHSAAMAEEEEVEDDNNTWQVTVRENQVLRLDMDSMRTRVHELERECSSMKRAIEKMDKMGPRGGGPWRASLALGRKFGCKFKTQFLHAKAETQITGSTCGRRKKGSRKGFFLY

SEQ ID NO: 220049 - protein, 183 aa, Glycine max
  Coding DNA Sequence Number=SeqID_103271
  Gene Ontology: Cellular component=chloroplast thylakoid membrane
  Homolog annotation: Hit_ID=O64835; Match level="QueryCoverage=62%, HitCoverage=68%, E-value=6e-10, Identity=37%"; Hit description =Expressed protein
  Subcellular localization annotation: CTP_CleavageSite=60; ConfidenceScore=5.75e-01
MVCAISSSPFSTLSFRRLVVSNATVSPCKPRAVKLLTALPSAGRRQLLFFLTATTAFTAREAASVAQDIPLFGIRKSLKKVEEEAEEIVKEGFEAADKGLVAAEKGLETAEKGLVAAEREIEEAVSFGGLAQAGAVAGAEVFGILVATAVVNDDNLLSESLASGLGFLSYHVYDNPVWTWIFE

SEQ ID NO: 220050 - protein, 127 aa, Glycine max
  Coding DNA Sequence Number=SeqID_103272
MEKEIITMIVDILPVFYYEKMVGYTPSSFADLVFVGKRIEVGLKRGKFDHPALTNKKPGANREDEKEEGIHVVTVVATWPNFPLAQQCHYSANIRPSHYPPPNQPQRPPLNQPQSLLVAHPNTKHHP

SEQ ID NO: 220051 - protein, 54 aa, Glycine max
  Coding DNA Sequence Number=SeqID_103273
MASILYTNENGVAPVDVRTEIGSIVHDNLPWQPIPEDYLPFDEPNYHALRDTGV

SEQ ID NO: 220052 - protein, 854 aa, Glycine max
  Coding DNA Sequence Number=SeqID_103274
  Gene Ontology: Mol. function=protein transporter activity; Cellular component=soluble fraction; Biological process=ER to Golgi vesicle -mediated transport
  Homolog annotation: Hit_ID=Q5BQN5; Match level="QueryCoverage=94%, HitCoverage=98%, E-value=1e-126, Identity=35%"; Hit description=WPP domain associated protein
  Pfam annotation: Domain name=Pox_A_type_inc; Domain location=394-416; Score=4.7; E_value=17; Accession=PF04508.3; Description=Viral A-type inclusion protein repeat
  Pfam annotation: Domain name=Pox_A_type_inc; Domain location=669-691; Score=11.8; E_value=1.5; Accession=PF04508.3; Description=Viral A -type inclusion protein repeat
  Pfam module annotation: Pfam domain module=Pox_A_type_inc::Pox_A_type_ inc; Domain location=394-416::669-691
MESSAAMEGGDRIYDNGKEDASVSNHIDILKEMDSFLEDIDEGLIISRMVGDSVIKGMVNAVEEQAAERIAQKELEVVGLKKILDEFRVGSDETKTLWSLVHHREPDEVGMHQFPDSVVGHDRCIMSVDSFQIAVHEQLNQLRKEVNKIRGASSIRRISSGSDLVGLGGILQENMPEKWIYVNKAFESLKDTLDTFCRRMEDMDHLSKASLSEWQQEQDFCSEIERMVISNSIWGLQQQFEQKLLDLYDSESRNCFNQYKEISSLRQELDAIFKTLSVSETGHLLSHGSLENTDEWCHNKRVDHFHVKLSTDPLSPSTMEENGKQEESKINKPENLDSASLKHMSKEDLVTYITKMRRNHESQVQEKTEENFRLRRELLNLKERGSSFPLKKDKEFELLKKKIPDVISKLNEILDGNEKVHQFSENIESLSSLKDRLDFLQLENHQLKDTLSDMKKEFKSLSSQLSASVEKLSQQQLTQKNLLQTIQKLEDDIGDAHTQVSVIQDVYKCFFEDIVSEFRYSTEELHLKNSFMQEIYEVIFKEASHSAQASSGLGIEEAEMESTIMQGQLDINHIIFKETLMNADEALKFESAEKETLKYEMLMLNSVVEEKEKLIQGAADALVLEKQKTESASEQLNSLRAEIVQQHKLIAENSKELNVTKGNLVAALKEIEQYKEQVQELHQNLEQRMNKLKETDEEKKVLCTLTQKQQETLKLIEEKERESRKQMESTINLIYKLLAMVTDFEARVNKDISRNRLSLENMRSEFHWIKNKANVLKTMGLVHKQRLETKSSDLLKAEAEVDLLGDEVDTLLSLLEKIYIALDHYSPILQHYPGIIEILELVRRELTGDSRKHV

SEQ ID NO: 220053 - protein, 195 aa, Glycine max
  Coding DNA Sequence Number=SeqID_103275
  Gene Ontology: Mol. function=transferase activity; Biological process= lipoate biosynthetic process
  Homolog annotation: Hit_ID=Q0M329; Match level="QueryCoverage=43%, HitCoverage=35%, E-value=4e-34, Identity=77%"; Hit description =Lipoate-protein ligase B
MGGAQRAGLVARGQDRGDRRQGPQMGHLPWDQSERRTEPGSFRRHRAVRHSGAWRDQPGRSRRPGHAGRGGRGAAAQFRFAVRARDDRIPAARGIHYESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 220054 - protein, 382 aa, Glycine max
  Coding DNA Sequence Number=SeqID_103276
  Gene Ontology: Mol. function=chitin binding; Cellular component =extracellular region; Biological process=chitin metabolic process
  Homolog annotation: Hit_ID=UPI000044A8F0; Match level="QueryCoverage =42%, HitCoverage=99%, E-value=3e-20, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTSPSEDYRSLPSEDNTSSPFVGIHVLNFRGLHALTFRGLHVLALRGLHALTFRGLHAFTFKGLHVLALRGLHALIFKVLHALAIRGLDVLSFGGLHALTFRGLHVLAFRGLHILAFRGLHVLTFRGLHFLTFRGLHVLTFRGLNALAFRGLHVLAFRGLVARPLAFRGLHVLTFSGLHICTFRKFKVLCPEMLNRDLHSWEAITQLLCIPRQDFTRATAKRRVRIMHTNMTTLTQIWMTLLLSNVPSSDHDADLPLRKHQGRAHKTPSGPRGAQQGPGVSSSGYGPLSVLQSARPPQQGIAPARHPVDPEKSNKVLGFPALITGLYQFYGVPVTPNKVIRPLSNRAFIKKYYAPQEGAGRDTTAAWGWLAAGNKRTIATSR

SEQ ID NO: 220055 - protein, 236 aa, Glycine max
  Coding DNA Sequence Number=SeqID_103277
MDTSEPYTGAMKGTMHKPQANLGADQKFSPNRFPATRGPLDESISCFLIRVDPWVLVPIAFRGLHTLTFRGMHVLAFRGLHILTFRGLHALAFRGLHALTFRGLHVLAFRGLHALAYKGLHIHAFRELKGGQLCEHNQRRGRVFGFDKETIAQLLCIPGQDFAQPLDHAHKTPSGPKEVQQGPGISSSDYGPLSVLQNVRRPQQGTRRGTTAALGWLAAAEALPTTRGRPAGGQPL

SEQ ID NO: 220056 - protein, 58 aa, Glycine max
  Coding DNA Sequence Number=SeqID_103278
MENWRTALHITSQDSRLDALGNNIHGAPKKVENGELANSATHNFAGLQTRRWRMHEQR

SEQ ID NO: 220057 - protein, 185 aa, Glycine max
  Coding DNA Sequence Number=SeqID_103279
  Gene Ontology: Mol. function=RNA-directed DNA polymerase activity; Cellular component=chromatin; Biological process=RNA-dependent DNA replication
MPMRTRGSDGAGTSQGGDDIPNPPPAPPSLADAIAVLLSATTDNARLLRELAQRQPHPAPNFRAPRNGDGEARYVDFTETRPPVFTKADEPLEADDWLRTMEHKFSLIQCSETQKPLFAAQQLRGAAGAWWENFLAIQAPGHQVTWTEFRDAFRAHYIPEGLMAMKAEEFLALQQGDKSVMEYVA

SEQ ID NO: 220058 - protein, 53 aa, Glycine max
  Coding DNA Sequence Number=SeqID_103280
MDGEELPSPGQDHLELPSGVGTKHEQQKPTKVLRNGCNWGWGHDRLIVTPSLR

SEQ ID NO: 220059 - protein, 99 aa, Glycine max
  Coding DNA Sequence Number=SeqID_103281
  Homolog annotation: Hit_ID=Q1SPY8; Match level="QueryCoverage=93%, HitCoverage=12%, E-value=1e-07, Identity=35%"; Hit description =Ankyrin
MAVEVDNQGNNILHFAAHLPVEFQELSSLRASIQMQRELQWFQFVDWYVPRELRRMRNNMGKRPIDVFYEEHKTLSEEIKDAGKGIAESGNARAALVAT

SEQ ID NO: 220060 - protein, 58 aa, Glycine max
  Coding DNA Sequence Number=SeqID_103282
  Gene Ontology: Mol. function=pseudouridylate synthase activity; Biological process=tRNA processing
  Homolog annotation: Hit_ID=Q1S3L9; Match level="QueryCoverage=86%, HitCoverage=12%, E-value=5e-17, Identity=82%"; Hit description=TRNA pseudouridine synthase
MNNIVEGSLGKFVDEKKTQLLKDKGLPIEGCAIVAGRTDKGVTGLQQVCSFCKSFPCS

SEQ ID NO: 220061 - protein, 89 aa, Glycine max
  Coding DNA Sequence Number=SeqID_103283
MEKMTEQKIEEAKEHHLDEDALIPHNVASSRACRPLIFFINVVFSFLKINGSRMEKEESEFQLWFNPLIQDQIQDSSLSELRRHEACKA

SEQ ID NO: 220062 - protein, 70 aa, Glycine max
  Coding DNA Sequence Number=SeqID_103284
  Gene Ontology: Mol. function=RNA-directed DNA polymerase activity; Biological process=RNA-dependent DNA replication
MASEDMEKTMFVTLWGTFYYKVTSFELKNAGATYQRAMIEVYVDDMIAKSRTEEEHLINLWKLFERLRKY

SEQ ID NO: 220063 - protein, 97 aa, Glycine max
  Coding DNA Sequence Number=SeqID_103285
DRARKTPSGPGEVHQGPGVSSSDYEPLSVLRSAHLPNKVIRHPINRAFIKKYCAPQAGTGRDTIAAWGWPAAGNRCTATTSRAPQLIYKCWSVAYDA

SEQ ID NO: 220064 - protein, 112 aa, Glycine max
  Coding DNA Sequence Number=SeqID_103286
MAHVESTPQILIEELLREEPHRVQLGFESLFCDHGWINPLSQPTVLRASEARLTGASSKGGKCAESPPTFICGKRRKNRRKPVMKNIPDSGVVFTFEEGISTSHTCPKGQQP

SEQ ID NO: 220065 - protein, 36 aa, Glycine max
  Coding DNA Sequence Number=SeqID_103287
MVTRPQFAAQCRFLLSGINETLGLIRILVMDLKRAN

SEQ ID NO: 220066 - protein, 107 aa, Glycine max
  Coding DNA Sequence Number=SeqID_103288
  Gene Ontology: Mol. function=RNA polymerase II transcription factor activity; Cellular component=transcription factor TFIIE complex; Biological process=transcription initiation from RNA polymerase II promoter
  Homolog annotation: Hit_ID=Q6S7C3; Match level="QueryCoverage=83%, HitCoverage=29%, E-value=1e-11, Identity=46%"; Hit description=TFIIE- alpha 2
DEYIKAYYAALLKQQHELEAASKQELSNTLTANDPSSSASNRQVGMKSKLEEDDDGTEWEEAPVAEGSLLCEGMGGGTGNENYKVDLNVQADDAPADDDEDVDWEEG

SEQ ID NO: 220067 - protein, 72 aa, Glycine max
  Coding DNA Sequence Number=SeqID_103289
MKQLISREFWKLLKHSHGPGLAAEVHSRKDCHAQTDDSLRTRNKDSGVGSMSHIELGCLREYLSAWFSPLNN

SEQ ID NO: 220068 - protein, 38 aa, Glycine max
  Coding DNA Sequence Number=SeqID_103290
MVVGATTIKPVGGAAIILVNMLMCVLMLNLATKHEHCA

SEQ ID NO: 220069 - protein, 349 aa, Glycine max
  Coding DNA Sequence Number=SeqID_103291
  Homolog annotation: Hit_ID=Q10PC8; Match level="QueryCoverage=85%, HitCoverage=41%, E-value=3e-28, Identity=29%"; Hit description =Hydroxyproline-rich glycoprotein family protein, putative, expressed
MAMPSGNAVMPEKLQFPGGGGGSEIHYRQQWFVDERDGFIGWLRSEFAAANAIIDSLCHHLRCVGEPGEYDMVVGAIQQRRCNWTQVLLMQQYFSVSEVVCALQQVSWRRQQRVVDLAKTGAKEFRKFGSGIRQGQHRLEAAKDGYNSSVESFCHGTNAVVVAGGVEKGTPLTEKNGEIKSGGKVGTMDNKSLASPEERKDTITNHQSDGILKGSGNSQGSLSTSECEAVGVNEECVSNSKENDSTMGKTFIGNEMFDGKMVNVVDGLKLYEDLLDRTEVSKLVSLVNDLRVAGKRGQFQGTNSEIPRCNRRHLVIDIWLKEDTWLSTEMTNSKPKNNKSSQCKEIIGG

SEQ ID NO: 220070 - protein, 154 aa, Glycine max
  Coding DNA Sequence Number=SeqID_103292
  Gene Ontology: Mol. function=oxidoreductase activity; Cellular component=cytoplasm; Biological process=lignin biosynthetic process
  Homolog annotation: Hit_ID=Q9ATW1; Match level="QueryCoverage=88%, HitCoverage=38%, E-value=6e-46, Identity=69%"; Hit description =Cinnamyl alcohol dehydrogenase
  Pfam annotation: Domain name=ADH_zinc_N; Domain location=42-154; Score=24.1; E_value=0.00015; Accession=PF00107.16; Description=Zinc -binding dehydrogenase
MVADEHFVVSIPSDLPLDIAAPLLCAGITVYGPLRYLGLHKPDMHLGVVGLGGLGHLAVKFAKALGLKVTVISTSPNKKKEAIQNLGADSFVVSRDQDQMQAAMCTLDGIIGTVSAVHPLMPLIDMLKCHGKLVMVGTPEKPLELLLPSLIMAG

SEQ ID NO: 220071 - protein, 329 aa, Glycine max
  Coding DNA Sequence Number=SeqID_103293
  Homolog annotation: Hit_ID=Q10PC8; Match level="QueryCoverage=84%, HitCoverage=43%, E-value=5e-60, Identity=42%"; Hit description =Hydroxyproline-rich glycoprotein family protein, putative, expressed
MSGNQTFVVSKRPMKGHGREMIQLGVPIADAPPDVDNFHQLNLTDKKVESIPSLFQDIIKRLVASQVMTVKPDACIVDFFNEGEHSHPNNWPPWFGRPLYMLFLTECDMTFGRIIVSDHPGEFRGAVTLSLVPGSLLVMQGKSTDFAKHALPSIHKQRIIVTFTKSQPRSSLPNDSERLAPPAAPHWAPPPSRSPNHVRHQLGPKHYPTVQATGVLPAPNGMQPLFVPVPVPVASPMSFPTPVPIPPGSIGWTSAPPRHPPPRIPVPGTGVFLPPPGSGTIHEVNPSVETWTVSGKENGKSNHSKTNSEAEEAGVEKEHESNDMTAASH

SEQ ID NO: 220072 - protein, 91 aa, Glycine max
  Coding DNA Sequence Number=SeqID_103294
  Gene Ontology: Mol. function=hydrolase activity, hydrolyzing O -glycosyl compounds; Cellular component=cell wall; Biological process= carbohydrate metabolic process
  Homolog annotation: Hit_ID=Q9SLN9; Match level="QueryCoverage=78%, HitCoverage=22%, E-value=5e-32, Identity=81%"; Hit description=ETAG -A3
  Pfam annotation: Domain name=Glyco_hydro_16; Domain location=1-90; Score=-49.4; E_value=0.00068; Accession=PF00722.11; Description =Glycosyl hydrolases family 16
MSNGDMFQNNHDEIDFEFLGNIRGKDWRIQTNVYGNGSTSIGREERYGLWFDPAEDFHQYSILWTDSKIIFFNCSIIAFYTLTIPCFDGVV

SEQ ID NO: 220073 - protein, 98 aa, Glycine max
  Coding DNA Sequence Number=SeqID_103295
  Subcellular localization annotation: CTP_CleavageSite=57; ConfidenceScore=5.44e-01
MTCGNTVWLSASFVNQGQTSPLTCAATCPFAGERRRGSRVRFPKEERCAESPPTFICGKRRKNRRKPVKMKILSSGVVFTFEEGDHFKALDLKNDPFT

SEQ ID NO: 220074 - protein, 113 aa, Glycine max
  Coding DNA Sequence Number=SeqID_103296
  Homolog annotation: Hit_ID=Q1S668; Match level="QueryCoverage=68%, HitCoverage=20%, E-value=1e-13, Identity=46%"; Hit description =Cyclin-like F-box; F-box protein interaction domain
MRTKYEPRKDNAAKTKANTQLAIANRTIHQTTGHHHFQRCTEASVLHMADGLEEAQELHSTIESKNFQLQIPSLAKQQNGFSGEHEKDTSSLSIPQVQGHGELEKDHSASANI

SEQ ID NO: 220075 - protein, 71 aa, Glycine max
  Coding DNA Sequence Number=SeqID_103297
MAFGAVVEVDGMAAMEATVEGAAIILVKMLMLMLMLNLATKQEICAKLALIIDKSLNERFTRGDFMAEPEN

SEQ ID NO: 220076 - protein, 134 aa, Glycine max
  Coding DNA Sequence Number=SeqID_103298
  Gene Ontology: Mol. function=ferric-chelate reductase activity; Cellular component=integral to membrane; Biological process=electron transport
  Homolog annotation: Hit_ID=Q3LGX5; Match level="QueryCoverage=95%, HitCoverage=54%, E-value=1e-22, Identity=41%"; Hit description =Cytochrome b561
  Pfam annotation: Domain name=Cytochrom_B561; Domain location=13-134; Score=-1.4; E_value=1.3e-06; Accession=PF03188.6; Description =Cytochrome b561
MARGFQVRATSVTIFAHLLFIAIATLVLVWLLHFREGVAFFSSSNPVKIFNLHPLLMVIGFILVGGEAIMIYKSVPEKRRSVKVVHLLLHLIALVAGIIGIIAVFKSKKEAGLADMYTLHSWLGMSAISLFGLQ

SEQ ID NO: 220077 - protein, 100 aa, Glycine max
  Coding DNA Sequence Number=SeqID_103299
  Homolog annotation: Hit_ID=P93704; Match level="QueryCoverage=41%, HitCoverage=29%, E-value=2e-14, Identity=88%"; Hit description=HMG-1
  Pfam annotation: Domain name=HMG_box; Domain location=26-72; Score =14.0; E_value=0.00064; Accession=PF00505.9; Description=HMG (high mobility group) box
MTNAEGEEKAFVCQSAERAGERGFLAFGFYKESVGKAGGDKWKSLSDAEKAPFVATAEKKKQEYEKTILAYNKKLGKNSEEDESDKSKSEVNDDEEDEVD

SEQ ID NO: 220078 - protein, 832 aa, Glycine max
  Coding DNA Sequence Number=SeqID_103300
  Gene Ontology: Mol. function=zinc ion binding
  Homolog annotation: Hit_ID=Q10PC5; Match level="QueryCoverage=80%, HitCoverage=88%, E-value=1e-142, Identity=41%"; Hit description =Tropomyosin, putative, expressed
  Pfam annotation: Domain name=DUF1423; Domain location=364-832; Score =694.9; E_value=5.9e-206; Accession=PF07227.2; Description=Protein of unknown function (DUF1423)
  Pfam annotation: Domain name=PHD; Domain location=517-579; Score=7.1; E_value=0.011; Accession=PF00628.19; Description=PHD-finger
  Pfam module annotation: Pfam domain module=DUF1423::PHD; Domain location=364-832::517-579
MIGGKDLVPNGVDSESENSRNKVQQHQQHHGFAHANKEHPQEKKPSFDEFRSTTPSKFATSGMQELTLSYLCENPKLGLAEREVGDRSLVKGKEVVVYGNSDQDEKCQSGLGLTEGVSLSQRDELRFKTSLGEVSPFSVQQYFEQNCLRRKISVGNQNQKQDQDEKWVERDFLSLSETRENSSKRSMEEECERETNGGSKKQKLETLSLSLALPDVSLSLTASNALQNGDQLVRPKPSKPSTRTTTTINSCSNDYTAASVSHSYSHPFSHNQSCSLTRNSTENFEYSHSKDDQIWHCGEGTNGSVHSRFKPIGDGVALVNHSFMQGNSQYKATSSENQSVFPSELPARMRFEAKSEGSRGKNSGNLRGLEGVDGGKMKFSTSERVLREIVSESIPAMALTFQEFTEEVITSIKEYLKGLIEMPEKKGELESLQNRLGRRSDLTRETLSKCHKQQLEILAAIKMGLGSFLSGKFQFAETVDVFLYMRCRNVNCKSLLPVDDCDCKMCSGNKGFCSSCMCPVCMSFDYASNTCSWVGCDVCSHWCHAACAIQRNLIKPGPSLKGPSGTSEVQFHCIGCGHTSEMYGFVKDVFVCCAKDWGLETLAKELDCVRRIFRGSEDRKGKELHIKTEDMLLKLQAKLVSPLDACNHIIQFFNYVDGVSDFPASAISSKDLSTSKANLAMDTTTSSLPQSTSLIQKYTYDMSYTRSNDLQQKDLKSSLLSEHKNESDFHLEALLGKGGGLESLESIVRIKEAEARMYQNKADEARREAEGFQKMIKTKAAQMEEEYAERIGKICLNEAEERRKNKFDELNVLQNSHYDYFNMKSRMQDEIH

SEQ ID NO: 220079 - protein, 822 aa, Glycine max
  Coding DNA Sequence Number=SeqID_103301
  Gene Ontology: Mol. function=nucleic acid binding; Cellular component= beta-galactosidase complex; Biological process=DNA integration
  Homolog annotation: Hit_ID=Q1S0A6; Match level="QueryCoverage=98%, HitCoverage=62%, E-value=0.0, Identity=52%"; Hit description=Zinc finger, CCHC-type; Peptidase aspartic, catalytic; Polynucleotidyl transferase, Ribonuclease H fold
  Pfam annotation: Domain name=rve; Domain location=449-610; Score =174.7; E_value=2.3e-49; Accession=PF00665.16; Description=Integrase core domain
  Pfam module annotation: Pfam domain module=Retrotrans_gag::rve; Domain location=83-197::449-610
MAENKKPHTDGTKKTPSPYDLNSNDNPGNLITQVQLRGENYEEWARAMKISLRARRKWGFIDGTYEQPDDGSPEMEDWWTVQSMLVSWILNAIEPTLRSTVTYAENAKDLWEDIRDRFSVVNGPRIQQLKAELAYCKQQGMTMVSYYGKLKTLWDELANYEQIPRCSCGGCKCDIASKLEKRREEERVHQFLMGLDDASYGTVRSNILAADPLPSLNRVYAILVQEERVRTISRTKEERGAVMGLAVQAGHKRKQDMMIRTASKSSDILTGRVIAHEVKADLVAKISNEMGLQLDWQTLVEMLNNRKTDETEKMTGYLKNLCQQRTIRGCPVGLRDGEKVIATKEGTVILDGGLKLENVLYDRTLKTLIGAGERKDGLYLYHGVRNSKAYHTSTKYDLDILHKRMGHPSFKVVKLIPNVTSSGKHSNKVCEICERAKQTREKFPLSTYRASGIFDLIHCDLWGPYRTPSSCGASYFLTLVDDYSRSVWIYLLSEKSEVSQTMINFFALIKRQFDKHVKVIRSDNGTEFTCLKQYFLEHGILHQKSCTGTPQQNGRVERKHRHILNVARALRFQGRLPIRFWGECILTAGYLINLTPSPILDGKTPYELVHGTSPSYDHLRVFGSLCYAHNQDRKGDKFDSRSRKCIFVGYPYGQRGWKLYDLEREVFFVSRDVKFVETEFPFEESINNPSPTSLVPLINPCMDGECMVENGHDNDTNADVRGGASEASNEPQSFAPPLETQNCIDVVQCSSEGPETRSNIPPTSPLGKGHRIKRPFVKLSDYVTNTMIKLSPSTCSSASSHDSGARYLIAHYVNCDRFSTTD

SEQ ID NO: 220080 - protein, 276 aa, Glycine max
  Coding DNA Sequence Number=SeqID_103302
  Gene Ontology: Mol. function=nucleic acid binding; Cellular component= intracellular; Biological process=chromatin modification
  Homolog annotation: Hit_ID=Q39263; Match level="QueryCoverage=74%, HitCoverage=90%, E-value=1e-28, Identity=38%"; Hit description=Zinc finger protein 4
  Pfam annotation: Domain name=zf-C2H2; Domain location=121-143; Score =18.4; E_value=0.026; Accession=PF00096.16; Description=Zinc finger, C2H2 type
MSASKLLVFSSALKGLDDTPQPKSKVASRWIVVKIHINMMTPNLNLEPEDDFKVLIQVGSDKSIRETSHDLTKADPDPGPVSLDLSLNFNPGDEELKVTSDTNCEVGPETHASASAIPRVFSCNYCWRKFFSSQALGGHQNAHKRERTMAKHAMRMGMFAERYTSLASLPLHGSSFQSLGLEAHAAMHQGHVHHHSMRAPDIRAAAKFGKDYFRMPIFLEDDDVGLFWPGSFRQTDERGGVNLGHGEHAHNSNTCFVVATAPPAQTSASPDLTLRL

SEQ ID NO: 220081 - protein, 415 aa, Glycine max
  Coding DNA Sequence Number=SeqID_103303
  Gene Ontology: Mol. function=transferase activity, transferring hexosyl groups; Biological process=metabolic process
  Homolog annotation: Hit_ID=Q9AT54; Match level="QueryCoverage=41%, HitCoverage=53%, E-value=3e-46, Identity=40%"; Hit description =Phenylpropanoid:glucosyltransferase 1
  Pfam annotation: Domain name=UDPGT; Domain location=11-414; Score= -158.9; E_value=0.013; Accession=PF00201.9; Description=UDP -glucoronosyl and UDP-glucosyl transferase
MDVESNFSQIAHLVFDGKSYDLWKHRKKIKTKKVKVKTCLFASVSQTIFTKIMNVNSPKEIWDYLKKEYEGYEHVRGMQVLNLMREFEVQEMKEFKIIKGYSDRLFDIANKDQVQHQPMQKEIRRNLIRLANIVERKGILYSDVGKDLMLSAISVIKWGTKLTVATGQLFQMETVVAAADALLLSVAPHIPWMCLHQPCCNHKRLKQEKMAVISCHLLTRLRRKKGAVAKESESRSYGVVVNSFYELEKASIDEHECLKWRDTKKPNSVVHVCFGCTVKFKRGWVPQVLILEHEAIGVFVTHCGWNSSLEAVNAGVPMITWPMGADQIFNEKLVTEVLKIGMPIGARKLFRLEGDSITCDAVEEAVKRIMIGEEAIEMRNRTKVPSQLAKQAMKGGGSSFTELEALVEELSSLNY

SEQ ID NO: 220082 - protein, 128 aa, Glycine max
  Coding DNA Sequence Number=SeqID_103304
MFWSKPELVCQVRGLWFQDLGDVRFGFGNVSLIKGKSRSFCERKCLRDCGCGGLSFDEGSGGSKEGSGGRNKGFDRKVLSGVVVVLGVVVMSLLVMVKKKRGGGKNGLEEEEDEFVLVLNLKDVVRSF

SEQ ID NO: 220083 - protein, 740 aa, Glycine max
  Coding DNA Sequence Number=SeqID_103305
  Gene Ontology: Mol. function=RNA-directed DNA polymerase activity; Cellular component=chromatin; Biological process=chromatin assembly or disassembly
  Pfam annotation: Domain name=RVP_2; Domain location=15-123; Score= -29.9; E_value=0.00021; Accession=PF08284.2; Description=Retroviral aspartyl protease
  Pfam module annotation: Pfam domain module=RVP_2::RVT_1; Domain location=15-123::238-407
MAGVPATDTFHLYGSINKTRVTILINSGSTHNFIHPRVAKFLNLPVKDTVPLRIMVGNGSVMDCNQLCADMKLFIQEHTFTVTLRILPLSGAEVVLGVEWLRTLGPVITNCASFIMQFSYSGKSINLHADVQTDSSPASANQVKRMISTSSTSGLFHLSLIPMDSTATPSHPFHSILAINELLLKYQSLFQQPSSLPPSRQHDHHINILPTANPINKTEIERQVSTLLDSGLIRPSRSPFSSLILLVKKKDGTWWMCIEYRALNTITVRDHFPLPTIDELLDELGKASWFSKLDLWQGFHQILMAEEDIPKTAFRTHHDHYEYWVMPFGLCNAPSTFQAAMNALLSPFLRKFASVFFDDILIYSATFNDHLHHLECVFNSLLQAHYYLKQSKCLIGQRQLDYLGHIISSSGVRPNPTKIQAIVEWATPRSPKDLRAFLGLTGFYRKFVQGYAAIAAPLTKLHCKNAFQWTSESQDAFDKLKVVMTAAPILSLPDFSIPFALEIKASSTAIGVVLQQHNHPIAYFSKPFCQRLQHASAYVRELHAIITVIRKWRQYLLGLKFTIFTDHRSLRKLMSQVVQTLEQQFYLAKLLGYDYNIQYKAGSSNIITDSLSRRDNHSPGQYFILSAPHPEFMIQLKGTLLATSEFQKQQKAIHSQSEAYPEFLISDDFIIFKGAIWLDSQNPFIPSLLHEYHATPVGGHFGVKKTLHRLQSNFRWPDMLKDVKTFVRHCALCQQIKHIT

SEQ ID NO: 220084 - protein, 53 aa, Glycine max
  Coding DNA Sequence Number=SeqID_103306
MVGTFSQNSVTLIGLPMILPTESDLTYQCVMIRWMAMENLMLENAGTQCSDKM

SEQ ID NO: 220085 - protein, 82 aa, Glycine max
  Coding DNA Sequence Number=SeqID_103307
MAETVAIMAMILVTMTMLCRISGDAGGGSNNVGGRCSNNGDDDACGSSSGDSSSGEGIGYNDDDSGDGYHVVSTMGVAMLCW

SEQ ID NO: 220086 - protein, 81 aa, Glycine max
  Coding DNA Sequence Number=SeqID_103308
  Homolog annotation: Hit_ID=Q8L5H0; Match level="QueryCoverage=60%, HitCoverage=7%, E-value=4e-10, Identity=56%"; Hit description =Sucrose synthase 3
MQKGGFRGIVGHKRFFPLVVVRASEMRLTMKSWIVSYSIRNASQEIGVELQGIPDLIIGNYSDGNLVATLLSYKLGITQVH

SEQ ID NO: 220087 - protein, 119 aa, Glycine max
  Coding DNA Sequence Number=SeqID_103309
MSFEKTLAVVGQTNSSRRCINNNKNVSKGSSDDDNSDDVHDNIGSGVNVVGGSSSNDNTNNDDNNIVVVVVEVQVECNDISTSDDNGGDSDDDDNDNDGGGDNVLVVVAMLVEVVTMLM

SEQ ID NO: 220088 - protein, 129 aa, Glycine max
  Coding DNA Sequence Number=SeqID_103310
MAGEELAGDHTPELLCLVHDIAGMCSALSSSAGSAGAMFRKDCTDLVRRISLLTHLFEEIKELSNNVVGGSSSSPSPSSSASSKWSSDLVLALHSARRLLSVARNFRSNCSSVSFTIHFQTTSFCSVFE

SEQ ID NO: 220089 - protein, 539 aa, Glycine max
  Coding DNA Sequence Number=SeqID_103311
  Gene Ontology: Mol. function=ubiquitin-protein ligase activity; Cellular component=ubiquitin ligase complex; Biological process =protein ubiquitination
  Homolog annotation: Hit_ID=Q6Z2K3; Match level="QueryCoverage=98%, HitCoverage=84%, E-value=1e-155, Identity=57%"; Hit description =Putative Avr9/Cf-9 rapidly elicited protein 276
  Pfam annotation: Domain name=Arm; Domain location=289-329; Score =41.3; E_value=3.4e-09; Accession=PF00514.13; Description =Armadillobeta-catenin-like repeat
  Pfam annotation: Domain name=Arm; Domain location=332-370; Score =13.3; E_value=0.27; Accession=PF00514.13; Description=Armadillobeta -catenin-like repeat
  Pfam annotation: Domain name=Arm; Domain location=371-411; Score =43.8; E_value=5.7e-10; Accession=PF00514.13; Description =Armadillobeta-catenin-like repeat
  Pfam annotation: Domain name=Arm; Domain location=412-452; Score =14.7; E_value=0.18; Accession=PF00514.13; Description=Armadillobeta -catenin-like repeat
  Pfam annotation: Domain name=Arm; Domain location=453-493; Score =24.6; E_value=0.00035; Accession=PF00514.13; Description =Armadillobeta-catenin-like repeat
  Pfam annotation: Domain name=Arm; Domain location=495-535; Score=5.4; E_value=2.6; Accession=PF00514.13; Description=Armadillobeta-catenin -like repeat
  Pfam annotation: Domain name=U-box; Domain location=160-233; Score =84.5; E_value=3.4e-22; Accession=PF04564.6; Description=U-box domain
  Pfam module annotation: Pfam domain module=Arm::Arm::Arm::Arm::Arm::Ar m::U-box; Domain location=289-329::332-370::371-411::412-452::453 -493::495-535::160-233
MGAAKTIVFQFQCVTWKLEKLLSNLPYDDLDISEEVKEQVDLVRTQLRRATDKYGFMISKMPSHELSQPLAEEISQVLGKSVSRLHKQQSCPENLSELDSIPINDEGKCCSTNPARSRLERTRSIPTEVEVSLNAIEPESQEISETKSLPEVKKTEGIVIPEDFLCPISLELMRDPVIVATGQTYERSYIQRWIDCGNTTCPKTQQKLQHLTLTPNYVLRSLISQWCIEHNIEQPTGLTNGKLKKSDGSFRDVTGDIAAIEALVWKLSSRSVEERRSAVTEIRLLSKRSTDNRILIAEAGAIPVLVNLLTSEDVLTQDNAVTSILNLSIYENNKGLIMLAGAIPSIVQVLRAGTMEARENAAATLFSLSLADENKIIIGASGAIPALVELLQNGSPRGKKDAATALFNLCIYQGNKGRAIRAGIITALLKMLTDSSKSMVDEALTIMSVLASHQEAKVAIVKASTIPVLIDLLRTGLPRNKENAAAILLALCKRDADNLACISRLGALIPLSELARNGTERAKRKATSLLEHIHKLQQL

SEQ ID NO: 220090 - protein, 80 aa, Glycine max
  Coding DNA Sequence Number=SeqID_103312
MDPNRNRRLHVGDYLVIHASKDLKAGAEEIIGCLRLEELKRNGGVVEKEKLFKTEEKCFERKWKNKQRIWRLKANIMPLS

SEQ ID NO: 220091 - protein, 37 aa, Glycine max
  Coding DNA Sequence Number=SeqID_103313
MDRLNMQIIIVALVTSGNKETYIWLLEQFNDAMKECD

SEQ ID NO: 220092 - protein, 390 aa, Glycine max
  Coding DNA Sequence Number=SeqID_103314
  Gene Ontology: Mol. function=nucleic acid binding; Biological process= transport
  Homolog annotation: Hit_ID=Q8H6Q8; Match level="QueryCoverage=100%, HitCoverage=51%, E-value=5e-47, Identity=36%"; Hit description=CTV.20
  Pfam annotation: Domain name=DUF755; Domain location=153-252; Score= -37.7; E_value=0.034; Accession=PF05501.2; Description=Domain of unknown function (DUF755)
  Pfam annotation: Domain name=zf-CCHC; Domain location=262-279; Score =30.4; E_value=6.5e-06; Accession=PF00098.13; Description=Zinc knuckle
  Pfam module annotation: Pfam domain module=DUF755::zf-CCHC; Domain location=153-252::262-279
MVATAYQTSHECSEETIIDILVAGFSGQLKGWWDNYLTNEEKSKIYSAVKTDLNGKVITNDDDKEIPDAVNTLIFTIAQHFIGDPSLWKDRSAELLSNLKCRTLADFRWYRDTFLTRVYTREDSQQPFWKEKFLAGLPRSLGDKVRDKIRSQSANGDIPYENLSYGQLISYVQKVALKICQDDKIQRQLAKEKAQTKRDLGSFCEQFGLPACPKQKKKQTSRKEAQDHKPANRRRFSKRRYSQKPSTSREMENPKQKIKLKITCYNCGKQGHISKYCRLKKKLRNLNLEPSIEEQINNLLIETSKEETETETSSSVLSDENLNLIQQDDQLSSTNDDGQINTLTREQDLLFEAINSIPDPQEKKVFLEKLKKTLEVKPRQKDFITNNKFD

SEQ ID NO: 220093 - protein, 91 aa, Glycine max
  Coding DNA Sequence Number=SeqID_103315
  Gene Ontology: Mol. function=oxidoreductase activity; Biological process=response to red or far red light
  Homolog annotation: Hit_ID=Q4W8C1; Match level="QueryCoverage=97%, HitCoverage=28%, E-value=1e-27, Identity=69%"; Hit description =Gibberellin 2-oxidase
MVKKLIVKACEEYGFFNVINHGVPRDTIAKMEEAAFDFFAKPMAQKKQVALYGCKNIGFNGDMGEVEYLLLSATPPSVAHLKNISNVPSNF

SEQ ID NO: 220094 - protein, 86 aa, Glycine max
  Coding DNA Sequence Number=SeqID_103316
MVEHSHRGFDVVGEEFDVIRGEGSSIKNNTPNGEQEFHLIRDEGSSIKNNTPNGTPCRACRPWIFFTNGVLCFLKINDNGMEKDER

SEQ ID NO: 220095 - protein, 64 aa, Glycine max
  Coding DNA Sequence Number=SeqID_103317
MGAKHLTRTKEWLHVIKQRSPDENQCMTLISLLSVDESRGPPGCACNSPPPIGDQPGSPKVFPT

SEQ ID NO: 220096 - protein, 103 aa, Glycine max
  Coding DNA Sequence Number=SeqID_103318
MRELEKSNSSLIQLREWKKKSAYSKKLYKNYTIPGISEAHIAFKLNIIDSVIDHGIQGWEHKQSRKGQKEREVLGTSSQWVALSGHCPSATVSNVKGGELVME

SEQ ID NO: 220097 - protein, 104 aa, Glycine max
  Coding DNA Sequence Number=SeqID_103319
MDSEAEALEHMKKRDRGHQSVSLENKTGDSTVVKMSEKNNNADADDCMILDDHEGEEHYCGKGTNARSVSFLPRSQEKIGDSAKVVIEQDMKGGEHKYGFNNNN

SEQ ID NO: 220098 - protein, 204 aa, Glycine max
  Coding DNA Sequence Number=SeqID_103320
MWTPPTSLEPRESLPSAICQFSILNLIRRPMNSLPSAVHVDSTNESGAPRIHCLALPANSLPSAVRQFSILNLIRRPMNSLPSAVHVSSTNESGAPRIHCLALFANSPFSNLIRRPINSLPSAVHVSSTIESGAPRIHCLALFANSPFSILSGDPLIHCLALFIPMNSLPSAGHVSSIIESGAPRIPCLALDAHSPFSVFFGDP

SEQ ID NO: 220099 - protein, 99 aa, Glycine max
  Coding DNA Sequence Number=SeqID_103321
  Gene Ontology: Mol. function=ribonuclease H activity; Biological process=DNA integration
MKKAFDKKVHLRKFHEGDLVLKKMSHAVKDNRGKWAPNYEGPFVVKRAFSGGALVLTNMDGEELPSPVNSDVGFPVYWAGSSRATFWGGDKVKAAGTNQ

SEQ ID NO: 220100 - protein, 150 aa, Glycine max
  Coding DNA Sequence Number=SeqID_103322
  Subcellular localization annotation: CTP_CleavageSite=82; ConfidenceScore=5.11e-01
MTTRDFDDANSQVFFVDNSSELQEIQETKVTSTTPFAAINRFFFRNSANFSVLKALGLFGFRRLSQRAWLAERELVNFRLARMGALSARRDHDLAGRAGCGLDVQISELSSSRISYPLSELDVSLSGCISLSGSASLSESSTALTFSSLA

SEQ ID NO: 220101 - protein, 79 aa, Glycine max
  Coding DNA Sequence Number=SeqID_103323
MESIKNEFCETVRVRLKWIWRRNGKGGVAARLLEKGDACGEMVAQWAKMLRSRDEFLDMDYDEMVMETKAAYVQQPPRK

SEQ ID NO: 220102 - protein, 450 aa, Glycine max
  Coding DNA Sequence Number=SeqID_103324
  Homolog annotation: Hit_ID=Q6K5F5; Match level="QueryCoverage=68%, HitCoverage=98%, E-value=2e-84, Identity=44%"; Hit description =Mitochondrial transcription termination factor-like protein
  Pfam annotation: Domain name=mTERF; Domain location=107-438; Score =92.4; E_value=1.3e-24; Accession=PF02536.5; Description=mTERF
MPLGAQLPFPAKVFFCQAKSGIDGSLNLKVVSPTLLVAEKEEAKAVLTLFLKKQGLSNAIAARTSKKSDHFIDHLVSRLHSKHKSWYLAGRELTTLEIRDALIPYLESLFEEHGDILVDVVENYPNPPGKDKSAVLVPPSNPVLDSKKLKAVSRVSETDPDGGNLRPHIVYLMELGMDIEQIRSITRRFPSFAYYSLEGKIKPVVEFFLELGVPKENIPTILTKRPQLCGISLSENLKPTMKFFESLGVDKNQWPKVIYRFPALLTYSRPKVMESIDFLLELGLSEEGIGKILTRCPNIVSYSVEDNLRPTAKYFRSLGVDVGILLFRCPQNFGLSIETNLKPVTEFFLERGYTLEEIGTMISRYGALYTFSLTENLIPKWDFFLTTGYPKSELVKFPQYFGYNLEERIKPRFEIMTKSGVKLLLNQVLSLSSSNFDEALKKKMKKMQVS

SEQ ID NO: 220103 - protein, 185 aa, Glycine max
  Coding DNA Sequence Number=SeqID_103325
MSTSEFSHDTWKEKERELVFYLKGTNVEQWKHKNISMKSETIKPGKHQWGNNRGERETKSSKQQRRKRRREKRKQQHGADEKTQKRKKGLPAKGEMEAVSSNGGSLAARRRRAETVFVLVGWAVFGRVCPLVGPRPITRLLHITVSGDGSDNRHRIAPELYSFVCPVRLRCGTRHFGGVSVLHRL

SEQ ID NO: 220104 - protein, 69 aa, Glycine max
  Coding DNA Sequence Number=SeqID_103326
MTKNERRTTKNDEERWEIFTKSLMETSRKRYGSASAWIFFTEIIFLTNFKGKEAGGCRPARPGELSSPR

SEQ ID NO: 220105 - protein, 65 aa, Glycine max
  Coding DNA Sequence Number=SeqID_103327
MYWKQVAQKHLIWFKTTLDNVWVVSKDMDDSLKGKEQVNEIMAMISYIVGILNNASANVILSYYK

SEQ ID NO: 220106 - protein, 80 aa, Glycine max
  Coding DNA Sequence Number=SeqID_103328
MYNYASTLEQRDKKLKVVIVAPTPSKERKNTNCCITKSVILGVGFEAMDYKITWKFSDRKRKIMAQQPQRKPPQYLKDYV

SEQ ID NO: 220107 - protein, 74 aa, Glycine max
  Coding DNA Sequence Number=SeqID_103329
MNDDSSDGLSNHNDSPRLIWDRRIGWVYKPKGSQEPDKERDEDQSLVSPKEGGNKIDDPIRGGEIVPFEAVPSK

SEQ ID NO: 220108 - protein, 95 aa, Glycine max
  Coding DNA Sequence Number=SeqID_103330
MESFMDQVKLVLMVSPLLLLLVVHFLCNYGSAGGVMSTLIPLPERESLHRAGGTPWGVGLVLVLLLFMVSYQSSFQERWFPILTRDMVFLQYMKM

SEQ ID NO: 220109 - protein, 169 aa, Glycine max
  Coding DNA Sequence Number=SeqID_103331
MANLWPLPIQSLASFVPMVSNGSLIDDHFSHVEQFMLGDIPFDTAMLKSQLRLLLAHKSTYTTNFQAVEVEQQADLFDQAKQDLIAPPFAPSTLTTPSSVISPTRIMYHIVEVVTGISSALATNVAHNIFVITTSVGVGLADPYKDDIGCNGTSSTEPIDMTIGLATNP

SEQ ID NO: 220110 - protein, 195 aa, Glycine max
  Coding DNA Sequence Number=SeqID_103332
MEVQSPAAKRHYDITMSRRTRKQQQQQRQQQQQFPVQGNEKTKSTMDDDEATPKDADVHVTVETKATQTVSVAGEVKEGGESDHKSLKQLIIGDDDHKEAKKGSSNNNSNNNNSDHERGGKGGSRNSLGEHFTEEEKQHNLQLVRMQQNKDNLQGLKLKKLVRRYAKVLGHLMKAKRDPHLGGDAGKKPVFKLSA

SEQ ID NO: 220111 - protein, 97 aa, Glycine max
  Coding DNA Sequence Number=SeqID_103333
MTMVVTSSATMMYEYGFGFSSITKSRVRVRIRIWGHVGELGLGIGETILIPVPPHCHVWMMLEIPVVVSMVMTVAVVVVMEVTLVVAAMQMVMAVAM

SEQ ID NO: 220112 - protein, 217 aa, Glycine max
  Coding DNA Sequence Number=SeqID_103334
  Homolog annotation: Hit_ID=Q2QYH0; Match level="QueryCoverage=53%, HitCoverage=17%, E-value=1e-16, Identity=45%"; Hit description =Expressed protein
  Pfam annotation: Domain name=DUF936; Domain location=1-215; Score= -251.5; E_value=0.00033; Accession=PF06075.3; Description=Plant protein of unknown function (DUF936)
  Pfam annotation: Domain name=Rep-A_N; Domain location=3-105; Score= -26.2; E_value=0.038; Accession=PF04057.3; Description=Replication factor-A protein 1, N-terminal domain
  Pfam module annotation: Pfam domain module=DUF936::Rep-A_N; Domain location=1-215::3-105
  Subcellular localization annotation: CTP_CleavageSite=21; ConfidenceScore=5.02e-01
MASLTPGVLSKLLDNAGSKVTAPHRQALLQVTEIVPRLSSTSPLQSRGYFLKLSDSLHSAYVSVPDADADLISAGKLNLGQFVYVTRLDAASPVPLVRGLNPLPKRRPCVGNPIELVPSERLRVTTTTTKKKKKKVEVFKRGKGSPEWKKEKGLEMMRRLSLDSSRRVWDHSPVSEGITASASNKLKAKKSNPTLPNVCYCSPFLPFVFLCTKLACI

SEQ ID NO: 220113 - protein, 54 aa, Glycine max
  Coding DNA Sequence Number=SeqID_103335
MSKGLGICAKEAELDFIMSQRKKRKSVGMRYMVEVKRRKGRWDRAGMKSEMDVI

SEQ ID NO: 220114 - protein, 310 aa, Glycine max
  Coding DNA Sequence Number=SeqID_103336
  Gene Ontology: Mol. function=oxidoreductase activity; Cellular component=proton-transporting two-sector ATPase complex; Biological process=flavonoid biosynthetic process
  Homolog annotation: Hit_ID=Q1SIC0; Match level="QueryCoverage=90%, HitCoverage=77%, E-value=1e-134, Identity=80%"; Hit description=2OG -Fe(II) oxygenase
  Pfam annotation: Domain name=2OG-FeII_Oxy; Domain location=210-303; Score=72.5; E_value=1.3e-18; Accession=PF03171.10; Description=2OG -Fe(II) oxygenase superfamily
MLKNQPQPDWPEPIVRVQSLSENCEDSIPERYIKPSTDRPSIKSCNFDDANIPIIDLGGLFGADQHVSASILKQISDACKEWGFFQVTNHGVNPDLMDKVRETWREFFHMPMEVKQQYANSPKTYEGYGSRLGIEKGAILDWSDYYFLHYLPFSLKDYNKWPASPPSCREVLDGYGRELVRLCGRLMKAFSINLGLDEKILQNDFGGEDIGACLRVNFYPKCPRPELTLGLSSHSDPGGMTMLLPDDQVPGLQVRKCDDWVTVKPAKHAFIVNIGDQIQVNNLPLIHAVLLSLCTKLYTWWDPCEVELLV

SEQ ID NO: 220115 - protein, 139 aa, Glycine max
  Coding DNA Sequence Number=SeqID_103337
  Gene Ontology: Mol. function=RNA-directed DNA polymerase activity; Cellular component=intracellular; Biological process=RNA-dependent DNA replication
MVEEQNDKTTLTPNEDILVKGLPEKRDGYGKKEVSLEEASEFLHIIQQSEFKVIEQLNETPATVSLLELLMSSEAHRALLVKVLNEAHVAQDISVEGFGRLVNNITANNYLPFAEEEVPAEGRGHNRLCMYQSNAWTTS

SEQ ID NO: 220116 - protein, 110 aa, Glycine max
  Coding DNA Sequence Number=SeqID_103338
MVSGASGDFRNTSFKIFENLGGGGSCFKNVQDPFGYAFGYFLFTKTRFREEKSSRSCFCNASVSDSVEILHRSSSFFTVLHPFSFVLRSSTVFFSSLLTCLSHLFKSFLA

SEQ ID NO: 220117 - protein, 116 aa, Glycine max
  Coding DNA Sequence Number=SeqID_103339
  Gene Ontology: Mol. function=oxidoreductase activity, acting on single donors with incorporation of molecular oxygen, incorporation of two atoms of oxygen
  Homolog annotation: Hit_ID=Q69ND5; Match level="QueryCoverage=96%, HitCoverage=22%, E-value=9e-30, Identity=51%"; Hit description =Crocetin dialdehyde-like
YNVIMDFPLTIDLNRLLRRGPLIKYNKEEYARIGVMPRYGDANSIKWFEVEPNCTFHMINSFEDGHEASYLEVVVRGCRSLDSLIPGPDPSLNEFEWLSRCHEWQLNMQTGEVKER

SEQ ID NO: 220118 - protein, 553 aa, Glycine max
  Coding DNA Sequence Number=SeqID_103340
  Gene Ontology: Mol. function=binding; Cellular component =intracellular; Biological process=RNA processing
  Homolog annotation: Hit_ID=O64858; Match level="QueryCoverage=96%, HitCoverage=97%, E-value=1e-169, Identity=54%"; Hit description =Expressed protein
  Pfam annotation: Domain name=DUF946; Domain location=22-552; Score =995.5; E_value=1.8e-296; Accession=PF06101.2; Description=Plant protein of unknown function (DUF946)
MGNCLTTCYCAGKVIQKNQALPINTIFKLPVHVTNSWPPGGNFASGTIDLGGLQLYEASTFNKVWGTYSGGPDDRGFSIFEPSGIPQGFSMLGSYSQPNNKPLFGYVLVAKDVSTNTSNPSLKQPLDYTLVWNSASLKIDQDGPIYVWLPTAPQGYKAVGYVVTTTPTKPSLDKIRCARLDLTDQCEANSFIWGSDNFNFYDVRPSNRGTQAPGVRVGTFVAQNGSPNPPSIVCLRNTNAIPKYMPNLPQIKAILQVYSPVMSLHPDEEFFPSSVEWFFSNGALLYKKGQESKPVSISPNGANLPQDPNIDGAYWVDLPADSTNKERVKKGDLKSAISYVHVKPMLGGTFTDIAMWVFYPFNGPARAKVEFLTVNLGKIGEHVGDWEHVTLRVSNFNGELKHVYFSQHSKGVWFDSSQLEFQSGNKPLYYSSLHGHASYPHGGLNLLGEDKIGIRNDTAISDNVMDLGAFQLVSAEYLGSDVVEPPPWLNYFREWGPKIDYNVNDELRKLEKFLPGKLKSTLENIVKNLPSEVLGEEGPTGPKVKDNWSGDER

SEQ ID NO: 220119 - protein, 457 aa, Glycine max
  Coding DNA Sequence Number=SeqID_103341
  Homolog annotation: Hit_ID=Q943L5; Match level="QueryCoverage=20%, HitCoverage=22%, E-value=3e-15, Identity=44%"; Hit description =Putative auxin-regulated protein
  Pfam annotation: Domain name=DUF966; Domain location=41-425; Score= -75.1; E_value=1.8e-08; Accession=PF06136.4; Description=Domain of unknown function (DUF966)
MSVPCVAGRQRDKDLIKGKKKNNKAREIGMEGKGGGEVRRLHIIYFLSQIGGRADHPHLIRVLHLARNGVYLRDVKRWLGELRGKDLPDAFAWSYKSRRYKSGYVWQDLLDDDLITPISDNEYVLKGSQIHPTPFTTTPSLAEKKIAVCDIHAEKKCTQVQLVEDENQQPQQQPLAEEEPRIQQDLNSKIDTLTKGSSEISQDSSLVFSSDRSSVTDDDSSKVEEEKHIEATGKKGFNEINQEKLETCSLPSLYHNLLITKASHKDDLNKTSSPESSFSTISSSSSQSSFTKIRSNSTKVSNVFRNWITCGTVETKDAALVLMNPAQKNLSKEPINIPERRVEICKGDKLGGSARCFRTSWGPHHQKQQYGARKSFEGNETNRSRKKLGELLNQTSSKPFGGPTCSQCGKSFKPEKMHKHMKSCKGMKALGKSSTTVEEAQLQGSSSSSYTDYFLTN

SEQ ID NO: 220120 - protein, 518 aa, Glycine max
  Coding DNA Sequence Number=SeqID_103342
  Gene Ontology: Mol. function=binding; Cellular component =intracellular; Biological process=RNA processing
  Homolog annotation: Hit_ID=O64858; Match level="QueryCoverage=93%, HitCoverage=86%, E-value=1e-144, Identity=52%"; Hit description =Expressed protein
  Pfam annotation: Domain name=DUF946; Domain location=15-517; Score =913.8; E_value=7.4e-272; Accession=PF06101.2; Description=Plant protein of unknown function (DUF946)
MASSLGQFKKKQNPRIETTFKLPADIPVWPPGGGFATSIIDLGGGLLLSQISTFNKVWTTYEGGPNNLGATFFEPTGLSEGFFMLGCYCQPNNKPLHGWVLVGKDNSSTLNGALAKPVDYKLVWNTKSLKIKQDGQGYIWLPIAPEGYKPVGHVVTTSPEKPSLDKIRCVRSDLTDECTTCHSMKLWRTENKRFNVYDVRPIKRGIEAQGVSVGTFLAQSGGGTNSKALPISCLKNTKGSFSYMPNLSQIKAMIKAYSPYMYLHPMEEYLPSSVDWFFTNGAVLIEKRKGVIRESSIEPNGSNLPQGGSNDDDDVTYWLDLPLDETKRVSIKKGDLASSQAYVHVKPMLGGTFTDIVMWIFYPFNGGARAKVACTNIPLRTKGEHVGDWEHLTLRVSNFNGELWRVYFSQHSEGKWVDASELDFQNGNRPAAYSSLHGHALFPKPGLVMQGMRGLGVRNDAARSDAVMDMATWFEIVAAEYLGSQIREPPWLNYWMNWGPKEGPKGPKQKDMWKGDER

SEQ ID NO: 220121 - protein, 79 aa, Glycine max
  Coding DNA Sequence Number=SeqID_103343
MKHLVTSTKGYKFNIKLLSISCGSDTDDGGKVAKLVDEVISAKEITIEEGGEGGGGEKRREKMEWCVPSEITSDGGKSD

SEQ ID NO: 220122 - protein, 367 aa, Glycine max
  Coding DNA Sequence Number=SeqID_103344
  Homolog annotation: Hit_ID=Q2QYH0; Match level="QueryCoverage=84%, HitCoverage=40%, E-value=3e-13, Identity=23%"; Hit description =Expressed protein
  Pfam annotation: Domain name=DUF936; Domain location=5-367; Score= -139.0; E_value=4e-08; Accession=PF06075.3; Description=Plant protein of unknown function (DUF936)
  Subcellular localization annotation: CTP_CleavageSite=47; ConfidenceScore=5.35e-01
EIDKKVFSVKPDSPLKSPTSSISPLKNKNENLCPKSLTSTPCGGTVHSQLVKVPLNCKSWRHDTPACCEDVSSPMCDLGKQVVAHRNVAFLAAVRSLEEASATDTVIQCMCMYAELCQSGQTHSPGSLVKQFLELHLSLQRVTVLIDLLLNPFPETKSSSHSTLQCLTEDACKVPARKNAISWVQAAIGTNLSKFNLFKTQAKSEVLNGEKCHYVVIESSPEDINTENSPAQNKQNRVTQANHLPNSTAKKLPSSKRNLLAAKNKDADKHDRSKEIKLKEVASLAEKLLEASSEWFLKYLEESLSNEYGLKNEGNIEIASLLGQLKQVNHWLDNLAGGDKVDHRVEKLRKNLYRFLLEHVNSAVTCN

SEQ ID NO: 220123 - protein, 69 aa, Glycine max
  Coding DNA Sequence Number=SeqID_103345
MVGEVAGRGLSVADKENKKKDKKALFMLHHQCIDVANFDKIIGATFAKQAWEILEKSHGDGEKFKMARL

SEQ ID NO: 220124 - protein, 82 aa, Glycine max
  Coding DNA Sequence Number=SeqID_103346
MGVNVGIICVLFLLATQAIGVPAFAPWKKLQLPWKKPSKDEKAIITLIIVGKRRKIWYSLSQLLEYENHVLAKVIMEDKFKS

SEQ ID NO: 220125 - protein, 94 aa, Glycine max
  Coding DNA Sequence Number=SeqID_103347
  Gene Ontology: Mol. function=phosphoribosylanthranilate isomerase activity; Biological process=tryptophan metabolic process
  Homolog annotation: Hit_ID=Q1SIB5; Match level="QueryCoverage=84%, HitCoverage=25%, E-value=6e-18, Identity=60%"; Hit description=N -(5phosphoribosyl)anthranilate isomerase
MAAEQMRTENRESSSTGSYLQLRAAKFHMRPISGSSILCPSSGLRGEKLQFSSVRFGLKHKISCKLTDVGNDLSSSKELGKCQPLVTMCGITSG

SEQ ID NO: 220126 - protein, 100 aa, Glycine max
  Coding DNA Sequence Number=SeqID_103348
MSLTIVKRWKKNPLYAKFRNKRLSFAHKLTKFFKDVIANGEFQRPPSSRILPVGVEVDMNNVYRPSLDGIGINVEESLGDSEDASVSATNGMIGPYRCEH

SEQ ID NO: 220127 - protein, 93 aa, Glycine max
  Coding DNA Sequence Number=SeqID_103349
  Homolog annotation: Hit_ID=Q8H3I3; Match level="QueryCoverage=40%, HitCoverage=12%, E-value=9e-14, Identity=94%"; Hit description =Putative 40S ribosomal protein
MANRNGLKAQIGHTAQPTPPQPLLPPGAMAAADSSAAPSHQLSQRETDIQMMLAADVHLGTKNCDFQMERYVFKRRTDGHCSILNFSFLFILC

SEQ ID NO: 220128 - protein, 87 aa, Glycine max
  Coding DNA Sequence Number=SeqID_103350
MGEGYCTQPYPCIRSLTLTYEKSSRNEIRFRNKYGFQSLDTICIGNIKMHVNLPRFVRGGGREDVSKGVGRKECVLGASGEQHKVGG

SEQ ID NO: 220129 - protein, 120 aa, Glycine max
  Coding DNA Sequence Number=SeqID_103351
  Gene Ontology: Mol. function=structural constituent of ribosome; Cellular component=small ribosomal subunit; Biological process =translation
  Homolog annotation: Hit_ID=Q1SHZ2; Match level="QueryCoverage=77%, HitCoverage=26%, E-value=2e-11, Identity=45%"; Hit description =Ribosomal protein S2, eukaryotic and archaeal form
MQVDLFFYREPEEAKQQEEDEAPPAQDYAISDFNAAGIGSFPASDGQWPAAVEQPWTEEAPQPISAAPTNLTPEAAVTICLTEVPLAVAGDWGEAVPAPVPAPQAGVPPAQAFPPATGWD

SEQ ID NO: 220130 - protein, 124 aa, Glycine max
  Coding DNA Sequence Number=SeqID_103352
MEIKVAEVNKDLLEQCLVGREFSNSEVNSMGSEFGSLGITLPSLNVWNKYTKKGFYILAMKWGGKRDFNKRKPRRRQRWMLVIVLWIMALKGTKIIGDIEMCKGEQVDRKVTTKDLMLAKGVTS

SEQ ID NO: 220131 - protein, 58 aa, Glycine max
  Coding DNA Sequence Number=SeqID_103353
  Subcellular localization annotation: CTP_CleavageSite=13; ConfidenceScore=5.15e-01
NLQQAQMSMLGVVASPAPHVVAPAPPAIVQPPPTTVEPTPPPPPPTQPSSPPQVQEWQ

SEQ ID NO: 220132 - protein, 102 aa, Glycine max
  Coding DNA Sequence Number=SeqID_103354
MTLPDIITTTQSSIRDDGVTSIITALWYHCPVYQFNGHVEYKTIQIIDEEVMQAPLELVGLGSSSSMDSFASWKINGSGMEKEEREETPLQGEDESRRSSPP

SEQ ID NO: 220133 - protein, 128 aa, Glycine max
  Coding DNA Sequence Number=SeqID_103355
MGDELYDELLGEVPPDNAHKEVTLKLTWLLSILRTSLPEEPTIYQLQCMCRAYIIYMIVFLGHIENLKNTHQDMHTETGTFVVSIHTENPKTEQQHYHHEGELVIHERRNSRRNRHPPPYGTGHHLGH

SEQ ID NO: 220134 - protein, 119 aa, Glycine max
  Coding DNA Sequence Number=SeqID_103356
MELRIVATCPFAGERGEAHGCAFQRRKDARSRHQCLFVENVGKTEGNRSKRIFQVRELYLRLRKVDKSGALAPTYPPSKRKSDLRSSFLRVNQAILFTWKMIILRRWTSKTIHLLGKKN

SEQ ID NO: 220135 - protein, 136 aa, Glycine max
  Coding DNA Sequence Number=SeqID_103357
  Pfam annotation: Domain name=zf-CCHC; Domain location=60-77; Score =12.8; E_value=0.0076; Accession=PF00098.13; Description=Zinc knuckle
MTLELVGILKVHEKELAQDEGTKKGKSLALTMQRLKCNYVSKEFIGSSKRSFSKKEKSPIIFYKCNKSGHFMLECPDLEKPKNKKKKLFKSKKKSLMSTWEDLDDSSFDEDNEEEANLCLMANVSTYKVEPTLDAS

SEQ ID NO: 220136 - protein, 120 aa, Glycine max
  Coding DNA Sequence Number=SeqID_103358
  Gene Ontology: Mol. function=oxidoreductase activity; Biological process=response to red or far red light
  Homolog annotation: Hit_ID=Q6TN17; Match level="QueryCoverage=99%, HitCoverage=37%, E-value=3e-32, Identity=57%"; Hit description =Gibberellin 2-oxidase
MVAPFPISTRSEKILPIDLPVVDLTAERSMVTKLIVKACEEYGFFNVINHGIPRDTIAEMEETAFDFFAKPMAQKKQLALYGCKNIGFNGDMGEVEYLLLSATPPSISHFKNISNMPSKF

SEQ ID NO: 220137 - protein, 561 aa, Glycine max
  Coding DNA Sequence Number=SeqID_103359
  Gene Ontology: Mol. function=protein serine/threonine kinase activity; Cellular component=cytoplasm; Biological process=protein amino acid phosphorylation
  Homolog annotation: Hit_ID=Q1SXL1; Match level="QueryCoverage=95%, HitCoverage=94%, E-value=0.0, Identity=75%"; Hit description =Serine/threonine protein kinase, active site
  Pfam annotation: Domain name=Pkinase; Domain location=166-501; Score =249.4; E_value=7.3e-72; Accession=PF00069.15; Description=Protein kinase domain
  Pfam annotation: Domain name=Pkinase_Tyr; Domain location=166-495; Score=-42.1; E_value=6.9e-10; Accession=PF07714.7; Description =Protein tyrosine kinase
  Pfam module annotation: Pfam domain module=Pkinase::Pkinase_Tyr; Domain location=166-501::166-495
MEHKLSEAAHPSAHSSSANSGNNSPTHPKNVNQEAKDTSTTTVHYSGNETGHMDQASKTEANLEGKSRPQNLLPPNRNLSDFNPQQHQSPSTKKPNSNSDHHAKAMSVSTPQTKTSTNQGQGSGASSRSDSLESTSAPIRPHTGGDVRWEAINMISRVGSLNLSHFRLLKRIGYGDIGSVYLVELKGTRTYFAMKVMDKAALISRNKLLRAQTEREILGLLDHPFLPTLYSYFETDKFYCLIMEFCSGGDLHSLRQKQPNKCFTEEAARFYASEVLLALEYLHMLGIVYRDLKPENLLVRDEGHIMLSDFDLSLRCSVSPTLVKSSSAHAGNSSSSGNNDVGGILTDDQAAQSTTQVSSFFPRILPSKKNRKAKSDFGLLVGGGRLPELMAEPTNVRSMSFVGTHEYLAPEIIKGEGHGSAVDWWTFGIFLYELLLGTTPFKGSGYKATLFNVVGQPLRFPETPQVSAVARDLIRGLLVKEPQKRIAYKRGATEIKQHPFFEGMNWALVRSATPPHIPEAIDFSKYASKDTATPADKKMADIANDKHSNSATDSYIDFEYF

SEQ ID NO: 220138 - protein, 65 aa, Glycine max
  Coding DNA Sequence Number=SeqID_103360
MVGYCMRKEVERMRKMMKGRKVGNSNNYMGVFIRKKKYHVKDERLILRLQVLKLASVEYASVTFG

SEQ ID NO: 220139 - protein, 73 aa, Glycine max
  Coding DNA Sequence Number=SeqID_103361
METPSTLTTTMAHGSRPWSSLWAHRPNHNLEWIFYKVLKRNLDLFSSKHVLDILKGEEHHESVLGYEGALRSQ

SEQ ID NO: 220140 - protein, 609 aa, Glycine max
  Coding DNA Sequence Number=SeqID_103362
  Gene Ontology: Mol. function=CTP synthase activity; Cellular component=cellular_component; Biological process=pyrimidine nucleotide biosynthetic process
  Homolog annotation: Hit_ID=Q9LTW8; Match level="QueryCoverage=99%, HitCoverage=99%, E-value=0.0, Identity=72%"; Hit description=CTP synthase
  Pfam annotation: Domain name=CTP_synth_N; Domain location=1-284; Score=686.7; E_value=1.7e-203; Accession=PF06418.4; Description=CTP synthase N-terminus
  Pfam annotation: Domain name=GATase; Domain location=308-545; Score =275.1; E_value=1.3e-79; Accession=PF00117.18; Description=Glutamine amidotransferase class-I
  Pfam annotation: Domain name=Peptidase_C26; Domain location=336-527; Score=-97.1; E_value=0.0052; Accession=PF07722.3; Description =Peptidase C26
  Pfam module annotation: Pfam domain module=CTP_synth_N::GATase::Peptid ase_C26; Domain location=1-284::308-545::336-527
MKYVLVTGGVVSGLGKGVTASSIGLILKACGLRVTSIKIDPYLNTDAGTMSPFEHGEVFVLDDGGEVDLDLGNYERFLDIKLTCDNNITTGKIYQSVIEKERRGDYLGKTVQVVPHVTDAIQEWIERVAKIPVDGKEGPADVCVIELGGTIGDIESMPFIEALGQFSYRVGPGNFCLVHVSLVPILHVVGEPKTKPTQHSVRQLRGLGLTPNLLACRSSKELDDNVKAKLAQFCHVPLSNILTLHDVPNIWHIPLLLKDQKAHEAILKALNLLGVAAEPNLKEWTSRTKVYDRCHEIVRIAMVGKYTGLSDAYLSVLKALLHASVARNRKLIVDWVPAGDLEDATYNEDPEAYKAAWSLLKGANGVLVPGGFGDRGVQGKILAAKYAREHNVPFLGICLGMQIAVIEFARSVLGLHDATSTEFNPETKTPCVIFMPEGSKTHMGGTMRLGSRRTYFEVADCKSAKLYGNVSFVDERHRHRYEVNPDMISPLENAGLSFVGKDETGRRMEIVELPSHPFFIGVQFHPEFKSRPGKPSPLFSGLIAAASESRRTIMVPSNGHAKLTNGNGMCNGHSPKLKAHQKGNGFNSSNGSLNGIYTNGNGVYVDGSC

SEQ ID NO: 220141 - protein, 138 aa, Glycine max
  Coding DNA Sequence Number=SeqID_103363
  Gene Ontology: Mol. function=ribonuclease H activity; Biological process=RNA-dependent DNA replication
  Homolog annotation: Hit_ID=Q1SZM6; Match level="QueryCoverage=88%, HitCoverage=40%, E-value=1e-20, Identity=41%"; Hit description =Ribonuclease H
  Pfam annotation: Domain name=RnaseH; Domain location=12-138; Score= -31.2; E_value=0.047; Accession=PF00075.14; Description=RNase H
MEVFRIFASIFGQFMRLNVDGSSLRNPSPLGYRGFIRNSLGEWITGFSGFCGIATNLYVELFAILQGLKIAWESSCHDIICESNSTLALSKLTQGNVLFHPYVVVINQVKSYMSCAWNLKFIHILKEGNNYANELVKM

SEQ ID NO: 220142 - protein, 53 aa, Glycine max
  Coding DNA Sequence Number=SeqID_103364
MPISLGFNNWSGLRGEQSCSGGGSFSASQCATTHMHMALCSSTTLDGYLSYDG

SEQ ID NO: 220143 - protein, 478 aa, Glycine max
  Coding DNA Sequence Number=SeqID_103365
  Gene Ontology: Mol. function=transferase activity, transferring glycosyl groups; Cellular component=membrane
  Homolog annotation: Hit_ID=Q9FN55; Match level="QueryCoverage=99%, HitCoverage=92%, E-value=0.0, Identity=66%"; Hit description =Arabidopsis thaliana genomic DNA, chromosome 5, P1 clone:MYC6
  Pfam annotation: Domain name=DUF604; Domain location=232-478; Score =614.1; E_value=1.3e-181; Accession=PF04646.3; Description=Protein of unknown function, DUF604
MGEKDSEKLIWEQMRTPTAATPIAAPQQHRTLPRLLVLLILFVSVTYVVYTLKLVSTSRACNNDAPFSTDNFSKTILSVNATAAVLRRGSLETNPEDRTDLRHVVFGIAASAKLWEQRRSYIKLWYRARDMRGVVWLDEEVKSEESSDALPPVRISGDTARFKYTNRQGHRSAIRISRIVSETLRLGMKDVRWFVMGDDDTVFVTENLIRVLRKYDHNQFYYIGSLSESHLQNIFFSYNMAYGGGGFAISYPLAKALQKMQDRCIQRYPGLYGSDDRMQACMAELGVPLTKETGFHQYDVYGNLFGLLASHPVTPLVSLHHLDVVEPIFPNVTRVEALQRLTIPMKFDSAGLMQQSICYDKSKSWTVSVSWGFAVQIFRGVFSPREMEMPSRTFLNWYRRADYTAYAFNTRPVSRNPCQKPFVFYFSKAKYNSTMQQIVSEYERHRVPHPDCKWNMANPAALNKVEVYKKPDPHLWDR

SEQ ID NO: 220144 - protein, 405 aa, Glycine max
  Coding DNA Sequence Number=SeqID_103366
  Gene Ontology: Mol. function=nucleic acid binding; Cellular component= spliceosome; Biological process=mRNA processing
  Homolog annotation: Hit_ID=Q1SD98; Match level="QueryCoverage=60%, HitCoverage=63%, E-value=8e-96, Identity=71%"; Hit description=Zinc finger C-x8-C-x5-C-x3-H type (And similar), putative
  Pfam annotation: Domain name=zf-CCCH; Domain location=303-329; Score =43.7; E_value=6.3e-10; Accession=PF00642.15; Description=Zinc finger C-x8-C-x5-C-x3-H type (and similar)
  Subcellular localization annotation: CTP_CleavageSite=10; ConfidenceScore=5.03e-01
MNNPVRRHAPAAAVVANRSTFTGTKSLPKRGQIKSKIVAGICWKVSDTADFAWASVSQHPNAPTATLKRNVTEVFVGPPLRPLFTTVDSEFGKFSLSTEADLRALDAEPRSLTLECEASLLNFSLCCINILVMEDSDQPAKSAENQQTEQDNEEDSNNETSLLHIQKKTLKPDNKLYFSTGSSKSSASAEPSEEPGKPVFQFESSKEIQVQHDSKATATLETETEFSKDARAIRERALKQAEESLKGKSPSSKNEKLYKGMNSYKDYKAGFRREQTIASEKAGGSHGPLRASAHIRVSARFDYQPDICKDYKETGYCGYGDSCKFMHDRGDYKSGWQMEKEWEEAEKARKMRLAAGEDADEEGANLTDEDDEDSLPFACFICRNTFVDPVVTKCKHYFCEHCALK

SEQ ID NO: 220145 - protein, 125 aa, Glycine max
  Coding DNA Sequence Number=SeqID_103367
MKWKNTFFGHEEWRRTECTAAMEPRRLTKRATRPVLVHRRLGVVEEYVVVCGEEAENEGGNDDALAEEKHLEEWIGGKIDSWWKEIKGVLLLLGARRKKMAFSLEPGWRRGKFQSEKERELEFRE

SEQ ID NO: 220146 - protein, 637 aa, Glycine max
  Coding DNA Sequence Number=SeqID_103368
  Gene Ontology: Mol. function=sequence-specific DNA binding; Cellular component=nucleus; Biological process=regulation of transcription, DNA-dependent
  Homolog annotation: Hit_ID=Q8LLE1; Match level="QueryCoverage=75%, HitCoverage=90%, E-value=1e-135, Identity=54%"; Hit description=BEL1- related homeotic protein 14
  Pfam annotation: Domain name=POX; Domain location=239-368; Score =224.3; E_value=2.7e-64; Accession=PF07526.2; Description=Associated with HOX
MARQLCEEKSKDMASSSHGLFYSDVSSNNPTIQPHLMNHIQGFVTDPDMFNLTTGMDMIGFSKNLQQHSESNGVMMWKSFFGKPGQLAGSSSSKTMNGSCSNFYNQHADAYNTNKQDFTSGISETSSENLVVGGAHDSAPWQENRLMVDDSSLRCVFPCEGNQRPSQGLSLSLSSTNPLSIGLQSFELRQTSHHQHLSDFVSREGFFGKPVNAQQQQQQMLQDGYLSPSKGANIYQGHFLIKNSKFLVPAQVLLNEFCSLGTKENDVLPKQKCSQKNKQWEEGNSGGGSSKNHSLSSLEYVELQKRKTKLLAMLEEVDRRYKHYRNQMKAVVSSFEAVAGNGAATVYSALALKAMSRHFRCLKDGIMDEIEATRKGMGEKDHVAAVPGTTRGETPRLRIVDQSLRQQRAFQQISIMETHPWRPQRGLPERSVSVLRAWLFEHFLHPYPSDVDKHILARQAGLSRRQARVSNWFINARVRLWKPMVEEMYLEEEKEQENDVASSDINVPEEDEKPTQEAPLLRIDSECMSSIVNDVTKSGKTIQNDNQMDAFGSVELDFSSYTHAHHSSGVSLTLGLQQHGESGVSLAFLPAATQSSMFYPRDQIQECQTVQYSLLDAEGQNMPFRNVMGTHLLHDLV

SEQ ID NO: 220147 - protein, 192 aa, Glycine max
  Coding DNA Sequence Number=SeqID_103369
MKHPRDHNLVDFEPHIGYAAERQAFYGVPIPNTLGVLQYRPQPQPLHFTVGRVPLAIVERERFDHIEERLRAIEGGRDYAFVNMVELCLVPDIVIPPKFKVPDFDKYKETTCPKNHLKMYNRKMGAYSKNEKLLMHFFQESLTGAFVTWWRDLAAQVAPPMMEREMITMIVDTLLVFYYEKMVVTCLQALPI

SEQ ID NO: 220148 - protein, 564 aa, Glycine max
  Coding DNA Sequence Number=SeqID_103370
  Gene Ontology: Mol. function=protein binding
  Homolog annotation: Hit_ID=Q75KA7; Match level="QueryCoverage=71%, HitCoverage=76%, E-value=9e-94, Identity=44%"; Hit description =Expressed protein
  Subcellular localization annotation: CTP_CleavageSite=32; ConfidenceScore=5.14e-01
MATLEVQKQPKRPKYRESSVSPSVNPQRRTPEAESPSSYSHRTRFSPIMDFFHSSSPTSNHDSFPSSFSKFNSALTAGLLNPLSPPPDKTRSSPTLFEIMASEPDVPHRPTPLIPPTPNPYPNKPLILDPHALLMQRISELLVSRSPGNQFNDAVSSDIKLTLTSKDGTCVSMNLHRQILVAHSRFFSVKLSDRWTKHQQELQRSPVPYEVEIADCDDVEVYIETLRLMYCKDLRKKLMREDVSRVLGILKVSAAIGFDAGVLSCLEYLEAAPWAEDEEEKVASLLSELRLEAVGAGEVLKRVSTGVANGNEEGSDNEEVLLKLIRVVLEGKDEKARREMKGLVSKMLRENSSQSDLRKESLYLACDDCLQLLRHHFLQAVASDMQDLSQIARQADNLHWILDILVDRQIAEDFLKTWASQSDLAEAHSKVPAVHRFEVSRVTARLFVGIGKGQLLASKDVRCLLLKTWLVPFYDDFGWMRRASKGLDRHLIEDGLSNTILTLPLPCQQDILLAWFNRFLNSGEDCPNIQRGFEVWWRRAFWKRNGEQERTRQFRIATTSVENP

SEQ ID NO: 220149 - protein, 77 aa, Glycine max
  Coding DNA Sequence Number=SeqID_103371
  Gene Ontology: Mol. function=pyridoxal phosphate binding; Biological process=carboxylic acid metabolic process
  Homolog annotation: Hit_ID=Q4H1G0; Match level="QueryCoverage=90%, HitCoverage=16%, E-value=4e-15, Identity=57%"; Hit description =Putative serine decarboxylase
MYSSSSFLGNGVVQNGTKNGERKIVLGRNIHTTCLEVTEPDIDDEVTGEREAYMAGMLAKYKKSLKGPTIIQDTPII

SEQ ID NO: 220150 - protein, 285 aa, Glycine max
  Coding DNA Sequence Number=SeqID_103372
  Gene Ontology: Mol. function=metal ion binding
  Homolog annotation: Hit_ID=Q9XF92; Match level="QueryCoverage=51%, HitCoverage=90%, E-value=2e-37, Identity=54%"; Hit description=BRH1 RING finger protein
MIVGSSEIQEASQLLSCLADFVYCTVCACMQTQHKIEMDKRDGKFGPQPAMAVPPVQQMSRIDQQVPPFVGFPPQPVYGQPAQGYPPAGYHPPATYPPPEYPPAAPIDWFIEQGYIPESLNKSTLHFVRYKGRSAKRAGSLIVPHPTVQTSSVEYVTTIRQPSDLIVFLELAQTHRARLRGIHQLPELHHRQDFPDERGRHGFELFGHSGLGFGPGNVGLEEVVEAHEAEEAANQLPEEAQEGEDVKEKLREEELRVPHWETHQNSDVVSFRVKRKSEREREREK

SEQ ID NO: 220151 - protein, 311 aa, Glycine max
  Coding DNA Sequence Number=SeqID_103373
  Homolog annotation: Hit_ID=Q2HU26; Match level="QueryCoverage=33%, HitCoverage=46%, E-value=1e-23, Identity=54%"; Hit description=CCT
  Pfam annotation: Domain name=CCT; Domain location=226-264; Score =79.4; E_value=1.2e-20; Accession=PF06203.4; Description=CCT motif
  Subcellular localization annotation: CTP_CleavageSite=66; ConfidenceScore=5.11e-01
MSSDLYAFDTTFYTHSNSDSVSSDGVGDLPFLSESFPFFANSQENSNALYNSLDPFSPSFFSFSPPSSHLESLSLYHANHVQPLSNGQNLANEFGSFSAFDGSEVKTEECQMGVDYVYGQQLLPHSHSYSGAENFSKYMLRSFSSNSYEGKPYSDTREDSTKFQSHEMSSPEDTVFGGQMRRVCSTGDLQNMKGNHMSPTEAPLLEESNFKVGRYSAEERKERISKYRAKRTQRNFNKTIKYACRKTLADNRPRIRGRFARNDEASETPKVSCSTRDEDDVDFWMEELRLHEEQDDVTVVTEQYLIEKLWS

SEQ ID NO: 220152 - protein, 78 aa, Glycine max
  Coding DNA Sequence Number=SeqID_103374
  Gene Ontology: Mol. function=kinase activity
  Homolog annotation: Hit_ID=Q1SCC6; Match level="QueryCoverage=64%, HitCoverage=10%, E-value=6e-19, Identity=88%"; Hit description=CBS
MNHKITNSDSDSWPQVVALDVDLPVKQAFHILHEQGVFMAPLWDFCKGQFVGVLSASDFILILREFNLNLFDPAEINL

SEQ ID NO: 220153 - protein, 37 aa, Glycine max
  Coding DNA Sequence Number=SeqID_103375
CCQIFAQNDDLAHSKLKCGVEDKCPIAIGSAQHKARF

SEQ ID NO: 220154 - protein, 903 aa, Glycine max
  Coding DNA Sequence Number=SeqID_103376
  Gene Ontology: Mol. function=transcription initiation factor activity; Cellular component=transcription factor TFIID complex; Biological process=transcription initiation
  Homolog annotation: Hit_ID=Q6SJR0; Match level="QueryCoverage=98%, HitCoverage=100%, E-value=1e-138, Identity=38%"; Hit description =TATA-binding protein associated factor 4b
  Pfam annotation: Domain name=TAF4; Domain location=598-895; Score =358.8; E_value=8.7e-105; Accession=PF05236.4; Description =Transcription initiation factor TFIID component TAF4 family
MDPSIVKLLEDDEDESMHSGADVEAFQAALNRDIGGDTSTSQLSGSDTGSNNSLSQSLPKQPTSTHDKQSDCQNQEPKVVQQQEQQHSSEMEQKPQQPLVEQLQNAASQDANNLPSSQKQSQDESAQGHTAQAPHQNSQTNVTQNSEKDPVFNHEAVNTHNPNHESQYAKLQQMSNQQATVKEQPGSQVDRNKQKDEMPKDQFVRLMKGIVGDQMLRLALTKVQLQTRSNPAPTGQQHPHVRTPNVNSGATKFNDPHALAHLHQRSMNAAADQSNNTSSAVQVKNEPTYPTMDINAKKSRELDVQVESQGAQLNQLPSSSSNAVSQETERSSLHLQGLNKEQQQHLHFPSAYGNSGGNYNPFSGSTSSSTSSIRPQPFDSHMRQIPHQSISPNQLGGSTQGLIGLTKLDQQNSFNDPKRMPGGFVSPVANNTTSQQTSNSWQPSANKEQSSGSFSSVPYVKKEPNDLSTEQQHRHNLSKLHGLHSVNSVQNEQGSSANQGTLKEEFSRGFPASTSMPHTTSSLLPLNSASPSVSQLDPSATLSPQIPSNTSVINARTPLKKPSPGQKKPIEALGSSPPPPSKKQKVSGASLEPSIEQLNDVTAVSGVDLREEEEQLFSGPKEDSRASEASRRVVQEEEESLILQKAPLQRKLIEIINECGLKGVSNDLERCLSLCVEERMRGVISNVIRMSKQRVDLEKTSHRTVVTSDVRQQILTMNKKAREEWEKKQSETEKLRKLNDVDGNAGIDGDKEKDEGRTKATKVNKEVDDKMRTNAANVAARAAVGGDDMLSKWQLMAEQARQKKRGGGMDASSGSQPAKDVSQKSSSTSGRSTKDNQAREKKGPTSGAGRKFGRSHATTPQNSIARSISVKDVIAVLEREPQMSKSSLLYRLYERIHSDTSTE

SEQ ID NO: 220155 - protein, 47 aa, Glycine max
  Coding DNA Sequence Number=SeqID_103377
VVGVECLMEDGVRNLVVPVRRKNLQSLKLFESSGCTFDGLVARVKIL

SEQ ID NO: 220156 - protein, 600 aa, Glycine max
  Coding DNA Sequence Number=SeqID_103378
  Gene Ontology: Mol. function=nucleic acid binding
  Homolog annotation: Hit_ID=Q10Q92; Match level="QueryCoverage=85%, HitCoverage=55%, E-value=1e-106, Identity=41%"; Hit description=CUE domain containing protein, expressed
  Pfam annotation: Domain name=CUE; Domain location=252-294; Score =38.2; E_value=2.9e-08; Accession=PF02845.6; Description=CUE domain
MGPVAETYFTRLCWVLFSSGNLDHHNAAFLQADLLEVMDFINDAIVSMDSFVSAYEPAAVFFSCPVEMSYGNEELLSLLARLHDSLIPSLQKGFRMIFADKQDGTVSNILVSLKMLKIRLVKFGWQLLHLCYLSDEVFRDSIPLLAATKMFPANVEDPVIRADILVQTFREINSVSVHSQESHQKETFLQDVERNFNILSRIERLKDSGWIFIDDEQFQYISGMLSSVYKELYSATTPAPNQTLLMDENAAITESNISQIRDLFPDYGKDFLAACLEVYDQKPEEVIQRILEGTLHEDLQKLDTSLETLPPAKATTVGGNDKGKGKLIDSTSASSNPVVRGKHPAEGTVMSSSASLGKFVRKSRANLPDRSILDKKDEKDTSKTAAMILQYEYEDEYDDSFDDLGLSVADSGVEENETLSDQINAKSGNSWATGGNSVKNAPDSKWGSRKRPQYFVKDGKNYSYKVAGAVAVANSDEASLVTQAQKELIHGLGCGGNLPLGAVKKVMDSYKEDDNQSQSSEMEGRGISGNSFGRGRKESGKQIASHQQQEKQSDDSEVDGNNQRGRGRGSGRGRGGGGGRNNHYQKDRAMKKHFSGMSGY

SEQ ID NO: 220157 - protein, 283 aa, Glycine max
  Coding DNA Sequence Number=SeqID_103379
  Homolog annotation: Hit_ID=Q10Q92; Match level="QueryCoverage=57%, HitCoverage=17%, E-value=1e-34, Identity=50%"; Hit description=CUE domain containing protein, expressed
  Subcellular localization annotation: CTP_CleavageSite=79; ConfidenceScore=5.76e-01
MSNRSSQGRHHDNNNNHNKGFSKTHSQKKFAPKTQNPNPNPTPTLSTSLRQTQSSVSSTSSRGQNGNFVKYLPQDEAVAAGLGAEDGALDPLESQRVVDLLNTHLSLLLKFKPKEFWTQVATDTSLHEFLDSFLQFRSRWYDFPHRGVRGIVAGVIVGELELSRRVFMVLYRISSNKDPGARPADALSLRDHEVLLQEKKLLELPKLLDICAIYYHENEELTRSLVYIITYVGFIILRIAAVPIFAIVLLGLASLLLSKIDNCGNRKGNLHYFTYRCIISQLI

SEQ ID NO: 220158 - protein, 153 aa, Glycine max
  Coding DNA Sequence Number=SeqID_103380
  Homolog annotation: Hit_ID=Q47522; Match level="QueryCoverage=24%, HitCoverage=45%, E-value=7e-15, Identity=100%"; Hit description=LacZ protein
MRKEKIPHQAPFAIQAAQLLGRAIGAGLFAITPAGERGMCCKAIKLEVNLMDHKPSVIAVAATLVAMDQQLTRDAVELKMSSIPQHRLLESKDVFEYYNLIQRLYEENTKSDTHTPIEMTESSRVTSSAAMTKRRRLTFSDDEGSSHGKGPPG

SEQ ID NO: 220159 - protein, 104 aa, Glycine max
  Coding DNA Sequence Number=SeqID_103381
  Gene Ontology: Mol. function=transcription regulator activity; Cellular component=nucleus; Biological process=regulation of transcription
  Homolog annotation: Hit_ID=Q1SL31; Match level="QueryCoverage=77%, HitCoverage=22%, E-value=3e-23, Identity=69%"; Hit description=Helix- loop-helix DNA-binding
  Pfam annotation: Domain name=HLH; Domain location=18-65; Score=29.7; E_value=1e-05; Accession=PF00010.16; Description=Helix-loop-helix DNA-binding domain
  Subcellular localization annotation: CTP_CleavageSite=50; ConfidenceScore=5.00e-01
MGMVTKNLVIQKMGSATDPQSLYARKRRLRINERLRILQNLVPNGTKVDRSSMLEEAVQYMKFLQLQIKLLSSDDLWMYAPIAYNGLDLVLNLNHQEFPTFVTL

SEQ ID NO: 220160 - protein, 356 aa, Glycine max
  Coding DNA Sequence Number=SeqID_103382
  Pfam annotation: Domain name=F-box; Domain location=42-89; Score =31.3; E_value=3.3e-06; Accession=PF00646.23; Description=F-box domain
MVPHPYHKGHLLLFYYSTLKTHYRKLQRRTLPYSETTIMDPRIWSKLPPDVVEHILLLLPLKTLLNLRPTCKAFTCLLFSPSFVSKHSSSLSSSSLSPFSSFLLLSHPQFPHYFRLYDSNLCSWRTLSLSLSNSLPFSSSFTLVSSSGGLFCLFNPTSSTFLVYNLFVKSFRKIESPTSLSLYLGHVTFVTTPLGYYIVLLRSKSTSNTSVFVYDSNELSCRSFEGFNAVLSGSIHQQGTFFDGGLYFTTPEPFSVVPIDLDSGRWERHVAELPQQVTFMRLVSDGEGKLYLLSGIGNDGILRSIKLWELTKGERVWVEVVVLPEIRCRKFVWVQCRTSDFALVAYCKQLRSYRQP

SEQ ID NO: 220161 - protein, 327 aa, Glycine max
  Coding DNA Sequence Number=SeqID_103383
  Gene Ontology: Mol. function=binding; Cellular component=ubiquitin ligase complex; Biological process=intracellular signaling cascade
  Homolog annotation: Hit_ID=Q9LUZ0; Match level="QueryCoverage=91%, HitCoverage=34%, E-value=2e-89, Identity=60%"; Hit description =Phosphoinositide-specific phospholipase C-line
  Pfam annotation: Domain name=Arm; Domain location=103-143; Score =24.5; E_value=0.00038; Accession=PF00514.13; Description =Armadillobeta-catenin-like repeat
  Pfam annotation: Domain name=Arm; Domain location=145-185; Score =29.2; E_value=1.5e-05; Accession=PF00514.13; Description =Armadillobeta-catenin-like repeat
  Pfam annotation: Domain name=Arm; Domain location=186-226; Score=3.0; E_value=5.1; Accession=PF00514.13; Description=Armadillobeta-catenin -like repeat
  Pfam annotation: Domain name=Arm; Domain location=227-267; Score =15.2; E_value=0.16; Accession=PF00514.13; Description=Armadillobeta -catenin-like repeat
  Pfam annotation: Domain name=Arm; Domain location=269-309; Score=3.6; E_value=4.3; Accession=PF00514.13; Description=Armadillobeta-catenin -like repeat
  Pfam annotation: Domain name=Arm; Domain location=62-102; Score=36.9; E_value=7.1e-08; Accession=PF00514.13; Description=Armadillobeta -catenin-like repeat
  Pfam module annotation: Pfam domain module=Arm::Arm::Arm::Arm::Arm::Ar m; Domain location=103-143::145-185::186-226::227-267::269-309::62-102
MFNHDSFSAFSDCNSDRSAEFPTPSSENSDELIRQLVLKLVSCSIEEQKQATMEIRLLAKNKQENRPKIAKAGAIQPLISLLPSSDLQLQEYVVTAILNLSLCDENKELIASHGAVKALVAPLERGTATAKENAACALVRLSHNREEEKVAIGRAGAIPHLVKLLEGGGLRGKKDAATALYALCSAKENKVRAVRAGIMRGLVELMADLGSSMVDKAVYVVSVVVGVAEARAALVEEGGIPVLVEIVEVGTQRQKDIAAGVLLQICEESVVYRTMVSREGAIPPLVALSQSNSNRAKQKAQKLIQLLPQPRSANGAAPTSEMPPIQH

SEQ ID NO: 220162 - protein, 160 aa, Glycine max
  Coding DNA Sequence Number=SeqID_103384
  Gene Ontology: Cellular component=nucleus; Biological process =regulation of progression through cell cycle
  Homolog annotation: Hit_ID=Q1S7L6; Match level="QueryCoverage=96%, HitCoverage=50%, E-value=6e-30, Identity=44%"; Hit description =Cyclin, N-terminal
  Pfam annotation: Domain name=Cyclin_N; Domain location=51-160; Score =30.1; E_value=3.4e-07; Accession=PF00134.13; Description=Cyclin, N -terminal domain
MDDDLSSSLLCHENETCLKEGGEELEYQFAGSQHDCGVSEDERVGILIEREIVLGFKRDESMVFGDWVKRARVEAINWILKTRATLGFRFETAYLSVTYFDRFLSRRSIDSEKSWAIRLLSIACLSLAAKMEECNVPGLSEFKLDDYSFEGKVIQKMELL

SEQ ID NO: 220163 - protein, 105 aa, Glycine max
  Coding DNA Sequence Number=SeqID_103385
MDLGIPRSCGSACHWTLGSRTSFLNDHLEETLGPTKIGENHSKCINLTQGKKVASAQDFGWQSKGEDHFRSWFPFSCLLGDNSILFRYWLVQRPFWMFLLFSSDP

SEQ ID NO: 220164 - protein, 85 aa, Glycine max
  Coding DNA Sequence Number=SeqID_103386
MKRQDVNIQLLNEHSGETWDFSIRYLLSLEEILLSFSSGEKMRILFIGKVQSSLRLCLNMVFSSWEPDLDIWGKTNSCVKVSVSG

SEQ ID NO: 220165 - protein, 279 aa, Glycine max
  Coding DNA Sequence Number=SeqID_103387
  Gene Ontology: Mol. function=protein binding; Cellular component =nucleotide-excision repair complex; Biological process=transcription- coupled nucleotide-excision repair
  Homolog annotation: Hit_ID=Q6Z0X1; Match level="QueryCoverage=90%, HitCoverage=52%, E-value=7e-79, Identity=57%"; Hit description =Putative cockayne syndrome 1 homolog
  Pfam annotation: Domain name=WD40; Domain location=101-140; Score =26.3; E_value=0.00011; Accession=PF00400.22; Description=WD domain, G-beta repeat
  Pfam annotation: Domain name=WD40; Domain location=203-242; Score =37.6; E_value=4.2e-08; Accession=PF00400.22; Description=WD domain, G-beta repeat
  Pfam annotation: Domain name=WD40; Domain location=41-80; Score=23.5; E_value=0.00077; Accession=PF00400.22; Description=WD domain, G-beta repeat
  Pfam module annotation: Pfam domain module=WD40::WD40::WD40; Domain location=101-140::203-242::41-80
MHKQTHTHVWKRIRDREAGKLHASHFANRIKWNRISQLQLSNHKDIVSPHKGAINSLQIDSTEGRYLLSAASDASVAVYDVQRPTVYEAGGVISKHSSIFVVDKQHQQAHKYAVSSAIWYPIDTGLFVTGSYDHHINVWDTNTTQGLAIFLMILIKELKGVVVNFKMPGKVHRAAMSNLSTSHMLIAAATEDVQVRLCDIASGAFAHTLSGHRDGVMTVEWSNSSEWVLVTGGCDGAIRFWDIRRAGCFQVLDQSRTQLGRRPTILNHSMITKVFFFIF

SEQ ID NO: 220166 - protein, 553 aa, Glycine max
  Coding DNA Sequence Number=SeqID_103388
  Gene Ontology: Mol. function=N-acetyltransferase activity; Biological process=metabolic process
  Homolog annotation: Hit_ID=Q1SZQ6; Match level="QueryCoverage=64%, HitCoverage=97%, E-value=2e-84, Identity=43%"; Hit description=GCN5 -related N-acetyltransferase; Zinc finger, RING-type; Zinc finger, FYVE/PHD-type
  Pfam annotation: Domain name=Acetyltransf_1; Domain location=441-518; Score=20.5; E_value=0.0062; Accession=PF00583.14; Description =Acetyltransferase (GNAT) family
MAPPTKPPPINIEPENCPEAVMNWYNITSRLNIEPENYKRQCTLSRDLSSQAKKHLCFLGWRFWHADKKNKWELRYTSPITGKNYISLRRACHACIQEGGCNNGNPQINLQQHNNNNNVDQNPSPSAPKKPRKSTNKRTRVCKKRQKSDDDDELGEASSSMNNNNYKKMMREAEATNVSDQSLKQQHRGAIIPWLIDNNVVALYSLVFCRDANNVVKKGKLWRSGIACECCGMFFSPTRFEAHAGCHKHRPNASIFLEDGRSLLDCQKEALSSQQNKHVPDGDWFCPACCCKVCKGPRCNTEENCDDHVDANRVLVCHQCEGRYHIGCLKALTYTKMGKDQDHVDNENENWFCSGDCENIFLALQKLVGKAINVVGEDNVTWTLLKALKKGESKLSEALNVLRECFSPVTDAFFGRDIISDVVFSRGSELNRLNFCGFYTVILEREGEVVSVATLRIFGKRVAEIPFVATRVQCRKQGLCGILMNEIEKQLTYLGVEEIVLPSTPKVIDTWTNSFDFEKMTLSVKSKFLDHVFLDFEDTIMCHKLLVVKQTVI

SEQ ID NO: 220167 - protein, 445 aa, Glycine max
  Coding DNA Sequence Number=SeqID_103389
  Gene Ontology: Mol. function=binding; Cellular component=thylakoid; Biological process=photosynthesis
  Homolog annotation: Hit_ID=Q10QD7; Match level="QueryCoverage=89%, HitCoverage=56%, E-value=1e-94, Identity=45%"; Hit description=TPR Domain containing protein, expressed
  Pfam annotation: Domain name=TPR_2; Domain location=186-219; Score =13.8; E_value=0.64; Accession=PF07719.7; Description=Tetratricopeptid e repeat
  Pfam annotation: Domain name=TPR_2; Domain location=379-412; Score =9.8; E_value=2.4; Accession=PF07719.7; Description=Tetratricopeptide repeat
  Pfam module annotation: Pfam domain module=TPR_2::TPR_2; Domain location=186-219::379-412
MDERFRVSILISLVLSHLLEAAKECRIILDTVESALPNGMPEGIGEGCKLQEMFHKALELFPSLWIKAGFLDEAVTAYRRALVKPWNLEPRKLAAVEKDLAMILLYGGVEVSLPSQLQVWGKTAPKSSAEEAILLLLILMSKVAIREIDWDAEIMDHLTFALSVTGMFELLADHVEQILPGIYGRAERWYFLALCYSAAGHDGVALNLLRKACGSSEANHRPHFPSFLFGAKLCSLDPHHAHEGIKFSREVIVIAKQQNEHFLSQGHKFLGICYGAAARISVLDSERSIFQRESLDSLNCAAVNGSDDLEAIVSLGLENAIQRNLDAAYNNIMMYSDMTVGSSRGWQLLALIISAQQRFKDAETIVDFALDDSGGMDQLELLRLKAVLQISQQQPKEAIETYRILLALIQAKKELLLQDKNIDQEQAFRHEVCSTFQGRTLTSLV

SEQ ID NO: 220168 - protein, 69 aa, Glycine max
  Coding DNA Sequence Number=SeqID_103390
MGLCFGCFDGGNKRMTKEEERLASEEARARAAEAAQKKQEQQGEAKQPETVKEPENSNNGEAFVKWQMG

SEQ ID NO: 220169 - protein, 214 aa, Glycine max
  Coding DNA Sequence Number=SeqID_103391
  Homolog annotation: Hit_ID=Q9SLT9; Match level="QueryCoverage=78%, HitCoverage=72%, E-value=6e-14, Identity=32%"; Hit description=ZCF37 protein
FHHQEEDVPCSSPKKYSRRKESRNINKNPYSNRGLDKFSALLADLDERRQKVYSQMSPQDISFVRFAYSSNDDFVPIVVKVKKNNKDQKKHKSEELKARHITSFSEQLEKSSEETTLEERKQKLNKLEAHKKKNLSFSWNVLKRPSFYVPAVVMLILVFLVVLGRSVATLCTCVVWGWLNDVKMVNPEDLASPRSGDSKAYSNDNNSGKHGHQK

SEQ ID NO: 220170 - protein, 104 aa, Glycine max
  Coding DNA Sequence Number=SeqID_103392
  Gene Ontology: Mol. function=nucleotide binding
  Homolog annotation: Hit_ID=Q69ST5; Match level="QueryCoverage=67%, HitCoverage=23%, E-value=2e-25, Identity=77%"; Hit description =Putative purine nucleotide binding protein
MLEMVIKDGLNGSDGKKILKLTKELCDVIENFSLVSFSTLDIQDKESVGNLVKLIDKSNGYIFVGMETSAVEFSKIAVGPVDWDYYRYPFFPHVYILIPLDDLL

SEQ ID NO: 220171 - protein, 133 aa, Glycine max
  Coding DNA Sequence Number=SeqID_103393
  Gene Ontology: Mol. function=nucleotide binding; Cellular component =intracellular; Biological process=transport
  Homolog annotation: Hit_ID=Q69ST5; Match level="QueryCoverage=99%, HitCoverage=34%, E-value=7e-43, Identity=65%"; Hit description =Putative purine nucleotide binding protein
  Pfam annotation: Domain name=ATP_bind_1; Domain location=7-133; Score= -28.2; E_value=4e-05; Accession=PF03029.7; Description=Conserved hypothetical ATP binding prot
MVFGQIVVGPPGSGKTTYCNGMSQFLSLIGRKVAVINLDPANDSLPYPSLYLFQTSFFSKLYSSIIIVSPNKEYRYDCAVNIEDLVKLSDVMVEHSLGPNGGLVYCMDYLEKNIDWLEAKLEPLLKVNCSAFD

SEQ ID NO: 220172 - protein, 76 aa, Glycine max
  Coding DNA Sequence Number=SeqID_103394
  Gene Ontology: Mol. function=metal ion binding; Cellular component =intracellular
  Homolog annotation: Hit_ID=Q306K1; Match level="QueryCoverage=58%, HitCoverage=73%, E-value=3e-21, Identity=78%"; Hit description=LIM domain protein
  Pfam annotation: Domain name=LIM; Domain location=10-69; Score=12.7; E_value=0.00019; Accession=PF00412.12; Description=LIM domain
MAFAGTTQKCMACDKTVYLVDKLTADNRVYHKACFRCHHCKGTLKIYIIIMIILHGYVAFDSSCSDLSVPGSGVSS

SEQ ID NO: 220173 - protein, 109 aa, Glycine max
  Coding DNA Sequence Number=SeqID_103395
MSVSFGRNYEKVSFAIRKTQSPIACSGLRHHLQLPRRYQGLPTETAKKSHLLSVRLKARYHAVAYVITCTFQGDRVPAETAKKSHLLSIRLKPASHAMTNVVTSTFLGD

SEQ ID NO: 220174 - protein, 51 aa, Glycine max
  Coding DNA Sequence Number=SeqID_103396
MIVVVFTSAIFDDDDDHGGGGGEYSNDHTSKGGDNHGDAIGTRVRINPCKK

SEQ ID NO: 220175 - protein, 334 aa, Glycine max
  Coding DNA Sequence Number=SeqID_103397
  Gene Ontology: Mol. function=calpain activity; Cellular component =intracellular; Biological process=proteolysis
  Homolog annotation: Hit_ID=Q1S3Q9; Match level="QueryCoverage=98%, HitCoverage=66%, E-value=4e-50, Identity=36%"; Hit description =Cyclin-like F-box; F-box protein interaction domain
  Pfam annotation: Domain name=F-box; Domain location=1-48; Score=46.5; E_value=8.9e-11; Accession=PF00646.23; Description=F-box domain
MAMAQLPQDLIEEILSWLPVKSLMRFRCVSRTWNSLIFQAHFVKLNLQRSSRNTHVLLRCQINTVFEDMRDLPGIAPCSICSLLENPSSTVDNGCHQLDNRYLFIGSCNGLVCLINLVARGEFSEYRVWFCNLATRIMSEDSPHLCLRSCNYKLWWYQVKCGFAYDDRSDTYKVVLVLSNIKSQNWEVRVHRLGDTHWRKVLTCPAFPILGEKCGQPVSGTVNWFAIRKLGFDYEWETVTVDQLVIFSYDLNKETFKYLLMPNGLSQVPCGPELGVLKGCLCLSHVHRRTHFVVWLMREFGVENSWTQLLNVTLELLQAPLPCVILKPLCISEK

SEQ ID NO: 220176 - protein, 83 aa, Glycine max
  Coding DNA Sequence Number=SeqID_103398
  Gene Ontology: Mol. function=protein binding; Cellular component =fimbrium; Biological process=cell adhesion
  Homolog annotation: Hit_ID=P13421; Match level="QueryCoverage=92%, HitCoverage=44%, E-value=9e-12, Identity=48%"; Hit description =Fimbria A protein precursor
MAVVLSLSGASAVHADTGKITFEGSVIDAPCSISADSLEQTIQMGAISNVQLAKNNNTGESVPKTVTIQLEECTVSTPGTKEQ

SEQ ID NO: 220177 - protein, 95 aa, Glycine max
  Coding DNA Sequence Number=SeqID_103399
  Gene Ontology: Mol. function=DNA binding; Biological process=DNA recombination
  Homolog annotation: Hit_ID=Q5J3R3; Match level="QueryCoverage=84%, HitCoverage=23%, E-value=2e-28, Identity=82%"; Hit description =Integrase/recombinase
MAAKVTPAAAIEGHGTQHPRNDAEERGHGLPAAGRIQGKKISPGGTDRAFTTGQRRQEFLTGWNDGCGQTQLRFVVGYQDHVGLRQGPGWDRRAA

SEQ ID NO: 220178 - protein, 58 aa, Glycine max
  Coding DNA Sequence Number=SeqID_103400
MKKKKIAIYGSRFDEEMSEIGRFGGLGMEEHRKEEGAAQRFLENVIFIKQDAWPSVLV

SEQ ID NO: 220179 - protein, 234 aa, Glycine max
  Coding DNA Sequence Number=SeqID_103401
  Homolog annotation: Hit_ID=Q1RZ53; Match level="QueryCoverage=95%, HitCoverage=68%, E-value=1e-22, Identity=33%"; Hit description =Cyclin-like F-box; F-box protein interaction domain
  Pfam annotation: Domain name=F-box; Domain location=7-54; Score=31.8; E_value=2.4e-06; Accession=PF00646.23; Description=F-box domain
MRSEKKSCSPLLYDELIKEILSRLPVKTLIQFKCVYKGWNSLMSDPYFIKLHLNKSATKDDLEHLQLMKNVCLGSIPEIHMESEIPEGYRVCFWNKETRVISRQLPTLSFSPGIGRRTMLGFGYDPSSDKYKVVAIALTMLSLDVSQKTEMKVYSAGDSSWRNLKGFPVLWTLPKVGGVYLSGTLNCVVIKGKETIHSEIVIISVDLEKETCRSLFLPDDFCFVDTNIGVFRDS

SEQ ID NO: 220180 - protein, 45 aa, Glycine max
  Coding DNA Sequence Number=SeqID_103402
MKNDRPPLSHGTATPTEKNPKHGYLNMNKEPGNGTNFFGFFDVQT

SEQ ID NO: 220181 - protein, 74 aa, Glycine max
  Coding DNA Sequence Number=SeqID_103403
MKTEERRRAMRNGGKPLRNRPRKRLGCVTEAPRLGFSSWKQFFSLILREKRVVVAAQLAQKHRLLLEDSGRPSG

SEQ ID NO: 220182 - protein, 88 aa, Glycine max
  Coding DNA Sequence Number=SeqID_103404
MEENMLTIIDQYKEKLNLTTSHEQRLEDEHAKVSALFTLTLNGSQELPRLLARAQAMADVYSAPKEVHGLFDYCQNMVELMSHIIRNH

SEQ ID NO: 220183 - protein, 232 aa, Glycine max
  Coding DNA Sequence Number=SeqID_103405
  Gene Ontology: Mol. function=DNA binding
  Homolog annotation: Hit_ID=Q1SFS3; Match level="QueryCoverage=88%, HitCoverage=37%, E-value=2e-13, Identity=25%"; Hit description =Lambda repressor-like, DNA-binding
MIEVSVEAIASLVQYYDQPLRCFTFGDFQLLPTVEEFEGILGRPLGGRKPYLFFGLYPSMVRIAKVGKVSIKESPIVAVLVDAYDTFDRRCEKSGARIFYCTPALYVWLVFHVFRHESRLVCPLQGHRMCAKKGKANWEQLLAGMVGTSVNWFPQWKEGGARVLSSCEGFPNIPLMGMRGCINYNPVLAIRQLGCPIRRAPSEESITPFIARGFSDPNARMLQRVQKAWNVV

SEQ ID NO: 220184 - protein, 86 aa, Glycine max
  Coding DNA Sequence Number=SeqID_103406
  Subcellular localization annotation: CTP_CleavageSite=44; ConfidenceScore=5.06e-01
RFFNVLSWTPNDLSVMDQVNSRGGGGASIARYRPSQCYCGVSPCARLGAQHSVELTEARNQSWKPQDPVGLLWVHRVSCGRDPCKQ

SEQ ID NO: 220185 - protein, 54 aa, Glycine max
  Coding DNA Sequence Number=SeqID_103407
LERIDGDPVLRETRIWATWEYVSSVGGGQQGMEVLKGELPAFIVTTECTWRYVA

SEQ ID NO: 220186 - protein, 148 aa, Glycine max
  Coding DNA Sequence Number=SeqID_103408
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=94%, HitCoverage=28%, E-value=1e-54, Identity=92%"; Hit description=NADH -plastoquinone oxidoreductase subunit 2
MMTYMLFYISMNLGTFACIVSFGLRTGTDNIRDYAGLYTKDPYLALSLALCLLSLGGLPPLSGRLIFLSFNRTPYECCFYLLLFKNNQVINDWTKPRNNSSRAKLSKAPFKIKQFHRIKYDCMCDSIYYTRNINEPYYEIAQDTLFSF

SEQ ID NO: 220187 - protein, 763 aa, Glycine max
  Coding DNA Sequence Number=SeqID_103409
  Gene Ontology: Mol. function=phosphatidylinositol phosphate kinase activity; Cellular component=mitochondrion; Biological process =phosphatidylinositol metabolic process
  Homolog annotation: Hit_ID=Q8H3L8; Match level="QueryCoverage=99%, HitCoverage=46%, E-value=0.0, Identity=47%"; Hit description=FYVE finger-containing phosphoinositide kinase-like
  Pfam annotation: Domain name=PIP5K; Domain location=512-754; Score =188.2; E_value=2e-53; Accession=PF01504.9; Description =Phosphatidylinositol-4-phosphate 5-Kinase
MVAFFRYSPIDILSVHLPPSVLEFGHIQEEWIIKEAGELFIKVETLYVEISNVLERLETKIVSPGIGNESADTCDIQNYILDLKDMLQRERTDYHCLLQSGSVATQPGMMTLDILELNRLRRSLLIGSHVWDHRLFSLDSLIKRSFSSKVKQENELCADVKELRVDSLHKEQNFDCGLEQNNTRLSKLHESHESHMLAEPDDTLEPCASGSFTCYLEGEKVHSDGELNRTLSECFPSNESNLSERIDSAWTGTDQPQANAVPAGSIQRPNQHDSPPFRRVSQPVRVHSFDSAVRVQERIRKILPSSLHLSTLRSFHASGDYGNMVRDPLSNILRSYFQMLPWETQKLNLILSSTPSFISSVSGIAEGARLLLSQTYHGDRVIAVYDNDYSSIISYALSSKEYEDWVSGKSDMQESRIARERSKEDLATSGFSAWGSLDLDYINYGSYGSEDVPSSVGSLLRDSKKSLHLQISFGDDSVGAGGKVNFSVTCYFAQQFESLRKKCCPNEVDFVRSMSRCRRWSAQGGKSNVYFAKSLDERFIIKQVTKTELESFEKFAPQYFKYLMDALNSGGPTCLAKILGIYQAPDWCINVTVKYPKGGKETKIDLMVMENLFYKRNISRVYDLKGSERSRYNPDTTGTNKVMLDMNLLETLRTKPIFLGSRAKRRLERAVWNDTSFLASVYVMDYSLLVGVDDDSKELVLGIIDFMRQYTWDKHLETWVKASGILGGPKNAAPTIVSPKQYKKRFRKAMTTYFLTLPDQWSS

SEQ ID NO: 220188 - protein, 59 aa, Glycine max
  Coding DNA Sequence Number=SeqID_103410
MLRISTGYNFIGVCILVFIEQKNIYLVNVQSTMIDEHTIQDRNSDEEEVGLESADGDFD

SEQ ID NO: 220189 - protein, 899 aa, Glycine max
  Coding DNA Sequence Number=SeqID_103411
  Gene Ontology: Mol. function=phosphatidylinositol phosphate kinase activity; Cellular component=mitochondrion; Biological process =phosphatidylinositol metabolic process
  Homolog annotation: Hit_ID=Q8H3L8; Match level="QueryCoverage=69%, HitCoverage=40%, E-value=1e-175, Identity=50%"; Hit description=FYVE finger-containing phosphoinositide kinase-like
  Pfam annotation: Domain name=Cpn60_TCP1; Domain location=318-719; Score=-208.2; E_value=0.015; Accession=PF00118.14; Description=TCP -1cpn60 chaperonin family
MCCECNRNLGEMNQQQNYNCKSCGRWLCGKCIRGCDLSNRESDNTGIKETIRSSKFCSDANSRRMCFEGQKKCSEKVHPSVSPQESPRQSPEPPSPCFSVESDRLGSPLNAELNQGTHFDSCFHDLDYGCYPCSVVNKRVNSSCTHPSSVSTHPPTFRSDEEGMEESRKLLLSPSSRTYCDTYSDIDSSSVSARHDTYNYNSVGSSPSDSPSRIGFTSSRAGLPEQKGQEKGHIPQNDGPLGQQSMAVLRKPEQGTEDAYTTAYFSDDLSIFRNQNENSQRPLDFENSGHIWFPPPPDDENDDAEGNFFAYDDEDDDIGDSGALFSSSCSLSNMFPGKEKHNDENKEPLKSVIQGHFRALVSQLLQGEGIKVGKENDSEDWLDIVATVAWQAANFVRPDTSKGGSMDPGDYVKVKCVASGSPSESTLVKGVVCTKNIKHKRMTSQYRKPRLLLLGGALEYQKVPNQLASFDTLLQQENDHLKMIISKIEALRPNVLLVEKSVASCAQEYLLAKEISLVLNVKRPLLERIARCTGALVTPSVDCLSKARLGHCELFRLDRMMEDHETTHQLNKKPTKTLMFFEGCPRRLGCTVLLKGTCREELKKIKHVVQYAVFAAYHLSLETSFLADEGATLPKMIVKNSTDMPESATADTDISMIPNSFSTTMCQSEVDDASRVKDFAGLDLKLENLGSVPEHLDDLSCHSYTGTMAESDYLHQCNESDGETIFSTRDLLQSELQQAMVQDERECGEVADSKDKPNEDELSGEFFSATDGHQSILVYFSSHCVSKGTVCERTRLLRFKFYGSFDKPLGRYLRDDLFDQACCCQSCKEPAEAHVLCFTHQQGNLTINVRCLPSVKLPGERDGKIWMWHRCLRCPFEDGVPPATQRVVMSNAAWGLSFG

SEQ ID NO: 220190 - protein, 85 aa, Glycine max
  Coding DNA Sequence Number=SeqID_103412
MGVQITIFKFLNLALPEKFRIRVAYGGSNPARLGELGDNLLPPFPINRRREAVPKIPNPLGYAFQVFRRSTPFFIRSAFVLRSST

SEQ ID NO: 220191 - protein, 176 aa, Glycine max
  Coding DNA Sequence Number=SeqID_103413
  Subcellular localization annotation: CTP_CleavageSite=68; ConfidenceScore=5.23e-01
MWSVLSYSNLAPTSHTSDLTVDRAMLIFGLVSRMDMNIGALISGQMTSIAQSSTSRLEFPALITALCRDRGVVSDSLTFERLSPFINLAYIKKNYSNPEDLTVSIRGVRRARARPTELPSTSAAPTLASTSVAPSIPAQTDSQRFEAMLHSIHQGQIILLQSLQVVASPGSIPSVE

SEQ ID NO: 220192 - protein, 116 aa, Glycine max
  Coding DNA Sequence Number=SeqID_103414
MGTPKSSIAFVKEVVCRNVRAAEQVRCGSRTNRAEAGGHVTPGRITPEREGSKGYVGPGLHKDLAWPESLYTRPDLIKYIKGLKAYVSHVTDRVQDMSTIERRKLWKYECIQAVGM

SEQ ID NO: 220193 - protein, 246 aa, Glycine max
  Coding DNA Sequence Number=SeqID_103415
  Gene Ontology: Mol. function=nucleic acid binding; Cellular component= membrane; Biological process=homophilic cell adhesion
  Homolog annotation: Hit_ID=UPI00005C0CA0; Match level="QueryCoverage =43%, HitCoverage=22%, E-value=2e-15, Identity=29%"; Hit description =PREDICTED: similar to concentrative Na+-nucleoside cotransporter
  Subcellular localization annotation: CTP_CleavageSite=18; ConfidenceScore=5.45e-01
MKARTLSPLKARTLCPLKARTLSPLKARTLGPLKARTLGPLKARTLSAIKVRTLSPVKARTLKPLKVGTLSPVKARTLSPLKVRTLSPMKVRTLSPMKARTLGPLKAKTLSPLKARTLRPLKARTLSPLKAGTLSPLKCGSNDFQDYFDDAKESRVKQIPKIQESIVATYPSAGGRRVTRGMRVPRKEYARSRHQRLFEENVGKTGKDAIYELLSERFGSCIYARGRVFPFAPTYSSIWDEKIRPT

SEQ ID NO: 220194 - protein, 330 aa, Glycine max
  Coding DNA Sequence Number=SeqID_103416
  Gene Ontology: Mol. function=structural molecule activity; Cellular component=intermediate filament; Biological process=nucleosome assembly
  Homolog annotation: Hit_ID=UPI0000DBF0F4; Match level="QueryCoverage =73%, HitCoverage=74%, E-value=3e-33, Identity=45%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
MGAKHLTRTKEWSHVIEQRSPDEIRNKRGYISYGSVQVEHPLGFSKRTREGTSLVNLWLVKVFTRLKEISRIGGCLGTGCHLIQHKGEDFESCEDEDFESSKGEDFKSCEGEDFESSESKDFESSEGEDFEPSKGKDFETSEGEDFEPSEGEDIEPSEGEDIEPSKGEDSESCEGEDFESSKGEDFKSYEGEDFKSSESEDFESSESKDFKSSEGEDFESCKGKEIEPFEGKDIEPSEGKDIEPSKGDDFESCEGEDFESSKGEDFKSYEGEDFESSESKYFDFSESKDFESSKGEDFEPSEDEDFESSKGEDYVLSKGEDFESYETSQR

SEQ ID NO: 220195 - protein, 153 aa, Glycine max
  Coding DNA Sequence Number=SeqID_103417
  Gene Ontology: Mol. function=calcium-dependent phospholipid binding; Cellular component=phagocytic vesicle; Biological process=fruiting body development (sensu Dictyosteliida)
  Homolog annotation: Hit_ID=Q6H450; Match level="QueryCoverage=75%, HitCoverage=37%, E-value=5e-40, Identity=70%"; Hit description =Putative annexin
  Pfam annotation: Domain name=Annexin; Domain location=40-106; Score =88.8; E_value=1.6e-23; Accession=PF00191.10; Description=Annexin
MNFPRAWFLNLLCVICQLLLAYVSIPRYEGPELDHIIVQEDAKQLYKSGEKRIGTDEKMFIKIFSEKSSTHLAAVNSAYIASYGHSLEKAIKKETSGSFGSALLTILRCATDPAMYFAKILRKSMKGVGTDDSRLIRKNLLIGAKLFIQVVLA

SEQ ID NO: 220196 - protein, 61 aa, Glycine max
  Coding DNA Sequence Number=SeqID_103418
  Gene Ontology: Mol. function=acid phosphatase activity
  Homolog annotation: Hit_ID=Q707M7; Match level="QueryCoverage=70%, HitCoverage=13%, E-value=5e-10, Identity=69%"; Hit description =Putative acid phosphatase
MASPSSPLHSAAILCIYFVLPAFAELQRFQHQPKHDGSLNFLVIGDWGRKGHYNQSLVATQ

SEQ ID NO: 220197 - protein, 271 aa, Glycine max
  Coding DNA Sequence Number=SeqID_103419
  Gene Ontology: Mol. function=acid phosphatase activity; Cellular component=integral to membrane; Biological process=iron ion transport
  Homolog annotation: Hit_ID=Q8LFV2; Match level="QueryCoverage=99%, HitCoverage=78%, E-value=2e-95, Identity=59%"; Hit description=Acid phosphatase type 5
  Pfam annotation: Domain name=Metallophos; Domain location=1-193; Score=33.4; E_value=7.6e-07; Accession=PF00149.18; Description =Calcineurin-like phosphoesterase
MGDKLDLDFVVSTGDNFYNSGLKGVNDPLFLQSFSNIYTAKSLRKQWYSVLGNHDYRGNALAQLSPLLRKIDRRWFCQRSFILNAGVAEFFFIDTTPFMRKYFNNSNRHYDWRGVLPRQKYLKTLLKILQNFCDKDLEEELRKSTARWKIAVGHHAIRSIGHHGDSPELVKHLVPVLKANNVDMYINGHDHCLQHISSTDSPLLYLTSGAGSKAWRGDVKETHFDVKFFYDGQGFMSVQMTENDTNFAFYNVFGEKIHHWKVTKSTMHPSI

SEQ ID NO: 220198 - protein, 167 aa, Glycine max
  Coding DNA Sequence Number=SeqID_103420
  Gene Ontology: Mol. function=oxidoreductase activity; Biological process=lignin biosynthetic process
  Homolog annotation: Hit_ID=Q9ATW1; Match level="QueryCoverage=64%, HitCoverage=28%, E-value=3e-28, Identity=56%"; Hit description =Cinnamyl alcohol dehydrogenase
  Pfam annotation: Domain name=ADH_N; Domain location=56-167; Score =8.4; E_value=9.7e-05; Accession=PF08240.2; Description=Alcohol dehydrogenase GroES-like domain
MTMKKKKKKELTDNCERNEMKEPTWAEITGEAVMVVNNSNGVVVGLVVSQNALNGIQGGLCHKPNHPFGHRTPTCNQNPKFATKGDNYSGEIVGEVTEVGSKVDQFKVGDKVAVGCLVGSCKSCQNCVNNVENYCQQNIPTYGAKYVDGTITYGGFSDFMVADEHFV

SEQ ID NO: 220199 - protein, 99 aa, Glycine max
  Coding DNA Sequence Number=SeqID_103421
MSSKEWMMTASSPLSTRAASSLDNNTSVLQKKLAKAIANKDKALETFGLAMKVKRILREQKGKVQTKKPAHQQKEEEKIVIEEQRMKKKHEVPRPSLPV

SEQ ID NO: 220200 - protein, 427 aa, Glycine max
  Coding DNA Sequence Number=SeqID_103422
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q8ZKD8; Match level="QueryCoverage=84%, HitCoverage=75%, E-value=1e-105, Identity=54%"; Hit description =Sensory histidine kinase in two-component retgulatory system with DcuR
VTGIADGQTMAAIRGAEADFRLIVISGLQNIGFNLRIIFHVQQAEDHMQLIHELVRALTQGINIVYHARQTLHQLADFGLVPEGADCADNTSLAAHRHGVAQQQTTIDVELLIAPRTTAVQHFLQMLVDHRGIINARGTHYAAAHFIAQQLARRLIDQRHLALIVHRHHAFLDGVKDRLALLKQGGNFVWLEAEQDTLQHAHQNEGANRAGKSADQNGPQNAPATLVDLVGDRLQRDADSHHANLPLLGVVHRGKHAQRFGQRALIHGDILVAAQRRFDVRADKVFAHQLRIAQMVALFHRFGDGLDSGPRARHCHGFILQLAARRGANLEEIKHVYAQQHQHNHRAEHQHHQGVELHRSPAHWRGLLWKAVSDDDLPWGSAGGLTLFHPVSEAFTQFLQLRRDHRQAVTVALAGTVPVILMIIFCR

SEQ ID NO: 220201 - protein, 67 aa, Glycine max
  Coding DNA Sequence Number=SeqID_103423
VMRDATMFGVFNENFPLYIKHEDLSKIVHGGQCLRIFVIQLWISHMTETSMRAGNVDMYGFLEPQSI

SEQ ID NO: 220202 - protein, 376 aa, Glycine max
  Coding DNA Sequence Number=SeqID_103424
  Gene Ontology: Mol. function=O-sialoglycoprotein endopeptidase activity; Cellular component=membrane; Biological process=proteolysis
  Homolog annotation: Hit_ID=Q5PKX9; Match level="QueryCoverage=77%, HitCoverage=94%, E-value=1e-121, Identity=72%"; Hit description =Possible glycoprotease
  Pfam annotation: Domain name=Peptidase_M22; Domain location=57-313; Score=203.2; E_value=6.2e-58; Accession=PF00814.15; Description =Glycoprotease family
TMDNLEPTGAFACAAAGVSRPVLHCAPQEEGDKAMRVLGIETSCDETGIAIYDDASGLLANQLYSQAALKQASLQAGEIDAVAYTAGPGLVGALLVGATIGRALAFAWNVPAVPVHHMEGHLLAPMLEDNPPAFPFVALLVSGGHTQLISVTGIGEYTLLGESIDDAAGEAFDKTAKLLGLDYPGGPMLSRMAQQGTPDRFKFPRPMTDRPGLDFSFSGLKTFAANTIREHDGDEQARADIARAFEDAVVDTLMIKCKRALEQTGFKRLVIAGGVSANRTLRERMATMMSARGGEVFYARPEFCTDNGAMIAYAGMVRLKGGTRAAEQYRQQPGAGHQAGQVPANRRDGAKRGGHTFAAAKAEKHRIDMAEAGGDG

SEQ ID NO: 220203 - protein, 62 aa, Glycine max
  Coding DNA Sequence Number=SeqID_103425
MKILYMCSARCRARCHVRCCARCRARCAARCHARYRTVQGAVLGAIRGVVPCENTPERFTCK

SEQ ID NO: 220204 - protein, 423 aa, Glycine max
  Coding DNA Sequence Number=SeqID_103426
  Homolog annotation: Hit_ID=Q8H147; Match level="QueryCoverage=14%, HitCoverage=10%, E-value=2e-08, Identity=54%"; Hit description =Putative homeodomain protein
  Pfam annotation: Domain name=POX; Domain location=307-414; Score= -6.2; E_value=1.8e-06; Accession=PF07526.2; Description=Associated with HOX
SVRNANILDGLAVYSSEMPNFSTSSSNPNLSDARNALEYHQEQGAAAEPSNRLMMNQYGSFPHSMSAIHSSHKEHCELRNLGNWRNSAPHQGSDWFVNYASNANSFLSADLNNNVSAYNELMDVHCSNASGEISGREIQKQLGVLHNNPPPSPLYQNALQDIVKSASFSSHTRQDMSSLMQQNDHSIWVGNAGEAEPQQPSYENQPNQLHFGWTNRTIANTLSDSTPQSLSLSLSSNAQPKPSVSHLEQGSASDDPQCLTNMKSIVKPSIVSRDIGKSVQETVGMPSKSTITYRSVGPLGPFTGYATILKSSRFLKSAQQLLDEICCLSGAKFAKSYDVSKRVSPEVSASTSADTVTGVAAKGSNSGSSSSILYSVSKENRADPGVRSSFGLSSRPDYQHKKAKLLYMQEELLAFWTYLLWYL

SEQ ID NO: 220205 - protein, 307 aa, Glycine max
  Coding DNA Sequence Number=SeqID_103427
  Gene Ontology: Mol. function=sequence-specific DNA binding; Cellular component=nucleus; Biological process=regulation of transcription, DNA-dependent
  Homolog annotation: Hit_ID=Q7XA57; Match level="QueryCoverage=65%, HitCoverage=22%, E-value=1e-43, Identity=47%"; Hit description =Putative BEL1-like protein
  Pfam annotation: Domain name=Homeobox; Domain location=101-151; Score= -1.7; E_value=0.0075; Accession=PF00046.19; Description=Homeobox domain
  Pfam annotation: Domain name=POX; Domain location=1-39; Score=-48.0; E_value=0.0097; Accession=PF07526.2; Description=Associated with HOX
  Pfam module annotation: Pfam domain module=Homeobox::POX; Domain location=101-151::1-39
MVVSSFESVAGLGSATPYIPMALKSVSKHFRCFKNSISEQLKLISEALGEDLSKPSNTSTCSNKADTTTTKARIRCSIDQSFLKNKSVKGTTELLEQHVWRPQRGLPERAVAILKACYPTDTDKHMLASQTGLSRNQVSNWFINARVRVWKPMVEEIHTLETKATSSKGNCGKNEGTSSGTEGDTSNPRALSNIGMNSIPENQFQGMDMGSSIIAANAEESGLNSEQWSQEKRSKLECQMTTSNMDGTLMGFVPYRRGGGIEVGGLGSVSLTLGLRHGVEGVQHQQQLQEEQLRHHLGGHMIHDFVG

SEQ ID NO: 220206 - protein, 262 aa, Glycine max
  Coding DNA Sequence Number=SeqID_103428
  Gene Ontology: Mol. function=uroporphyrinogen-III synthase activity; Cellular component=nucleus; Biological process=tetrapyrrole biosynthetic process
  Homolog annotation: Hit_ID=Q1T097; Match level="QueryCoverage=99%, HitCoverage=21%, E-value=1e-129, Identity=80%"; Hit description =Transposase family tnp2, putative
MEYYQYFRSWMYDRTFPGRTGLKPHFVQGVEGFISWAWAQEICTTEGGIRCPCLKCKCRYIIADPGHVNQHLKRVGFMPDYWIWIYNGEKFQNFGVEVNAQASTSHGGTNVEYNEEEGNREQFNMMDDMVADALGVELSYGDDVEDDQEEQLPNEKAQRFYQLLSECNTPLYEGSSHSKLSMCVWLLAHKSNYGSPDAGVDDVTKMLKAATLFKDNLPASYYDAQRLVMKLGLAVKKIDCCRNGCMLFYDNEFGINDGALEE

SEQ ID NO: 220207 - protein, 82 aa, Glycine max
  Coding DNA Sequence Number=SeqID_103429
MHQIIVGAPPIMEKSSPKTQIHKKHNKFDKKARELKFQKGALFYVKSVPCRTQIAIANGEFGVSEQLAYGTGDTCMQTLNRH

SEQ ID NO: 220208 - protein, 85 aa, Glycine max
  Coding DNA Sequence Number=SeqID_103430
MDYSTDDSSTIKEIEEVKEAFNEMHQEAQKLTILNNKLRSNLKWDLTKLASTQSELDKLKQENEKLFSSYKATSCVYARSLNMDD

SEQ ID NO: 220209 - protein, 236 aa, Glycine max
  Coding DNA Sequence Number=SeqID_103431
VGVEEVKDVDAPIPVPTKEVKVIGQTLNTFLTWSTHLVKCISKLDATLFGLFNEDSPLYIKHEDLSEIAQGGQCLSISVIKLWILHMTETSMRAGNANVYGFLEPQPDNYLKGIINSALKGLDDTQQSKSKPAARWIVVKYFTDARPLEPERLKALRIQWAKYYLKGLGYYGVPMRPRYEIQHEMDLGIGVLFHVRDGHERPMTGEDVVDVVVATVEIAIGAVVLAKKVVTGGTVV

SEQ ID NO: 220210 - protein, 134 aa, Glycine max
  Coding DNA Sequence Number=SeqID_103432
MFPKRFRDPKTGFHLLSSMHAKKYLKNIGLESEDYHFFKRVGKGLLCTYAVLGALWLYNNNSSLGWEKLKPRLKEHEEALKGFIAEGGMIGTSTSPKGMAESDKENFDEEAQKLWLRMKNEVKTELREKGFDVE

SEQ ID NO: 220211 - protein, 447 aa, Glycine max
  Coding DNA Sequence Number=SeqID_103433
  Pfam annotation: Domain name=DUF740; Domain location=1-446; Score =195.5; E_value=1.2e-55; Accession=PF05340.3; Description=Protein of unknown function (DUF740)
  Subcellular localization annotation: CTP_CleavageSite=59; ConfidenceScore=5.18e-01
MTSKTHRFTTCHRHPSTPVTGFCASCLRERLAGIDSSSAESPELRRTKSFSGRTTDAPSSSAAPEPRRRSCEVRLPPLGGSLSDLFNVDDKKKKPPNRNAEICSSTTGGGIGEKERGDPVRVSGDDDGEGKTMKEFIDLELRSKKNTGRDFRDIAASFREAASVFSKRLMKWRRKQNAKRNRYNDGLGAGAGVGPVEKLGLRTLHEAQSEVGEYGIALGRRSCDTDPRLSVDDSRFSFEAPRASWDGYLIGKAYPGVSRMVRVGDRVLLEEEEEEEGEESLENGEECCPGGSAQTKHYYSNWHRRRRSFDRSNSRRKSSMGEVDELRAISNAKVSPATTELFYGAKVLITENDLRDANLKPINSVQSDNVMGSASKDDACDVAIGDDQKGLNRFHKWGRLWSKLGLMQKRREDRLEEGEYAGGGGGDVVDKPIAESWQKLRRVVNGQ

SEQ ID NO: 220212 - protein, 87 aa, Glycine max
  Coding DNA Sequence Number=SeqID_103434
MARTKNVGGDLDDHVKLIASNRRRPRETYIFHLHEGEIIGDVLSLLHIPLMELFRIMSIWIRMRQLPCLWREKQLPLEAWAKEMLLV

SEQ ID NO: 220213 - protein, 194 aa, Glycine max
  Coding DNA Sequence Number=SeqID_103435
MLWDMLHSTDKHWVRVLEDKYHNGKFILSITLKPGSSYIWRSLLEARDSLLKGFKPRLREPQSSFWYSNWKGKGQLCNQGDSFTLTSAPRMGPAYFEYSSSPKSDGKGYYLLGVSCNNIKTGMDAHTWVAQILKHKDVTLMITVCWWAWRWRSKFIFESQHWHISHICSMIRSHVVDPLQLRMCFAENIPCSHK

SEQ ID NO: 220214 - protein, 173 aa, Glycine max
  Coding DNA Sequence Number=SeqID_103436
  Homolog annotation: Hit_ID=Q1SAV4; Match level="QueryCoverage=47%, HitCoverage=20%, E-value=2e-08, Identity=40%"; Hit description =Integrase, catalytic region
MAQLFLDMFCKHHCLPHNLVFDHDPIFVTTSFHSSLLDGFFFRRSGRSTPLRSSINDYKPQTLTSSHPTIQVGFFHTLPPHCLVLVQWMGLSPEDSSWEKWDNIATTFHLEDKVNLSRSGIDSESHNFEERPLVWTPTMKSLRGTCPDQFITGIDLVLILFFCYSVENVASAF

SEQ ID NO: 220215 - protein, 69 aa, Glycine max
  Coding DNA Sequence Number=SeqID_103437
MKARCRKCREGGDAEESGVVTAKASSCAKPNSKELKSREVFRLSAEHALSETTTANDQGLRRLAQSQLA

SEQ ID NO: 220216 - protein, 265 aa, Glycine max
  Coding DNA Sequence Number=SeqID_103438
MAPRKRKTTASLSQANNILGRNILSERNVKLYITDFDDFRREVERRNMHTELTNFSEGSINVETVKEFYANLYVLEDKEPKQSLPSYSRFCRLRPDPQELAARLCIPRRGFVLNAKGLSWKLLRKDLITLAQTWSVLSYSNLAPTSHTSDLNLDRASPTPQGLDFQPSSLPCARPEESPQILSLMRTQKSRARRSEASSPSATPTPPTSALPSAPAAPVLPEPAPGPAPDYAELARCGPTVTSYERGGVFAEGCLARSPAFSFGR

SEQ ID NO: 220217 - protein, 47 aa, Glycine max
  Coding DNA Sequence Number=SeqID_103439
MSLFNRDSQQRILALHYKGAAFTDRRRVSEKIADYKAMGIPPPPLKT

SEQ ID NO: 220218 - protein, 189 aa, Glycine max
  Coding DNA Sequence Number=SeqID_103440
MLTSPERAQTTTLVSACQSNLGSPNDEDGVVDKSGASAPTYPQFEMRNSDLRSSCFCETNSLGLKMLTSPERVQMTTLVSVCQSDLGSPNEEMRITIRASPRATDLTGHDSKSFGLKMLTSPKRVQMITLVSACQSDLGSPNDEVWITVRASPRATGLTGHDSKMWGGRQKRGFCSYVSSICDEELKPM

SEQ ID NO: 220219 - protein, 99 aa, Glycine max
  Coding DNA Sequence Number=SeqID_103441
  Gene Ontology: Mol. function=protein-tyrosine kinase activity; Biological process=protein amino acid phosphorylation
  Homolog annotation: Hit_ID=Q2HSI2; Match level="QueryCoverage=85%, HitCoverage=9%, E-value=4e-26, Identity=61%"; Hit description =Protein kinase
  Pfam annotation: Domain name=LRRNT_2; Domain location=37-78; Score =17.3; E_value=0.014; Accession=PF08263.3; Description=Leucine rich repeat N-terminal domain
MPIFDTNGVVTMMGMMKVSIFVFLTLMITMGCYGVTNPNNLRILNDFRKGLKNPKLLKWPDNGNDPCGPPSWSYVYCSGGRVTQIQTKNLGLEGSLPPK

SEQ ID NO: 220220 - protein, 256 aa, Glycine max
  Coding DNA Sequence Number=SeqID_103442
  Homolog annotation: Hit_ID=Q5ZC01; Match level="QueryCoverage=97%, HitCoverage=24%, E-value=2e-11, Identity=27%"; Hit description=IFA -binding protein-like
MMDEESEYEIEALQKANCLLVEKEKEIEELEAKLELYRKKFPDESMLENMVDTNFEMKDESVLGKSVSENTNISDKYEVLPTSLEKQNVQSVKNSPLEFQDERLYISQRLKKLEKQVYFFLNIHQSRDNWLNSEKDEKESLENCEKLDNNILMQETICSPKLNSDDMGDDSSSKEPPVCKQNGELGYNGHNSPALCRNNDLSSTGSLVSDFIGRLQVLEADLSFLKHSINLSSNGEEGLKLLQEIDDQLQQNARLG

SEQ ID NO: 220221 - protein, 77 aa, Glycine max
  Coding DNA Sequence Number=SeqID_103443
MWVSRKRFPTDFRREEKEKSDFRQEDDKEKREGKQTKKNRMTNLSLKFGMDEGFSCEGTKVRNSCCQHGLVPGMKPK

SEQ ID NO: 220222 - protein, 275 aa, Glycine max
  Coding DNA Sequence Number=SeqID_103444
  Gene Ontology: Mol. function=ion channel activity; Cellular component= integral to membrane; Biological process=hypersensitive response
  Homolog annotation: Hit_ID=Q94AS9; Match level="QueryCoverage=90%, HitCoverage=35%, E-value=1e-120, Identity=82%"; Hit description =Cyclic nucleotide-gated ion channel 4
MRHWVWLRVNTKEVSIIFIVLNRIVAAGACWYLLGIQRAAKCLKVQCEKTSGCGMKILSCQTPIYYGSNSFLVRDRARLAWAENREVRHTCLNGPDNYNYGAYRWSVQLVTNDNRLEKILFPIFWGLMTLSTFGNLESTTEWLEVVFNIIVLTSGLLLVTMLIGNIKVFLHATTSKKQAMQLKMRNIEWWMRKRRLPLGFRQRVRNYERQRWAAMRGVDEFEMTKNLPEGLRRDIKYHLCLDLVRQVPLFQHMDDLVLENICDRVKSLIFTKGET

SEQ ID NO: 220223 - protein, 87 aa, Glycine max
  Coding DNA Sequence Number=SeqID_103445
  Gene Ontology: Mol. function=DNA binding; Cellular component=nucleus; Biological process=regulation of transcription, DNA-dependent
  Homolog annotation: Hit_ID=Q8GZA8; Match level="QueryCoverage=95%, HitCoverage=37%, E-value=2e-11, Identity=42%"; Hit description =Protein ULTRAPETALA1
GVEGGRETSGLIVKTKTPLIKYYTQQANVANRKDSAMRKQNIHRDEFLRCKRCGKERRFHLKSTPDIKNYHDALNNKCWTCSLWPYQ

SEQ ID NO: 220224 - protein, 72 aa, Glycine max
  Coding DNA Sequence Number=SeqID_103446
MHKTQCGPLRVHRMNRKAWFEQNRGGGCRPARPGELNSPRRAGLLPPEATAFWRNIPEGPSGPGCYLHPHFY

SEQ ID NO: 220225 - protein, 45 aa, Glycine max
  Coding DNA Sequence Number=SeqID_103447
DKGSEVEVVTMMMVTIVMVLVTTMVGWNTGGGGEMVIVTVVAVEW

SEQ ID NO: 220226 - protein, 85 aa, Glycine max
  Coding DNA Sequence Number=SeqID_103448
MIGGIRLEKGSFAAQQHKQHDQEESNLLKKTNNGANKEAIVCKDEQYCTGTLKKRASRVSRKPKNQLPHIHEDYSGPRHHRPRHH

SEQ ID NO: 220227 - protein, 92 aa, Glycine max
  Coding DNA Sequence Number=SeqID_103449
MQIKSVLNTVMLRMHDNTDGGARVVYLCCGGIVVARSWGLHAHGFGVRSGTRSCLDYGGGVVAIGTILVVRGSSRSEKKVWGHKKGEEEEGG

SEQ ID NO: 220228 - protein, 87 aa, Glycine max
  Coding DNA Sequence Number=SeqID_103450
MRSAKKAEPLFFFTPPPIYSKIGEELAHPACPGEHGCFLQKQQTSGGRIWKAQLSKKLWKLTDCAETHLFDFRHITEFYGSRKPASF

SEQ ID NO: 220229 - protein, 108 aa, Glycine max
  Coding DNA Sequence Number=SeqID_103451
  Subcellular localization annotation: CTP_CleavageSite=70; ConfidenceScore=5.51e-01
MSPPPLETSQSLKISSKAPQDGFLVKLSYLSVSPQPKPKANSLKSSPPFQFQDFSFNSSIFQILLYAQPTVVALSGLLAQQRIWLSELTISTLHQSFLFHLKLRWKDH

SEQ ID NO: 220230 - protein, 92 aa, Glycine max
  Coding DNA Sequence Number=SeqID_103452
MTNDHIGMMLVMSWVAVMIVMGWVQSACHGLGTEVGGWLLSVEQLKKEKKRVTINQCDKIDGKGCPFSSTKKLEGISNIILTIIITSQPTIT

SEQ ID NO: 220231 - protein, 80 aa, Glycine max
  Coding DNA Sequence Number=SeqID_103453
MAQPPPRDRTLREMAAPNFTYESLCIQYPDEGEDPHKNLKEFHIVCYTMKPPDVQDDHIFLKAFPHSLEWQKNGYTTLLP

SEQ ID NO: 220232 - protein, 64 aa, Glycine max
  Coding DNA Sequence Number=SeqID_103454
MEVHPYLKFEAPQCRGVLHDFENGFSLQFGVEMEKNFGASMEASMVEKKKEEKQHGREEKLMNF

SEQ ID NO: 220233 - protein, 81 aa, Glycine max
  Coding DNA Sequence Number=SeqID_103455
MNLIVALLNCLHSYIVCFEFLVLEWGNELISENDNAKFGFKALGVAIGERVMCVLLIAIRGCKVNLQGLEGNSAMSGSDRS

SEQ ID NO: 220234 - protein, 128 aa, Glycine max
  Coding DNA Sequence Number=SeqID_103456
MAMINLRVSNILLLMLTRRNLNQLRGIVVADSAALASCTDKLYGDGDVGYGVVADIQDSMRRGLAQTLKGYGELNVCCGYTAVVDAAAAAAESDAAAAVAVDQIVAAKHIQLPAHAAASESNLVDQSH

SEQ ID NO: 220235 - protein, 78 aa, Glycine max
  Coding DNA Sequence Number=SeqID_103457
MVLGCTIGIGGIKCPCLKCNCCAILRDQMVKVHLYKVGFKPNYWIWIDDGEETSHVDLLVEDNCMGVLSSGADVTQVE

SEQ ID NO: 220236 - protein, 47 aa, Glycine max
  Coding DNA Sequence Number=SeqID_103458
NTNGNDVDVAPEFSPLKTVHFGNPSQDTVDPRDGGFGGRLSRWKWEK

SEQ ID NO: 220237 - protein, 86 aa, Glycine max
  Coding DNA Sequence Number=SeqID_103459
  Homolog annotation: Hit_ID=O64438; Match level="QueryCoverage=47%, HitCoverage=17%, E-value=7e-14, Identity=83%"; Hit description=ARG10
CFYSTAVGGLRCYENPKNKITAVPAEEEQIWGAFFKNRESVISLNSNIRLMSVETALGTKGKCEVILELKKLELNIPYVTRIASCN

SEQ ID NO: 220238 - protein, 134 aa, Glycine max
  Coding DNA Sequence Number=SeqID_103460
VAVCLRRACSQMDLTPGLKCFATADIKEIATNTGNGFAITDELNDLLFSLGVDLAGMRNIGKIAIAGEENMLFAKATFWQRAQNKADAAQKIVVVNPQVIAFGTNVRVFTEHFGLHEADGRINDEYHSAEYPAP

SEQ ID NO: 220239 - protein, 89 aa, Glycine max
  Coding DNA Sequence Number=SeqID_103461
  Gene Ontology: Mol. function=methyltransferase activity; Biological process=metabolic process
  Homolog annotation: Hit_ID=Q67W64; Match level="QueryCoverage=83%, HitCoverage=21%, E-value=1e-26, Identity=68%"; Hit description =Methyltransferase-like
MEDECKNVLELGTQQDHAIEADIFACPVCYEPLIRKGPSGLNLPAIYRSGFMCKRCKKTYSSKDRYLDLTVTAGLRDYTEIQPARTELF

SEQ ID NO: 220240 - protein, 192 aa, Glycine max
  Coding DNA Sequence Number=SeqID_103462
  Gene Ontology: Mol. function=nucleic acid binding; Biological process= DNA integration
  Homolog annotation: Hit_ID=Q1RXW3; Match level="QueryCoverage=81%, HitCoverage=25%, E-value=3e-18, Identity=35%"; Hit description=Zinc finger, CCHC-type
  Pfam annotation: Domain name=zf-CCHC; Domain location=121-138; Score =10.3; E_value=0.02; Accession=PF00098.13; Description=Zinc knuckle
MKQQKLIFLLNSKAKNAMLCALLEEEYTKVTVLRALKNLESMSLEKLVGTLKVHEQELQQGKALKVSDSSNNEYEKDSDEDELAFISRKICKMWRNKNRSKWTNSSRRMPWDKKDKDKSSIVCYEYKKPRHFKSKCPYLVKSQNKKKFFKTKAKKEIMNTWEDLDYTSSNEDDEDANICLMAYTTSEGSKSD

SEQ ID NO: 220241 - protein, 101 aa, Glycine max
  Coding DNA Sequence Number=SeqID_103463
MDKRGWCVIIKTKPRGVIESDDVEEDELVRNITHNYREDALFQPSVQNAIFKKDNIEETRRPPRNMPWKVAFTKVKKHMTLSILPINPRPSELDTLNNSSM

SEQ ID NO: 220242 - protein, 410 aa, Glycine max
  Coding DNA Sequence Number=SeqID_103464
  Gene Ontology: Mol. function=oxidoreductase activity; Cellular component=intrinsic to endoplasmic reticulum membrane; Biological process=electron transport
  Homolog annotation: Hit_ID=Q69NJ7; Match level="QueryCoverage=97%, HitCoverage=77%, E-value=1e-121, Identity=50%"; Hit description =Flavin containing monooxygenase 3-like
  Pfam annotation: Domain name=FMO-like; Domain location=2-391; Score= -378.5; E_value=2.4e-06; Accession=PF00743.9; Description=Flavin -binding monooxygenase-like
MERRVAIIGAGTSGLVACKYLIEFGFNPIVFEVDDGVGGLWRHTIESTKLQNTKQTYQFIDFPWPSSVKEDNPSHNQVLDYLKSYAEHFSLISYIRFNSKVINIDYVGESSEEMKSWELWGCNGRPFCSKGTWHIVVQDTKNLSIEVHKADFVILCIGKYSGFPNIPEFPPGKGPEVFNGRVMHSMDYSNLDNETAAEFIKRKKITIIGSQKSGLDLAAECANVNGVMYPCTIIQRTAHWILPDFDLWGVIVGFFFLNRFAELLIHKPGEPFLLGLVATLLSPLRWGISKFVETILKWKLPLKKYGLVPNHSFLQDLSTCLLGVFPDNFFDKLKEGSILMKKSQSFSFCREGVIIDGEAKPLETNIVIFATGYKGDQKIKNIFKSPIFQNYIIGPATSTLPLYRLVVEEK

SEQ ID NO: 220243 - protein, 65 aa, Glycine max
  Coding DNA Sequence Number=SeqID_103465
  Gene Ontology: Mol. function=methyltransferase activity; Biological process=metabolic process
  Homolog annotation: Hit_ID=Q67W64; Match level="QueryCoverage=74%, HitCoverage=14%, E-value=1e-15, Identity=71%"; Hit description =Methyltransferase-like
MLRQCYDFIEKDDTLSTNNIALVRADVSRLPFSSGSVDAVHAGAALHCWPSPSNAVSAVSVCDEQ

SEQ ID NO: 220244 - protein, 104 aa, Glycine max
  Coding DNA Sequence Number=SeqID_103466
MKLLSSQGRAKVILNQLLLSRRSRGCEGIEKTRATHANKAFTGKEVTPPSPSHSSSNSESDDETTTHISLVRPQSPPHKCPPLSPLNLSSSSVTLFAWKVLWRP

SEQ ID NO: 220245 - protein, 103 aa, Glycine max
  Coding DNA Sequence Number=SeqID_103467
MKGTNYTRNKKTLSRNNKLVRRLDSHNTRISWYRTVRLDTKKVSTSNFADMSIDDHRDSIQVLLLTKAFLKQQEETKQELFNQREETKQELQAFVEQQKLENE

SEQ ID NO: 220246 - protein, 94 aa, Glycine max
  Coding DNA Sequence Number=SeqID_103468
MVKGFGRWRCMGQFVESIVMIRVREMCEHKGKEEKRRDRWGLLMSLGVKKKGFVNVSIVIERKTMGLEEVEMMAVVVAKNNSDGMHPWEARSNY

SEQ ID NO: 220247 - protein, 73 aa, Glycine max
  Coding DNA Sequence Number=SeqID_103469
MAQIADVERLGKLGTAGSQLASLGIGKVRSRWKKSNGWDEAWENEGIGDTCLAGEGIKVDLGLDMGMLLYFNS

SEQ ID NO: 220248 - protein, 148 aa, Glycine max
  Coding DNA Sequence Number=SeqID_103470
  Gene Ontology: Mol. function=prephenate dehydratase activity; Cellular component=cytoplasm; Biological process=L-phenylalanine biosynthetic process
  Homolog annotation: Hit_ID=Q1RXT6; Match level="QueryCoverage=60%, HitCoverage=22%, E-value=4e-35, Identity=76%"; Hit description =Prephenate dehydratase with ACT region
  Pfam annotation: Domain name=DUF1442; Domain location=1-140; Score= -29.6; E_value=2.5e-05; Accession=PF07279.2; Description=Protein of unknown function (DUF1442)
  Pfam annotation: Domain name=PDT; Domain location=64-148; Score= -37.8; E_value=1.1e-06; Accession=PF00800.9; Description=Prephenate dehydratase
  Pfam module annotation: Pfam domain module=DUF1442::PDT; Domain location=1-140::64-148
  Subcellular localization annotation: CTP_CleavageSite=47; ConfidenceScore=5.11e-01
MAAGWNSQLVVETWSQGGRITTSVGLAVARSHTCGRHVCVVSNERVRSKYVERIGKVGVMMDIMGLPGAYTEDAALKAYPKCETVPCEDFETSFKAVESWLVDKVVLPIKSSIGGSINRNYDLLLGHKLYIVGEVQLLINHCLLGLPG

SEQ ID NO: 220249 - protein, 41 aa, Glycine max
  Coding DNA Sequence Number=SeqID_103471
MVIFNYGDATEDKGEEPRSLTNVNLRGIFQGYAKGILAYSL

SEQ ID NO: 220250 - protein, 74 aa, Glycine max
  Coding DNA Sequence Number=SeqID_103472
MEHNIRRENGVRLFVCQRERMQTEVVVRHMGRAWVWMHSNIVLVIGVGEGSVIVTTNHTLVAISPPCDHVSTTS

SEQ ID NO: 220251 - protein, 175 aa, Glycine max
  Coding DNA Sequence Number=SeqID_103473
  Gene Ontology: Mol. function=nucleic acid binding
  Homolog annotation: Hit_ID=Q1RZN4; Match level="QueryCoverage=75%, HitCoverage=77%, E-value=4e-19, Identity=64%"; Hit description=Zinc finger, SWIM-type
MFQSQGIPCRHILCVLKGKGLTEIPSNYNVNRWIKLANRKLVFDIADNVLDTFSKPENERDSKQTKTKIYKPLLDQAFLKKWEFFHHNFQRQKEVVNESKAAKRKLLNNNKKECVFVKHVANKHFIIAVIVPKNYLPNFGLAKEENEEKIVEKWSNQASMFLLISSENAHVELKV

SEQ ID NO: 220252 - protein, 50 aa, Glycine max
  Coding DNA Sequence Number=SeqID_103474
QEPQPKPEVAREATPEATPRTSPVTSPILEVSGEEDGAVDADYAADMTAA

SEQ ID NO: 220253 - protein, 219 aa, Glycine max
  Coding DNA Sequence Number=SeqID_103475
  Gene Ontology: Mol. function=glutathione transferase activity; Cellular component=cytoplasm; Biological process=auxin mediated signaling pathway
  Homolog annotation: Hit_ID=Q9FQF1; Match level="QueryCoverage=96%, HitCoverage=97%, E-value=8e-76, Identity=64%"; Hit description =Glutathione S-transferase GST 7
  Pfam annotation: Domain name=GST_C; Domain location=92-191; Score =39.9; E_value=8.9e-09; Accession=PF00043.15; Description=Glutathione S-transferase, C-terminal domain
  Pfam annotation: Domain name=GST_N; Domain location=6-79; Score=80.2; E_value=6.3e-21; Accession=PF02798.10; Description=Glutathione S -transferase, N-terminal domain
  Pfam module annotation: Pfam domain module=GST_C::GST_N; Domain location=92-191::6-79
MAKDYGEVELFGVGGSPFARRVQIALELKGVQYTYFEEDLRNKSALLLKYNPVHKKVPVLVHNGRPLAESLVILEYIDETWENHHPILPQQPYDRALARFWSRYIDDKAAFTVDKEERDKGTEESLESLQILENELKHKFFGGETIDIVDIAAGFIAFWLPAIEEAVGLKLLTNEKFPKLYKWGEDYTNHPIVKKNLPQRDRLVGFFKARYASSNTASK

SEQ ID NO: 220254 - protein, 80 aa, Glycine max
  Coding DNA Sequence Number=SeqID_103476
MSDHGNGFLQLSLGDPAIPCTATCTAHSTKDNLCCCGMGRIICTSRMGYLLGWTLVGIIAKLGSNLWQLKKQDKCLLGGG

SEQ ID NO: 220255 - protein, 185 aa, Glycine max
  Coding DNA Sequence Number=SeqID_103477
  Gene Ontology: Mol. function=zinc ion binding; Cellular component =intracellular
  Homolog annotation: Hit_ID=Q6H889; Match level="QueryCoverage=94%, HitCoverage=75%, E-value=2e-80, Identity=77%"; Hit description =Putative zinc-binding protein
  Pfam annotation: Domain name=PLATZ; Domain location=25-135; Score =262.1; E_value=1.1e-75; Accession=PF04640.4; Description=PLATZ transcription factor
MELQLGHQKPAWLEALYAQKFFVGCSHHENAKKNEKNICCLDCCTSICPHCLPSHRCHRLLQVRRYVYHDVVRLEDLQKLIDCSNVQPYTINSAKVVFIKKRPQNRQLKGSANYCTSCDRSLQEPFIHCSLGCKVDFVLKHYKDLSPYLRTCKSLHLGPDFLIPQEMGDDETTRSTIVDFDEPMS

SEQ ID NO: 220256 - protein, 228 aa, Glycine max
  Coding DNA Sequence Number=SeqID_103478
  Gene Ontology: Mol. function=drug transporter activity; Cellular component=membrane; Biological process=multidrug transport
  Homolog annotation: Hit_ID=Q1T297; Match level="QueryCoverage=59%, HitCoverage=45%, E-value=4e-40, Identity=64%"; Hit description=Multi antimicrobial extrusion protein MatE
MLKEALVLYSLALCILNLLLTLNPSQGFPKCCERAAPLRRNHDLRARRPPPPLPPLAAAFWLRRPFLSLAGVVLIVIYIFSKPILIFLGESARIALAARLFVYRLIPQIFAYATNFPIQKFLQAQSIVAPSLGGGVRDWVGAVGGVVSAEPVVVDNHDWSVRVHCEEQEVQTDVAGVHVGSVYRFVWVLQDLCCVRGHTVPRDVLDNLELAVNLANRRNLPGAEELVT

SEQ ID NO: 220257 - protein, 67 aa, Glycine max
  Coding DNA Sequence Number=SeqID_103479
MERRCKYRRWPEWLYSWMIKDFRSRGRLPCGRDSHWLECGVRFPYVVARGPQEGEALTDSSESRPWG

SEQ ID NO: 220258 - protein, 87 aa, Glycine max
  Coding DNA Sequence Number=SeqID_103480
MVRMQSYPPRHLDRRLQEDWARDAREGIRVHMSLRIGREITSREVSCQVSIKGGLASHCHGGFTITRGEYLVKGKKIRKGMAGRNGS

SEQ ID NO: 220259 - protein, 56 aa, Glycine max
  Coding DNA Sequence Number=SeqID_103481
MASGASGTSMEVIRAIFKFSNLGPSRSFWKLGYLGRKQPSSLGRQPRRREAVPKGP

SEQ ID NO: 220260 - protein, 88 aa, Glycine max
  Coding DNA Sequence Number=SeqID_103482
MEKTTWASLMQSRMKNQFMLLLMRLTLRPRKDILDDIIDILEDTHIHEEVHKDKEDGNSRDSQSKENQINVIFQGSGELQGITLLIIS

SEQ ID NO: 220261 - protein, 99 aa, Glycine max
  Coding DNA Sequence Number=SeqID_103483
MKVEQLFACHHISIERKVPLATLSFQGYALYWWTSLVRERRIHGDPLVEYWNDLKSSLRKRRIPSYYERELMVMQSYPPRVLDRRLQEAWARATKEGPR

SEQ ID NO: 220262 - protein, 86 aa, Glycine max
  Coding DNA Sequence Number=SeqID_103484
  Gene Ontology: Mol. function=sequence-specific DNA binding; Cellular component=nucleus; Biological process=regulation of transcription, DNA-dependent
  Homolog annotation: Hit_ID=Q8LLR1; Match level="QueryCoverage=94%, HitCoverage=33%, E-value=4e-31, Identity=76%"; Hit description=MADS -box protein 3
  Pfam annotation: Domain name=K-box; Domain location=12-86; Score =42.9; E_value=1.1e-09; Accession=PF01486.8; Description=K-box region
MVELTTKTIELYHRSSFTPQDEHIECETESWYQEVSKLKAKYDSLQRTQRYLLGEDVGPLNIKELQNLEKQLEGSLAQPRQRKVRM

SEQ ID NO: 220263 - protein, 658 aa, Glycine max
  Coding DNA Sequence Number=SeqID_103485
  Gene Ontology: Mol. function=serine-type peptidase activity; Biological process=proteolysis
  Homolog annotation: Hit_ID=Q9FG66; Match level="QueryCoverage=98%, HitCoverage=98%, E-value=0.0, Identity=63%"; Hit description=Acyl -peptide hydrolase-like
  Pfam annotation: Domain name=AXE1; Domain location=378-630; Score= -194.5; E_value=0.0011; Accession=PF05448.3; Description=Acetyl xylan esterase (AXE1)
  Pfam annotation: Domain name=Abhydrolase_3; Domain location=474-620; Score=-71.9; E_value=0.0049; Accession=PF07859.3; Description =alphabeta hydrolase fold
  Pfam annotation: Domain name=DLH; Domain location=441-639; Score= -46.6; E_value=0.00045; Accession=PF01738.9; Description=Dienelactone hydrolase family
  Pfam annotation: Domain name=Peptidase_S9; Domain location=460-642; Score=147.7; E_value=3e-41; Accession=PF00326.11; Description=Prolyl oligopeptidase family
  Pfam module annotation: Pfam domain module=AXE1::Abhydrolase _3::DLH::Peptidase_S9; Domain location=378-630::474-620::441-639::460- 642
MAFSTATVTTAPYGSWKSPITSDDVSGATKDLGGTTIDGRGRLIWLEFRPTESGRGVLVLEPENNGGEAVDITPKEFGVRTLAQEYGGGAFTVSGDVVFFANYNDQRLYKQSISSLDVPPVPLTPDYGGPLVSYADGRLDARFNRFISVREDRRESSLNPPTTIVSIALGSKDLQEPEVLVSGSDFYAFPRLDSKSERITWIQWNHPSMPWDKTELWMIVGVPVFYYMYMSCFNLKLNHLKVPCSEIYKRVCIAGNDPSRVESPTEPKWSLDVGWLQIEFENKVVSVYSLEAEFTRPLWTYGMNSYEFVESSKQKNLIACSYRQHGKSYLGIIDVQGSKLTVIDFPCTDINNITSGNDCLYVEGASEVLPSSVAKVTFDDDKSKAVDFNIIWSSSPDSLKYSSYISKPEFIEFPTEVPGQNAYAYFYPPSNPDFQASKEEKPPLLLKSHGGPTQETRGILNLSVQYWTSRGWAVVDVNYGGSTGYGRVYRERLLRQWGIVDVNDCCSCATYLVDSGKVDKERLCIMGGSAGGYTTLAVLAFRDTFQAGASLYGIGDDKDMYERSPINHVDNFSCPIIIFQGLEDKVVPPDQARKIYQAVKEKGVPVALVEYEGEQHGFRKAENIKFTLEQEMVFFARLIGHFDVADDITPIKIDNFDD

SEQ ID NO: 220264 - protein, 144 aa, Glycine max
  Coding DNA Sequence Number=SeqID_103486
  Gene Ontology: Mol. function=ubiquitin-protein ligase activity; Biological process=defense response to bacterium
  Homolog annotation: Hit_ID=Q8LLW2; Match level="QueryCoverage=66%, HitCoverage=25%, E-value=8e-18, Identity=44%"; Hit description =Receptor-like kinase Xa21-binding protein 3
  Pfam annotation: Domain name=Ank; Domain location=30-62; Score=30.0; E_value=8.3e-06; Accession=PF00023.20; Description=Ankyrin repeat
  Pfam annotation: Domain name=Ank; Domain location=64-95; Score=0.3; E_ value=28; Accession=PF00023.20; Description=Ankyrin repeat
  Pfam module annotation: Pfam domain module=Ank::Ank; Domain location =30-62::64-95
MVEEDPNVLKHTTGDDDKLSPLHVAAANSQVQTPLMYAAKQGKTDCVEKLINAGANIFMLDSRHGGTCLYDAAFHGRIDCLEAILFAAHFTPFEDSRFEILSLHKIGTNELSYLGRGAQSEFLTVQWRRFLSKDSVYALLTMAI

SEQ ID NO: 220265 - protein, 181 aa, Glycine max
  Coding DNA Sequence Number=SeqID_103487
MNPYGGGTSTSFASLMRREGGFKDSWNVDGVPLKVKYPRLYITSNQQHQYTQQIGMSSDTEWEWTLQWRRLFFDVEIDMAAKFMEDTEGLTIHPYKHDKWVFDKGPKEVAENTGTKMESKVQAGVDSISGTGENTTSKGKDTENTRVPLADGHAQQAETVVQTASKTKRKILRPAYLKDFV

SEQ ID NO: 220266 - protein, 102 aa, Glycine max
  Coding DNA Sequence Number=SeqID_103488
MFLVQNVVEVPLSFHRQWMYRYPNYVLFNCDGTKHFIRASACKVTINDGVPSIADPWFRYLGEKKLMARDEVAFYFQFDDHAWELLIRKEIEWEEQDIQLED

SEQ ID NO: 220267 - protein, 766 aa, Glycine max
  Coding DNA Sequence Number=SeqID_103489
  Gene Ontology: Mol. function=nucleotide binding; Cellular component =cytoplasm; Biological process=response to unfolded protein
  Homolog annotation: Hit_ID=Q655N4; Match level="QueryCoverage=98%, HitCoverage=96%, E-value=0.0, Identity=53%"; Hit description =Putative heat-shock protein
  Pfam annotation: Domain name=HSP70; Domain location=3-680; Score =477.3; E_value=1.8e-140; Accession=PF00012.10; Description=Hsp70 protein
MSVVGFDIGNENCVIAVVRQRGIDVLLNYESKRETPAVVCFGEKQRILGSAGAASAMMHIKSTISQIKRLIGRKFADPDVEKELKMLPVETSEGQDGGILIHLKYMGEIHVFTPVQLLSMLFAHLKTMTEKDLEMLISDCVIGIPSYFTDLQRRAYLDAAKIAGLKPLRLIHDCTATALSYGMYKKDFGSAGPVNVAFIDIGHCDTQVSIASFEFGKMKILSHAFDRSLGGRDFDEVIFSHFAAKFKEEYHIDVYSNTKACFRLRAACEKLKKVLSANLEAPLNIECLMDEKDVKGFITREEFEKLASGLLERVSIPCRRALIDANLTEEKISSVELVGSGSRIPAISTLLTSLFKREPSRQLNASECVARGCALQCAMLSPIYRVREYEVKDVIPFSIGLSSDEGPVAVRSNGVLFPRGQPFPSVKVITFRRSDLFHLEAFYANPDELPPGTSPIISCVTEKEEENVVDLTSFFVLIGPFHGSHGSKIRVKVRVPLDLHGIVSIESATLIKDDSVMAGDYHSNSDAMDIDPISETVTNGFEDNTNKNLESPCSSADGTRKDNRRLNVPVNENVYGGMTKAEISEAREKELQLAHQDRIVEQTKEKKNSLESYVYDMRSKLFHTYRSFASEQEKDDISRTLQETEEWLYEDGVDETEHAYSSKLEDLKKLVDPIENRYKDDKERVQATRDLSKCILKHRASADSLPTQDKELIINECNKVEQWLEEKIQQQESFPRNTDPILWSSDIKSKTEELNLYDFLFSFSEV

SEQ ID NO: 220268 - protein, 63 aa, Glycine max
  Coding DNA Sequence Number=SeqID_103490
MKTNNQIWIPWWLTHNDTVVIDSEGESMLIVSIEGGCSGGVIAKVVTVAIEDEARRTLTLVDV

SEQ ID NO: 220269 - protein, 61 aa, Glycine max
  Coding DNA Sequence Number=SeqID_103491
VFNDNNWCASLRRGEAKRVMVWLVGDGATIVRGWHLAMLKLVHVFMGSATVQHNNGLGVSL

SEQ ID NO: 220270 - protein, 181 aa, Glycine max
  Coding DNA Sequence Number=SeqID_103492
  Gene Ontology: Mol. function=RNA-directed DNA polymerase activity; Biological process=RNA-dependent DNA replication
MVALDLKVEQQQLSAKELLEGICRSMKQVFSEEESDIMWMMTKFYFFRKLPRGTNASFLALIPKKEFPEGLSDYRPISLIKSLYKIIVKVLFGRLRTIMHLLVIHEAKSKKKATLVYKADFEKAYKVLTNNSFLYDVQNKKLFGSDSGGGQHGVSICKVDELYYLETSFEVPRLTYRGQCS

SEQ ID NO: 220271 - protein, 83 aa, Glycine max
  Coding DNA Sequence Number=SeqID_103493
MSSLLVIRENSNPNPNPYPINSSIPCQSQDGYPQVKYQLEDYSSLENNILGREKVNLHVQGHGRREGLQGQVQPQGEEEPYSL

SEQ ID NO: 220272 - protein, 105 aa, Glycine max
  Coding DNA Sequence Number=SeqID_103494
MKVPQQMEDESSETTTPEPLVRRKKENQTEEAAATSEKSLEATFEPSEPMADSASLQQAADPSTPEDQTTPVLSPNTSPTATPMLHLTDKEDVQTQDTQDRSQDF

SEQ ID NO: 220273 - protein, 60 aa, Glycine max
  Coding DNA Sequence Number=SeqID_103495
MSRNLTDYATIPSLASGMLQNLMDCALTRLFNSRHAAELHGLPNDGCQACNELQNKERET

SEQ ID NO: 220274 - protein, 97 aa, Glycine max
  Coding DNA Sequence Number=SeqID_103496
MQNKWGPLRVHRMKTEERRRAMRNGGKPLRNRPRKRLGCVTEAPRLGFSSWKQFFSLILREKRVVVAAQLAQKAPPSVGRFWKAQVGLIATCTPRVY

SEQ ID NO: 220275 - protein, 161 aa, Glycine max
  Coding DNA Sequence Number=SeqID_103497
MLRKLEEIYGALESISVKDTLLEEEEYALGVYGDREPVIKEFPPRKIVAPNPNSLIFKHRLTDRKMYPPCENVPKANCYKVKEFLIEDDEDVPPIRYVKARPGRLFKHKLEALRQKAEITNLDWYAMKRFYRLQECYFGLELNEKPPVDAVHMKLGDVIRP

SEQ ID NO: 220276 - protein, 286 aa, Glycine max
  Coding DNA Sequence Number=SeqID_103498
  Homolog annotation: Hit_ID=Q1SNL3; Match level="QueryCoverage=54%, HitCoverage=40%, E-value=4e-10, Identity=25%"; Hit description =Immunoglobulin/major histocompatibility complex
MGDHKVTGWEWDFHWRRHLFDCEVSMADNFINEMTGVRVQLNCRDDWVWKPEPSGQYSAKSDYDMLRGVVVQGADVADFEQLWKLRIPSKAAIFVSRSTAEDTPHLFFQSSKILPLWWETTSWVWWVALTWSVWQMRNNIIFSNGIFNGNKLMEDATFLFWTWLRNYEKDFVTNFNHWSSNLTESALGNHPTGLYVSVPLPHLKDTMRWLADPSGLYSSKSAYSLLTNVNRNLPHPNIYKSFWKLNIPPRAAISSRGGWPLVFQLQGHYCFMVGIHELEQDGRSPG

SEQ ID NO: 220277 - protein, 120 aa, Glycine max
  Coding DNA Sequence Number=SeqID_103499
MKQAKYSLKAQVEKDEGPSGEGQSPRVEKDEGPEAETLSRLLIVAEGPNLSSFTGSGVYPDLSSLTGSGVYPDLSSFTGSGVYHDLSSFTGSGVIQTFVACIKRSAPTQVRIIWYQSFGS

SEQ ID NO: 220278 - protein, 367 aa, Glycine max
  Coding DNA Sequence Number=SeqID_103500
  Homolog annotation: Hit_ID=Q9FFT8; Match level="QueryCoverage=96%, HitCoverage=66%, E-value=8e-50, Identity=35%"; Hit description =Genomic DNA, chromosome 5, P1 clone:MBG8
  Pfam annotation: Domain name=PAM2; Domain location=152-169; Score =18.7; E_value=0.022; Accession=PF07145.5; Description=Ataxin-2 C -terminal region
MTKTAAETTATRALFHQFQSSSLPHSRQAGDDKSNSNGKTDNCGEKSEFVNEKTDEKIQSLNSSHETDTSLGQEVAVEHGSTDRTSIPSDNGLLCNNTPASVKASDRNSERSTSADSVSTNLTQGVDLIQDSQPARSNEISVPRGTGSTRNAKEFKLNPAAKTFSPSFVNPMPATSAANMVYIPNSSPPVPVTIQPEVGFNTFASRPSMPVKVSQYSNLTVGNGGSGSQFSQPIVGHVAHRAQPLRYATHYNPVLSEPAYMQPSSPAVMVGRSPQLVYVQPVSHDLIHGTTAVPPVSARPLMNHVQFPKQQGGTIGPAMPVCVPPPVLTSGHQPFTLRSHIPLLQPGFPVSRPISVPGPNGFYGTKF

SEQ ID NO: 220279 - protein, 127 aa, Glycine max
  Coding DNA Sequence Number=SeqID_103501
MLHADVVGGNITGGDEEAVAHNVCSESLTCEVENHTGPLMDTKQVNHSRYYDIFYFGGQHLSYESLEFKAYLENGKIMSDKATKGNKSVRWLVSHRLWHSSAERPPPAAGDAIAEWLVVVVADQIAG

SEQ ID NO: 220280 - protein, 70 aa, Glycine max
  Coding DNA Sequence Number=SeqID_103502
  Homolog annotation: Hit_ID=Q1RYJ7; Match level="QueryCoverage=97%, HitCoverage=7%, E-value=1e-12, Identity=63%"; Hit description =Timeless protein; Timeless C-terminal
MEMKKLVHPQQRDMLDVIKGFAPTSGSNSDKDDHNGEQLMEDESQIALRRRKKLVLNGDLERQIKDLHEK

SEQ ID NO: 220281 - protein, 100 aa, Glycine max
  Coding DNA Sequence Number=SeqID_103503
  Homolog annotation: Hit_ID=Q9LHH2; Match level="QueryCoverage=90%, HitCoverage=8%, E-value=9e-09, Identity=36%"; Hit description =Ankyrin-like protein
MGKTHFDVEEKRAKGDDDDVVVVEGGSPPKRLMAEIYQHFTNPWSPGSDRSKRQREREKERLSRRKWEPQHFFKIINCSPTPTRPLQGLWKDCNKTTAAI

SEQ ID NO: 220282 - protein, 72 aa, Glycine max
  Coding DNA Sequence Number=SeqID_103504
MGCRNRDSITENHTSSSSSSSDSLSEALLFTTMCIVGHPVDVHVKDGSVYSGIFHTASVHADYDSLVGSKGL

SEQ ID NO: 220283 - protein, 116 aa, Glycine max
  Coding DNA Sequence Number=SeqID_103505
MYLLEEAHPEERRFGDTVGVRIGVGRGNPRSGDEGWAPLEEEQGRDSGSALAPEVEEILPAVEGVVELLEGDGGLLGPLGDADVVELLEGKPCCGRGTNSLSVAMKKLKRQEGTPE

SEQ ID NO: 220284 - protein, 283 aa, Glycine max
  Coding DNA Sequence Number=SeqID_103506
  Homolog annotation: Hit_ID=Q8LJ95; Match level="QueryCoverage=23%, HitCoverage=10%, E-value=1e-09, Identity=39%"; Hit description=NBS -LRR resistance protein RGH1-like
MSIRTNPMKAIPLVLKRLRATRITTKLDASSAAKLEELMSLLDKKKDLFKTVKSNGDEFLDILTLLDGHLRYLNKDNLDNAKFEKDMEAILQRIKDSAEKLLPKGATNEGETQALGSSSKVRPLDNQMKKLHSDPSSSQNKNELLDHDLYQKIEVSYEELKDSLNICLLSLLVFPEGAVIRKRHTIYWWIGEGFVTSNGEKTAEEVGEAYGNGLNPVVKKFKVNPHICGQLVSFVSREKLQHLGFSFQIISHHEQPSWLVVERQKVNLGDKGHLKSDLLENYF

SEQ ID NO: 220285 - protein, 463 aa, Glycine max
  Coding DNA Sequence Number=SeqID_103507
  Homolog annotation: Hit_ID=Q2QW37; Match level="QueryCoverage=39%, HitCoverage=12%, E-value=2e-39, Identity=49%"; Hit description =Expressed protein
MVELILLYGGAKFESYKGKLNVVLGLNACRRASISLRHDFVMFCFVCIDNWATITNLCPLCQNEFQLITCVPVYDTIGNNKVEDDSFFKDDDWSIEEKNNTLSFPSYYIDENAVICLDGDGCKVRNGLATIEGDSDLDTSIACDSCLDLICKGHLAEKSGPGFCFRCVVDEVSKGTSNSVERTTMECNADNHNSNSECHAEDSFSGKVSVSVADTGETAVVVSMVDQTIWVPATSEKSLLPFEVGGYPMTESCILMSDTNGQQSGEVKTGTNTLQIMEEEELELSLSNNISCSVTSKSLVHNDLKKSVRGARDDPSGFDGTKLFDESLTKTSPSRIESEMGLQLGLSVGSFLSVDSADKNETKDQATNVLCLSSEECFLKGDEIEANACKDNARVAGGKRKHADYNFPWSLCWGEREREDVKMLWDEAHFALVLTPHAYYTLTDDSNMDTRPNTNTDALTWSM

SEQ ID NO: 220286 - protein, 214 aa, Glycine max
  Coding DNA Sequence Number=SeqID_103508
  Homolog annotation: Hit_ID=Q9FNL3; Match level="QueryCoverage=79%, HitCoverage=80%, E-value=1e-30, Identity=37%"; Hit description =Arabidopsis thaliana genomic DNA, chromosome 5, P1 clone:MCL19
  Pfam annotation: Domain name=DUF679; Domain location=48-211; Score =269.2; E_value=8e-78; Accession=PF05078.3; Description=Protein of unknown function (DUF679)
MDLNEQQIGIKVYNNNATPAPEHETPNPSSNPPQPKKHRALMAKGVQKTLSKTSLLGNFLPTGTLLTFEMVLPSIYKNGQCTHIHTLMIHFLLLVCALSCFFFHFTDSFHGPDGAVYYGFVTPRGLAVFKPAVAVPEDDRFKVGFTDFIHAVMSVMVFVAIAISDHRVTNCLFPGKDKDMEQVRESFPLMVGIVCSSLFLVFPTFRRGIGCMSA

SEQ ID NO: 220287 - protein, 138 aa, Glycine max
  Coding DNA Sequence Number=SeqID_103509
  Gene Ontology: Mol. function=serine carboxypeptidase activity; Biological process=proteolysis
  Homolog annotation: Hit_ID=Q1S8R0; Match level="QueryCoverage=47%, HitCoverage=13%, E-value=2e-19, Identity=82%"; Hit description =Peptidase S10, serine carboxypeptidase
MVINSHKLICKFAANLLSLESPVGVRFSYTNTSSDISELGDTITGNLKIHTPLSSSGLEDFHNSGHTNSTFPVKAMLVSSNVLKQAIACFNSQVASYTSFITSRINNAECLASACSVLNMLILKVSQVFPSLVMEVSY

SEQ ID NO: 220288 - protein, 466 aa, Glycine max
  Coding DNA Sequence Number=SeqID_103510
  Gene Ontology: Mol. function=transferase activity, transferring glycosyl groups; Cellular component=membrane; Biological process =cellulose biosynthetic process
  Homolog annotation: Hit_ID=Q67BC7; Match level="QueryCoverage=99%, HitCoverage=50%, E-value=0.0, Identity=66%"; Hit description =Cellulose synthase catalytic subunit 12
  Pfam annotation: Domain name=Cellulose_synt; Domain location=1-464; Score=569.9; E_value=2.4e-168; Accession=PF03552.5; Description =Cellulose synthase
LSETSEFARKWVPFCKKFCIEPRAPEWYFAQKVDYLKDKVDATFIRERHAIKREYEEFKVRINALVALAQKVPEDGWTMQDGTPWPGNNVRDHPGMIQVFLGQNRVRDFEGNELPRLVYVSREKRPGYDHHKKAGAMNALVRVSAIITNAPYVLNVDCDHYINNSKALREAMCFMMDPTSGKKICYVQFPQRFDGINRHDRYSNRNVVFFDINMKGLDGIQGPIYVGTGCVFRRQAFYGYDVPTSKKAPRKTCNCWPKWCCCLCCGSKKKKIKAKSTSTLLEDGGVPKAASSATLLKEAIHAISCVTEDILTSFKMHCHGWRSVYCMPKRPAFKGSAPINLSYRLHQVLRWALGSVEIFFSRHCPIWYGYGGGLKSLERFSYINSVVYPLTSIPLISYCALPVVCLLTRKFIVPELQLASWKCSGEVSVYMTGGGTSSSGSLVVPPHISLLSFRVCSKFCQEFSQY

SEQ ID NO: 220289 - protein, 89 aa, Glycine max
  Coding DNA Sequence Number=SeqID_103511
  Homolog annotation: Hit_ID=Q1RT71; Match level="QueryCoverage=51%, HitCoverage=10%, E-value=2e-15, Identity=80%"; Hit description =Cyclin-like F-box
MSLGVAEEWIYVIKRNPNGKISWHALDPVYHLWQSLPPVPKEYSGALARSLIKEGATKKKKMQQDQLKKVVSLSMISHLVCKVCYDAMR

SEQ ID NO: 220290 - protein, 174 aa, Glycine max
  Coding DNA Sequence Number=SeqID_103512
  Gene Ontology: Mol. function=zinc ion binding; Cellular component =intracellular
  Homolog annotation: Hit_ID=Q9ZTK7; Match level="QueryCoverage=80%, HitCoverage=46%, E-value=3e-25, Identity=49%"; Hit description =CONSTANS-like protein 2
MAQPIQSMRVMRGSCCQQARVAPLACHALRGVRADRDIHFANPLASCHERIPVTPFFEFVHSFKASLPINFHHRFFSNTDADADADVSTEEAEAASWLLANLKTDLNLSQYLFSETKPVPYIDLDYAAIDPKTEEKSSAIADDIVPVQSNFESFTYEHRTSFFTATFLNLQPSE

SEQ ID NO: 220291 - protein, 52 aa, Glycine max
  Coding DNA Sequence Number=SeqID_103513
MSSFALEIASGISKMFAQKNVTLSPGRHKIVILDEADRYQIRYLCGLTSKLN

SEQ ID NO: 220292 - protein, 219 aa, Glycine max
  Coding DNA Sequence Number=SeqID_103514
  Gene Ontology: Mol. function=methyltransferase activity; Biological process=metabolic process
  Homolog annotation: Hit_ID=Q6X0N8; Match level="QueryCoverage=63%, HitCoverage=18%, E-value=7e-47, Identity=68%"; Hit description =Putative spermine/spermidine synthase
MWMGVLGSDVQSLLPAARSLFLLWKPVITGSQENHFIAIQSNKAPRPSALQLTLKTHVPLISTGSPIWGQVRAPSKHLVHFVNNSTEALILKLHGGHVHDAPSHEGMVADVAVEHVGDDDLGEVDVGDGGVASVVEVLGEAEVAAAGDEELKRERNGFEEGEEWLPEVGSFGVPLEGITVEGEELFPVLFAREVSQGFQNVFRGTTMAVRTLMTLIAAL

SEQ ID NO: 220293 - protein, 104 aa, Glycine max
  Coding DNA Sequence Number=SeqID_103515
  Pfam annotation: Domain name=Ank; Domain location=72-104; Score=21.3; E_value=0.0034; Accession=PF00023.20; Description=Ankyrin repeat
MGTHLQVIGDPMNGVQRQEHLVFRRFGNPFAAHDRNQQVVVSWERSAIRISYRAFNGIVRGCARYVNSRDFNGYTPQHLVALQGQSKCVGALLDNAALIGARTG

SEQ ID NO: 220294 - protein, 88 aa, Glycine max
  Coding DNA Sequence Number=SeqID_103516
MNPRKQCKQKRTQNNHKPNWQARRLTISDKGNAVEERAKCEQLKNATNRSKTAKPHCGGNSCHMRLLTWTQTCHVGLPTWTKVCHIDI

SEQ ID NO: 220295 - protein, 40 aa, Glycine max
  Coding DNA Sequence Number=SeqID_103517
MVQFYSTFSSTLTAFSTPNVAALNKISAICNENAKQNGLV

SEQ ID NO: 220296 - protein, 106 aa, Glycine max
  Coding DNA Sequence Number=SeqID_103518
MKDKREEEEKLEKQKKKKDSKALFSKTKGKEKEENDSSKKIVNRKTILQQKVISKDHSFLNNPSTFSYKGKHPLALPYLLSLRYYEAPNPYDRWYDECVEWCNPLL

SEQ ID NO: 220297 - protein, 148 aa, Glycine max
  Coding DNA Sequence Number=SeqID_103519
MARTKKTGQIMFEAAKEIVDKIGSAGGSIIEKVTQQLMLSFNQMQSQLQSQIQSQGLALPPEPEVGPSATRVSTKGSCVDPSPTDLETGDLDKCGLYIKDNPSHLVALGRVYEGSIVVHNIPLLHGQVKVGVEQVKDAEAPVPVPTDE

SEQ ID NO: 220298 - protein, 190 aa, Glycine max
  Coding DNA Sequence Number=SeqID_103520
AGQEYEALRVLDKGELAMVDFHQPEAAGKHQMVDQHEDEEVTTHPVDQLSVLAGRALPGHPARPARCRELDCQRAFAAEDAGTECQMNEKRQFREADEPCTKDIPRQTSLKALHGRGKPNPPREALSNETNKGPAVKRPPGLIRLRGSDSSGGGLDGGDLPVVVAGAADKGPHFHRFGRMLLVTFDHLAR

SEQ ID NO: 220299 - protein, 103 aa, Glycine max
  Coding DNA Sequence Number=SeqID_103521
  Gene Ontology: Mol. function=electron carrier activity; Cellular component=cytoskeleton; Biological process=electron transport
  Homolog annotation: Hit_ID=Q9JKS4-3; Match level="QueryCoverage=83%, HitCoverage=12%, E-value=4e-09, Identity=36%"; Hit description =Isoform 3 of Q9JKS4
MARTCSPLKVRTCSPLKVRACSLTKVKAHDPLTARTCSPLKLKVHDLLKARTCSLLKVKVRACSPLKARTCSPLEVRACSPLMVRTCSPLKARTCSPLDGEGN

SEQ ID NO: 220300 - protein, 54 aa, Glycine max
  Coding DNA Sequence Number=SeqID_103522
MTKPNDAPSVANIPLDARGSSGASTLWMQEDLLILDLKFSTRLILLCYGFYVIL

SEQ ID NO: 220301 - protein, 113 aa, Glycine max
  Coding DNA Sequence Number=SeqID_103523
  Gene Ontology: Mol. function=transporter activity; Cellular component= integral to membrane; Biological process=transport
  Homolog annotation: Hit_ID=P21727; Match level="QueryCoverage=75%, HitCoverage=21%, E-value=4e-32, Identity=81%"; Hit description =Triose phosphate/phosphate translocator, chloroplast precursor
SLPHLRKRRGRRLQRLPRRREGRGLRRGRRKPDLGEAAAPGALLAGAEEGGCPPPAMPRRRLLAGRGEAKVAPAGFFDKYPALVTGFFFFTWYFLNVIFNILNKKIYNYFPYP

SEQ ID NO: 220302 - protein, 96 aa, Glycine max
  Coding DNA Sequence Number=SeqID_103524
MASINSTYKLFIVILMIEAFLLHLRWWWRPERMIMTTPLRLCFAFILRTPGQISGEAYISGSSRGSDVCQAENNEKNGKNIHRSRVGKQSIKQKSD

SEQ ID NO: 220303 - protein, 187 aa, Glycine max
  Coding DNA Sequence Number=SeqID_103525
  Gene Ontology: Mol. function=transcription factor activity; Biological process=regulation of transcription, DNA-dependent
  Homolog annotation: Hit_ID=Q4K789; Match level="QueryCoverage=88%, HitCoverage=58%, E-value=7e-44, Identity=52%"; Hit description =Transcriptional regulator, LysR family
  Pfam annotation: Domain name=LysR_substrate; Domain location=1-170; Score=32.1; E_value=2e-06; Accession=PF03466.10; Description=LysR substrate binding domain
MHIELTASVSHGLDFSTEQFDAAVVFGRPPGKKLSAHLLFDEILTPVCTPTFLPPAPRLADLTDKTLLHPTRDRRDWLRWLKAAGADALPSGKAQHFDTLDLAMSAALQGFGIAIGDLCLLEEDIQARRIVTPFPLCVSSGAAYYLVYPERGAPSPALAQFIDFLTAEAADSRARLQNYLPITCNAL

SEQ ID NO: 220304 - protein, 301 aa, Glycine max
  Coding DNA Sequence Number=SeqID_103526
  Subcellular localization annotation: CTP_CleavageSite=28; ConfidenceScore=5.43e-01
DPSFSRVVQTSSLLQSLSGVYLFRHSTRTAPRSGPCGRGAEGEYKSLFSNPAFPHIASPHVSSRVCLVGSAATLATTTWCRRRRRLGLSRSTARRLCHSPRPAGPAGSAGGWLSLSSIVQGEVALVWLPRVEQYESIGGSVVECSPATRAARASVAQWLARSAVNRKVGGSTPPGGVTFCQSSSGTTRRTRATPGAGGRIGASGQQGQQPSLASRCGRAVTPLVRRCIVRNSDRSSPVTVVLLLPCPDPRRQRMRDACFAKCGSGGIRTHASEETGALNQRLRPLGHATSHGRVESRSNVD

SEQ ID NO: 220305 - protein, 160 aa, Glycine max
  Coding DNA Sequence Number=SeqID_103527
WHRSHLRPHSCSREKERKPQEANINLPYFHWKDNVEAYLDWEITIEQQLKRKSTSKSYDSHSYPKKDQGQGILGAAPSKPKDDKGKTIEKQPPNTRDINSQCPTKKTMIMRSQDIYSSQDEATTSPSSSESEEAKGEESSEDIYPQEEGQPLMVKEECKE

SEQ ID NO: 220306 - protein, 103 aa, Glycine max
  Coding DNA Sequence Number=SeqID_103528
MKYVVYVHGGAATMLDIPSGGNRVCIDGAHVSYFILYGNSINFVIWNSLETRADPPWGRGGQAVAYARHGDLNTCCLVFLSESVVWTHLGYFLDEWYHIAFES

SEQ ID NO: 220307 - protein, 129 aa, Glycine max
  Coding DNA Sequence Number=SeqID_103529
  Gene Ontology: Mol. function=transporter activity; Cellular component= integral to membrane; Biological process=transport
  Homolog annotation: Hit_ID=UPI00005F7630; Match level="QueryCoverage =99%, HitCoverage=25%, E-value=4e-41, Identity=61%"; Hit description =COG0659: Sulfate permease and related transporters (MFS superfamily)
  Subcellular localization annotation: CTP_CleavageSite=27; ConfidenceScore=5.03e-01
MVHQHGVQYILPAVLMAGVIQILFGVSGMARLMRFIPQAVMTGFVNALGILIFFAQVPHFWSRSPLIVGLFVLTVLIVLWVPRYIKSVPSPLIAIVVLTLYTVSTGQILPTVGDEGAISGGLPGLTELR

SEQ ID NO: 220308 - protein, 111 aa, Glycine max
  Coding DNA Sequence Number=SeqID_103530
SPCVSETRIKFKEVPSRAVDDEMRCSSKISDDTTIDNKGAHSLGWPVGSDHRELRMGACQWKTPLELLGLGSSSSMDSLASWKMNGNGMEKEEREEMPLQGEDESRRSSPP

SEQ ID NO: 220309 - protein, 413 aa, Glycine max
  Coding DNA Sequence Number=SeqID_103531
  Gene Ontology: Mol. function=unfolded protein binding; Biological process=protein refolding
  Homolog annotation: Hit_ID=P31658; Match level="QueryCoverage=57%, HitCoverage=84%, E-value=1e-110, Identity=76%"; Hit description =Chaperone protein hchA
  Pfam annotation: Domain name=ADH_N; Domain location=277-358; Score =77.3; E_value=4.7e-20; Accession=PF08240.2; Description=Alcohol dehydrogenase GroES-like domain
  Pfam annotation: Domain name=DJ-1_PfpI; Domain location=98-252; Score= 4.9; E_value=0.00077; Accession=PF01965.14; Description=DJ-1PfpI family
  Pfam module annotation: Pfam domain module=ADH_N::DJ-1_PfpI; Domain location=277-358::98-252
SQFTSPVSDLSGADYASGYRGRRKVLVIAADERYLPTDNGTLFSTGNHPVETLLPMYHLHAAGFDFDIATLSGQMVKFEYWAMPREDQKIMPFFERYLPQFRQPLALSDVVGQLGADSDYAAVFIPGGHGALIGLPESEAVAETLRWALRHDRFVISLCHGPAAFLALRHGENPLNGYAICAFPDAADKQTPDIGYMPGHLTWYFGEALKAMGLEIVNSDIKGRVHQDRKVLTGDSPFAANALGQLAAKALLDEYANHPGGPEVLQIGEGDIPSVGDNDVLIQVKAAGVNRPDILQRQGVYPMPEGVTPIPGLEVAGLVVAVGAQVTDFHPGDKVCALTNGGGYAEYCAVPAGQTLPIPPGLSFSEAAAIPETFFTVWANLFQMGRAQPHESVLIHGGASGIGTTAILLCHEL

SEQ ID NO: 220310 - protein, 131 aa, Glycine max
  Coding DNA Sequence Number=SeqID_103532
DVLDIVSDIVDPAAFFLPCALCSNSSIFGQDVLDIVSDIVDPAASILHLTFYLALSSNLAQVSKEDLIVRSFLVGAVVVASFGYRKERDGSWVKKGAQPNDDEGQLPVKGDSSLLQSILDRFDGLQTYVGE

SEQ ID NO: 220311 - protein, 294 aa, Glycine max
  Coding DNA Sequence Number=SeqID_103533
  Gene Ontology: Mol. function=DNA binding
  Homolog annotation: Hit_ID=Q1S0F5; Match level="QueryCoverage=81%, HitCoverage=47%, E-value=5e-24, Identity=33%"; Hit description=IMP dehydrogenase/GMP reductase
MVEEFEEILGCPLGGRRPYLFSGFYPSLARISKIVQISAHELDHRKQVENGVVGIPRKYLEAKARILVGKGEWAPFIDILALLIFGGILFPNVDGLVDLAVIDAFLAYHNHKESPVVAMLADLYDTFDRRCEKSSTRIVCCTPALYVWLVSHLFRQEVRHACPLESHHSCTKKGGANWDQLLANKEGASINWFPRWKEERIGVLISCGGFLNVPLIGTRGCINYNPVLAIRQRGYPMRGAPLEEELAPVISRGFDKTNVKTLQKGPQGMGGGAKEGTKNSGAVTMGPLVATVSG

SEQ ID NO: 220312 - protein, 78 aa, Glycine max
  Coding DNA Sequence Number=SeqID_103534
MAELHLVLDVVIPLKLKVSDFDKYKGTTYPKNHLKILTGAAITWYSNLEPSQVHSWKDPMVAFVRQYQYNSDMAPDRM

SEQ ID NO: 220313 - protein, 178 aa, Glycine max
  Coding DNA Sequence Number=SeqID_103535
MRGQDMYSSQDEATTSPFSSESKEATGEESNEEIYPQEEGQPLMVKEGCKEVSVSSKRLAKKESHFAIKINIKETSSLRQPPHFLLCQKILVSTATPLGLEVIPQVKELLDEGLVRMSLNHCALLVPKIGIMRHQIPMINGRQWCFPCSYVSSGAMRKSDLRSSLKARKLCGVLILDF

SEQ ID NO: 220314 - protein, 117 aa, Glycine max
  Coding DNA Sequence Number=SeqID_103536
MDKFDIFVPHPLTDASLLIQLSPECGCKPLVCLLKRPVLRVWTSKTVQSEITRATHLVGVPINRLFHSPLLQGCENKTMMDTLEPYTGAMKGTMHKPQANLRADYKFSPNGFPATRS

SEQ ID NO: 220315 - protein, 261 aa, Glycine max
  Coding DNA Sequence Number=SeqID_103537
  Gene Ontology: Mol. function=protein binding; Cellular component =integral to membrane; Biological process=defense response to fungus
  Homolog annotation: Hit_ID=Q1SWI7; Match level="QueryCoverage=99%, HitCoverage=85%, E-value=3e-73, Identity=41%"; Hit description =Leucine-rich repeat
  Pfam annotation: Domain name=LRR_1; Domain location=103-125; Score =8.9; E_value=6.1; Accession=PF00560.23; Description=Leucine Rich Repeat
  Pfam annotation: Domain name=LRR_1; Domain location=127-150; Score =10.7; E_value=2.9; Accession=PF00560.23; Description=Leucine Rich Repeat
  Pfam annotation: Domain name=LRR_1; Domain location=152-175; Score =8.1; E_value=8.6; Accession=PF00560.23; Description=Leucine Rich Repeat
  Pfam annotation: Domain name=LRR_1; Domain location=2-24; Score=8.8; E_value=6.4; Accession=PF00560.23; Description=Leucine Rich Repeat
  Pfam annotation: Domain name=LRR_1; Domain location=200-222; Score =2.8; E_value=86; Accession=PF00560.23; Description=Leucine Rich Repeat
  Pfam annotation: Domain name=LRR_1; Domain location=225-247; Score =7.6; E_value=11; Accession=PF00560.23; Description=Leucine Rich Repeat
  Pfam annotation: Domain name=LRR_1; Domain location=26-48; Score=9.0; E_value=5.9; Accession=PF00560.23; Description=Leucine Rich Repeat
  Pfam annotation: Domain name=LRR_1; Domain location=50-72; Score =19.7; E_value=0.011; Accession=PF00560.23; Description=Leucine Rich Repeat
  Pfam annotation: Domain name=LRR_1; Domain location=74-96; Score =13.6; E_value=0.73; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=103-125::127 -150::152-175::2-24::200-222::225-247::26-48::50-72::74-96
MILQNLDLSGNSFSSSIPDCLYGLHRLKSLEIHSSNLHGTISDALGNLTSLVELHLSNNQLEGTIPTSLGNLTSLFALYLSYNQLEGTIPTFLGNLRNSREIDLTILNLSINKFSGNPFESLGSLSKLSSLWIDGNNFQGVVKEDDLANLTSLTVFDASGNNFTLKVGPNWIPNFQLTFLDVTSWQIGPNFPSWIQSQNKLLYVGLSNTGILDSIPTWFWEAHSQLLYLNLSHNHIHGELVTTIKNPISIQTVDLSTNHLC

SEQ ID NO: 220316 - protein, 94 aa, Glycine max
  Coding DNA Sequence Number=SeqID_103538
MSLPSAVHVSSTFEFGAMLHDCLSVDPQVQSSILHFYSETHECHCLALFMCPPLSSAEPLQKKEGVEMRIVITERAGRTKSMSYLCFPLISDER

SEQ ID NO: 220317 - protein, 128 aa, Glycine max
  Coding DNA Sequence Number=SeqID_103539
RTKARSSLAIHSEGGWGSTSFMTHGPIETRFSDMDFFEMVNHFFNREREVIQNPLAPVQNRWKFPTPIPQRRLSVHFPEIEEIYSSVAENIMSRDLEISAEISIETLRGWVEEIKENPNPLKSLIREH

SEQ ID NO: 220318 - protein, 219 aa, Glycine max
  Coding DNA Sequence Number=SeqID_103540
  Gene Ontology: Mol. function=type I protein secretor activity; Cellular component=membrane; Biological process=protein secretion
  Homolog annotation: Hit_ID=UPI000068EF7F; Match level="QueryCoverage =72%, HitCoverage=38%, E-value=5e-35, Identity=46%"; Hit description =Secretion protein HlyD
  Subcellular localization annotation: CTP_CleavageSite=46; ConfidenceScore=5.28e-01
MTNKLFILSVAAISLTAWQKRSSKTGWCKTLPSAAKAGIGAAESTVAAAQASVNAAQVEVNKLKPLVAKNIISNVQLQTAQANLAQAQAQLQQAVASKRQATANYKGVEANIEYSIIRAPISGVVGKLPLKVGSLVGPTDQTPLTTISDTSEVFAYFSMNEKEYFNFLEKSVGATMPEKIKNLPMVDLQLANGSIYPEKGKIEAITGQIDPTTGTIQFR

SEQ ID NO: 220319 - protein, 66 aa, Glycine max
  Coding DNA Sequence Number=SeqID_103541
MDMTQMQFMNTGTREIVPFLDTTFGAARRSTYVFKKVTQTLRWFAKVRGSRRKPAHNAYAKGVHDT

SEQ ID NO: 220320 - protein, 112 aa, Glycine max
  Coding DNA Sequence Number=SeqID_103542
MSGRLLASSLAFECHIMHYLVVCILLPRSSNLAQRSFSIGANVVSSFGYCKERDGSWVKKDAPVQAAKDRSPSPYSQRDDSSSLMHNILERFDGLQTYVGEMVKGLMLWGIP

SEQ ID NO: 220321 - protein, 109 aa, Glycine max
  Coding DNA Sequence Number=SeqID_103543
MVRNVSRRLKLNNRCSREIHMVITFHTDVRFGRIIHRDARNCTADAIEKFKLSSLFTRMSDSGKKYIMTLEIEQRKLSRNSNIHNISHGCPIQAHNILRSSKLNNGSSR

SEQ ID NO: 220322 - protein, 84 aa, Glycine max
  Coding DNA Sequence Number=SeqID_103544
MGTSIHQLDSMNLFVKARAWFNPITQEMAILIANTSSTIHRDERLGNMHAINGFMIPTWLAHEENTRIMYEQTCRTKSMLNAYA

SEQ ID NO: 220323 - protein, 222 aa, Glycine max
  Coding DNA Sequence Number=SeqID_103545
  Homolog annotation: Hit_ID=Q1T1F7; Match level="QueryCoverage=63%, HitCoverage=28%, E-value=4e-21, Identity=39%"; Hit description=IMP dehydrogenase/GMP reductase
MERYAWGVPALVHMYDQLNDASMSHSRQLGGYITLLQCWIYEHFLSVTDSTADQEYDEDSPRACRWIATKKTVKSIRTPSYREHLDRLRISDVCWIPYGEHREVRDFHVKSCYSDLLRWGPVAVYYRPERIVRKFHYTQTIPTPLVDSWVSYDDIHDRWMHYEDHIVLADHALDPLPHGHAPQPRVVPQASQTDIPHVSEPRASSTSTEEPRHAVEVCDDIA

SEQ ID NO: 220324 - protein, 96 aa, Glycine max
  Coding DNA Sequence Number=SeqID_103546
MENWQTALRNNFAGLRTRRWSTHEQRKAINSWGSEKSGEWRIGEQRYAMTSWGSELEGGGHMNSASGEWRIGKQRYAITSRASRLDGGGHMNSARQ

SEQ ID NO: 220325 - protein, 147 aa, Glycine max
  Coding DNA Sequence Number=SeqID_103547
  Gene Ontology: Mol. function=RNA-directed DNA polymerase activity; Biological process=RNA-dependent DNA replication
MRRGKSEANTEKKKDTTPNEGKGVPYPLVPSRKEKERHLARFLDIFKKLEITLPFGEALQQMPLYAKFLKDTLTKKNWYIHSDKIMVKGNFSAVIQCILPTKHKDPGVVTIPCSIGELEIIPTRMTLQLADRSITRPYGVIEDVLVK

SEQ ID NO: 220326 - protein, 117 aa, Glycine max
  Coding DNA Sequence Number=SeqID_103548
MGEVEEVQKQMKADMEAVKVQMATMMEAMMSMKEIMEANAVAVAATRAVAKVNPMPPFDINQMNHPTSDMVGKDLGSTNDPMMCKFKMSTPSRHMARLPVRMSITPLLYPLRAKNPK

SEQ ID NO: 220327 - protein, 84 aa, Glycine max
  Coding DNA Sequence Number=SeqID_103549
  Gene Ontology: Mol. function=protein binding; Biological process =signal transduction
  Homolog annotation: Hit_ID=Q1SXM4; Match level="QueryCoverage=54%, HitCoverage=21%, E-value=5e-21, Identity=97%"; Hit description =Leucine-rich repeat, plant specific
  Pfam annotation: Domain name=LRRNT_2; Domain location=27-67; Score =58.1; E_value=3e-14; Accession=PF08263.3; Description=Leucine rich repeat N-terminal domain
MAAATPTSLRFLLSVSVTLTLLNLAASNSEGDALYTLKRSLSDPDNVLQSWDPTLVSPCTWFHVTCNQDNRVTRVFPNCYCLLL

SEQ ID NO: 220328 - protein, 179 aa, Glycine max
  Coding DNA Sequence Number=SeqID_103550
  Gene Ontology: Mol. function=electron carrier activity; Cellular component=membrane; Biological process=electron transport
  Homolog annotation: Hit_ID=Q1T235; Match level="QueryCoverage=72%, HitCoverage=88%, E-value=7e-40, Identity=59%"; Hit description =Cupredoxin
  Pfam annotation: Domain name=Cu_bind_like; Domain location=29-118; Score=41.7; E_value=2.5e-09; Accession=PF02298.8; Description =Plastocyanin-like domain
MVLMMMMTMVLANMAKSELHYVGGDKSSWGPNVNLTEWSSHEHFHLEDWLYLMMCLQDFGYDRNEYNVLEVNKTGYENCVDTGFVQNISRGAGRDVFHLTEFKTYYFLSGGGYCWHGMKVAISVTEGVSAPNPATSPKGGAQASSPKSGCASDGIQVNQKLLEFIFVLMWSISSINISY

SEQ ID NO: 220329 - protein, 169 aa, Glycine max
  Coding DNA Sequence Number=SeqID_103551
  Gene Ontology: Mol. function=electron carrier activity; Cellular component=membrane; Biological process=electron transport
  Homolog annotation: Hit_ID=Q1T235; Match level="QueryCoverage=71%, HitCoverage=86%, E-value=5e-39, Identity=61%"; Hit description =Cupredoxin
  Pfam annotation: Domain name=Cu_bind_like; Domain location=16-98; Score=66.2; E_value=1.1e-16; Accession=PF02298.8; Description =Plastocyanin-like domain
MAKSELHYVGGNKTTWAANVNFTEWSSSEHFHLMDWIYFGYERHEYSVLEVNKTSYENCIEKGFIQNVSRGAGRDVFQLTEFKTYYFLSGGGHCWDGVKVAITVTEGVASPTPAPSPKTGAPTPSPQSDVPATSPKSGAPAPSPKTSSASDDNRLLQMWIKMKNKRIDK

SEQ ID NO: 220330 - protein, 626 aa, Glycine max
  Coding DNA Sequence Number=SeqID_103552
  Homolog annotation: Hit_ID=UPI0000DB7170; Match level="QueryCoverage =27%, HitCoverage=19%, E-value=5e-53, Identity=58%"; Hit description =PREDICTED: similar to La related protein CG14066-PA, isoform A
  Pfam annotation: Domain name=La; Domain location=1-35; Score=25.0; E _value=1.5e-05; Accession=PF05383.7; Description=La domain
MDDQGWVPISTVADFKRVKKMSTDIAFILDALQSSNTVEVEGDKIRKHNSWSKWIRISSGNSESSTDQIQQGELVDGAVNSLENSDAVGDKTKETSEENDKDAVHDSILAEHNQPNKDMLQISYMDQEKNTESHHSNDKSHEGVKFCDFDTANNNLCSQQETEPKIFDNNEAGNMDVLNEMDVRDLSNDFANTFMLDEEIELEQKMLIKKTELSSSGRNDDEDDEMAVIEQDVQRLVIVTQNGDPKQGSRGGVKESISISNELASAINDGLYFYEQELKHRRSNRRKNNSDSRDRNIKSPSHNSGASNIKVFESIGGNSVEESGSNNSRRKHKVFHKQPSSLKQRFFSSNFKNHGTGRNSNGIISESPPSNSVGFFFASTPPENHGFKPSKLSSSPHGGLSGSSPHGVFSGSPHGVFSGSPHGGFSGSPPVGSMPKSFPPFQHPSHQLLEENGFKQQKYLKYHKRCLNDRKKLGIGCSEEMNTLYRFWSYFLRDMFVPSMYNEFKKLAKEDAAANYNYGIECLFRFYSYGLEKEFRDDLYKDFEQTTLDFYHKGNLYGLEKYWAFHHYRKVRGQKEPLNKHPELDRLLREEYRSLEDFRAKEKNVSFDGIPNFDENSNNITIRVVE

SEQ ID NO: 220331 - protein, 198 aa, Glycine max
  Coding DNA Sequence Number=SeqID_103553
MVTYEAEKDVSSPLKTVEEEKADEVIDPLGELVKNLFDIYQRPVEVSWDGAKFGINNVKDGFFITHADVSEIILGDKCLNISILQLWLIASIGYGSLYGFLEPQCIHNASSRRQECENYIGRWLKEVGKQIYIAPYLNQAHWQLVVLCPGDNVVVWFCSLKKKPDAAIKGAVNSAMKSVTKTAEGKPPQHGPQWIEAK

SEQ ID NO: 220332 - protein, 429 aa, Glycine max
  Coding DNA Sequence Number=SeqID_103554
  Gene Ontology: Mol. function=kinase activity; Biological process =fatty acid biosynthetic process
  Homolog annotation: Hit_ID=Q4VYF4; Match level="QueryCoverage=50%, HitCoverage=78%, E-value=1e-106, Identity=83%"; Hit description=SNF1- related protein kinase regulatory beta subunit 1
  Pfam annotation: Domain name=AMPKBI; Domain location=341-428; Score =123.1; E_value=8e-34; Accession=PF04739.5; Description=5'-AMP -activated protein kinase, beta subunit, complex-interacting region
  Subcellular localization annotation: CTP_CleavageSite=20; ConfidenceScore=5.39e-01
MGNANGREDGSIPPAAADPSAAARGTHAPPVSLPPVRAFSSDSMANSPPHSPRRSRSPILFGPQLGWNFGFVRSTRLFVDFAFRVRLLKRNVLLNGSGNFVVDGLVLSCMDRHERGSDVWICVVDGRMDGVDLEDYELLILFETPTYDIPVEFPANPHSGTLAHPSVVSVYILCVLFCSCQRGSLVVSNFCGMDMQQWSFHFLLSCYSGFVVPLAPLQRGNGPPFLNQMWQNESHGIVNHPPEQGIPVMITWNYGGNNVAVEGSWDNWTSRKALQRAGKDHSFLIVLPPGIYHYRFIADGEERFIPELPNVADEMGHVCNLLDVNDYVPENPDGVSEFEAPPSPESSYGQAFPAEEDFAKEPMAVPSQLHLTVLGMENSDIGSSSKPQHVVLNHVFIEKNLASKSVVALGLTHRFQSKYVTVVLYKPLK

SEQ ID NO: 220333 - protein, 121 aa, Glycine max
  Coding DNA Sequence Number=SeqID_103555
MEKIDDSLNKDRGIIIAEENKDPPLSDSMEKTDPSLNKDEGIAKDADALLREMEQDLAFLQRPRSPTSNGYLEAVVINKKRKIEEVEKEMEIPQLPEFEEPPRSFGGLDDIVNLAKQHKNN

SEQ ID NO: 220334 - protein, 89 aa, Glycine max
  Coding DNA Sequence Number=SeqID_103556
  Subcellular localization annotation: CTP_CleavageSite=52; ConfidenceScore=5.32e-01
MGPKSTLRLMRTLGPSLASLAQSFWSLLSNALGGRIASEKGNPRRGSARDVLAQRPTSLPHESFVSSRAQCAQLAKPNFTNSRLAGQSR

SEQ ID NO: 220335 - protein, 136 aa, Glycine max
  Coding DNA Sequence Number=SeqID_103557
  Subcellular localization annotation: CTP_CleavageSite=32; ConfidenceScore=5.03e-01
MYYPGHHQHQSYVEPNVPPVHVLGFMSQHHPSQAQYQSTSFSSHASQGCQQSFQPLGFLSCIPQYSFQVPSTSNVFYGSSQMFATTFNTPPSTYNLASSSSCYRPSLPTQICYMSHEDEDEGEDNNNNNDDDDDGD

SEQ ID NO: 220336 - protein, 133 aa, Glycine max
  Coding DNA Sequence Number=SeqID_103558
SAKRNTHGLSARKNLEEDELYRFIKHTAPGHQAHRFISSAKQEKRAKPKITNDSELCMSRVSREKKVQVPESFERFFRVKIYRDQSLKQEPASWYGKLNSLLDPPWSFNSGNWFDSKVLDSAGMSCRAFTRNQ

SEQ ID NO: 220337 - protein, 73 aa, Glycine max
  Coding DNA Sequence Number=SeqID_103559
MAPHFYSKLQGEAIFGVVKHTSMLWDFEFQVEKWEILRVREAKFGVSGNWSLKWVDSSLKCQLGLVGKLGKSK

SEQ ID NO: 220338 - protein, 496 aa, Glycine max
  Coding DNA Sequence Number=SeqID_103560
  Gene Ontology: Mol. function=protein serine/threonine kinase activity; Cellular component=cytoplasm; Biological process=protein amino acid phosphorylation
  Homolog annotation: Hit_ID=Q53VM3; Match level="QueryCoverage=99%, HitCoverage=100%, E-value=0.0, Identity=82%"; Hit description =Ser/Thr protein kinase
  Pfam annotation: Domain name=NAF; Domain location=330-390; Score =124.7; E_value=2.6e-34; Accession=PF03822.5; Description=NAF domain
  Pfam annotation: Domain name=Pkinase; Domain location=13-291; Score =328.7; E_value=1e-95; Accession=PF00069.15; Description=Protein kinase domain
  Pfam annotation: Domain name=Pkinase_Tyr; Domain location=13-289; Score=19.2; E_value=1.2e-13; Accession=PF07714.7; Description =Protein tyrosine kinase
  Pfam module annotation: Pfam domain module=NAF::Pkinase::Pkinase_Tyr; Domain location=330-390::13-291::13-289
MSQPKIKRRVGKYEVGRTIGEGTFAKVKFARNSETGEPVALKILDKEKVLKHKMAEQLLYSLDSDTMKSSLLDVFNASLQIRREVATMKLIKHPNVVRLYEVMGSKTKIYIVLEFVTGGELFDKIVNHGRMSENEARRYFQQLINAVDYCHSRGVYHRDLKPENLLLDTYGNLKVSDFGLSALSQQVRDDGLLHTTCGTPNYVAPEVLNDRGYDGATADLWSCGVILFVLVAGYLPFDDPNLMNLYKKISAAEFTCPPWLSFTARKLITRILDPDPTTRITIPEILDDEWFKKEYKPPIFEENGEINLDDVEAVFKDSEEHHVTEKKEEQPTAMNAFELISMSKGLNLENLFDTEQGFKRETRFTSKSPADEIINKIEEAAKPLGFDVQKKNYKMRLANVKAGRKGNLNVATEGLESSKKLVYLVMWDTICHIIVLKFERTHHKQIFQVAPSLHMVEVRKAKGDTLEFHKFYKKLSTSLDDVVWKTEDDMQMRETK

SEQ ID NO: 220339 - protein, 172 aa, Glycine max
  Coding DNA Sequence Number=SeqID_103561
  Gene Ontology: Cellular component=chloroplast envelope
  Homolog annotation: Hit_ID=Q5JL23; Match level="QueryCoverage=68%, HitCoverage=32%, E-value=6e-39, Identity=64%"; Hit description=ABC -type transport system-like
  Pfam annotation: Domain name=MCE; Domain location=49-116; Score=23.3; E_value=0.00064; Accession=PF02470.10; Description=mce related protein
MAKGHHLLLQKQRNHFQLCQTFCALFGGKETNFLRPLSDFGFSDWSNWEACGISKGTPVRIRGATAGNVIGVNPFLKSIEAVVEVGDDKTVISRNSLIKVNQSGLLMETKIDITPREPIPTPSVGPLHQDCTKEGLIVCDREKINSDQGTSLDTLVGIYFGLDSDRENWHHQ

SEQ ID NO: 220340 - protein, 148 aa, Glycine max
  Coding DNA Sequence Number=SeqID_103562
  Homolog annotation: Hit_ID=Q9ZVE0; Match level="QueryCoverage=26%, HitCoverage=18%, E-value=3e-12, Identity=82%"; Hit description =Oligoribonuclease
ELAAKRYFHGAGSSDKRVNADIDIVPGKSEKQNLENPVTSSCEYKLPLVWIDLEMTGLNIEVDRILEIACIITDGNLTKTVENLECEFEPNSTPKASSRGEGYPSLIYFNLALFIDDMGLEFFPIHPLKSRALLGLGAWITMVGDPLD

SEQ ID NO: 220341 - protein, 82 aa, Glycine max
  Coding DNA Sequence Number=SeqID_103563
HLRMSSDSLSLDDKGADDDVSLGMSTGSLASGADNHKKSVCTDNHLGISACHLTSRVRINRKAFEWITTWVSPHVIGLAVSG

SEQ ID NO: 220342 - protein, 118 aa, Glycine max
  Coding DNA Sequence Number=SeqID_103564
MLNGMPQNSPMISTYCIRVVSLEKWRLRNLCWGYECHDIIKQIREQVSIQHQNWGEFYGLLFWKIPSPAGVLKAGLGADLGVAFVDDWVFLADRVVGNEKGRYWLSIDIIKLVGDFAM

SEQ ID NO: 220343 - protein, 289 aa, Glycine max
  Coding DNA Sequence Number=SeqID_103565
  Gene Ontology: Mol. function=sequence-specific DNA binding; Cellular component=nucleus; Biological process=regulation of transcription, DNA-dependent
  Homolog annotation: Hit_ID=Q2VTE6; Match level="QueryCoverage=75%, HitCoverage=100%, E-value=1e-107, Identity=81%"; Hit description =HDZip I protein
  Pfam annotation: Domain name=HALZ; Domain location=119-153; Score =19.2; E_value=0.0028; Accession=PF02183.8; Description=Homeobox associated leucine zipper
  Pfam annotation: Domain name=Homeobox; Domain location=79-119; Score =6.6; E_value=0.001; Accession=PF00046.19; Description=Homeobox domain
  Pfam module annotation: Pfam domain module=HALZ::Homeobox; Domain location=119-153::79-119
  Subcellular localization annotation: CTP_CleavageSite=43; ConfidenceScore=5.69e-01
MAGGSVFCSTSSSSNLTTTTQPPLDSLFLSASSPFLGSRSIVSFGDVQGGKGCNDSFFSSYDEHGDHEDMDEYFHQPEKKRRLSVEQVRFLEKSFDEENKLEPERKIRLAKELGLQPRQASYNDLKANYDNLLREKVKLKAEVARLTEKVLGRKKNEGNLEQAETNGLQEPLQKSLADSASEGEGSKVSIGACKQEDINSAKSDIFDSSESPHCTDGIHSALLETGDSSYVFEPDQSDVSQDEEDNLSKTLLPHFIFPKLEDVDYSDLPHGSCNFGIPEEDQAIWSWPY

SEQ ID NO: 220344 - protein, 248 aa, Glycine max
  Coding DNA Sequence Number=SeqID_103566
  Gene Ontology: Mol. function=voltage-gated ion-selective channel activity; Cellular component=mitochondrial outer membrane; Biological process=anion transport
  Homolog annotation: Hit_ID=Q4PKP6; Match level="QueryCoverage=99%, HitCoverage=99%, E-value=5e-37, Identity=36%"; Hit description =Mitochrondrial voltage-dependent anion-selective channel
  Pfam annotation: Domain name=Porin_3; Domain location=4-242; Score =31.7; E_value=3.5e-10; Accession=PF01459.12; Description=Eukaryotic porin
MSQGPGLYFDIGKKARDVLHKDYAQQSPIHFNYRFLNWNLDLSCQEELVHGLRGLFTCNIPDSGKLEIQHLSRFSGFSASIGLSGEAEKGYNPVANISGHIGTRILTLGANLAYDLSASSSAKITNNLNAGLSLNSPYLVAAATLHDNFQTLKGSCYFEVNPLTKTAIAAEVKYDLADYETIGVTVGAQHALFPWTLLKARLNNNGNVGGLIQQKFGRKFSITVAGEMNFNEEDKEKFPKVGVSMALK

SEQ ID NO: 220345 - protein, 270 aa, Glycine max
  Coding DNA Sequence Number=SeqID_103567
  Homolog annotation: Hit_ID=Q1T4K9; Match level="QueryCoverage=49%, HitCoverage=49%, E-value=2e-21, Identity=46%"; Hit description=Heat shock protein Hsp20
  Pfam annotation: Domain name=HSP20; Domain location=5-86; Score= -10.6; E_value=0.0053; Accession=PF00011.11; Description=Hsp20alpha crystallin family
  Pfam annotation: Domain name=LRRNT_2; Domain location=215-253; Score =46.2; E_value=1.1e-10; Accession=PF08263.3; Description=Leucine rich repeat N-terminal domain
  Pfam module annotation: Pfam domain module=HSP20::LRRNT_2; Domain location=5-86::215-253
MASEAEFRKEEVTLQVDGSTGRIIVKGERQTNEQKRVQFELAFPLPPDSDVDNISGNYDSEILHVHVPKQASHQEHNKESSDIEKASNYGSVEMPQEIESEEHNVVDEGRNHGHEQHKEDREKKKERRNENAQHMDDYYSKKLTRKLIIIANNCPPLRKSEIEYYAMLAKTMWIWALHVENIRECVALALLILVSDVMGAIGPNCAVKNNSFECIEMERKTLLKFKQSLNDPFHCLSSWVGSDCCKWVGVRCKKHTRKALLKFKQSLNVP

SEQ ID NO: 220346 - protein, 111 aa, Glycine max
  Coding DNA Sequence Number=SeqID_103568
MGGTEENDKHEAEVEKEHKKEKKEKSEDAGKEEEGEESKEKKKEKKKNKKDKEGKEKKEKNPEDKNDPAKLKQKLEKLESKMQALQTKREEILKQLREVEQGASEPPVASS

SEQ ID NO: 220347 - protein, 144 aa, Glycine max
  Coding DNA Sequence Number=SeqID_103569
  Gene Ontology: Mol. function=RNA-directed DNA polymerase activity; Cellular component=nucleus; Biological process=RNA-dependent DNA replication
  Pfam annotation: Domain name=RnaseH; Domain location=2-109; Score= -30.8; E_value=0.043; Accession=PF00075.14; Description=RNase H
MDGWVTLNTDGSSTGIDEASRANAFIAELWGVYEGLKLAQNRGFKVVIVQVDSQVIVNILKGKKDGSAQGWSLVRKIRLLFSADWRTKVFHVYREANIWAHMLAKMAINLDGECVMFEHPQVELSQLLEADRRTVSTLDHLVAL

SEQ ID NO: 220348 - protein, 72 aa, Glycine max
  Coding DNA Sequence Number=SeqID_103570
MVTRTFHQPGANEPIDVQRLTSSSATFAIQGQRVRWQAVIPYGHPHLSSTEGNEFDVIRMMLVIRFRWWVKF

SEQ ID NO: 220349 - protein, 148 aa, Glycine max
  Coding DNA Sequence Number=SeqID_103571
PIVALLLPKRMISLKAGDALSLVVPIAALLLPKRMISLEAGTNENNDGSDDEHKEDEVNIATTVAASIATKRDSTHPLGFNQEGHLVSDVVGQGDEATSNAYGPYYVQVQNKSSFPLYGLPPNCTPLTVVYALSENIGNLAPVSIENQ

SEQ ID NO: 220350 - protein, 75 aa, Glycine max
  Coding DNA Sequence Number=SeqID_103572
MGNHELKKKPQRSWWIRIIKWAIPIKSSKYFLASPVFINNKNLLKEGKATAVEERDLQKGLQLGFGEVTKGSSDF

SEQ ID NO: 220351 - protein, 76 aa, Glycine max
  Coding DNA Sequence Number=SeqID_103573
MEVYFKSPSLEKTEVGPQVEENMHFHNSVQELRELKSQLHHAADYCETTFFKSEAKRDLLSGSRFIFPMVVHVDKT

SEQ ID NO: 220352 - protein, 388 aa, Glycine max
  Coding DNA Sequence Number=SeqID_103574
MAKKLDFKNIQSSKTNENIPIVHSNWKDVPKSLKDLVWDDILVSLVIDAPNANKKFMSTVVTRWRQFKSTLTSKFVYANTDGKQTQDPSSKYDLDPETWNEFAATCQSPNWEVARTKPYGHMTSQSAQEISNKIGSFVPHGRDDILNTAIGQLDHGGRVRATRSSVTIIQYYRRASRGSNNSSTSGSNAKTSVNPSREEDVADVIPTMGLYVQHDHSTHLVALGKIYKERSTIHSVTYAYDMVLDTFIALWTQLVKLVSHEFKLGKIPCMDCLSLSPYIMQRIDVGNANNTLKHGLRNPNERAHWQLVVLCPIQDVVVWFCSLRKKPYIHVKAAINNAMNTLKTTLHGHTKQAAPEWIESHVQTEGYECGYYVMHWMWNIVSGELKTD

SEQ ID NO: 220353 - protein, 260 aa, Glycine max
  Coding DNA Sequence Number=SeqID_103575
MTMALKETIKIELSQKGSSGLPPIELDIQQLGARVSIKGSNAETNVHPSGEDDVDVIPSMGLYVQRYDRTHLVALRKILQGGSTIHSVAYAYDVALDTFITWPTQLVKVVSHEDAQITPYKVAAHVPTPTNVDADDSMRGMIKLSFDIYDKPVEIKFDGSKFGIVDGATSIFLTYSDTSSSGDTKPTAPKWIEVKSHAQIGCYECGYYVMHWMWNIVSGEMKSDWSLWFGDDKSLDNDTITTIRKKWASYFLKNTDIGRV

SEQ ID NO: 220354 - protein, 109 aa, Glycine max
  Coding DNA Sequence Number=SeqID_103576
  Gene Ontology: Mol. function=aldehyde dehydrogenase [NAD(P)+] activity; Cellular component=chloroplast; Biological process =aldehyde metabolic process
  Homolog annotation: Hit_ID=Q70DU8; Match level="QueryCoverage=79%, HitCoverage=25%, E-value=4e-19, Identity=42%"; Hit description =Aldehyde dehydrogenase 3H1
MIDQLFVGSARVGRIVMAATVKHLTPMILELGGKCPTVVESDVNLQVDALKEELEQYFGKDPMESKDMSRIVSPNQFVRLVNLLDEDKGLDENAGPQIIKLYAKVVHIF

SEQ ID NO: 220355 - protein, 478 aa, Glycine max
  Coding DNA Sequence Number=SeqID_103577
  Gene Ontology: Mol. function=cellulose synthase (UDP-forming) activity; Cellular component=membrane; Biological process=cellulose biosynthetic process
  Homolog annotation: Hit_ID=Q1T0J4; Match level="QueryCoverage=78%, HitCoverage=51%, E-value=1e-138, Identity=68%"; Hit description=Zinc finger, RING-type; Cellulose synthase; Zinc finger, FYVE/PHD- type
  Pfam annotation: Domain name=Cellulose_synt; Domain location=54-478; Score=-19.6; E_value=8.2e-07; Accession=PF03552.5; Description =Cellulose synthase
MDPSQPNHFNAVIEKIERLYMGKDSSDDEDLLDVSNDDLYDTEDSFINDAELALLSAHLIVGRGSQTNAPGITTTLEFDATSVAAGIPLLTYGHEDVGISADKQDYSPIHASRETGSSNASRFICARYEKEGKPSELADIDIFDSTVDPMKEPPLLTANIVISILAIDYPVEKVSCCVLDDGAAMLTFEAISKTSKFARKWVSFCKKFNIEPQAPEWYFAQKVDYLKDKVDATFIKEHRAIKREYEEFKLRINALVAMAQKVLEDGWKMQDGTPWPGNSVKDHPRMIQFNYDALAQVFLGQNGIYNIEGNELPCLVYVSYEKRPGYEHHKKAGAMNALVRVSTVILNAPYLLNVDCDHCINNNKALCEAMCFRMDPTSGKKICYALYGYDAPATKKPPRKPCNCWPKWCYLCCGSRNKNRKVKSGPWKTSCSEALKELKEWMKPEKVNTSITIYPSSVEIVPEPLGVVLVISTWNFPF

SEQ ID NO: 220356 - protein, 150 aa, Glycine max
  Coding DNA Sequence Number=SeqID_103578
  Gene Ontology: Cellular component=mitochondrion; Biological process =protein complex assembly
  Homolog annotation: Hit_ID=O22958; Match level="QueryCoverage=78%, HitCoverage=47%, E-value=6e-51, Identity=77%"; Hit description =Expressed protein
  Pfam annotation: Domain name=ATP11; Domain location=2-149; Score =74.6; E_value=3.2e-19; Accession=PF06644.2; Description=ATP11 protein
MKYIPGKVVINKSKECEDGTGMVFTSMDSTDIFVIPLWRGSGYTTMFVQVQTPHMVSTGLEDYKARGTQAAPYFIVSFYTEFAESKDLVLIRGDVVFTSKLTDSEAKWLLEAAQSFYLNDARYKLVERFKRQTHDFEFKDVLQVLDMPIL

SEQ ID NO: 220357 - protein, 58 aa, Glycine max
  Coding DNA Sequence Number=SeqID_103579
MWTKFGCERSDREISWKCKKHILRRLLRTFYVGSASSLKPPSLKAKTFDDGQSTTILE

SEQ ID NO: 220358 - protein, 64 aa, Glycine max
  Coding DNA Sequence Number=SeqID_103580
MDAARRTGDIGVAGGCRQWHRRDMLSWRVSPVTQARHVDMKHAANKNGGTCNVLKILLDGNMRV

SEQ ID NO: 220359 - protein, 125 aa, Glycine max
  Coding DNA Sequence Number=SeqID_103581
MPLKGTALTWYDGLPPRSIDKFDTLVDRFNGHYATSRSHHITSTALVSLRQEDDESLRKFMDKFGHTAIQIWNLNPEVALHSILKPRQVREQSVQKAPSSMGELCELAKGYIQMEEMSRFRNEVR

SEQ ID NO: 220360 - protein, 58 aa, Glycine max
  Coding DNA Sequence Number=SeqID_103582
MASSWLSDFYCKGMSACIMQSMKGCRQVVRPAGRCMWEKLKSSRVLTMCHECDSPWDV

SEQ ID NO: 220361 - protein, 641 aa, Glycine max
  Coding DNA Sequence Number=SeqID_103583
MPLRATASSCTSICTQFNSELRAPELHTSIWRDTFVKRTGGKTCKTKDYDAQARESDRERNVHRLATRVLVYCVEGSMKPGEYLKSGVIVLTSRGQQVDVACQALEPGQVLSGLLLSSYLGWACLWCVRYSFSLTMSSFLFDSFIGMDDGDSRGSIEQPMINQEVISIGSSLSKDTRCGASDNEFFSLERGATFRYCWGACPCYCDPHLLCFWGVRRGSGSGDVKASPHVRHSHRTGSSSSILVMVGYAWVKLANLEDYRKLVVQACGNDNFPFLEAASGTLGYVLFSTPPKQLANADWQDWLGLLEQHFQEAVLSIDVLVDGLSLMFNRDKEPHFPFYRQFNPTRFKSFDEDLLTPVERVDEAILEQLSTLLDTRAILSLPSVGPTGGALPPPAAIAAAGEGGLMPGAGRPLIVQDVPSALPIIEAPAATLDVAKVNVPTTLASSIVAPSSTVVAPLLSADVATTRAYVVLPPYSLAPMRSLAILEENELRHQEALHKWHPRRRRLPNGGLTSSSPLLRLDGVELFKRCKDLQMEKKYSADKLKGIRRRGMSLLEEREANKELEEELLVYKKESVEQHEKGFNKAIKQVGFFTKDLDLGLFDPFKDVKDGVLLDKEDFVAEEKIVNEEQGVAKQGNDAHV

SEQ ID NO: 220362 - protein, 80 aa, Glycine max
  Coding DNA Sequence Number=SeqID_103584
MIPVEVEEQSTRRLLFQKQQNKENMRVELETIDEVQETVRIKEEVAKLRAARRYNTKVQSRAFQPSDLIWRVRGEAKKDT

SEQ ID NO: 220363 - protein, 107 aa, Glycine max
  Coding DNA Sequence Number=SeqID_103585
MVVEVAVSELNQGGTLGFVGVHTKGEPWVFDRLKRSLRAELTYLVPVKMELSNRKGSPMVNIGFVKPQTENVFALGFLMPVELCRGLPRTSLGFYEPMRVTKRGTWV

SEQ ID NO: 220364 - protein, 255 aa, Glycine max
  Coding DNA Sequence Number=SeqID_103586
  Gene Ontology: Mol. function=sequence-specific DNA binding; Cellular component=nucleus; Biological process=regulation of transcription
  Homolog annotation: Hit_ID=Q1T4J9; Match level="QueryCoverage=92%, HitCoverage=40%, E-value=3e-66, Identity=55%"; Hit description=DNA -binding WRKY
  Pfam annotation: Domain name=WRKY; Domain location=198-248; Score =73.3; E_value=7.6e-19; Accession=PF03106.6; Description=WRKY DNA -binding domain
EPPLSTTERSTVEVGPNASSLTKKEEAVDELETAKAEMGEVMEENQRLKTCLSRILNDYRTLQMQFHNRVEQETKDSSDQKVNNNNDHQREESDLVSLSLGRLPTRNNEKVNNKPLKEEEKEDKEGLSLGLDCKFETSKSGSTTEHLPNQSPNNSVEEVPKEEAAGESWPQRKGHKTARDTTGEDEVSQQNPAKKARMNDGCQWRKYGQKISKGNPCPRAYYRCTVAPSCPVRKQVSISITAIVYHSSGFNLTEK

SEQ ID NO: 220365 - protein, 51 aa, Glycine max
  Coding DNA Sequence Number=SeqID_103587
MGQEAAVVMAVEGLDPECEVDEPDNSMEAAAEMVEAMAVAESGRGWLWLPS

SEQ ID NO: 220366 - protein, 69 aa, Glycine max
  Coding DNA Sequence Number=SeqID_103588
  Subcellular localization annotation: CTP_CleavageSite=32; ConfidenceScore=5.73e-01
MKWGELFPSSSSALPSSSTKVNGCASSFLNKSAANTKPGTTLMFLQPLLPLSSPKSASGSPGDHRDKRN

SEQ ID NO: 220367 - protein, 148 aa, Glycine max
  Coding DNA Sequence Number=SeqID_103589
MKADMEAMKEQMATMMEAMMSMKKIMEANAVTVVATSVVAEVNPMPLSGLNQMNHPTSDMVGKDLGSTGSPYYAQIQNKHAFPPYGLPPNYTTPNVAYIPNEDVNNSTPILIESRQPDHAHVSQPMGETHEMPHHNLADFEPCLGYAT

SEQ ID NO: 220368 - protein, 81 aa, Glycine max
  Coding DNA Sequence Number=SeqID_103590
DSTSDSPQISASPYQLDLAPYASEPYNAQWNAPGLLRDKHTLRSSRILGEMEVDEPWLGLWLPLNYQVVFVIGSAVDRLCG

SEQ ID NO: 220369 - protein, 181 aa, Glycine max
  Coding DNA Sequence Number=SeqID_103591
  Homolog annotation: Hit_ID=Q93S78; Match level="QueryCoverage=75%, HitCoverage=83%, E-value=7e-19, Identity=41%"; Hit description=UptF
AKAPPLVVPWRGRLIGGAAMPGQKRPAGPSMAGSRRSGRDGKSLLGQQLLALHATQGDIIDREYTQLRVHALLVQLAVLVMECPELRITRAAGVDLALGLIFKHDGPPSTDTRTPRPQGTGRCSWRSAGRWPPGRLQRPAALACARRFAAVRALFASARPSHRPVRGIASRTIDPTPAQGG

SEQ ID NO: 220370 - protein, 233 aa, Glycine max
  Coding DNA Sequence Number=SeqID_103592
  Gene Ontology: Mol. function=protein serine/threonine kinase activity; Cellular component=integral to membrane; Biological process=protein amino acid phosphorylation
  Homolog annotation: Hit_ID=Q9FM23; Match level="QueryCoverage=69%, HitCoverage=33%, E-value=8e-37, Identity=47%"; Hit description =Receptor-like protein kinase
  Pfam annotation: Domain name=LRRNT_2; Domain location=24-66; Score =29.7; E_value=1e-05; Accession=PF08263.3; Description=Leucine rich repeat N-terminal domain
MGLVVLMLMVVISTTVLCPSSLALTLDGLALLEVKSTLNDTRNFLSNWRKSDESHCTWTEIYLICNWGGLYLPALANSVDCIDWHFIKMAYMELFLMKLAIVLSLEHYFNGKFKYRDLSSNSLKGAIPSSIGRLTQLRVLNLSTNFFSGEIPDIGVLSTFGSNAFIGNLDLCGRQVQKPCRTSLGFPVVLPHAESDEAAGKSNPVLCIFSNNAISSYNIFILILILPIFNQPC

SEQ ID NO: 220371 - protein, 123 aa, Glycine max
  Coding DNA Sequence Number=SeqID_103593
  Gene Ontology: Mol. function=protein serine/threonine kinase activity; Cellular component=integral to membrane; Biological process=protein amino acid phosphorylation
  Homolog annotation: Hit_ID=Q9FM23; Match level="QueryCoverage=95%, HitCoverage=20%, E-value=4e-47, Identity=76%"; Hit description =Receptor-like protein kinase
MSTSEYLQSGRATEKSDVYSFGVLLLELVTGKRPTDPSFARRGVNVVGWMNTFLRENRLEDVVDKRCTDADLESVEVILELAASCTDANADERPSMNQVLQILEQEVMSPCPSDFYESHSDHC

SEQ ID NO: 220372 - protein, 211 aa, Glycine max
  Coding DNA Sequence Number=SeqID_103594
  Gene Ontology: Mol. function=nucleic acid binding; Cellular component= nucleus; Biological process=DNA integration
  Homolog annotation: Hit_ID=Q1RVB5; Match level="QueryCoverage=96%, HitCoverage=17%, E-value=2e-55, Identity=49%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
MGKRIIGYKWVYKRKPLVSKKEGKKFKARLVTKGYAQQKRVDYDEIFSPVIRRTSIKAVLALVASHDMHLEQMDVKTTFLHGDLNEKIHMEQPDGSSKDGPGQLVCKWKKSLYRLKESLRQWILDDGSFIILLLYVDDMLIVGYHLCDVNEFKSMLSKEFDMKDLGSAKKILGMEIHMDMKSRRQWLSQQGYVEKVLDKFNMSNAKLVLLH

SEQ ID NO: 220373 - protein, 196 aa, Glycine max
  Coding DNA Sequence Number=SeqID_103595
  Gene Ontology: Mol. function=nucleic acid binding; Biological process= DNA integration
MSIWVTTKHVLLLEGDRPMVLTIELMEIEIPSECVWVYFMKQKSKVFEKFKLWKAEVENQTCRKIRYGEYSMLFAPLITMNIIGWESCTGCLDCDERSKLDPKSKKCVFVGYSKCVKGFKFWDPISKKMVINKDAVFDEQFILLEIVKTNMPMFDGASPNSVEVQVDFEQLLVIPERVKPCRPRPEATTPHLSLDW

SEQ ID NO: 220374 - protein, 85 aa, Glycine max
  Coding DNA Sequence Number=SeqID_103596
  Gene Ontology: Mol. function=oxidoreductase activity; Biological process=metabolic process
  Homolog annotation: Hit_ID=Q76KV8; Match level="QueryCoverage=84%, HitCoverage=24%, E-value=1e-15, Identity=65%"; Hit description=Short- chain alcohol dehydrogenase A
MAESANSIHNSGQKKLAGKVAIITGGASGIGEETARLFAHHGARMVVIADIQDDLGIQVAASIGSHRYKIFLHNLTVETKNYYYY

SEQ ID NO: 220375 - protein, 91 aa, Glycine max
  Coding DNA Sequence Number=SeqID_103597
  Homolog annotation: Hit_ID=Q8H9E9; Match level="QueryCoverage=68%, HitCoverage=14%, E-value=2e-15, Identity=58%"; Hit description =Resistant specific protein-2
MVACHTMPYPYTVFYCHSQESENKIYRVPLAGENGDRVDAMVVCHMDTSQWGHGHVSFQVLKMCSVGAKEIMQKLIIGYLAYEQNAEVLLA

SEQ ID NO: 220376 - protein, 201 aa, Glycine max
  Coding DNA Sequence Number=SeqID_103598
MERSMIDASSGGALGDMTPAEARNLIEKMASNSQQFSARNDAIVRRGVHVVPTDSSSSTENKKLEGKLDALVNLVTQLAMNQKSAPVARVCDLCSSTDHHTDLCPSLQQSGVNEQPEAYAANIYNRAPQQQNQQQNHPNLGWASPPQQQQPIPPFQNAAGPSKPYVSPPMQQQQRQQATEAPPQPSLEELVRQMTIQNMQF

SEQ ID NO: 220377 - protein, 279 aa, Glycine max
  Coding DNA Sequence Number=SeqID_103599
MANYYDPEDKSPKQVRVRGHLIKFDEATLNTFLKTPVIVEGESLYAYSRFALLRLDPQELDAKLCILGSGFELNVDGQPLKILRKNMTTLAQTWNIFSFLNLIPTSHTSDVTLDRARLIYGIIMKMDMNVGYLISHQISLSAQHDTSRLGFPAMITTLCKARGVQSDSRSLESLSLAINLAYIKKNCWNLDDPIVTFRGPRKARRKRSEAFSTSAPETGGPSSSTLPPSSSTKIPVIPLAPSQIPLPAPLSASPADFILTPQMLHSMLQSIHRGQSIIM

SEQ ID NO: 220378 - protein, 304 aa, Glycine max
  Coding DNA Sequence Number=SeqID_103600
  Homolog annotation: Hit_ID=Q9M670; Match level="QueryCoverage=94%, HitCoverage=89%, E-value=1e-14, Identity=21%"; Hit description=Small heat shock-like protein
MEKSNLQPNLNYENCQPKFETKETPDSHILLVHLPGYAEDDIGAQFEYDYRRVRVFGGRPLGDNRSIRFNVVYAVPWNCDVNKLKGMFQGEIYSVTMPKVNTSSDFPDQNSPKSSSHGKAQIEVSEEPKSIIESQKQDNETLTLPKAISDSLPQKGEEVISQDAKNRREERFESSEKKRVDRKDTMEESENVSASGKPPQKGKKEHVMDETSFITKSEEDGKGKGEKMEMNDTLDEGNDGKDIIGTSKKKGIKEVATSASHAVTSLVKRFNEEDMMLLYTSATTAIVLALGVYASYQTSFSARQ

SEQ ID NO: 220379 - protein, 380 aa, Glycine max
  Coding DNA Sequence Number=SeqID_103601
  Gene Ontology: Mol. function=nucleic acid binding; Cellular component= nuclear pore; Biological process=DNA integration
  Homolog annotation: Hit_ID=Q1T1E6; Match level="QueryCoverage=66%, HitCoverage=41%, E-value=7e-96, Identity=67%"; Hit description=Zinc finger, CCHC-type; Peptidase aspartic, catalytic
MSEEFTALMNNGTWSLVPSQPHFNVIGNKWVFRLKRNPDGSIARYKAQLVAKGFHQRPGIDYKDTFSLVIKPQIIKIVLCIALSKVYVDDLLLTGNDVSFLAKFKAALATKFSLKDPRTSSHFLGIELLPTTNVMFLSQQHYIRDILQKGNMIDAKPVGTPMSTTCSLSSHDDTPSCDSSLFHNIIGSLHYLSITRPDVAFAVNKLSLYMQAPKTTHMQALKRILRYLKHTISHGLQLVATKNLDLTAFCEANWGGDTNDKKSTGAYIVYLGPNAISWSCKKQSIVARSSTEVEYRTIGLMAFKLLWLQELLLELGIKLTKQPTIFSYNIGATYLCANPIFHSRMKHLVIEYHFVHDIVAKGELKVSHVSFQSLTSKLAN

SEQ ID NO: 220380 - protein, 114 aa, Glycine max
  Coding DNA Sequence Number=SeqID_103602
MAPDRMQLQNMCKKVHESFKEYAQRWRDLAAQAAFPMMEREMITKIIDTLPMFYYEKMVGYTPSSFADLVFADERIEVGLKRGKFDYPALMNGKPGENEKNKEGGTHAMTVIPT

SEQ ID NO: 220381 - protein, 157 aa, Glycine max
  Coding DNA Sequence Number=SeqID_103603
MSIHMVGAFSQNRETSIGLPIISLNESDLTYPFDDDVYVSQLMVIIMLEMERHSLSYGNALIGSDIWAWVLFVYICGSNDFQDYFDDAKESRVKQVPKNQESKSFKNQVSKNQDSRTIKFQDSRFKNNQDQDSRLKIQESTEDSIKISTKKVFQNIE

SEQ ID NO: 220382 - protein, 68 aa, Glycine max
  Coding DNA Sequence Number=SeqID_103604
MATSRFQPCFRYNEFSNIPVSKNSKLAALEAVSLQGETLQITLEKTQGNIQVDDKTLDSDAILSPKGN

SEQ ID NO: 220383 - protein, 96 aa, Glycine max
  Coding DNA Sequence Number=SeqID_103605
MRSHSTFIVLLNWITVVKLEDSRHILGGEAPSSMAYSLVDGVSPLLFSFAFHCISMVENHHWRTSLKLKDPVSIEAPQASFHQVVIRAQKLQVGAP

SEQ ID NO: 220384 - protein, 141 aa, Glycine max
  Coding DNA Sequence Number=SeqID_103606
  Gene Ontology: Mol. function=DNA binding; Biological process=DNA integration
MSLYWVVFGKACHLPVEIEHKAYWAVKTCNFSMDQAGEERKLQLSELDEIRLEAYENAKFYKEKTKKFHDSMIIKKDFMVGQKVLLYNSRLGLMSFEIKSDSTNKSFKVNGHRLKPFLTNPSLVVVVVEETSLIHPTLPPP

SEQ ID NO: 220385 - protein, 169 aa, Glycine max
  Coding DNA Sequence Number=SeqID_103607
  Gene Ontology: Mol. function=DNA binding; Cellular component =mitochondrion; Biological process=DNA integration
  Homolog annotation: Hit_ID=Q1S1G2; Match level="QueryCoverage=82%, HitCoverage=9%, E-value=5e-42, Identity=59%"; Hit description =Integrase, catalytic region; Zinc finger, CCHC-type; Peptidase aspartic, catalytic
MNAEIKALELNDTWILTDMPQHNNVIGCKWVYKIKHKSDGSMERHKARLVAKGYTQVEGQDYLGTFSPVSKLTTVRLLLALAAINKWHLNQLDVNNAFLHGDLNEEVYMMLPQGMQVAKLGQVCFEVARKPTGINLSQRKYALDILSDAGMLGSKLVSTPSDYATKLHQ

SEQ ID NO: 220386 - protein, 320 aa, Glycine max
  Coding DNA Sequence Number=SeqID_103608
  Gene Ontology: Mol. function=DNA binding; Biological process =metabolic process
  Homolog annotation: Hit_ID=Q324U2; Match level="QueryCoverage=95%, HitCoverage=50%, E-value=1e-103, Identity=60%"; Hit description =Hypothetical protein ybdN
  Pfam annotation: Domain name=ParBc; Domain location=176-274; Score =39.0; E_value=1.6e-08; Accession=PF02195.8; Description=ParB-like nuclease domain
MGECYNPLYDLMFQAGVPPRYMRICEPFGPEQRQGLWLYHVVEPERWAAMCERVAGVHCGGVYAGQDNHFYGHRKILKPDALSWREYAMLLLDSMPQMTAEHYRNKIAIYLHWYQKRGMADIPDTQEGDIGAKDIPSWRRVCKSLPEDQRIEAINAFRQAIHENSPFREQPVDCVLWIKQDDITANDYNPNNVAPPEKRLLCKSLELDGFTQPIVVTESDTQHYEIVDGFHRHEMGSNRAVLKRQLKGYLPVTFLRKERQKKFDRMAATIRHNRARGRHQISAMSDIVRELAQLGWDDEKISQELGMDNDETVDTPKPGR

SEQ ID NO: 220387 - protein, 299 aa, Glycine max
  Coding DNA Sequence Number=SeqID_103609
  Gene Ontology: Mol. function=DNA binding
  Homolog annotation: Hit_ID=Q1SDS1; Match level="QueryCoverage=73%, HitCoverage=40%, E-value=7e-27, Identity=35%"; Hit description=IMP dehydrogenase/GMP reductase
MAEVSTEAIASLVQYYDQPLRDPGMPSGRKEVVSFLRELDRGKQVENGVVGVPRKCLEAKARVLASQDEWAPFVDILALLIFGVVLFPNVDGLVDRATIDAFLAFYDRKESPVVAILADLYDTFDRRCEKNNTRIVCCTPTLYVWLVSYFFRQEMRHVCPLEGHRSCTKKKKANWDRLLASKEGASVNWFPRWKERRTEILISCGKFPNVPLMGTRGCINYNIVLAIRQLGYPMRGAPSEECLIPFITRVFNSTNVGVLQRVHKAWEMSQRKDKELRGSSNKPIGSYHRWLKAYAQDLD

SEQ ID NO: 220388 - protein, 46 aa, Glycine max
  Coding DNA Sequence Number=SeqID_103610
  Subcellular localization annotation: CTP_CleavageSite=20; ConfidenceScore=5.00e-01
MSSLSARGALSEFTLAQRLCAAHPSSRFFCALSQRMVRLADGSPST

SEQ ID NO: 220389 - protein, 81 aa, Glycine max
  Coding DNA Sequence Number=SeqID_103611
MDCLANLRQMGFEQRFALGGDQQRLVIDTLRKMGRNHSLDFGQRMARGGLKLIVAVRRYAARSADSDDSAAIAAVREAAEF

SEQ ID NO: 220390 - protein, 73 aa, Glycine max
  Coding DNA Sequence Number=SeqID_103612
MNLATDQIASPGHVRRLHVEQNEFETLIRWSLSKIKILSDLKIQLMQSYRQGHWIEDSKKIGPELQEKALGFS

SEQ ID NO: 220391 - protein, 116 aa, Glycine max
  Coding DNA Sequence Number=SeqID_103613
  Subcellular localization annotation: CTP_CleavageSite=28; ConfidenceScore=5.09e-01
MSPPPLGPHDHSQTHIKLSGWLPLVALVSMNLHTTNSLKLSRTWTFLSLELSDYAEASRKGYIPCGTSRGYIYLGLTENKRGYISCGLDFYKVERNLKDRRSLGDWMQARVVAEPV

SEQ ID NO: 220392 - protein, 262 aa, Glycine max
  Coding DNA Sequence Number=SeqID_103614
MSWNFTDCLTMGVKYLEVVKQRVLITNKDSGDHTLAINSTKTWDYYAGGDFDSVYAGQLAKQIAEKSSNSFVANIEKNPKEECKAVMTRSKRFVEAEDEDSDVPKKKAAEKKDTDDKKDDMREVTVGKTLIDLGASINLMPLSMCRRLGELEIMPTRMTLQLADRSITRPYGVIEDVLKKLGWRLDLVLVIIYNLTGHGFILASPMDLILDVGKLVVRQQAKDVVLAGFIFMVIKAFSINFHAPKAAELEGAVLAISIAHSK

SEQ ID NO: 220393 - protein, 270 aa, Glycine max
  Coding DNA Sequence Number=SeqID_103615
MATMMEAMMNMKKIMEVNGVVVVATSVVAEVDPTPPSGLNQINHLTSDMVGQGGKELGSMGSPHFVQVQNKHAFSPYGLPPNYTPPNVAHTLDENVNNSTPILIESQQPQSDHAHVSQPMGETHEVPHHNLVDFEPRLGYVAEGQAVGGVPLPNTLEDPQFCPQPQPLHFAVGRVPPNTVERGKLDHIEERIRAIEGGGDYAFTDMAELCLMPDIFIPPKFKMPDFDKYKGTTFPKTHLKIYCPKMGTYSKDEKLLMHLFQESLMGAAFT

SEQ ID NO: 220394 - protein, 247 aa, Glycine max
  Coding DNA Sequence Number=SeqID_103616
  Gene Ontology: Mol. function=hydrolase activity, hydrolyzing O -glycosyl compounds; Cellular component=periplasmic space; Biological process=metabolic process
  Homolog annotation: Hit_ID=Q1GZ09; Match level="QueryCoverage=89%, HitCoverage=32%, E-value=2e-72, Identity=57%"; Hit description=Lytic transglycosylase, catalytic
  Pfam annotation: Domain name=SLT; Domain location=68-187; Score =105.4; E_value=1.7e-28; Accession=PF01464.10; Description =Transglycosylase SLT domain
MEVLFDVEARYEARLEWLYLLEVLDDPTRIVAAQYALLKGWYDLAVLAADKTSRTHNFELRYPTPYRDYLQKASRNRAIDEAWVYGIIRQESRFMHYAKSSVGAGGLMQVMPATAKWIAKKLGLNGYHDGMLHDIDTNVNLGTYYMRYTLDTFNGQEVMATAAYNAGPSRARRWAGNTPLEGAIYAETIPFSETRNYVKKVLANAHMYAPRLGLPMLTLKRRLGTIPARTTAEVESVTTTISISEQE

SEQ ID NO: 220395 - protein, 254 aa, Glycine max
  Coding DNA Sequence Number=SeqID_103617
  Homolog annotation: Hit_ID=Q1STP5; Match level="QueryCoverage=45%, HitCoverage=20%, E-value=5e-08, Identity=33%"; Hit description=IMP dehydrogenase/GMP reductase
MVEVYAKSLYYIEITSDTQDNRIMVSTRGLGRDLSHVTGRGVGRGDRDDFDDALQHRWPTASTRRQRVPVTTVHNEPVVPVAEADGASIEANVYADEPMAGGDVQDTGADISADTGAQAAEDEPKGFSGGPSDPSVLIGYADHIAGNIWMGEEHPELKLSSHGRKVHSLGRFVPTIEGLVAGTGLSPLIACLIDTDDRGLFSSFVERWHRETCSFHLPVGSRCTGAYVRPPQRCFYQHQPTAWRLHHVVAVLDI

SEQ ID NO: 220396 - protein, 98 aa, Glycine max
  Coding DNA Sequence Number=SeqID_103618
MQSVLDKLDGLRTFVGECFDSLDNHIDAIDARIVIIKKGEIVEAKLSKFIFMTPKTQVKSQELSKFQESKSSSIKNQDSSKDSREDSRYTRTSRKASR

SEQ ID NO: 220397 - protein, 178 aa, Glycine max
  Coding DNA Sequence Number=SeqID_103619
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=86%, HitCoverage=65%, E-value=2e-39, Identity=52%"; Hit description =Transcription factor, MADS-box
  Pfam annotation: Domain name=SRF-TF; Domain location=25-75; Score =69.9; E_value=8.3e-18; Accession=PF00319.9; Description=SRF-type transcription factor (DNA-binding and dimerisation domain)
  Subcellular localization annotation: CTP_CleavageSite=77; ConfidenceScore=5.07e-01
MESNNMPDLNGVAKKTKGRQKIEMKKMRNESNLRVTFSKRRTGVFKTASELATLCGVDVAVIMFSPGNRVFSFGSPSVDSVVQRYKTQGPPPLLTLDLNKVHSTVDEVELHTHLHCLSNQIAIEKKRTKDLNHLAKAAEDQFWWARPIESMTDSQLDKYKKMLEEFKRQLKEKRGNLN

SEQ ID NO: 220398 - protein, 79 aa, Glycine max
  Coding DNA Sequence Number=SeqID_103620
MPAIEDKTLFTSTIRRENTTLNLPRLLNTNNGAVAEQGLPARRKKTTLTGRTNAMQRMTTVGDAFLRPAKMLGAPSNTL

SEQ ID NO: 220399 - protein, 125 aa, Glycine max
  Coding DNA Sequence Number=SeqID_103621
  Subcellular localization annotation: CTP_CleavageSite=37; ConfidenceScore=5.34e-01
MDENIAQPNTHAQRTTCAKRASQHRRSARRQARRIATCTERASRTERTIQQKHTLSAQQALSTRCRAKRAYESPRPISAAINIESVQGGTYTSPQSTFLSILSPSFSLSLYIPYLLSILSFTPQL

SEQ ID NO: 220400 - protein, 259 aa, Glycine max
  Coding DNA Sequence Number=SeqID_103622
  Homolog annotation: Hit_ID=Q1RVU7; Match level="QueryCoverage=97%, HitCoverage=62%, E-value=1e-30, Identity=32%"; Hit description=IMP dehydrogenase/GMP reductase
  Pfam annotation: Domain name=Ank; Domain location=14-46; Score=9.4; E_ value=1.4; Accession=PF00023.20; Description=Ankyrin repeat
  Pfam annotation: Domain name=Ank; Domain location=48-111; Score=7.9; E_value=2.3; Accession=PF00023.20; Description=Ankyrin repeat
  Pfam module annotation: Pfam domain module=Ank::Ank; Domain location =14-46::48-111
MTLKPSLSQKQNPKGFTPIHLALQHDQERMPLCLVQINKDLIQLKGRDDFTPLHLASRKEEADDELSYLHLKVGTDVAEDGIPPPLHLASRMGETELLDKFLEVCPDSIEDVNTRSETALHIIAAKHGAKHGRYGALKVLFRWLVRNSKEDDRQFIRTTTLNWKDEKGNSILHVAALYNRIKVATKSRAHLVRSFHKRRYMTQEECNAYLVVTTLIATATYQVALSPHGGLYQTHVGTNNTVMSHVAASSSSINFKSTT

SEQ ID NO: 220401 - protein, 140 aa, Glycine max
  Coding DNA Sequence Number=SeqID_103623
GTKKDKEEEPFLYHRKGTFSHRRGVNLGGAILCSVPWWEQNHEGPPCSSKIQNLYPIRWRRGESNVGCSGTAGDRWEEASVTPARGAHDGNSPQRDEDRGEGGWLGRALARLAGARYVQVSVAGINAAEAYECGVGGNRC

SEQ ID NO: 220402 - protein, 91 aa, Glycine max
  Coding DNA Sequence Number=SeqID_103624
  Gene Ontology: Mol. function=transcription factor binding; Cellular component=intracellular; Biological process=regulation of transcription, DNA-dependent
  Homolog annotation: Hit_ID=Q40207; Match level="QueryCoverage=47%, HitCoverage=21%, E-value=9e-15, Identity=86%"; Hit description=RAB1Y
MAAISVLGAMCLMVFGKQEVALPIYDVTRRDTFTNLFEIWAKEIDLYSTNQDYIKMLVGNKLDKRFDARVGVTSFAAVLCLLELWWFMMGC

SEQ ID NO: 220403 - protein, 67 aa, Glycine max
  Coding DNA Sequence Number=SeqID_103625
  Subcellular localization annotation: CTP_CleavageSite=29; ConfidenceScore=5.10e-01
MRTRGENLLGKFTTKKKVFYIGSNGLSTSVMTRGGNTVSLNTDIGWRTAFEGRSFYIGSKVETDVEW

SEQ ID NO: 220404 - protein, 219 aa, Glycine max
  Coding DNA Sequence Number=SeqID_103626
  Homolog annotation: Hit_ID=Q42384; Match level="QueryCoverage=46%, HitCoverage=33%, E-value=4e-20, Identity=47%"; Hit description =PP1/PP2A phosphatases pleiotropic regulator PRL1
  Pfam annotation: Domain name=WD40; Domain location=28-105; Score =20.4; E_value=0.0066; Accession=PF00400.22; Description=WD domain, G- beta repeat
MANCFSVWSSAVIWDGLQLIPLWDLASGVLKLTLIVHIEQVRGLAVSNRHSYMFSAGDHKQVKCCQNNIYICENLGAYTRSYPVSILQNPQVVTGSHDTTIKMWDLRYGNLWLYFSYLLACLCIDHMHNLTHDAFIFIQQLFTKPHSQSKPRSTLNIMISDPLKVAAEGNNIDDLYQEIQQDPRVLESIDSIPFVETPLHVAASLGHFEFATEIMTLKP

SEQ ID NO: 220405 - protein, 210 aa, Glycine max
  Coding DNA Sequence Number=SeqID_103627
  Gene Ontology: Mol. function=RNA-directed DNA polymerase activity; Cellular component=chromatin; Biological process=chromatin assembly or disassembly
MDPSVSVLTTELSKLSWRKTYAKAAFRTHYGHYEFCVMSFGLCNALSSFQATMNNISGPYLCRFIIVFFDDILIYNKTFPGHLDHLAKAFEVLLEGLFFLKLTKCTFAQQQVEYLGHIVSRHGVEPVPTKVEAIQAINSSGCQRPSWPSKFSKMPFTELQFWGCRTSPNHFLLKHALLVWAWGLDHGGSEEMASVSIGPPLHHFDRPLEP

SEQ ID NO: 220406 - protein, 84 aa, Glycine max
  Coding DNA Sequence Number=SeqID_103628
  Gene Ontology: Mol. function=oxidoreductase activity, acting on NADH or NADPH; Cellular component=mitochondrion; Biological process =mitochondrial electron transport, NADH to ubiquinone
  Homolog annotation: Hit_ID=Q9SP38; Match level="QueryCoverage=73%, HitCoverage=34%, E-value=1e-11, Identity=68%"; Hit description=NADH ubiquinone oxidoreductase PSST subunit
MTIRLVRAGPKNDVEAVKIIAGSVGRRSWAKWSYDEPSSSDRQPSTSRTFPPSTHQQERKHERKGNLRGESYARESEKARGKRK

SEQ ID NO: 220407 - protein, 142 aa, Glycine max
  Coding DNA Sequence Number=SeqID_103629
  Gene Ontology: Mol. function=transporter activity; Cellular component= integral to membrane; Biological process=transport
  Homolog annotation: Hit_ID=Q2PF01; Match level="QueryCoverage=79%, HitCoverage=23%, E-value=2e-42, Identity=61%"; Hit description =Putative cytosolic factor
  Pfam annotation: Domain name=CRAL_TRIO_N; Domain location=31-77; Score=20.6; E_value=0.00019; Accession=PF03765.5; Description =CRALTRIO, N-terminus
MWVWVFLCVCVCVCVFVSVCMAVCVCGCVWGIPLVGDERSDVILLKFLRAMDFKVKDALSMLRNTVRWRKEFGIEGLIEEYLGNDWDKVVFSHGHDKEGHPVYYNVFDEFEDKELYNKTGISTIVQLNDLKNSPRLGKRELR

SEQ ID NO: 220408 - protein, 195 aa, Glycine max
  Coding DNA Sequence Number=SeqID_103630
MVLVYIKVLEEFPIRQAIAPNPNSLILEHMPTKRNVYPLRAFVWRSRDADPCEMPFSIPLDLQQLSMMYHLNVVLPWDCTKVEETFQTKDVPLEDPQYSPREYVKRVEDALPRTREALDQAFQDKYYVEKKAMKWFLIRDYFDKKLTRWEPSRTPTPLGNLVFPAPINLSSNDESSDEFLRKLDEEVAKQKGEDK

SEQ ID NO: 220409 - protein, 54 aa, Glycine max
  Coding DNA Sequence Number=SeqID_103631
MTVVNYATEATIAAKAVTTTNELGFVTVAIESWPLIGSSNVCVKLVQSKTFKIN

SEQ ID NO: 220410 - protein, 144 aa, Glycine max
  Coding DNA Sequence Number=SeqID_103632
MKDLRFMPIFYIIAYTNLALSKLMLEVWEGSLSEFNSNLFPGIHKRAANYYGFGLNKTNLAYTGILSPSSITTGVSKKGTSTRVVVTENKRGYISCGSVQLEGTSTWLFKENKGGYIPCGSFLVKAFTRLKRNLKDHRSLGDWM

SEQ ID NO: 220411 - protein, 68 aa, Glycine max
  Coding DNA Sequence Number=SeqID_103633
  Subcellular localization annotation: CTP_CleavageSite=50; ConfidenceScore=5.21e-01
MTVKKRLSYEVQKVTVGLSSAFGLSAHPPLSVASAHLARQKNQGRLLSTRSVRKRSWCLQPGSAHNWH

SEQ ID NO: 220412 - protein, 216 aa, Glycine max
  Coding DNA Sequence Number=SeqID_103634
MAEGTRSKTNMECMEEAIAKLASNQLHVTTKLDELIQHITVLETNQQHSPTPSSSSSNPHSPSTNPVLSRMKLEVPRFDGFDPLGWTFKISQFFEYHATPKPERLVIASFAMEGPALAWFQWGLPEFTSLGPPTIDVGSSGGSRVPPGGEIGRPTSRHPRWLPRLSSTQPFPSPSTVTTNSSAVALPCETTTASCSPPVTGRDDYVSGEGSLFQLR

SEQ ID NO: 220413 - protein, 105 aa, Glycine max
  Coding DNA Sequence Number=SeqID_103635
MQSHGLALSPKLKVGPSVARVSTKESCVDPSGNDPNTGSYGTEKSTDRPDHEVDGPIYLMTLSISQLFLKPLHMTETSMQVGNFDMYGFLEPQSIQRSGQSQFES

SEQ ID NO: 220414 - protein, 476 aa, Glycine max
  Coding DNA Sequence Number=SeqID_103636
  Gene Ontology: Mol. function=3'-5'-exoribonuclease activity; Biological process=RNA processing
  Homolog annotation: Hit_ID=Q1RVU7; Match level="QueryCoverage=78%, HitCoverage=92%, E-value=5e-77, Identity=43%"; Hit description=IMP dehydrogenase/GMP reductase
  Pfam annotation: Domain name=Ank; Domain location=105-135; Score =20.6; E_value=0.0055; Accession=PF00023.20; Description=Ankyrin repeat
  Pfam annotation: Domain name=Ank; Domain location=139-174; Score=7.9; E_value=2.3; Accession=PF00023.20; Description=Ankyrin repeat
  Pfam annotation: Domain name=Ank; Domain location=185-216; Score =30.3; E_value=7e-06; Accession=PF00023.20; Description=Ankyrin repeat
  Pfam annotation: Domain name=Ank; Domain location=37-69; Score=1.9; E_ value=17; Accession=PF00023.20; Description=Ankyrin repeat
  Pfam annotation: Domain name=Ank; Domain location=71-104; Score=17.3; E_value=0.055; Accession=PF00023.20; Description=Ankyrin repeat
  Pfam module annotation: Pfam domain module=Ank::Ank::Ank::Ank::Ank; Domain location=105-135::139-174::185-216::37-69::71-104
MSSDALKVAAVGNNIDGLYQEIQQDPRILESIDSIPFVETPMHVAASLGHFEFATEIMTLKPSFAQKLNPEGFTPIHLALQCNHDEMVLRLVEMNKDLVRVKGREGFTALHLASQENKTELLDKFLKACPDSIEDVTARSETALHIAVKHGHYETLQVLFRWLMRNSRKDSQKFIRTMLDWKDQKGNTVLHVAALYDHIEAVSLLLTMVDLDAKNSEGKTASDIASSDHMKSILIKDLGFRRYMTEEERNAYLVVAALIATATYQAALSPPGGLYPSDVGTNNNTSHVVASTHSINDKSSIPKDGNSIMSAGEFNLFSIANMSSFMASTFGIILLLPRTNILMWCLLYSPPFFLQISFCTAMMVISPAPLNVYVSIAELQNKDEDSKPSKKVEGAEESADEKESDNEGSKLRKSALERLEKANEESRLSQASIKGYFPLGGWGGRKEQDVLNAMGSMYAAVTSIGVINSALVQPSN

SEQ ID NO: 220415 - protein, 276 aa, Glycine max
  Coding DNA Sequence Number=SeqID_103637
MRHGVERLFGTGVNIGFEKADVKELIVTSLKIEISQAARARKPCPPSSLCHREIALLFLLPPENFQKPLPRHPHCPRSNPHNPLHCRKTHIVLARTHRTPYSTGKPILSSLESTEPPTLFLEVWLEENPTYTVATRVLKQSWVLKAQSFLREVLLLIEVRGKLKVSCHFVRSHCHCHFLGSRLLGAPVEITSDKDPVIVHNKLLTLLAIILEFGALVWTRVRYSHKQSSSKLFLELKEFTETSSSKSEAASFVYLLLELWSRNFRCLAPRYWKTSG

SEQ ID NO: 220416 - protein, 75 aa, Glycine max
  Coding DNA Sequence Number=SeqID_103638
MYDSMMSEEVDMNVENEEDAGVKVEHVDCFDVFNTSQLFASCDEVLQWARSLAHNIEFVVVIMRSDTNTGVRGRA

SEQ ID NO: 220417 - protein, 129 aa, Glycine max
  Coding DNA Sequence Number=SeqID_103639
MALARDFCKETTHGAFWFRIGSKIPLAIYTLGMIAKYLDVLEIPGCARMQFSIAKVLKVCMKWPRGSLPQRGPGRTRQPKELVPLRSMTITALGALYTSSASRPSRDGRFSGSDASSSGTTSILISRRK

SEQ ID NO: 220418 - protein, 138 aa, Glycine max
  Coding DNA Sequence Number=SeqID_103640
MKRCLCDARYECIYGHESPKNHFFLLAHLGVQCPMCAVKKVIWTFRLPMTKDETNIQRLSQPTLLRASEARLTGASSKGGKCAESPPTFICGKRRKNRRKPVMKNIPDSGVVFTFEEGRQKRGSCSYVPSIEEEIRPT

SEQ ID NO: 220419 - protein, 103 aa, Glycine max
  Coding DNA Sequence Number=SeqID_103641
  Gene Ontology: Mol. function=3'-5'-exoribonuclease activity; Biological process=RNA processing
  Homolog annotation: Hit_ID=Q9M209; Match level="QueryCoverage=64%, HitCoverage=15%, E-value=8e-16, Identity=64%"; Hit description =Nucleolar autoantigen-like protein
MEQRLANTRRMPLNDKKFIETSLLSDLRVDGRHPSDYRKLTVKLAKQDSSVEVHLGQTHVMTFVTAQDSSVYLLILKMKRVRFVGWPLMDVVLTVNFLETTAR

SEQ ID NO: 220420 - protein, 160 aa, Glycine max
  Coding DNA Sequence Number=SeqID_103642
  Gene Ontology: Mol. function=protein binding; Cellular component =cytosol; Biological process=Golgi organization and biogenesis
  Homolog annotation: Hit_ID=Q42384; Match level="QueryCoverage=75%, HitCoverage=22%, E-value=6e-21, Identity=49%"; Hit description =PP1/PP2A phosphatases pleiotropic regulator PRL1
  Pfam annotation: Domain name=WD40; Domain location=14-52; Score=15.2; E_value=0.24; Accession=PF00400.22; Description=WD domain, G-beta repeat
  Pfam annotation: Domain name=WD40; Domain location=56-106; Score =29.4; E_value=1.3e-05; Accession=PF00400.22; Description=WD domain, G-beta repeat
  Pfam module annotation: Pfam domain module=WD40::WD40; Domain location=14-52::56-106
MCWIQTGWDSSPFNMSDHVISGHLGWVRSVAVDPSNISWLFCSSCSFGQLWDLASGVLKLTLIVHIEQVRGLAVSNKHTYMFSAGDHKQNPQVVTGSHDTTIKMWDLRYGNLWLYFSYLLACLCSDYMHNLTHDAFIFIQEATRYLSDKITNQIDSNKVF

SEQ ID NO: 220421 - protein, 82 aa, Glycine max
  Coding DNA Sequence Number=SeqID_103643
  Homolog annotation: Hit_ID=Q6ATR5; Match level="QueryCoverage=59%, HitCoverage=7%, E-value=2e-07, Identity=48%"; Hit description =Expressed protein
MLGLNRIERVLPVGTSLTVVGEVISVEHSWKKSRDLLEKIGRQGDLTGYRVSCLLIGAKDDLTPYPRAVQDSVKVLHINSVS

SEQ ID NO: 220422 - protein, 177 aa, Glycine max
  Coding DNA Sequence Number=SeqID_103644
  Gene Ontology: Mol. function=DNA binding; Biological process =regulation of transcription, DNA-dependent
  Homolog annotation: Hit_ID=O80383; Match level="QueryCoverage=74%, HitCoverage=26%, E-value=3e-25, Identity=48%"; Hit description=98b
  Pfam annotation: Domain name=HMG_box; Domain location=115-169; Score =29.1; E_value=1.5e-05; Accession=PF00505.9; Description=HMG (high mobility group) box
MKDTVRGSNQRKVVGVVFPTCIISLLFRKIFLATLLQKIVTAEEKMPYEGIYHAGKEAYLQVIAMEKRETDSMRFLEDEQKQRTAMELFEQYMQFKQEAEKDGKKNKKEKDPLKPKHPMSAYLLFTNDRRAALAAENNNLLEVPKITSKEWKNMTEEQKRPYEEILAFNNLDVCKTN

SEQ ID NO: 220423 - protein, 175 aa, Glycine max
  Coding DNA Sequence Number=SeqID_103645
  Gene Ontology: Mol. function=ATP-dependent helicase activity
  Homolog annotation: Hit_ID=Q1RWC6; Match level="QueryCoverage=62%, HitCoverage=16%, E-value=2e-14, Identity=57%"; Hit description=ATP -dependent helicase HrpA
MDCLQAGSLASLKATLEELSGQATLSSSNEEETSVNIEATQFHVFDEVRDGEWLVIATNVVEISLTIPRIKYVVDTGREKVANFPFPTSLKDSSLLEAKTCLKALEALDKKDELSCSFFLNIQKKIAMIAAISQDPSSFKSEELQYSKDFTHIMFDRKNAPTMWDQHKLKGALKP

SEQ ID NO: 220424 - protein, 92 aa, Glycine max
  Coding DNA Sequence Number=SeqID_103646
  Gene Ontology: Mol. function=transferase activity, transferring hexosyl groups; Biological process=carbohydrate metabolic process
  Homolog annotation: Hit_ID=UPI0000610C32; Match level="QueryCoverage =88%, HitCoverage=49%, E-value=3e-14, Identity=47%"; Hit description =glycosyltransferase 28 domain containing 1
MTKLQGWGSGSIFETLQLGKPLIVVVNEDLMDNHQSELAEELADRKHLYCASPQTLHQTIANMDLSSLFPYSPGDATPVAKHINNLLGFPDD

SEQ ID NO: 220425 - protein, 67 aa, Glycine max
  Coding DNA Sequence Number=SeqID_103647
MAAMAVAAAMAPPYPTRHATAIRSTPPEHLPNPSSQGQGLQIPGEDTIIIIHALLDPGYPLAQSRTR

SEQ ID NO: 220426 - protein, 393 aa, Glycine max
  Coding DNA Sequence Number=SeqID_103648
  Gene Ontology: Mol. function=nucleic acid binding; Cellular component= nuclear pore; Biological process=DNA integration
  Homolog annotation: Hit_ID=Q2HUL7; Match level="QueryCoverage=98%, HitCoverage=35%, E-value=7e-78, Identity=34%"; Hit description =Integrase, catalytic region; Zinc finger, CCHC-type
  Pfam annotation: Domain name=rve; Domain location=262-393; Score =63.6; E_value=6.6e-16; Accession=PF00665.16; Description=Integrase core domain
MSLREQLSSITKGNSSISTFLHSIHNIADELALICHPIDKLEMVIHALNDLGPTFREITASIYTRDSPIAFNELYGKLVDFEMFLQREECILTPQCYKIHGYPNKPCHPTAHVAQQVVSHSSSPSWLFDYGASHHITNDMSNLSIKKITMELIIFKLQMVSIEFYPWHFEVKNLHTKEILLRGLNEDNAYRLQPHTPAPHTSFATFNPTLKLWHHRLGQPAPLTLLHALKSNNIVYYGSLTKCLPCLSNKSHKLPFSTSSISSSYPLEILYSDLWGSTPVNLIDGFRYYVIFMDHFSKYVWLYPLKLKSVVSIIFPIFKNLVERQFNSQIKTLYSNNGEEYIKLRPFLQANGISHFTTPPHTSKHNGLSERKHFHLIEIAHCLLNHISLPPHY

SEQ ID NO: 220427 - protein, 47 aa, Glycine max
  Coding DNA Sequence Number=SeqID_103649
MGEEMDLRGCSSSVPSKTILGVLVEELDLHVEIQQNILIMDRSKIRS

SEQ ID NO: 220428 - protein, 536 aa, Glycine max
  Coding DNA Sequence Number=SeqID_103650
  Homolog annotation: Hit_ID=Q9M0R2; Match level="QueryCoverage=25%, HitCoverage=22%, E-value=2e-29, Identity=51%"; Hit description =Patellin-5
MVRCAHVKAMDGNFNEVEVFSFRETIMFRSMGWGCEVGDTIGLVGLKVAKEVCGAGVCGWSLYALSSFSPRKRISFVCKFFTSKCQGFFTVLENGRIVEWWHVGVGESRSVTMVIVVAASLIVSSIIAIIMALSKVCNYWNRCQDAFFTLQKHLKIHQLAIEFVESNWGARCCAYDIAFKITSYEKSLRPLESELFDDAMMGIEKKKRAEGENQGASLLAHVDVPILLISLSLMKLPKKKFNKSKIQSKPRDCVSAYQPFGCDEVWGLDLDFGSDEGNEFGFKCPLKIHGSGDHEEDHDSMPQLPRILLLLHSHRAKHGVFFILDEASLVAAYVGKAVQLRDYVSDGNCNENLVLVVGTMAHGKIDADYIDDLISDPNSNRVSDSEKNSIDELKKLLKEELEDEEVSIWGVPLLKGDRTDVILLKFVRARELKTLSDGGRTSTSTPFWMKIWVTTWRRWCSCTDTAEMAIPSVTTSTASSRTRTSTTRPCPLRIIKKSFSDGVFSCWSAVFGTSRIMKKKLQCFTKRTLGFKRFTK

SEQ ID NO: 220429 - protein, 100 aa, Glycine max
  Coding DNA Sequence Number=SeqID_103651
MKKKKVEAASVSLSEGFALSEQHPLSEALSLLSELGESGKMPSMHAPSVPLARPANAAKPKISTFKRILGLGVIFRFLEVEETSSPLCNLNFASKTPYCS

SEQ ID NO: 220430 - protein, 101 aa, Glycine max
  Coding DNA Sequence Number=SeqID_103652
MATRRVGVGFCLSRPQLSIPPETQWGCKFTPSPSPTGQRDGFESRLGSGINNLIPTPNPTLAIEKNLNLTSILVNSDFPCQNLKEFKMGPMNSDPIVMPVR

SEQ ID NO: 220431 - protein, 258 aa, Glycine max
  Coding DNA Sequence Number=SeqID_103653
MTTAMLNTGTFTFTAPNRSQRIHEPETMPHEKQNERNTGNKNGVQSSLEERLHVGQPVELFGRRLVTATAHRDVKAQRHARQQEQANDVVNGIEVIDYLTWTQVWTFMDGSSLKGFYDVQYTALNKGISNAFLESISMKQEADVVTSAGPKYLSDLSTYHQHAWEITALTYLYDHFFYASLCASKQYGSYMMLRMVFKNLPINCFLECLTDYDQHQPLVARWSSYEAYKHVRPFTDQTYYFGYIMYGIDIRLYLPKRV

SEQ ID NO: 220432 - protein, 392 aa, Glycine max
  Coding DNA Sequence Number=SeqID_103654
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=Q1EP29; Match level="QueryCoverage=98%, HitCoverage=94%, E-value=1e-140, Identity=60%"; Hit description =Glycosyl transferase family 14 protein
  Pfam annotation: Domain name=Branch; Domain location=50-275; Score =404.5; E_value=1.5e-118; Accession=PF02485.11; Description=Core-2I -Branching enzyme
MGLVSTIHSFNSILFFLPSRLAENQSAPVFVETKISATAPAPAAPAIPRFAYLISGSKNDLEKLWRTLLALYHPLNHYIVHLDLESPLEMRLELASRIEKQPVFSEVGNVFMIPKANMVTYRGPTMIAHTLHACAILLKRTKDWDWFINLSASDYPLVTQDDLLYTFSEVDRSLNFIEHTSRLGWKLEKRAMPLIIDPGLYRTNKSDVFWVGPKRTLPTAFKLFTGSAWMVLSHSFVEYVVWGWDNLPRTLLMYYTNFISSPEGYFQTVACNEPELAKTVVNSDLHYISWDNPPKQHPHVLNINDTTKMIASNAAFARKFKHNDPVLDVIDKKLLHRENEQLFTPGGWCSGNPRCSKVGNIHRITPSPGSKRLRLLVTRLTWMAKFGQKQCI

SEQ ID NO: 220433 - protein, 196 aa, Glycine max
  Coding DNA Sequence Number=SeqID_103655
METCSTTEELLQGMMDQARFEIGDASKGEQHVCMQLADKSPSKPKPLMIHFTRDAASQKPRGSQPIPGKKFVPFPCRSNKAVPWRYAPQKPNEKKDKAVGDDLSFAKVTYISGMSGVTRSGRVFAAPDPLVWSKDAKGKAKVGTKENDKASPILDEEIPVGRFAKGEEDFSTKKISTKEANEFLRIIQQNEFKVIE

SEQ ID NO: 220434 - protein, 91 aa, Glycine max
  Coding DNA Sequence Number=SeqID_103656
MTLYVKNTALRRRNGPNFVKAIETPRGRMCGKRHRPSISKTLPPHVVSWGFEYLEKKLMAEKTKKKLEEADQSKITEAMIDPPSPIRRHVK

SEQ ID NO: 220435 - protein, 353 aa, Glycine max
  Coding DNA Sequence Number=SeqID_103657
  Gene Ontology: Mol. function=nickel ion binding; Biological process =nitrogen compound metabolic process
  Homolog annotation: Hit_ID=Q8H1P5; Match level="QueryCoverage=41%, HitCoverage=59%, E-value=2e-76, Identity=84%"; Hit description =Urease accessory protein UreD
  Pfam annotation: Domain name=UreD; Domain location=215-353; Score= -43.8; E_value=0.0012; Accession=PF01774.8; Description=UreD urease accessory protein
MKIENENQTHLNDSVSGRKQNRKKKVTLEVWCKGFFICSILTNPSQRILLAPTIFATAIPLYAATWHHPKGRRAVEKLIRRCQLVETPGVGVGEVEEGHCVMTDLGSMIEIYCTIEFKNACRIYNSACTTTTRCCLLHSVPRTSLIQSNQRVALPSVDVRGRIMRSGEADREMEMGSVVVEKVGGRSSVTSCFSRYPLKFVIPKKVGSSKTDAVWVYALNYGGGIVSVYKSVGSKCSQQILEARVGSNALLAIIPDPVTCFSTARYCQKQVFCVLPDSNLVMVDWITSGRHESGEKWDFDLYRSSNNIFLEDGQPLFLDTAAGSTNYLYYCLGTCDLIKERFIPYTGFVLVVL

SEQ ID NO: 220436 - protein, 122 aa, Glycine max
  Coding DNA Sequence Number=SeqID_103658
  Gene Ontology: Mol. function=nickel ion binding; Biological process =nitrogen compound metabolic process
  Homolog annotation: Hit_ID=Q8H1P5; Match level="QueryCoverage=67%, HitCoverage=28%, E-value=2e-42, Identity=98%"; Hit description =Urease accessory protein UreD
MASCYKQMLLDKEKIGCVQEHMHNYQVIAMIVLLGPKVQYVQNRVQDHVKEVMSEQLQHPSAAWSHQRDKADHFITKPSFIASCSAFGPKDFSSEYFDFLEDERNKISLWKKILVKYALPRE

SEQ ID NO: 220437 - protein, 140 aa, Glycine max
  Coding DNA Sequence Number=SeqID_103659
  Gene Ontology: Mol. function=DNA binding; Biological process=DNA integration
MEEGCCKIPKFQLLSISFSYLGIPNGANPRHCKLCDPIINKCERELAKWKQRHIPFGGRVTLIKVSNSVVDKLDSHDNLECYKTRLVAKRFTQKNDIDYKETFSLVSRKDSFRITMALVTHYDLELHQMDVKITFFLVEN

SEQ ID NO: 220438 - protein, 65 aa, Glycine max
  Coding DNA Sequence Number=SeqID_103660
  Gene Ontology: Mol. function=nucleic acid binding; Biological process= DNA integration
MKQYRGYSDLDFAGSKTDRKSTSGTCQFIGSALVSWHNKKKIVLLYPLPRQNISLLAVVVHKSYG

SEQ ID NO: 220439 - protein, 110 aa, Glycine max
  Coding DNA Sequence Number=SeqID_103661
  Subcellular localization annotation: CTP_CleavageSite=40; ConfidenceScore=5.23e-01
MRDYLMVTCTFRQPGANEPVDAQRLTSSSSPSIVLTREVRESESGSRRRYLVAIRTFRQPRGTNSTVFTLVVRKHSSPTMREIFLCWAGTIECNGVGKCRRCPTLSLSRH

SEQ ID NO: 220440 - protein, 126 aa, Glycine max
  Coding DNA Sequence Number=SeqID_103662
MTPRAGSPRRHLTVIRTSSVIDKQRPIWSSAPFSEMSEFLIEGYVGVRPCFCRPPHISSSGGGPDDPGGHVMCTLLSSRGGGPDDTRRYLTVIRTLLSSRGGGPDDKQRPSLVILHPCIIQRRRAR

SEQ ID NO: 220441 - protein, 56 aa, Glycine max
  Coding DNA Sequence Number=SeqID_103663
VTYVLKDCVVSELPVCSLKKGMATLGQGELIQGYILIMGLDSILPVLSTLIAMYED

SEQ ID NO: 220442 - protein, 126 aa, Glycine max
  Coding DNA Sequence Number=SeqID_103664
MRRHTITFRLALPLKGRLRQSPITQLSVVLIRVKEVAKAAGSPAITDASSIGACRPRIFFINGFLCFLEDEWQQNGERKRERRRHFKERMSLEEAHHHRRPWIRAWRKKEMNEGRGREEHEILCSK

SEQ ID NO: 220443 - protein, 97 aa, Glycine max
  Coding DNA Sequence Number=SeqID_103665
MHCLPKLCRLFLFFVLLSILFRKLFSKVDKTFDVTLLPTFKACEDQEGDSQLSQRALLRASEGEAHGCAFQRRKDVRSRHQRLFVENTGKTEGNRSK

SEQ ID NO: 220444 - protein, 155 aa, Glycine max
  Coding DNA Sequence Number=SeqID_103666
MGGVCKFDEMTNGYSKMQTYRGKLLDPTMNLRNHLEVGGLTIEDIILVYLITYIHTPRSSNDARVTGDDLQIVDGLKSDYEFHYAVLASRFIDYLNVDGSNEIVDFTKASSEIIKRHLKKLNRWMKLLKLKLHKSLHINGVHLSHLCRSKASRRF

SEQ ID NO: 220445 - protein, 72 aa, Glycine max
  Coding DNA Sequence Number=SeqID_103667
MDKSKETTTPINFYLSADEKGKLIDQTKYKESHFSTVKRVLKYLRGTLDVDLWYPKGVEISLLGDTDSNFVG

SEQ ID NO: 220446 - protein, 118 aa, Glycine max
  Coding DNA Sequence Number=SeqID_103668
MALVIGRFLRMTASSWNSEKQACVALSIVKGDCDIEFVDTYSQLTYIFTKPLARDRFFHLHIELGILSVATYPSAGGRRETRGRRVPRKEYARSRHQRLFEENVGKTGKDAIYELLSE

SEQ ID NO: 220447 - protein, 138 aa, Glycine max
  Coding DNA Sequence Number=SeqID_103669
  Subcellular localization annotation: CTP_CleavageSite=34; ConfidenceScore=5.53e-01
MTPLKLPSLGADVWGANTFPVRKYNSRTFHLKVRRSRLFRFFRRFPQINVGGDSARIPFVEHASRESRVALPPKAFCNNVLTLTIDKATHACFSLFQDDAVILRKRPITRAMSKRLQEDWARATEEGPRVLMNLRVDF

SEQ ID NO: 220448 - protein, 138 aa, Glycine max
  Coding DNA Sequence Number=SeqID_103670
MMAHQLSYPNLSGDHCLVARNLCLTASKYLTPIVRQSVRFRGMLEVERKHCCAIRKVLQHYRGQKGHCCVIRKESTQKAKWGVFSKKRCANSNQAHLGLLGGSNRWRCLLVEATQLAWVSWATTTSLFFPINRGKWAE

SEQ ID NO: 220449 - protein, 104 aa, Glycine max
  Coding DNA Sequence Number=SeqID_103671
  Subcellular localization annotation: CTP_CleavageSite=44; ConfidenceScore=5.08e-01
MGAKHLKMTKHKLHATKQRSPGRLALWLLGRMLLNSNAIHIHVRVVMLVRMIRTRLFAAARAKSCPGMHIRCVITSLSGCARTVGRPPISGGGPGTDKRKLLAP

SEQ ID NO: 220450 - protein, 69 aa, Glycine max
  Coding DNA Sequence Number=SeqID_103672
MEKTDRKTFKDKKAKKAYITWEDNDMDSFKESENEVVNLSLMTKNYKSEEENFKMHSMTYIKNQSNLPN

SEQ ID NO: 220451 - protein, 166 aa, Glycine max
  Coding DNA Sequence Number=SeqID_103673
MGSSQKPSLKKRFYQVKIKSLEGRSLHGTVGPSIRYKVTARASKKGKRIGTNSWLAWRGDSIFMRRMSKCSLDGTRGCINYNPVLAIRQLGYPDRELRGSSNGIIGGYHKWLRVRTQGLDWLPNLKTVRGDEVKASEESDEVQALKEELERARVVEEKFKSIAIKV

SEQ ID NO: 220452 - protein, 128 aa, Glycine max
  Coding DNA Sequence Number=SeqID_103674
  Gene Ontology: Mol. function=chlorophyll binding; Cellular component =integral to membrane; Biological process=photosynthetic electron transport
  Homolog annotation: Hit_ID=Q95DZ4; Match level="QueryCoverage=49%, HitCoverage=28%, E-value=3e-31, Identity=96%"; Hit description =Photosystem II CP47 protein
  Subcellular localization annotation: CTP_CleavageSite=51; ConfidenceScore=5.01e-01
MCRSCALSFAHLFRKDVISGINRVQCETFLYPRTAGQTNSMTYIMSNRSTSLEPKSQLTINLDPSSPRGWFTFGHASFALLFFFGHIWHGARTLFRDVFAGIDPNLDAQVEFGAFQKLGDPTTKKQVV

SEQ ID NO: 220453 - protein, 75 aa, Glycine max
  Coding DNA Sequence Number=SeqID_103675
MLHIPLLHSSILLLPVPPPFIPPITATVVVFVFAFVVSLCYPLYEIIVKPLPGLGEIKDPYKAYGLSICMAHMDW

SEQ ID NO: 220454 - protein, 90 aa, Glycine max
  Coding DNA Sequence Number=SeqID_103676
MDISEDTDIPVILGRPFMLTASCIVDMGKRKLELGFEDQKIDFDLFVEDKPAPEHNVCLQVMEGGQEVLKIIGNLLHNLYIGVYQPIFEC

SEQ ID NO: 220455 - protein, 65 aa, Glycine max
  Coding DNA Sequence Number=SeqID_103677
AIPAPCPQVAEDEFLPQHIDLRQFRLHARKLLRMSFYRSTLTLGRFTSIDTDLNVLKKRIETLHL

SEQ ID NO: 220456 - protein, 51 aa, Glycine max
  Coding DNA Sequence Number=SeqID_103678
MALSSIKMRFGRKKVSLATRIDTQLHELQFSPGMNQPKMKGLGAKRLRLMA

SEQ ID NO: 220457 - protein, 51 aa, Glycine max
  Coding DNA Sequence Number=SeqID_103679
MEVAGKKWALLDSRRRRNPYKAVLGEGATIFTRPKRLGLWGLIRCQVVVSR

SEQ ID NO: 220458 - protein, 106 aa, Glycine max
  Coding DNA Sequence Number=SeqID_103680
MQRLPFLYPTDEAVVSPAKPPDRPDPEVDDPLYQMTLTIPQLLLKPLQVMNLTETSMQAGNSNVYGFLEPKSIQRSGKSQFESESYIKSWMQSSKRDVYLGAYLNG

SEQ ID NO: 220459 - protein, 71 aa, Glycine max
  Coding DNA Sequence Number=SeqID_103681
MHLRDQGIPGSLLNNKEKNKMKDCKNTSGEDVSFTCRISQSLTNSSQALKPAPASSSGLCRSSHSKSLKTL

SEQ ID NO: 220460 - protein, 179 aa, Glycine max
  Coding DNA Sequence Number=SeqID_103682
  Homolog annotation: Hit_ID=Q9LVC1; Match level="QueryCoverage=79%, HitCoverage=30%, E-value=2e-23, Identity=41%"; Hit description =Similarity to carboxyl-terminal proteinase
MGKLLHFSAMGSTIFILLGLVVTVYGFVDYGSSSLSRLKVLEVERKLKQLRGHSLKTIQSEDGDIIDCIDINKQPAFDHPALKGHKIQMAPTYNSAKKDMTIGTKTTRTRKNAKSGKMMKQRDEGSSVTVTSQVWQKSGRCPEGTIPVRRIQERDMIKAHSIEDYGRKKPASLINMLVN

SEQ ID NO: 220461 - protein, 100 aa, Glycine max
  Coding DNA Sequence Number=SeqID_103683
  Gene Ontology: Mol. function=phenylalanine-tRNA ligase activity; Cellular component=cytoplasm; Biological process=phenylalanyl-tRNA aminoacylation
  Homolog annotation: Hit_ID=Q1SWR9; Match level="QueryCoverage=74%, HitCoverage=12%, E-value=3e-27, Identity=77%"; Hit description =Phenylalanyl-tRNA synthetase, class IIc; Aminoacyl-transfer RNA synthetase, class II
MQDIASDEIKALKARKLIVPQTWKGYSLKRGPNYAPKRKKVVTDLTRDNFQSGEWKELEFKEYNYSAKGQPLEGGNLHPLLKARRYTFLLFSPTQILFDI

SEQ ID NO: 220462 - protein, 265 aa, Glycine max
  Coding DNA Sequence Number=SeqID_103684
  Gene Ontology: Mol. function=phenylalanine-tRNA ligase activity; Cellular component=cytoplasm; Biological process=tRNA aminoacylation for protein translation
  Homolog annotation: Hit_ID=Q1SWR9; Match level="QueryCoverage=99%, HitCoverage=45%, E-value=1e-140, Identity=90%"; Hit description =Phenylalanyl-tRNA synthetase, class IIc; Aminoacyl-transfer RNA synthetase, class II
  Pfam annotation: Domain name=tRNA-synt_2; Domain location=71-250; Score=-199.6; E_value=0.016; Accession=PF00152.11; Description=tRNA synthetases class II (D, K and N)
  Pfam annotation: Domain name=tRNA-synt_2d; Domain location=1-257; Score=419.0; E_value=6.6e-123; Accession=PF01409.10; Description =tRNA synthetases class II core domain (F)
  Pfam module annotation: Pfam domain module=tRNA-synt_2::tRNA-synt_2d; Domain location=71-250::1-257
MGFEEMPTNNFVESSFWNFDALFQPQQHPARDSHDTFFLEARSTTKILPEDYVLRVTQVHESGGYGSRGYAYDWKREEANKNLLRTHTTSVSSRMLYQLAQKPFAPKKYFSIDRVFRNEAVDRTHLAEFHQIEGLVCDRGLTLCDLIGVLHDFFSRLEVISLLSSGMTKLKFKPAYNPYTEPSMEIFSYHEGFKKWVEVGNSGMFRPEMLQPMGLPEDVQVIAWGLSLERPTMILYGIDSIRDLFGHKVDLGLIKKNPMCRLGID

SEQ ID NO: 220463 - protein, 239 aa, Glycine max
  Coding DNA Sequence Number=SeqID_103685
  Gene Ontology: Mol. function=ubiquitin thiolesterase activity; Cellular component=intracellular; Biological process=ubiquitin -dependent protein catabolic process
  Homolog annotation: Hit_ID=Q6ZL19; Match level="QueryCoverage=95%, HitCoverage=57%, E-value=1e-50, Identity=42%"; Hit description =Putative carboxyl-terminal proteinase
  Pfam annotation: Domain name=DUF239; Domain location=23-197; Score =192.5; E_value=9.9e-55; Accession=PF03080.5; Description=Arabidopsis proteins of unknown function
MTLPGAFYGPVQKAIALAVGFRYLGAKGDIKVDNPSVEKDDEYSTSQVSLLTGPYNDFECVEAGWAVNPSVYGDRQTRLFVYWTISNEIALGAAIYPISIPGGLQYIITIYIYKDPYTNNWWVQYGENTNIGYWPPELFETIRYNAESVEWGGEVYSSTIGHTPHTATQMGNGQFASVFGESSTITRMRIHDNSAALKIPEYVAEFTDEFNCYDVWYLSDYVEDPELYYGGPGQNPKCP

SEQ ID NO: 220464 - protein, 142 aa, Glycine max
  Coding DNA Sequence Number=SeqID_103686
MTHYVHITNLMLWAVMFLQLWLQQKKDGEARELNLHPAHESWHTGYLHIGHSELVFSLSFLIKVATKLQGHFLPMPCPCIEFDIDTVEHGLLAGQADKAPREPNVLLLLPKVKEGPELEMNGEAGVVHEDISLRGALTHWES

SEQ ID NO: 220465 - protein, 121 aa, Glycine max
  Coding DNA Sequence Number=SeqID_103687
  Homolog annotation: Hit_ID=Q1RYI2; Match level="QueryCoverage=36%, HitCoverage=6%, E-value=8e-08, Identity=51%"; Hit description =Ribonuclease H
MWKPIKLSRGGPALSHLAFADNLVLFSKASLDQVKIIKACLGYSAPVRARKSSNPLKSSVDNIIVLYHANDLSIYVRTLIGNVKISYGGTRMIIEICTWCHVIIFVNGNKRVVWACIKRVK

SEQ ID NO: 220466 - protein, 241 aa, Glycine max
  Coding DNA Sequence Number=SeqID_103688
  Gene Ontology: Mol. function=protein binding; Cellular component =Golgi apparatus; Biological process=endocytosis
  Homolog annotation: Hit_ID=Q9LYF9; Match level="QueryCoverage=66%, HitCoverage=27%, E-value=2e-76, Identity=84%"; Hit description =Clathrin binding protein-like
  Pfam annotation: Domain name=ENTH; Domain location=105-228; Score =234.5; E_value=2.3e-67; Accession=PF01417.11; Description=ENTH domain
MEGLYKVVAEYKEQGGWNLNQIQHLLPENIADIIQSVVGSQAQFIIKSVYDEIHQRGIDNQNPFSNLSSLQIGSDQNPTAMDFMKVFDQTVREIKREVNLKVLKVPEIEQKVLDATDNEPWGPHGTVLAEISQATKKFTECQMIMNVLWTRLGETGKDWRYVYKALAVIEYLVAHGSERAVDDIIEHTFQISALSSFEYVEPSGKDVGLNVRKKAENIVSLLNDKDKIHEVRNKAAANRDK

SEQ ID NO: 220467 - protein, 50 aa, Glycine max
  Coding DNA Sequence Number=SeqID_103689
MFVEIVFATYPLRSKKSTKGKSPGKGTPRALLLFLLLPEFVFVANWAALP

SEQ ID NO: 220468 - protein, 99 aa, Glycine max
  Coding DNA Sequence Number=SeqID_103690
MTPLMKKIQGLQAPHGAYITILGAPLDLKQPKPHQILSETLEKNQKWRLKSPLLLLHSTAIDLQEAKDSIYEEDPRPTSSTWNYIINGECVQIVGLSTT

SEQ ID NO: 220469 - protein, 424 aa, Glycine max
  Coding DNA Sequence Number=SeqID_103691
  Gene Ontology: Mol. function=RNA-directed DNA polymerase activity; Biological process=RNA-dependent DNA replication
  Homolog annotation: Hit_ID=Q8H6Q8; Match level="QueryCoverage=89%, HitCoverage=52%, E-value=3e-56, Identity=37%"; Hit description=CTV.20
  Pfam annotation: Domain name=DUF755; Domain location=106-205; Score= -37.7; E_value=0.034; Accession=PF05501.2; Description=Domain of unknown function (DUF755)
  Pfam annotation: Domain name=zf-CCHC; Domain location=215-232; Score =30.4; E_value=6.5e-06; Accession=PF00098.13; Description=Zinc knuckle
  Pfam module annotation: Pfam domain module=DUF755::zf-CCHC; Domain location=106-205::215-232
AVKTDLNGKVITNDDDKEIPDAVNTLIFTIAQHFIGDPSLWKDRSAELLSNLKCRTLADFRWYRDTFLTRVYTREDSQQPFWKEKFLAGLPRSLGDKVRDKIRSQSANGDIPYENLSYGQLISYVQKVALKICQDDKIQRQLAKEKAQTKRDLGSFCEQFGLPACPKQKKKQTSRKEAQDHKPANRRRFSKRRYSQKPSTSREMENPKLKIKLKITCYNCGKQGHISKYCRLKKKLRNLNLEPSIEEQINNLLIETSKEETETETSSSVLSDENLNLIQQDDQLSSTNDDGQINTLTRVQDLLFEAINSIPDPQEKKVFLEKLKKTLEVKPRQKDFITNNKFDVSNILKRLENSSTKPTTIQDLQTEINNLKREVIELRQLQEIHQIILSQLEVDSDSESAHNSEVNLPADLEDDMFMGFNQQD

SEQ ID NO: 220470 - protein, 183 aa, Glycine max
  Coding DNA Sequence Number=SeqID_103692
  Gene Ontology: Mol. function=electron carrier activity; Cellular component=integral to thylakoid membrane; Biological process =electron transport
  Homolog annotation: Hit_ID=P49161; Match level="QueryCoverage=99%, HitCoverage=76%, E-value=5e-78, Identity=66%"; Hit description =Apocytochrome f precursor
  Pfam annotation: Domain name=Apocytochr_F_C; Domain location=129-183; Score=12.7; E_value=4.4e-10; Accession=PF01333.10; Description =Apocytochrome F, C-terminal
GYENPREATGRIVCANCHLANKPVDIEVPQAVLPDTVFEAVVRIPYDMQVKQVLANGKKGALNVGAVLILPEGFELAPPDRISPEIKEKIGNLSFQNYRPTKKNILVVGPVPGGNRGRGQIYLDGSKSNNNVYNATAAGMDQNFLYPEGESIKLDQPLTSNPNVGGFGQGDAEIVLQDPLRVQ

SEQ ID NO: 220471 - protein, 175 aa, Glycine max
  Coding DNA Sequence Number=SeqID_103693
  Gene Ontology: Mol. function=helicase activity; Biological process =proteolysis
  Homolog annotation: Hit_ID=Q9LTU4; Match level="QueryCoverage=98%, HitCoverage=12%, E-value=9e-56, Identity=56%"; Hit description =Helicase-like protein
MIESERLSYVRKNQKKLRVDKFCSLQQSSDAGNTKGLSKGKRIILPSTFVGSPRYMDQLYFDGIAICSHVGFPNLFITFTCNPNWPEIHRLLTPLNLTAIDKPEIISRIFKLKYEHMLSDLTKNHLLGKVVAYMYTIEFQKRGLPHVHLLLFLHAINKYPSPNDIDHIISAEIPS

SEQ ID NO: 220472 - protein, 115 aa, Glycine max
  Coding DNA Sequence Number=SeqID_103694
  Gene Ontology: Mol. function=voltage-gated ion-selective channel activity; Cellular component=mitochondrial outer membrane; Biological process=anion transport
  Homolog annotation: Hit_ID=Q9FKM2; Match level="QueryCoverage=68%, HitCoverage=28%, E-value=4e-21, Identity=62%"; Hit description=Porin- like protein
MNLLWHSYNVSDHAILPQLDVQYLHPHAAVDSSIGLNPSPLLELSAAIGSKDVCLGAEVGFNTTSASFTKYNAGVAFNKPDFSAALLLYLLIVSSFLCSEVSQLVSEKTYQHGKT

SEQ ID NO: 220473 - protein, 98 aa, Glycine max
  Coding DNA Sequence Number=SeqID_103695
  Gene Ontology: Mol. function=kinase activity; Biological process=DNA integration
  Homolog annotation: Hit_ID=Q1S4N1; Match level="QueryCoverage=82%, HitCoverage=6%, E-value=3e-30, Identity=76%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MDLNLEQKESTKIFVDNQAANSISHNPVFHGKTKHFNIKLFFLREVQKEGLVTLVYCKSENQLADLLTKPLPVSRFEFLRKKLEFVAPKARRSVKNML

SEQ ID NO: 220474 - protein, 69 aa, Glycine max
  Coding DNA Sequence Number=SeqID_103696
  Gene Ontology: Mol. function=DNA binding; Biological process=DNA integration
  Homolog annotation: Hit_ID=Q0ZCD0; Match level="QueryCoverage=85%, HitCoverage=5%, E-value=4e-15, Identity=58%"; Hit description =Integrase
MSPDRVVIGKACHLPVEIEHEAYWAVKTCNFSMDQSGEERNLQLSELDDIRLDAYENAKLGLMSGIVEV

SEQ ID NO: 220475 - protein, 205 aa, Glycine max
  Coding DNA Sequence Number=SeqID_103697
  Homolog annotation: Hit_ID=Q6CQF2; Match level="QueryCoverage=17%, HitCoverage=43%, E-value=9e-09, Identity=80%"; Hit description =Kluyveromyces lactis strain NRRL Y-1140 chromosome D of strain NRRL Y- 1140 of Kluyveromyces lactis
MAARALGVPRHLRAPGVGLWAPHSARLETRTKESDMCASQRASKPVRRKEADWWDPPHTCRDPKDGELCLSGAKPEETLVEARSDTDVQIVRLTWNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 220476 - protein, 330 aa, Glycine max
  Coding DNA Sequence Number=SeqID_103698
  Gene Ontology: Mol. function=phosphotransferase activity, alcohol group as acceptor; Biological process=carbohydrate metabolic process
  Homolog annotation: Hit_ID=Q4UPQ7; Match level="QueryCoverage=64%, HitCoverage=56%, E-value=2e-73, Identity=66%"; Hit description =Anhydro-N-acetylmuramic acid kinase
  Pfam annotation: Domain name=UPF0075; Domain location=2-213; Score =182.2; E_value=1.2e-51; Accession=PF03702.5; Description =Uncharacterised protein family (UPF0075)
MLGTADEDRAVLNLGGIANLTLIPREGAVRGFDTGPANALMDAWCQRHTGRTFDADGAYAASGAVDEGLLAGWRSDPWFALPPPKSTGREQFHLAWAEVHMGEGQYAAADVQATLLELTVATVADALLAQQPQTRRLLVCGGGVRNRQLMKRLAARLPGVQVESSAVHGLDPEYVEAMGFAWLAQRTMDGLAGNLPSVTGAKGPRILGAIHLARAWARLYSIVARPLIEALPCGQGLQGGDGVGERVHFGITEAGADLQFTAEQALLQQSGAGLFVGPAAGDRDAFDAFQQQRVQVPQHNVGHARFPVRKAPPPRRVEAMIPQTGRAGNQ

SEQ ID NO: 220477 - protein, 58 aa, Glycine max
  Coding DNA Sequence Number=SeqID_103699
MKDKSQVWRSRLYGSASSKEALESMFFKDCVGLWGHTGILFNGALLGPLHGELLRSQF

SEQ ID NO: 220478 - protein, 126 aa, Glycine max
  Coding DNA Sequence Number=SeqID_103700
  Gene Ontology: Mol. function=transition metal ion binding; Cellular component=cytoplasm; Biological process=fucose metabolic process
MQSGSQCKSFDVEIGDRLEDMIRDLGHESFQPAHVPMYNTLQTHSKKPLYLGCKNSLTLLSTVLSLVNVKAIYGWSDKSFSSQLQVVNDMLPEENTLPKSYYQAKKILCPMGIEYQKIHACPNDCI

SEQ ID NO: 220479 - protein, 170 aa, Glycine max
  Coding DNA Sequence Number=SeqID_103701
MCKKEHKSFKGYAKRWRDLAAQVVPPMMEKEMITMIVDTLPVFYYEKVVGYTPSSFVGLVFVGKRIEVGQKRGKFDHPALTNKKPRANREDDKEEGTHVVTVVSTCPNFLATQQCHYSTNISLSHYPPLSHPQRSSLNQPQSLPFVHPMPNTTLNTNQKTNQGGSFPVKK

SEQ ID NO: 220480 - protein, 275 aa, Glycine max
  Coding DNA Sequence Number=SeqID_103702
  Gene Ontology: Mol. function=oxidoreductase activity; Biological process=electron transport
  Homolog annotation: Hit_ID=Q26B70; Match level="QueryCoverage=95%, HitCoverage=76%, E-value=3e-37, Identity=33%"; Hit description=FAD dependent oxidoreductase
  Pfam annotation: Domain name=DAO; Domain location=1-261; Score=-40.4; E_value=0.0027; Accession=PF01266.14; Description=FAD dependent oxidoreductase
VDSRGSHKSASQVSAGIINPVPIHRVFHDENEQKLWVKKSDHLELQNFLNKEFQSLEGINNPFSTGIVNQSARLDVSNFFNDFFNYFEDKGNLINEKFDYDSLDVSGSEYKGIRFKNIVFCEGMGVMKNPYFSDIAVIPNKGHHIRVKLSEKISTADTIKKKHFLFPIDNGLYFYGGTYDREQLHHEIDDSAVDQLLRGLSEVYPYDFKIQEVNFGFRPTVKDRRPIIGSHSEYSNMYVFNGLGARGILNGCYFSGSLYQLIEKGIPLPDEVALK

SEQ ID NO: 220481 - protein, 140 aa, Glycine max
  Coding DNA Sequence Number=SeqID_103703
  Homolog annotation: Hit_ID=Q1SKD7; Match level="QueryCoverage=83%, HitCoverage=30%, E-value=1e-07, Identity=28%"; Hit description =Ankyrin
MAPKKLSTKRSRRDATGEGWSFHRERRVQLREDEYTNFQEEIAHRHWTPLVTPMAKFDPEIVLEFYANAWPIEEGVQDMCSWVRGQWIPFDADALSQFLGDPLILEEGQQCEFSQRRSEVDDFDEEAITQLLCIPGQDFA

SEQ ID NO: 220482 - protein, 72 aa, Glycine max
  Coding DNA Sequence Number=SeqID_103704
  Gene Ontology: Mol. function=pectinesterase activity; Cellular component=cell wall; Biological process=cell wall modification
  Homolog annotation: Hit_ID=Q43062; Match level="QueryCoverage=69%, HitCoverage=9%, E-value=8e-15, Identity=74%"; Hit description =Pectinesterase PPE8B precursor
MFHFQNLLFIQETLKTLHKWNTSSDLRTWLSAALANQDTCIDGFDGTNGMVKGLVSTGIGQVMSLLQQLLTQ

SEQ ID NO: 220483 - protein, 148 aa, Glycine max
  Coding DNA Sequence Number=SeqID_103705
MAIYGDNKQRPLDQQPQQLKVGSGSYWQLEVGNESYWKLKVENEGWKLEGEVVVIIKKGENVNHEDFDIKKNLLEKEGDVNHASFDGVEKKSHVCHHQKGGECESLFQDSLKTKSCLKTKCFQDMQGSGNRLPGSVIDYQKTGLRNSY

SEQ ID NO: 220484 - protein, 102 aa, Glycine max
  Coding DNA Sequence Number=SeqID_103706
MAPTRHPLDPDKSNRALGKVIRPPITRAFIKKYCTPRQAQGDAHQAADAPPPPRQADPAGSQGPQSAGAGDAILPARALDRRLQVDWARDPREGPRALMSLR

SEQ ID NO: 220485 - protein, 63 aa, Glycine max
  Coding DNA Sequence Number=SeqID_103707
  Gene Ontology: Mol. function=DNA binding; Cellular component=nucleus; Biological process=regulation of transcription, DNA-dependent
  Homolog annotation: Hit_ID=Q0PJC1; Match level="QueryCoverage=64%, HitCoverage=26%, E-value=1e-13, Identity=75%"; Hit description=MYB transcription factor MYB122
MWLSIFLLLCFQGLARCGKSCRLRWLNYLRPNLKRGNYTKEEEETIIKLHKLEKSYEIVNPIF

SEQ ID NO: 220486 - protein, 69 aa, Glycine max
  Coding DNA Sequence Number=SeqID_103708
WLALLPLRSRADLKFHSDPGRESTQIGNQINITTMGEVTCFLFQILALQRLNNNYALDFVVDRYTCNIC

SEQ ID NO: 220487 - protein, 287 aa, Glycine max
  Coding DNA Sequence Number=SeqID_103709
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=98%, HitCoverage=41%, E-value=1e-143, Identity=90%"; Hit description=DNA -directed RNA polymerase beta' chain
  Pfam annotation: Domain name=RNA_pol_Rpb1_1; Domain location=11-208; Score=-60.9; E_value=3e-08; Accession=PF04997.3; Description=RNA polymerase Rpb1, domain 1
  Pfam annotation: Domain name=RNA_pol_Rpb1_2; Domain location=210-287; Score=-39.0; E_value=8.5e-05; Accession=PF00623.11; Description=RNA polymerase Rpb1, domain 2
  Pfam module annotation: Pfam domain module=RNA_pol_Rpb1_1::RNA_pol _Rpb1_2; Domain location=11-208::210-287
MEIQSWKHSIPLFFTTQGFDIFRNREISSGAGAIREQLADLDLRILMDSSLIEWKELGEEGSPDNENEWEDRKVGRRKNFLVRRIELAKHFLRTNIEPEWMVLCLLPVLPPELRPIIQIDGGKLMSSDINELYRRVIYRNNTLIDLLTTSRSTPGELVMCQEKLVQEAVDTLLDNGIRGQPMRDGHNKVYKSFSDIIEGKEGRFRETLLGKRVDYSGRSVIVVGPSLSLHRCGLPREIAIELFQTFLIRGLIRKHFASNIGIAKSKFGKRPIVWEYFKKLCRDIPYC

SEQ ID NO: 220488 - protein, 178 aa, Glycine max
  Coding DNA Sequence Number=SeqID_103710
  Subcellular localization annotation: CTP_CleavageSite=40; ConfidenceScore=5.18e-01
TTCNVSHNVVQLFNHNNNPATSFQSTPPSHETLSIDDSERCSKRHAINVSSIQRNLMSSYDNQKNITTASTSTFQASNAYSNITQLDIHRDEHQRPTDTTQHDQFVGYDSSDFNDDDVNMTQENIDIEYSLNDPTIDDFDDYDEQTFLSASSTYQNTGGTYIDIGDPVWECPHCKAMM

SEQ ID NO: 220489 - protein, 408 aa, Glycine max
  Coding DNA Sequence Number=SeqID_103711
  Gene Ontology: Mol. function=penicillin binding; Cellular component =integral to membrane; Biological process=peptidoglycan-based cell wall biogenesis
  Homolog annotation: Hit_ID=Q0QC60; Match level="QueryCoverage=97%, HitCoverage=87%, E-value=1e-148, Identity=62%"; Hit description =Putative peptidoglycan synthetase Fts1
  Pfam annotation: Domain name=Transpeptidase; Domain location=90-386; Score=340.4; E_value=3.1e-99; Accession=PF00905.13; Description =Penicillin binding protein transpeptidase domain
MSEAAAPLIGIVGADNNGLNGLEKGFDRVLQGEPGKEVYRQDGDGNIIAMIDYEPPKQPPTVQLSIDKFDQFTLYSKLRDGVLLNKADSGAAVLVKIDTGEILAMASYPSFNPNNYDNATPAQMRNTAINDSYEPGSTVKPLVVMEGLQRHLVRPDSVIDTTPYSVNGHLIRDVGHWPRLTMTGILQKSSDIGVSHIALAMPAEALVNTYQAFGLGKPTGLGLTGESVGYFPLHRQRWADIERATFSFGYGLRVTPLQIAREYATLGSYGVYRPLSITKVTPPVLGRQVADPQIVQTVVHMLESDVLPGGTGVKAAVPGYRLATKTGTAEKMGSSGKYDGGYVNYTAGIAPASHPEVALVVMINHPTAGDHFGGSVAAPVFGNIMGPVLKHMNVAPDAIYSKPASDKS

SEQ ID NO: 220490 - protein, 84 aa, Glycine max
  Coding DNA Sequence Number=SeqID_103712
MLSFDFRHVTELHGLANDGCQVSRSGQMRVASQQTDGPRTKLGYDIEEASWGSYMSCLGKNAAQSSLSLDQIEIWSAATQDTCP

SEQ ID NO: 220491 - protein, 140 aa, Glycine max
  Coding DNA Sequence Number=SeqID_103713
MVIPLKFKAPKFDKYVGTACPENHLKRCYRKMGAYAKDEKLLMHFFQESHTGAAVTWYTNLEPSRVHSWKGLMVAFIRQYPYNSDMAPDKMQLQSMCMRGHESFKEYAPKVEGPGNSSSTSNDKERDDHIDRGHITSVLL

SEQ ID NO: 220492 - protein, 135 aa, Glycine max
  Coding DNA Sequence Number=SeqID_103714
  Subcellular localization annotation: CTP_CleavageSite=10; ConfidenceScore=5.48e-01
MQINLNVIFRSNSGSKRSTSVPPTIADETRSGASTNPKRSRFGDTKLRAPHPIYSVCLSQSLTNLLSERGLENRDLTSTKGKLLMEKTTAFNGLPCLVCFLQAHPKLDEIEREKGSWIMPIFMILGALILAIFSS

SEQ ID NO: 220493 - protein, 161 aa, Glycine max
  Coding DNA Sequence Number=SeqID_103715
  Gene Ontology: Cellular component=outer membrane; Biological process =pathogenesis
  Homolog annotation: Hit_ID=Q0TBK4; Match level="QueryCoverage=99%, HitCoverage=9%, E-value=7e-35, Identity=47%"; Hit description =Putative haemagglutinin/invasin
  Pfam annotation: Domain name=HIM; Domain location=34-54; Score=22.7; E_value=0.0013; Accession=PF05662.4; Description=Haemagluttinin motif
  Pfam annotation: Domain name=YadA; Domain location=83-161; Score =114.5; E_value=3.1e-31; Accession=PF03895.6; Description=YadA-like C- terminal region
  Pfam module annotation: Pfam domain module=HIM::YadA; Domain location= 34-54::83-161
  Subcellular localization annotation: CTP_CleavageSite=40; ConfidenceScore=5.51e-01
LQASLQGTIRYDTTVNGATNYNSVTLGSTNSGPTTVRNVAAGNAGTDAVNVDQLKSGMAQTLDWSKAYTDERMGGFERDLRKTDNRASAGIASAMATAALPQPSEAGRSMASVAAGSYNGESGVAVGISGVSEGGRWIYKFSGSTNSRGEAGVAVGAGIQW

SEQ ID NO: 220494 - protein, 126 aa, Glycine max
  Coding DNA Sequence Number=SeqID_103716
  Gene Ontology: Mol. function=structural molecule activity; Cellular component=outer membrane
  Homolog annotation: Hit_ID=Q1LBA9; Match level="QueryCoverage=73%, HitCoverage=41%, E-value=2e-21, Identity=50%"; Hit description =SmpA/OmlA
  Pfam annotation: Domain name=SmpA_OmlA; Domain location=31-118; Score= 49.6; E_value=1e-11; Accession=PF04355.4; Description=SmpA  OmlA family
MAAVLGLVLGMGLLAACRSHAPAAEGPAETTAVQFPEASKASLKEGIYPDVADLRRFAPGMSKRQLYTLLGTPHFNEGMWGVREWNYLFNFRTAQGAEYFTCQFQVRFDSKGIAQGGYWKPESCAA

SEQ ID NO: 220495 - protein, 140 aa, Glycine max
  Coding DNA Sequence Number=SeqID_103717
DMIEVSSFYHRQWALEYLEFVNFRYDGTTYQIRLRQHRAKVYFAEGLNEFRKDLSIFESVIIKFLACNNKSMFDLYFVPSLECQTCGRPQLMSRQHIWTLEITQSMLGAPGPLRLPNCAMTHVNSCGQHMTILRRFGPPL

SEQ ID NO: 220496 - protein, 182 aa, Glycine max
  Coding DNA Sequence Number=SeqID_103718
  Gene Ontology: Mol. function=transporter activity; Cellular component= integral to membrane; Biological process=transport
  Homolog annotation: Hit_ID=UPI000034F4F5; Match level="QueryCoverage =96%, HitCoverage=44%, E-value=1e-41, Identity=41%"; Hit description =permease
MEVQKSEALLLGFQHYLLTLGITVLIPTILVPQMGGGDIIPIISIIQANRYKSYTDPYEVKRFTQTMRGIQGALITTSCFQMAVGFFGLWRNAVRFLRPLCVVPYVTFTGLSLYRLGFPMYLNRYMSTKKPIYDRYSVLFTISSAWLFALVLTSCTAYNHKPQSTQNSCRTDRAGLISAAPW

SEQ ID NO: 220497 - protein, 238 aa, Glycine max
  Coding DNA Sequence Number=SeqID_103719
MDYHSQYSSASESGWTHYLDQSSLPENYYQRRGGVVECDEGKGARMEEYSEEDLSMVSDASSGPPYYDNECYCQNWYPCLSSTTKDSQKKNKKVKEYGRSQQPSPLDDTASSPFFNCAKESHKKQDSFSGNGAVESALNFSQCVSATRIKRKTKFQKHFGFLDRSLAGKLTSEEQGISGTSQVFSFGYYSQTLLEMHKTELTNFTPHSREKGKSCFTTMKHAYIKSKGLVVMSSDPLD

SEQ ID NO: 220498 - protein, 571 aa, Glycine max
  Coding DNA Sequence Number=SeqID_103720
  Gene Ontology: Mol. function=protein binding; Cellular component =nucleus; Biological process=ribosome biogenesis and assembly
  Homolog annotation: Hit_ID=Q969X6-3; Match level="QueryCoverage=64%, HitCoverage=54%, E-value=4e-17, Identity=24%"; Hit description =Isoform 3 of Q969X6
  Pfam annotation: Domain name=WD40; Domain location=225-263; Score =29.4; E_value=1.3e-05; Accession=PF00400.22; Description=WD domain, G-beta repeat
  Pfam annotation: Domain name=WD40; Domain location=300-338; Score =22.5; E_value=0.0015; Accession=PF00400.22; Description=WD domain, G- beta repeat
  Pfam annotation: Domain name=WD40; Domain location=359-431; Score =7.4; E_value=5; Accession=PF00400.22; Description=WD domain, G-beta repeat
  Pfam annotation: Domain name=WD40; Domain location=5-42; Score=4.6; E_ value=11; Accession=PF00400.22; Description=WD domain, G-beta repeat
  Pfam annotation: Domain name=WD40; Domain location=51-92; Score=17.0; E_value=0.067; Accession=PF00400.22; Description=WD domain, G-beta repeat
  Pfam module annotation: Pfam domain module=WD40::WD40::WD40::WD40::WD4 0; Domain location=225-263::300-338::359-431::5-42::51-92
MAELFRLSSVEWSPSPVIALATSFDGSRVAAARKDGSLEIWLVSPGSIGWHCQLTIHGNPNGRVTSLIWCPGGPDGSRLFSSNIDGSVTKWDLFHLTQKVNPNRILKVRDTPMCSCLLENDADVAAIAVCDVIAECQNALTLRVTIWQMAVTFPKSDEINDKRKGGQMGNGFHDFDEHESIESDEDDDSGSPGPLGLLVGEHPRVAIALDNGCVRICDISDTDEFILVKSLPPVKGRVLSVTWSTDANYIYSGSSDGLIRCWNATLGNEIYRITAGLGGSGTLVSADSSGSVQFWDSQHGTLLQAHSLHKGHVHALAACPSHNRVFSAGSDGQVILYKLSSSQSTSSNDINSPSTMKRWIYVHYVRAHTHDIRALAVAVPISHEADIKPEKRIKRARRAENPISFRYHKWAHLGVPMLISAGDDTKLFAYPVKEFTMFSPHDICPAPQRTPIQLVHNSVFNQRKLLLVQSSQKIEVQLLQLKNVRTSGGFTKNVVVAQVNSKASQKIICSTISNSGALFAYSDHKKPSLFQLKRDEVGKIKWDVRKRELPQILPFAHSMIFTHDSSKLIVA

SEQ ID NO: 220499 - protein, 591 aa, Glycine max
  Coding DNA Sequence Number=SeqID_103721
  Gene Ontology: Mol. function=isomerase activity; Cellular component =intracellular; Biological process=protein folding
  Homolog annotation: Hit_ID=Q7F1F2; Match level="QueryCoverage=83%, HitCoverage=89%, E-value=1e-119, Identity=42%"; Hit description =Putative 70 kDa peptidylprolyl isomerase
  Pfam annotation: Domain name=FKBP_C; Domain location=142-219; Score =5.0; E_value=0.0014; Accession=PF00254.18; Description=FKBP-type peptidyl-prolyl cis-trans i
  Pfam annotation: Domain name=FKBP_C; Domain location=241-339; Score =93.1; E_value=8.3e-25; Accession=PF00254.18; Description=FKBP-type peptidyl-prolyl cis-trans i
  Pfam annotation: Domain name=FKBP_C; Domain location=26-120; Score =56.8; E_value=7.2e-14; Accession=PF00254.18; Description=FKBP-type peptidyl-prolyl cis-trans i
  Pfam annotation: Domain name=TPR_1; Domain location=359-392; Score =3.2; E_value=2.2; Accession=PF00515.18; Description=Tetratricopeptide repeat
  Pfam annotation: Domain name=TPR_1; Domain location=408-441; Score =5.7; E_value=1.1; Accession=PF00515.18; Description=Tetratricopeptide repeat
  Pfam annotation: Domain name=TPR_1; Domain location=442-475; Score =27.1; E_value=6.1e-05; Accession=PF00515.18; Description =Tetratricopeptide repeat
  Pfam annotation: Domain name=TPR_2; Domain location=359-392; Score =15.1; E_value=0.25; Accession=PF07719.7; Description=Tetratricopeptid e repeat
  Pfam annotation: Domain name=TPR_2; Domain location=408-441; Score =4.0; E_value=11; Accession=PF07719.7; Description=Tetratricopeptide repeat
  Pfam annotation: Domain name=TPR_2; Domain location=442-475; Score =24.1; E_value=0.00049; Accession=PF07719.7; Description =Tetratricopeptide repeat
  Pfam module annotation: Pfam domain module=FKBP_C::FKBP_C::FKBP _C::TPR_1::TPR_1::TPR_1::TPR_2::TPR_2::TPR_2; Domain location=142 -219::241-339::26-120::359-392::408-441::442-475::359-392::408 -441::442-475
SGFSAAAEGRRRERISGFKKKLFKPGQGLEFPNFDDVVTVRCVGIGTLLDGTTFDSTRERDQPRTFALGKDDIGAGLDRAIITMKKGEVALFTLPGDGGDGDVSLDSDDSSAVRFEVELVSWITVVDVCKDGGVVKKILEKGSGIERPGDLDEVLVKYRVVLGDGTVVVETLEGGVEFHMKDVINTVTPDAFGEKGREAGSGLCSIPPNSVLHVNIELVSFKPVINVTGDSKVIKKILKEGEGAFTANEGANVTVSFTAMLEDGTVFEKRGIGETLPLEFITDEEQVITGLDRAVATMKKGERAIISIHPDYAFGDVEVRRDIAIVPPGSNVVYDIEMMDFIKEKAPWELNSKEKIEVAGRMKEEGNVLFKVGNYQRAGKKYEKAADFVDEDGSFGFDEQKQAQTLKVSCWLNSAACSLKLNDFPGAIKLCSQVLDVEFCNVKAFYRRAQAYIETGDYLLADVDIKKALVVDPQNRDVKVIQKKLKQLQADSDKKDAKLYENMLARKTKDPSMAIKRLKVEKDQGENEEVARMEIDEVADSAVGGCRNGDVGVVHGSRQNGFAVETTCPDEKSDTPPSPVNPNDDTIGFNE

SEQ ID NO: 220500 - protein, 100 aa, Glycine max
  Coding DNA Sequence Number=SeqID_103722
  Homolog annotation: Hit_ID=Q9LXT8; Match level="QueryCoverage=52%, HitCoverage=4%, E-value=9e-12, Identity=64%"; Hit description=Pre -mRNA splicing factor ATP-dependent RNA helicase-like protein
MFDGDNSSLFLGDKAFFQKKEADFAKRLIDADIAVVGKQGEIDFEEAKFSQHLKKGEAVSDFAKLKIISEQRKYLPEELLQGCFLAKCKELMGIQSLELM

SEQ ID NO: 220501 - protein, 65 aa, Glycine max
  Coding DNA Sequence Number=SeqID_103723
MTLSLLIKEPESNTIVASISYLHVVLSPSSNVDIDVFSSASNTLKDSSFVQPSSRHCSCLLGMMT

SEQ ID NO: 220502 - protein, 126 aa, Glycine max
  Coding DNA Sequence Number=SeqID_103724
MKNLRLDYLKLAAGPKRKRRLYGTGDLAHTYKCGNDSFMQHTQGSSSRDEDASEINQLRVEVRQSKEEMCVFQPIILQFLPLEAKNIIHQQQQPHQQHDHVDDQQADDQHEHDDQQRHSPDDYFDY

SEQ ID NO: 220503 - protein, 86 aa, Glycine max
  Coding DNA Sequence Number=SeqID_103725
MAICRSHREPPVKLASSMVQAYVAGQLGCRSLQELFQRAFSERGVATAIGELPASCNSHWRFTQEKIAISNGDFVLINTAVRRYSF

SEQ ID NO: 220504 - protein, 151 aa, Glycine max
  Coding DNA Sequence Number=SeqID_103726
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=2e-15, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MDPWVLVPIALRGLYALTFRWLHVLAFRGLHVLALRGLHALAFRGLLALALRGLHALTFRGLHVLAFRELHILALRGLHALAFRGLHALAFRGLQVLTFRGLHILAFRGLRTLTFKGLHVLAYRGLLVLAFRGLHVLAFRGPHALAFRGLH

SEQ ID NO: 220505 - protein, 157 aa, Glycine max
  Coding DNA Sequence Number=SeqID_103727
  Gene Ontology: Mol. function=ATPase activity, coupled to transmembrane movement of substances; Cellular component=integral to membrane; Biological process=transport
  Homolog annotation: Hit_ID=Q1SEN8; Match level="QueryCoverage=64%, HitCoverage=7%, E-value=3e-32, Identity=60%"; Hit description=Cyclic peptide transporter
MVLEKGYIPSQVMSIFLALFYASIITFISRSLIPSPYYLNKPEIPELVLGTLVAIVTGAILPLMGFLISNMINTFLEPTDELRKDSKFWALMFIALGVAGTIFHPIRSYFFAVAGSKLIKRIGLMCYKKIIHMEVGWFDKAGIRSEIYKLRVIYVQN

SEQ ID NO: 220506 - protein, 185 aa, Glycine max
  Coding DNA Sequence Number=SeqID_103728
MQETHEVPRDRTIADFEPHLEYAIEGKHLVAYPCQTLWGALNTAHNHTYNPYISRDYPFADMVELCLVPDVIIPLKFKVSDFDKYKGTTCPKNHLKMYSRKMGAYSKNEKLLMHFFQESLTGAAVNWEHESFKEYAQRWRDLAAQVAPPMMEREMITMIVDTLLEFYYEKMVGYMPSSFADLVFA

SEQ ID NO: 220507 - protein, 276 aa, Glycine max
  Coding DNA Sequence Number=SeqID_103729
MTYQASSKGYCYFMQQQGTQFERNQSSAGYQWESYRQSDYHNKAEGILNLDDLLMKFKDIVESIQDAFRRTETQISKLVDDMTNAAARKEEERVEIEIHQENIHQVTSIYHQLTNEEEKPEVSSTPEYPYWATVGYVGGKDKGRLELSVEDQKISFDIFEATKHSDMGDACFDEEEEVEQEITLLASTMVLQSLLVKEHGYGRDCLPCDEELDDSKDSCVDQVVFEELEKLRPAKKPKAKLKTLPAHLKYVFLEEDETKPIIISNSLKKGEEDQLV

SEQ ID NO: 220508 - protein, 109 aa, Glycine max
  Coding DNA Sequence Number=SeqID_103730
MVRTRGLGRALGRVIGRALGREDHHDSDDVLQRQRPTASACRQWEVAPIAEDAHDMTEDVPATSAEATDGGEGFPIDDAEGFLGGTCDPSVLTEFGDHVALSIWNGEVF

SEQ ID NO: 220509 - protein, 417 aa, Glycine max
  Coding DNA Sequence Number=SeqID_103731
  Gene Ontology: Mol. function=RNA binding
  Homolog annotation: Hit_ID=Q6F393; Match level="QueryCoverage=27%, HitCoverage=38%, E-value=3e-18, Identity=47%"; Hit description =Expressed protein
  Pfam annotation: Domain name=Agenet; Domain location=3-67; Score =60.7; E_value=4.8e-15; Accession=PF05641.3; Description=Agenet domain
  Pfam annotation: Domain name=ENT; Domain location=353-413; Score =24.8; E_value=0.00031; Accession=PF03735.5; Description=ENT domain
  Pfam module annotation: Pfam domain module=Agenet::ENT; Domain location=3-67::353-413
MRFKKGNKVEVLSKVEVPCGSWLYAEIICGNGHHYTVKYDGYESDAGEAIVEQVSRKDIRPCPPALELTDNWNSGDVVEVFQNFSWKMATVLKVFGKNHILVRLLGSSLEFQVSKFDIRVRQSWQDDKWIIVGKQLPSSVGCRRGYCYTSSVELGSSSHENRKRSSAQLQKMYTKTKLSGSAYYRPEKKKLSILESKLVSFKTLKRGSNSQVDAYAKPPPKFRARENEGRCHRARLRNPPTPLKQVQGVSFPREVIAEECIPASVNNRKTGISNMVDMERRKQTGENLESNHAYSVTCSVGSCSITSRNSYKSQFPVYAGPFDDVDSSFSDAESVCQRSDEEGNCSPPTQEELAAEIHRLELHAYHCTIEALHASGPLSWEQEALMTNLRLSLHISNDEHLMELRNLISSENSIPFR

SEQ ID NO: 220510 - protein, 95 aa, Glycine max
  Coding DNA Sequence Number=SeqID_103732
MHKYWNSIVQSSHGSYKTLSMHSSAKQISEAHRWPEMEECENSTNLWMCWLIKGHTRKAIPCLEQERICRNLEATPICLLLSPGKCRGSITSKCK

SEQ ID NO: 220511 - protein, 32 aa, Glycine max
  Coding DNA Sequence Number=SeqID_103733
MYNFAMFDDIVNGFVGIDYLIDVIGEIVEIGQ

SEQ ID NO: 220512 - protein, 110 aa, Glycine max
  Coding DNA Sequence Number=SeqID_103734
MVLEKGCHRLISTIELDGIIVGRRRWGILVHSALYGRSKKHSIFDTNVHSRITNCANSCFLRDLSLSKIHDPGADPYVHERRGKSMVIFLSRDSLLNLTSLNEGLRVLSD

SEQ ID NO: 220513 - protein, 94 aa, Glycine max
  Coding DNA Sequence Number=SeqID_103735
MFSSYAWYWTEKEGTRYFSSHEADREIDVGRGIPLSPTRIYHHHYHKLQPSSLATVTTFVSMAVIIVTVFITTTSDATIVMVTKVIMVMVIMIG

SEQ ID NO: 220514 - protein, 66 aa, Glycine max
  Coding DNA Sequence Number=SeqID_103736
MEHRRNFCTYFSRNGGHSGCGWVARWWPAEMRGETALLARWLETETGGRSGTGCGGGRSEVAGTSG

SEQ ID NO: 220515 - protein, 659 aa, Glycine max
  Coding DNA Sequence Number=SeqID_103737
  Homolog annotation: Hit_ID=Q1RT73; Match level="QueryCoverage=99%, HitCoverage=99%, E-value=0.0, Identity=81%"; Hit description=IMP dehydrogenase/GMP reductase
MDDGMQLQISLDKLPIKRLDSIEENGIERFPPDVDYDEKRLSLIRRIDFAWAVEKDEEKKKKQKSSKETSTPWQWQGMVENLQLAHQELSVIIDLINTVEANDAVTVASMTRPKLLPNEALSDLAVSAATKLQCYRHVGKYFKQSAKAFEQQVAREARFYGALIRLQQNWKVKRQRQAAIVPGNEGFTFDLFDNSYDQAAIIRSLSMSTVRVNHDAAGNLAINVSPDLCHSLQFGFVGAQSDDTRRKSNQNKSHFSGELNLGKTGEESLSDEECVKKTHSLLREVHEAIFNEQVFDLVNREAFNTVAGVSVTGIRENYLQLSLGQETSVYLTLVSNSQDHSTVEGELTDNAENAILPLESSDGMKREAKQNTSNKGQFSNSICYEIYIQQIFHEYIFGKGGDKPSSSGNRLSGIQAKDGSSLLGHFFKSLAHRIFSTKVLAELENVVCKVPYIQLISNPTWHSRASSWTLYMEVPQSILRGSQTKTSDYYEKNAVKRQFWTKVVVNDDCINVKAEGSPNVAGLFKGKIEETHSINKYNCNLADLPVIILQQVASQIINWLYQEAMMVGIKANRDFLCLSLELEQGETLGLVASVDPEDSEGCISWWLVMEDSFAEEQKLHMSITDGASEYRKFLGHLSLDLLYATLIDLVSLCSGGGSQ

SEQ ID NO: 220516 - protein, 368 aa, Glycine max
  Coding DNA Sequence Number=SeqID_103738
  Gene Ontology: Mol. function=protein serine/threonine kinase activity; Cellular component=cell surface; Biological process =protein amino acid phosphorylation
  Homolog annotation: Hit_ID=Q1RVK5; Match level="QueryCoverage=98%, HitCoverage=93%, E-value=1e-130, Identity=61%"; Hit description =Protein kinase
  Pfam annotation: Domain name=APH; Domain location=72-277; Score= -16.1; E_value=0.081; Accession=PF01636.13; Description =Phosphotransferase enzyme family
  Pfam annotation: Domain name=Pkinase; Domain location=105-335; Score=- 24.1; E_value=4e-07; Accession=PF00069.15; Description=Protein kinase domain
  Pfam annotation: Domain name=Pkinase_Tyr; Domain location=105-333; Score=-98.6; E_value=2e-06; Accession=PF07714.7; Description=Protein tyrosine kinase
  Pfam module annotation: Pfam domain module=APH::Pkinase::Pkinase_Tyr; Domain location=72-277::105-335::105-333
MEDRKANIISVISVIALIILVISARVLLKLSRAFFLICGASIAAILAVFSCVFIRHRYNRRRKLLESQLRTEGRELRIEHIFLRKVAGVPTKYRFKELEEATDGFQALLGKGSSASVFKGILNDVTSVAVKRIDGEERGEKEFRSEVASIASVHHVNLYIPNGSLDCWIFPLRENHARRGGCLPWSLRYKVAIDVARELSYLRHDCRRRVLHLDVKPENILLDENYKALVSDFDLSTLAGKDVSQLWDGSIGDSWREEECVEGGGSEGQDQEKVGLFLPKIVNVKVREGKFMEIVERGGVEESEVTRLVYIALWCIQEKPRLRPSMAQVVDMPEGRVRVNEPPGSRMILVDLLAVDEDPADHKNLQGC

SEQ ID NO: 220517 - protein, 747 aa, Glycine max
  Coding DNA Sequence Number=SeqID_103739
  Gene Ontology: Mol. function=transferase activity
  Homolog annotation: Hit_ID=Q1RVK0; Match level="QueryCoverage=99%, HitCoverage=100%, E-value=0.0, Identity=68%"; Hit description =Protein prenyltransferase
  Subcellular localization annotation: CTP_CleavageSite=58; ConfidenceScore=5.74e-01
MKIVIAKNPINLVNSQGSLVLFRAPSLARNFLHASSSKWPRSTNPLMFSFSSLRVSVSCASSSSTVYGGWDDLGSSDAPGESNALRNFLVSIGIDDRKNVFVFLLGLVCALAISRVKVSSIVVLPASALVFAVGFTVGFFRNGTFGEVRASGSKRREKEENSNLNWKLSWEKLRSLVEFFDELDLVVDNLKNDVQSAIRDNKIRVDDFYGYVEVTDKIKISAKNARDVVRALIDNEENSGGVLVENHKSGRRKKQVGESGYQMLQSFSSLFGENLFSSNPTKVRENVKQEAVDRTLNQTRGNGNVPLVEDRALNLVDDHKGNRKLDLDPSQDSSTNSVLDMNKNGSIRTTPEGENVGLGDIRRSTNKFFDDKEYSYRNKGLRFTNNHSFSLKMDSSSVTDMWESQDSLIDSESFKVRTKRMESESSFLREQLLDGGHETFRSSHDKREGGSDRSQYNNDTVNYDDHRHLADDLSAHENEFNTPSSTKISDDMMFDRYLAEATDLLKQAKEFIKGRQGEEQAEIMLYRSANLLSKAVELKPMSLLAVGQLGNTYLLHGELKLKISRELRTLLSGSIQPSSVKHSRILKGLRNKINSKEEVAPFLIDVCEECEELLVEAGRKYRLALSIDSNDVRALYNWGLALSFRGQLIADIGPGAAFEAERVFLAAIDKFDAMLLKGNVYAPDALFRWGVALQQRSRLRPGSSKEKLKLLQQAKRLYEDALDMNSNNGQVKDALSSCLAELNYRQF

SEQ ID NO: 220518 - protein, 217 aa, Glycine max
  Coding DNA Sequence Number=SeqID_103740
  Homolog annotation: Hit_ID=Q1SZM6; Match level="QueryCoverage=39%, HitCoverage=39%, E-value=1e-08, Identity=30%"; Hit description =Ribonuclease H
MESSSSSSHQEGFMGYCGFNTNMIVELLGIFNGLNIAKAASFCTVACETNSQIALQMISQGNACSDWLAKTGANPQDNLRLISSCPSPMHYLLIANAMVLNSATIAAEWLLLAIPPKPEWPLSAMESLVAGWIEVAMVIKITLEQVRIELRVCIEFASLLFPHSIPQRWDCESEGKVRMRGARSHMRGGRGDGEVCGCNKPTTVKGVSATVSAMARD

SEQ ID NO: 220519 - protein, 128 aa, Glycine max
  Coding DNA Sequence Number=SeqID_103741
MSIILSSAFLVKIAAALCSCLLPESLQVTSVKQLPEYHECSEDKFVESLSPATPRESTEIDEEQEKHLLSPSDGTEDAHFVKEDASEISGVFEGSESQCPSIPYLEERGDNRDMRNSRGHFFLLSVIF

SEQ ID NO: 220520 - protein, 90 aa, Glycine max
  Coding DNA Sequence Number=SeqID_103742
  Gene Ontology: Mol. function=protein dimerization activity
  Homolog annotation: Hit_ID=Q1SYN6; Match level="QueryCoverage=97%, HitCoverage=12%, E-value=7e-19, Identity=49%"; Hit description=Zinc finger, BED-type predicted
MEGLKFAKNALTKFRESIKYVKGSEGKMNAFKACVVKVGSVDTKVGLCLGVPTRWNSTFVMLQSVLAYRCVFNTLAIEDANYVTCPTAEE

SEQ ID NO: 220521 - protein, 200 aa, Glycine max
  Coding DNA Sequence Number=SeqID_103743
  Gene Ontology: Mol. function=protein binding; Cellular component =integral to membrane; Biological process=defense response to fungus
  Homolog annotation: Hit_ID=Q1SWI6; Match level="QueryCoverage=80%, HitCoverage=76%, E-value=5e-41, Identity=52%"; Hit description =Leucine-rich repeat, plant specific
  Pfam annotation: Domain name=LRRNT_2; Domain location=16-56; Score =49.5; E_value=1.2e-11; Accession=PF08263.3; Description=Leucine rich repeat N-terminal domain
  Pfam annotation: Domain name=LRR_1; Domain location=126-148; Score =11.6; E_value=2; Accession=PF00560.23; Description=Leucine Rich Repeat
  Pfam annotation: Domain name=LRR_1; Domain location=174-199; Score =11.6; E_value=1.9; Accession=PF00560.23; Description=Leucine Rich Repeat
  Pfam annotation: Domain name=LRR_1; Domain location=99-123; Score =5.3; E_value=29; Accession=PF00560.23; Description=Leucine Rich Repeat
  Pfam module annotation: Pfam domain module=LRRNT_2::LRR_1::LRR_1::LRR_ 1; Domain location=16-56::126-148::174-199::99-123
MKLWLLSLPCRESVCIPSERETLLKFKNNLIDPSNRLWSWNHNNTNCCHWYGVLCHNVTSHLLQLHLNTTFSAAFYDRGAYRRFQFGGEISPCLADLKHLNYLDLSANYLLGAGMSIPSFLGTITSLTHLDLSLTGFYGKIPPQIGNLSNLVYLDLSYVFANGTVPSQIGNLSKLRYLDLSDNDLLGEGMAIPSFLCAMC

SEQ ID NO: 220522 - protein, 90 aa, Glycine max
  Coding DNA Sequence Number=SeqID_103744
GKALQVGVNGIPGHRKPQFLPPFPLDHCSHQRNSVYEIHEGTLISEVYGIKMVIDQSLFYDLTKLPSEGVPFEGALIDDWKFDCSVHDVR

SEQ ID NO: 220523 - protein, 321 aa, Glycine max
  Coding DNA Sequence Number=SeqID_103745
  Gene Ontology: Mol. function=nucleoside-triphosphatase activity; Cellular component=intracellular; Biological process=regulation of transcription, DNA-dependent
  Homolog annotation: Hit_ID=Q1RZJ4; Match level="QueryCoverage=99%, HitCoverage=10%, E-value=3e-82, Identity=40%"; Hit description =Aldo/keto reductase; Sigma-54 factor, interaction region
MNFTQPKKYASKSSKLIDKQVSPTELASQSKVDWQTSGTENVTAESNLSNSHHDFDPTLLGGLPSSNMFEMDVKIFDSSNSGGEMDDDNAHEHGYVSEFEKETTQALGPALVEQVDRNIDCDKSDKECLTGEDAKLQFKKKKSEMNSLSLHEKDLGKGQDPCDVPNYVKDNAITLWKRFELSTTKLSLKLDEQLHHVMEPTVASKLQGDYKIGKRINMKKSCCGDVAIEALVIVCPVVSQLEMGSLVVASFGTKGNKKLLHDFDKPFTGKVSVKEKMISNLTFKEENTIVDEPVVNLLKYLTNKLDVALAKARLPSRHNPL

SEQ ID NO: 220524 - protein, 481 aa, Glycine max
  Coding DNA Sequence Number=SeqID_103746
  Gene Ontology: Mol. function=protein serine/threonine kinase activity; Cellular component=cytoplasm; Biological process=protein amino acid phosphorylation
  Homolog annotation: Hit_ID=Q1RWL0; Match level="QueryCoverage=96%, HitCoverage=97%, E-value=0.0, Identity=74%"; Hit description=Protein kinase
  Pfam annotation: Domain name=Pkinase; Domain location=90-430; Score =216.2; E_value=7.4e-62; Accession=PF00069.15; Description=Protein kinase domain
  Pfam annotation: Domain name=Pkinase_Tyr; Domain location=90-430; Score=-32.2; E_value=1.7e-10; Accession=PF07714.7; Description =Protein tyrosine kinase
  Pfam module annotation: Pfam domain module=Pkinase::Pkinase_Tyr; Domain location=90-430::90-430
  Subcellular localization annotation: CTP_CleavageSite=53; ConfidenceScore=5.49e-01
MNTPIIVTTITTTRDEPDYDSSSSSITVPESSRSWMTNLSFGSRRRRSSVSVSSSTMESPHAKPHKANQAAWEAMRRLWRDKGQVGLDHFRLLRRLGSGDLGNVYLCQIRNPVVGLPQCFYAMKVVDREALAIRKKLQRAEMEKEILAMLDHPFLPTLYTEFDASHYSCLVMEFCPGGDLYAARQRQPGKRFSIASAKFYAAETLLALEYLHMMGIVYRDLKPENVLVREDGHIMLTDFDLSLKCDVIPKLLRSKTRLERSIKSTKRSVPACTAPMQPVLSCFLSSSKKKKATVTTVIRENVEVEENDPELVAEPIDAKSKSFVGTHEYLAPEVILGQGHGSAVDWWTFGVFLYEMLYGRTPFKGENNEKTLVNILKQPLSFPRIAVSSSKEFEEMVKVQDLISKLLVKNPSKRIGSCMGSVEIKRHEFFKGVNWALIRSVRPPEVPSEINKIRSRVLLPKLSKTDSDQPYQLRSHHFEYF

SEQ ID NO: 220525 - protein, 140 aa, Glycine max
  Coding DNA Sequence Number=SeqID_103747
  Gene Ontology: Cellular component=integral to membrane; Biological process=nodulation
  Homolog annotation: Hit_ID=Q1RWK7; Match level="QueryCoverage=75%, HitCoverage=97%, E-value=2e-23, Identity=59%"; Hit description=Early nodulin 93 ENOD93 protein
  Pfam annotation: Domain name=ENOD93; Domain location=22-103; Score =102.4; E_value=1.4e-27; Accession=PF03386.5; Description=Early nodulin 93 ENOD93 protein
MTKRNVAANSSFETTSLASLHQKLAMAKRCSRDNAYLSQELRQQLLLVLPLPFQLQLASVRMLPWARANLNHTAQALIISTVTGAAYFIEADKTVLATARRTPSTNPPMHEFQMDNLDFGFGFTTLGYLSINQSLNLSYM

SEQ ID NO: 220526 - protein, 52 aa, Glycine max
  Coding DNA Sequence Number=SeqID_103748
NYEVATDMLMQHPRPFNAGKLIWTASARVEISSNRQDNACLSNLTFRFTLAS

SEQ ID NO: 220527 - protein, 96 aa, Glycine max
  Coding DNA Sequence Number=SeqID_103749
  Gene Ontology: Mol. function=hydrolase activity; Biological process =nucleotide metabolic process
  Homolog annotation: Hit_ID=Q7XDP2; Match level="QueryCoverage=82%, HitCoverage=38%, E-value=5e-15, Identity=52%"; Hit description =Inosine triphosphate pyrophosphatase, putative, expressed
MGVLKKATSEIKDLVNVYSRCRSVKNVLAVAPETFTIKWFLQKLGHEGLNNLLMAYDDKSAYALCVFSFAAGSNSEPITFSGKTPVSQSPYTICRT

SEQ ID NO: 220528 - protein, 116 aa, Glycine max
  Coding DNA Sequence Number=SeqID_103750
  Gene Ontology: Mol. function=zinc ion binding; Cellular component =intracellular
  Homolog annotation: Hit_ID=Q1RWK5; Match level="QueryCoverage=91%, HitCoverage=79%, E-value=8e-48, Identity=74%"; Hit description=Zinc finger, RanBP2-type
  Pfam annotation: Domain name=zf-RanBP; Domain location=4-33; Score =13.9; E_value=0.02; Accession=PF00641.9; Description=Zn-finger in Ran binding protein and others
  Pfam annotation: Domain name=zf-RanBP; Domain location=48-76; Score =20.6; E_value=0.0028; Accession=PF00641.9; Description=Zn-finger in Ran binding protein and others
  Pfam module annotation: Pfam domain module=zf-RanBP::zf-RanBP; Domain location=4-33::48-76
MSWYGGDWMCGVCEHINFKKRETCQSCRYPKYGGTDPSTYRYNKTEALAGDWFCNCGAHNYASRSSCYRCGAIKDYYCSGYGTKSGEYGSYTFPLGWKNGDWLCPRMRRNFRRPGI

SEQ ID NO: 220529 - protein, 736 aa, Glycine max
  Coding DNA Sequence Number=SeqID_103751
  Gene Ontology: Mol. function=binding; Cellular component =intracellular; Biological process=metabolic process
  Homolog annotation: Hit_ID=Q1RWK6; Match level="QueryCoverage=99%, HitCoverage=99%, E-value=0.0, Identity=76%"; Hit description =Pancreatic ribonuclease; Tetratricopeptide-like helical
  Pfam annotation: Domain name=PPR; Domain location=163-197; Score=2.7; E_value=3.6; Accession=PF01535.11; Description=PPR repeat
  Pfam annotation: Domain name=PPR; Domain location=225-259; Score =47.8; E_value=3.6e-11; Accession=PF01535.11; Description=PPR repeat
  Pfam annotation: Domain name=PPR; Domain location=326-360; Score =43.7; E_value=6.4e-10; Accession=PF01535.11; Description=PPR repeat
  Pfam annotation: Domain name=PPR; Domain location=431-465; Score =49.7; E_value=9.6e-12; Accession=PF01535.11; Description=PPR repeat
  Pfam annotation: Domain name=PPR; Domain location=466-500; Score=2.1; E_value=4.2; Accession=PF01535.11; Description=PPR repeat
  Pfam annotation: Domain name=PPR; Domain location=502-536; Score =10.8; E_value=0.39; Accession=PF01535.11; Description=PPR repeat
  Pfam annotation: Domain name=PPR; Domain location=93-127; Score=14.8; E_value=0.13; Accession=PF01535.11; Description=PPR repeat
  Pfam module annotation: Pfam domain module=PPR::PPR::PPR::PPR::PPR::PP R::PPR; Domain location=163-197::225-259::326-360::431-465::466 -500::502-536::93-127
MVSCLSPPFVHFLPSSDPPYKLLENHPHLNLLAKCPDIPSLKQIHSLIIKSGLHNTLFAQSKLIEFCALSPSRDLSYALSLFHSIHHQPPNIFIWNTLIRAHSLTPTPTSSLHLFSQMLHSGLYPNSHTFPSLFKSCAKSKATHEAKQLHAHALKLALHLHPHVHTSLIHMYSQVGELRHARLVFDKSTLRDAVSFTALITGYVSEGHVDDARRLFDEIPAKDVVSWNAMIAGYVQSGRFEEALACFTRMQEADVSPNQSTMVSVLSACGHLRSLELGKWIGSWVRDRGFGKNLQLVNALVDMYSKCGEIGTARKLFDGMEDKDVILWNTMIGGYCHLSLYEEALVLFEVMLRENVTPNDVTFLAVLPACASLGALDLGKWVHAYIDKNLKGTGNVNNVSLWTSIIVMYAKCGCVEVAEQVFRSMGSRSLASWNAMISGLAMNGHAERALGLFEEMINEGFQPDDITFVGVLSACTQAGFVELGHRYFSSMNKDYGISPKLQHYGCMIDLLARSGKFDEAKVLMGNMEMEPDGAIWGSLLNACRIHGQVEFGEYVAERLFELEPENSGAYVLLSNIYAGAGRWDDVAKIRTKLNDKGMKKVPGCTSIEIDGVVHEFLVGDKFHPQSENIFRMLDEVDRLLEETGFVPDTSEVLYDMDEEWKEGALTQHSEKLAIAFGLISTKPGSTIRIVKNLRVCRNCHSATKLISKIFNREIIARDRNRFHHFKDGFCSCNDRW

SEQ ID NO: 220530 - protein, 118 aa, Glycine max
  Coding DNA Sequence Number=SeqID_103752
GKGGKQECVCSGSHGVGSKSHDSDNGFHSWNQKFSMKLGQHTRCVTIEVKCKSGVGVVRDVGVVRIAVSNLLGGLGLGFATDQDGGVVADATVTRERLVGFIRGVKNDCCSSSLSIRV

SEQ ID NO: 220531 - protein, 327 aa, Glycine max
  Coding DNA Sequence Number=SeqID_103753
  Gene Ontology: Mol. function=racemase and epimerase activity, acting on amino acids and derivatives; Biological process=metabolic process
  Homolog annotation: Hit_ID=Q1RT82; Match level="QueryCoverage=96%, HitCoverage=96%, E-value=1e-125, Identity=72%"; Hit description =Asp/Glu racemase
  Subcellular localization annotation: CTP_CleavageSite=54; ConfidenceScore=5.58e-01
MSMQTLNHPPFLTGDAFRKRTQTRCRGRANSTTALQLSSDESGNFAEPGTSLMRCKNSGSLLSQPNTVGVIGGVSLLSTLIFLEKLACWGSRNGKECPPFVVSSDPELSKVLSLRGPLPSARSRFDRIKLNQDLVIENLRSKRNFLQQSGARGLAMPCHLSHAWHSEISEDSSLPFLHDGDCVAMELKNAMLKPIHAAVTVGIGLLTTDSNFVASYYQEKLQSQGFEVVFLDKATEEHVLVPAMEALYRKDVEGARNLLRIAIHVLLVRAVNVVLLASDDLLGVLPHNDPLLRKCIDPMDALARSTIHWAETTAENFSFATAPFFDR

SEQ ID NO: 220532 - protein, 149 aa, Glycine max
  Coding DNA Sequence Number=SeqID_103754
  Gene Ontology: Mol. function=isopentenyl-diphosphate delta-isomerase activity; Cellular component=chloroplast; Biological process =isoprenoid biosynthetic process
  Homolog annotation: Hit_ID=Q1RT83; Match level="QueryCoverage=99%, HitCoverage=37%, E-value=2e-39, Identity=57%"; Hit description =Isopentenyl-diphosphate delta-isomerase, type 1
  Subcellular localization annotation: CTP_CleavageSite=63; ConfidenceScore=5.57e-01
MFLSLHSHAFSGNPLLSKFPLSGHPLSPSSALEALKAQIGLNNTHSSPSPSFKVLPFRNGRPLASSAAGSGDSPPIWHLGWLGLDEIRGIFENSGAQLSVDSLVYLSSSAEDDAVYWAIDVSDKVPELGSNKERLCFVDLRTLMVATDW

SEQ ID NO: 220533 - protein, 144 aa, Glycine max
  Coding DNA Sequence Number=SeqID_103755
  Gene Ontology: Mol. function=cytochrome-b5 reductase activity; Cellular component=mitochondrial intermembrane space; Biological process=electron transport
  Homolog annotation: Hit_ID=Q1RT78; Match level="QueryCoverage=98%, HitCoverage=47%, E-value=4e-53, Identity=76%"; Hit description =Flavoprotein pyridine nucleotide cytochrome reductase
  Pfam annotation: Domain name=FAD_binding_6; Domain location=15-78; Score=-17.5; E_value=0.03; Accession=PF00970.14; Description =Oxidoreductase FAD-binding domain
  Pfam annotation: Domain name=NAD_binding_1; Domain location=87-144; Score=8.9; E_value=0.0003; Accession=PF00175.11; Description =Oxidoreductase NAD-binding domain
  Pfam module annotation: Pfam domain module=FAD_binding_6::NAD_binding_ 1; Domain location=15-78::87-144
MPGFHLIPLRNWVWILPLASLQGLHWDKMLKENQNLLYARYLHPNLQVYPEGKMSQHFASLKPGDVVEVKGPIEKLRYTPNMKKHIGMIAGGTGITPMLQVIEAILKNPDDKTQISLLYANVSPDDILLKQKLDILATSHPNLK

SEQ ID NO: 220534 - protein, 248 aa, Glycine max
  Coding DNA Sequence Number=SeqID_103756
  Gene Ontology: Mol. function=isopentenyl-diphosphate delta-isomerase activity; Cellular component=chloroplast; Biological process =isoprenoid biosynthetic process
  Homolog annotation: Hit_ID=Q1RT83; Match level="QueryCoverage=88%, HitCoverage=59%, E-value=8e-96, Identity=74%"; Hit description =Isopentenyl-diphosphate delta-isomerase, type 1
  Pfam annotation: Domain name=NUDIX; Domain location=51-174; Score =57.8; E_value=3.6e-14; Accession=PF00293.18; Description=NUDIX domain
  Pfam annotation: Domain name=zf-NADH-PPase; Domain location=21-54; Score=44.7; E_value=3.1e-10; Accession=PF09297.1; Description=NADH pyrophosphatase zinc ribbon domai
  Pfam module annotation: Pfam domain module=NUDIX::zf-NADH-PPase; Domain location=51-174::21-54
MQLPNYWVWPGQAKALLEWHNISRFCGHCGEKTVPMEAGRRKKCSNDSCKKRIYPRVEPKERVLLAKRPMHIARLYTCLSGFTEPGESLEEAVRRETWEETGIEVGEVVYHSSQPWPVAPNSIPCQLMVGFFAYAKSLEITVDKTELEDAQWYSREDVRKALTFAKYKQAQRTAAEKVEQMCKGLEKNQSLASDLNVESADEQHAPIVFPGPFAIAHHLISSWVFSDQNVVNGVECNSKQPIRSMTNS

SEQ ID NO: 220535 - protein, 172 aa, Glycine max
  Coding DNA Sequence Number=SeqID_103757
  Gene Ontology: Mol. function=oxidoreductase activity; Cellular component=chloroplast
  Homolog annotation: Hit_ID=Q1SMY3; Match level="QueryCoverage=61%, HitCoverage=44%, E-value=7e-23, Identity=49%"; Hit description =Alcohol dehydrogenase superfamily, zinc-containing
  Pfam annotation: Domain name=ADH_N; Domain location=10-84; Score =11.6; E_value=4.9e-05; Accession=PF08240.2; Description=Alcohol dehydrogenase GroES-like domain
MQPIPTFSFKTRVVAAALNPADSKRALGVLKDTDSPLPSVPGCDVAGVVVKVGSEVSKFKVGDEVYGDINEYFIEAASLPLAIITAYQGFEKVEFSAGKSILVLGGTGGVESLVIQINSYKLSSQVSTLNEFEINYNIIHFIKDNRRYKCGNTIMILDASMKPRGPCNIMSY

SEQ ID NO: 220536 - protein, 88 aa, Glycine max
  Coding DNA Sequence Number=SeqID_103758
  Gene Ontology: Mol. function=cytochrome-b5 reductase activity; Cellular component=mitochondrial intermembrane space; Biological process=electron transport
  Homolog annotation: Hit_ID=Q1RT78; Match level="QueryCoverage=85%, HitCoverage=23%, E-value=6e-35, Identity=86%"; Hit description =Flavoprotein pyridine nucleotide cytochrome reductase
IFYTVDNPTKNWRGGAGYISKDIVVKGLPGPSDDTLILVCGPPGMMKAISGEKAKDWTQGEVSGVLKEAGYTEQMLSSMEVNNGHLWG

SEQ ID NO: 220537 - protein, 513 aa, Glycine max
  Coding DNA Sequence Number=SeqID_103759
  Gene Ontology: Mol. function=nucleic acid binding
  Homolog annotation: Hit_ID=Q1RT77; Match level="QueryCoverage=95%, HitCoverage=100%, E-value=2e-88, Identity=56%"; Hit description=Zinc finger, CCCH-type
  Pfam annotation: Domain name=zf-CCCH; Domain location=38-62; Score =3.5; E_value=0.46; Accession=PF00642.15; Description=Zinc finger C -x8-C-x5-C-x3-H type (and similar)
  Pfam annotation: Domain name=zf-CCCH; Domain location=7-34; Score =13.1; E_value=0.024; Accession=PF00642.15; Description=Zinc finger C- x8-C-x5-C-x3-H type (and similar)
  Pfam annotation: Domain name=zf-CCCH; Domain location=84-109; Score =28.9; E_value=1.8e-05; Accession=PF00642.15; Description=Zinc finger C-x8-C-x5-C-x3-H type (and similar)
  Pfam module annotation: Pfam domain module=zf-CCCH::zf-CCCH::zf-CCCH; Domain location=38-62::7-34::84-109
MDQDSLKRYTDCVYFLASPLTCKKGAECEYRHNEIARLNPRDCWYWLSGQCLNPTCAFRHPPLDGHTGASVPSEPTQTSLPANKTMVPCYFFFNGSCNKGDRCSFLHGPDDSIFTVKPVKNDNGSTDALNLENKTSSGNRIGLVSTPTDQSVAAPKNLSDLKLQPKEDHQLEIPKDVKQQGYYLELSASEYKEAAVSRSDSSIPDDGFVHNVPHLCTEQSSEEQVNSHIEPEERWESSPHSPGFDVLVHDEVDNLGYEEDSEYVTVGDRDEQELDDQYFGYEFKDSVEYDTICPEADILYEQETYDGYRFLDRGLIHANGRTIHAYPRDVFLDPRLSRKRIRMSAEMAAYDKNLDLRDHLRRRREIKGPPVSNFLRRESSPLMIRKQERHQRHGIEQRPIRRLTSQLGYSAIDSIGEVGTLSVANKHRKPAFKQRGFIHEFSAFSGPKTLAEIKEEKMKKAEGSLHWKSTSTDFQDPKPLSEILKDKRTMDQTKFADDGAFLASFTVLGDCHW

SEQ ID NO: 220538 - protein, 120 aa, Glycine max
  Coding DNA Sequence Number=SeqID_103760
DQGVLTNPKRIKIISEWPTPPSVEGRSLEFQGTSGFEVKSFSKGKGMMQSYLPRALDRRHKEDWARDAREGLRWRLLSTLLLLHSAAIKIQEAKDFIDEEDPRPTSSNGATSCGIKSVFI

SEQ ID NO: 220539 - protein, 143 aa, Glycine max
  Coding DNA Sequence Number=SeqID_103761
  Pfam annotation: Domain name=zf-CCHC; Domain location=81-98; Score =22.8; E_value=0.00017; Accession=PF00098.13; Description=Zinc knuckle
MQEKVLGAPNNVEAYLDWEIRVKQQLKRKSTSKSYGSHSYPKKYQGQGILGATPSKPKDDKGKTIEKQPPKASMQEKTSSIKCFKCLGRGHITSQCPTKKTLIMKGHDLYSSQDKATTSPSSSESEKAKGEESNEKIYPQEEE

SEQ ID NO: 220540 - protein, 118 aa, Glycine max
  Coding DNA Sequence Number=SeqID_103762
MFAITFNTPPSTYNLAPSSSCYRPSLPTQIRDISHEDEDEKEDNNNNNDDDGDGDDDDDNGGHHVPQQQRTITREHPRTRGGRDCRSRRQQTQTNPVQQDERPKRVSRRTRCGTSSHY

SEQ ID NO: 220541 - protein, 60 aa, Glycine max
  Coding DNA Sequence Number=SeqID_103763
MDDTSAPAPTIALLVSVGASRAAKVDQQQNTQCGNGKNAGYGNRGVRKESNGYDDDDFLL

SEQ ID NO: 220542 - protein, 39 aa, Glycine max
  Coding DNA Sequence Number=SeqID_103764
MGSPSPIGPIREKALINTAQRRNFKVQFKGQSSHSQTHR

SEQ ID NO: 220543 - protein, 67 aa, Glycine max
  Coding DNA Sequence Number=SeqID_103765
  Gene Ontology: Mol. function=oxidoreductase activity; Cellular component=chloroplast
  Homolog annotation: Hit_ID=O23939; Match level="QueryCoverage=95%, HitCoverage=20%, E-value=3e-16, Identity=71%"; Hit description =Ripening-induced protein
QGDRAFKAVKEGGKVVTIVPPGHPPAIFFVLTSKGSVLEKLRPYFESGKLMPRLLCHFLRLLKPFPT

SEQ ID NO: 220544 - protein, 106 aa, Glycine max
  Coding DNA Sequence Number=SeqID_103766
  Gene Ontology: Mol. function=binding
  Homolog annotation: Hit_ID=Q1EPA6; Match level="QueryCoverage=77%, HitCoverage=11%, E-value=7e-12, Identity=54%"; Hit description =Kinesin light chain-related
MDELNVNSAAEEPSGSYKENFAQQASPRSTLSPRSIQSDSIDLAIDGVVDTSIEQLYHNVCEMRSSDHSPSRASFYSYDYDGESRIDSELGHLAGDIVDLEITKEV

SEQ ID NO: 220545 - protein, 58 aa, Glycine max
  Coding DNA Sequence Number=SeqID_103767
  Subcellular localization annotation: CTP_CleavageSite=23; ConfidenceScore=5.07e-01
MLGTVASPSKNTIIKSNFAEMLRLKRKKHRVSGLTAFGREKTRDKGKGKVTVRFRVRE

SEQ ID NO: 220546 - protein, 427 aa, Glycine max
  Coding DNA Sequence Number=SeqID_103768
  Gene Ontology: Mol. function=binding; Cellular component=kinesin complex; Biological process=defense response
  Homolog annotation: Hit_ID=Q8S3S1; Match level="QueryCoverage=99%, HitCoverage=59%, E-value=1e-179, Identity=72%"; Hit description =Putative kinesin light chain gene
  Pfam annotation: Domain name=TPR_1; Domain location=120-153; Score =11.9; E_value=0.2; Accession=PF00515.18; Description=Tetratricopeptid e repeat
  Pfam annotation: Domain name=TPR_1; Domain location=162-195; Score =3.2; E_value=2.2; Accession=PF00515.18; Description=Tetratricopeptide repeat
  Pfam annotation: Domain name=TPR_1; Domain location=202-235; Score =17.1; E_value=0.048; Accession=PF00515.18; Description =Tetratricopeptide repeat
  Pfam annotation: Domain name=TPR_1; Domain location=244-277; Score =22.0; E_value=0.0022; Accession=PF00515.18; Description =Tetratricopeptide repeat
  Pfam annotation: Domain name=TPR_1; Domain location=287-320; Score =15.7; E_value=0.072; Accession=PF00515.18; Description =Tetratricopeptide repeat
  Pfam annotation: Domain name=TPR_1; Domain location=328-361; Score =6.9; E_value=0.8; Accession=PF00515.18; Description=Tetratricopeptide repeat
  Pfam annotation: Domain name=TPR_1; Domain location=35-68; Score=3.5; E_value=2.1; Accession=PF00515.18; Description=Tetratricopeptide repeat
  Pfam annotation: Domain name=TPR_1; Domain location=370-403; Score =2.9; E_value=2.4; Accession=PF00515.18; Description=Tetratricopeptide repeat
  Pfam annotation: Domain name=TPR_1; Domain location=78-111; Score =7.6; E_value=0.67; Accession=PF00515.18; Description=Tetratricopeptid e repeat
  Pfam annotation: Domain name=TPR_2; Domain location=120-153; Score =14.8; E_value=0.32; Accession=PF07719.7; Description=Tetratricopeptid e repeat
  Pfam annotation: Domain name=TPR_2; Domain location=162-195; Score =8.2; E_value=3.7; Accession=PF07719.7; Description=Tetratricopeptide repeat
  Pfam annotation: Domain name=TPR_2; Domain location=202-235; Score =12.9; E_value=1; Accession=PF07719.7; Description=Tetratricopeptide repeat
  Pfam annotation: Domain name=TPR_2; Domain location=244-277; Score =16.3; E_value=0.11; Accession=PF07719.7; Description=Tetratricopeptid e repeat
  Pfam annotation: Domain name=TPR_2; Domain location=287-320; Score =19.1; E_value=0.016; Accession=PF07719.7; Description=Tetratricopepti de repeat
  Pfam annotation: Domain name=TPR_2; Domain location=328-361; Score =7.8; E_value=4.1; Accession=PF07719.7; Description=Tetratricopeptide repeat
  Pfam annotation: Domain name=TPR_2; Domain location=35-68; Score=5.6; E_value=7.4; Accession=PF07719.7; Description=Tetratricopeptide repeat
  Pfam annotation: Domain name=TPR_2; Domain location=370-403; Score =5.5; E_value=7.6; Accession=PF07719.7; Description=Tetratricopeptide repeat
  Pfam annotation: Domain name=TPR_2; Domain location=78-111; Score =11.3; E_value=1.6; Accession=PF07719.7; Description=Tetratricopeptide repeat
  Pfam module annotation: Pfam domain module=TPR_1::TPR_1::TPR_1::TPR _1::TPR_1::TPR_1::TPR_1::TPR_1::TPR_1::TPR_2::TPR_2::TPR_2::TPR _2::TPR_2::TPR_2::TPR_2::TPR_2::TPR_2; Domain location=120-153::162 -195::202-235::244-277:...
  Pfam module annotation: Domain location=:287-320::328-361::35-68::370- 403::78-111::120-153::162-195::202-235::244-277::287-320::328-361::35- 68::370-403::78-111
MISSGENPRKALDLAVRALKSFEICADGKPSLDMVMCLHVLATIYCNLGQYNEAIPVLERSIDIPVLEDGQEHALAKFAGCMQLGDTYAMMGQIENSLLFYAAGLEIQGQVLGETDPRFGETCRYVAEAHVQALQFDEAEKLCQMALDIHRGNGAPASIEEAADRRLMGLICDSKGDYEAALEHYVLASMAIAANDHEADVASVDCSIGDAYLALARYDEAVFSYQKALTVFKSTKGENHPTVASVYVRLADLYNKIGKFKESKSYCENALRIFGKIKPGIPSEEIASGLIDVAAIYQSMNDLEKGLKLLKKALKIYGNAPGQQSTVAGIEAQMGVMYYLLGNYSDSYNIFKSAIAKFRASGEKKTALFGIALNQMGLACVQCYAINEAADLFEEAKTILEKEYAPYHPDTLGVYSNLAGTYDAMGR

SEQ ID NO: 220547 - protein, 684 aa, Glycine max
  Coding DNA Sequence Number=SeqID_103769
  Gene Ontology: Mol. function=L-aspartate oxidase activity; Cellular component=chloroplast; Biological process=NAD biosynthetic process
  Homolog annotation: Hit_ID=Q6Z836; Match level="QueryCoverage=80%, HitCoverage=89%, E-value=0.0, Identity=72%"; Hit description =Putative L-aspartate oxidase
  Pfam annotation: Domain name=DAO; Domain location=152-470; Score= -45.4; E_value=0.0059; Accession=PF01266.14; Description=FAD dependent oxidoreductase
  Pfam annotation: Domain name=FAD_binding_2; Domain location=152-509; Score=281.4; E_value=1.8e-81; Accession=PF00890.14; Description=FAD binding domain
  Pfam annotation: Domain name=Pyr_redox_2; Domain location=152-498; Score=-35.8; E_value=0.045; Accession=PF07992.4; Description =Pyridine nucleotide-disulphide oxidor
  Pfam annotation: Domain name=Succ_DH_flav_C; Domain location=565-671; Score=-16.8; E_value=2.3e-07; Accession=PF02910.10; Description =Fumarate reductasesuccinate dehydroge
  Pfam module annotation: Pfam domain module=DAO::FAD_binding_2::Pyr _redox_2::Succ_DH_flav_C; Domain location=152-470::152-509::152 -498::565-671
MATCVPAVSGALHYGVTNCKGHSYRRSASFSDVPNTGFLQKDLSWLEDSDPGIILVHLHSVYLKLFECFVVASENLIRKRLNGKGSSLSGSSVIAELMIFHCFGVQNFRSKVVSKVLQIHRCGFSAPPLHKDQKLFKVISSWKKDSPTKYFDFIVIGSGIAGLRYALEVAKYGSVAVITKAESHECNTNYAQGGVSAVLCPSDSVESHIKDTIVAGAYLCDEESVRVVCTEGPERVRELIAMGASFDHGEDGNLHLMREGGHSHHRIVHAADMTGKEIERALLKEVISNPRIFVFEHHFAIDLLTCQDRSDMICLGVDTLNSKTLEVATGDGIAMAHRAQAVISNMEFVQFHPTALADEGLPIKPTKPRENAFLITEAVRGDGGILYNFGMERFMPLYDERAELAPRDVVARSIDDQLKKRHEKYVLLDISHKPKEEILSHFPNIASTCLQYGLDITRRPIPVVPAAHYMCGGVQAGLQGETNVKGLYVAGEVACTGLHGANRLASNSLLEALVFARRAVQPSVDHMKGSSLDLTASNLWPRPVVPLPLGSNVTDKIMSTTKELRAELQSIMWDYVGIVRSTMRLETAEQKIGSLEAKWEESLFQHGWKPTMVGPEICEMRNLFCCAKLVVSSALSRHESRGLHYTVDFPYLEESKRLPTIIFPSSPVNSTWSSRQLHKQPMYQ

SEQ ID NO: 220548 - protein, 183 aa, Glycine max
  Coding DNA Sequence Number=SeqID_103770
MERANTGFTTKPYVEGRTVAAAFLLLTLTQLKLETLEEKNDVEVVVLSRASAAADAADGGAGAAALRLPSPRRAQPHAPPHLRRRFRQARHHLPLPGLLSPGQALDHPNHAQADRQSSRRCHRNRDWFQVLLITSRKKVLPEMRCFAGKGFLLYSLQRFKLWSRSLILWEIADKCGQYGHNYG

SEQ ID NO: 220549 - protein, 82 aa, Glycine max
  Coding DNA Sequence Number=SeqID_103771
MDWTIHKSHTDWANYRRSEGSRDGLDCKGEEEQQLKEWECVNEENEVNDGVTLSQVFLISCTSRMSSTNHLLMFLEQAHEVC

SEQ ID NO: 220550 - protein, 710 aa, Glycine max
  Coding DNA Sequence Number=SeqID_103772
  Gene Ontology: Mol. function=nucleic acid binding; Cellular component= intracellular; Biological process=DNA integration
  Homolog annotation: Hit_ID=Q1S1X7; Match level="QueryCoverage=98%, HitCoverage=60%, E-value=0.0, Identity=48%"; Hit description =Integrase, catalytic region; Zinc finger, CCHC-type; Peptidase aspartic, catalytic
KRAKFKQWKSLVEKQTEKKVKRLRTDNGLEFCNNEFNEFCANEGIARHRTDEQDITGESSMHALKCRLQKRCGQALQQIIQFCVYLGVQHINEGKLEPRAKKCILLGYQDGVKGYRLWDPKESKLLISRDVTFDETAMLNPRPHKDHDNKVEVHGDIKKVEFEVEARKPEEIYDESEVTPTEFEHTLASDRPRRQTRPPQRYDDFVAFALNMAESIDDEQEPSSFHEAVTCDEASQWIGAMKEELESLHKNHTWKLVEKPIDQKIVGCKWIYKKKDGIRFKARLVAKGFTQRKGIDFNEVFSPVVKHSSIRVLLALVSLLDLELEQLDVKTAFLHGDLEETIYMQQPDGFVVPGKEDHVCLLKKSLYGLKQSPRQWYKRFDSFMIDIRYIKSEYDSCVYHTKLFDNTYIYLLLYVDDMLIACKHPNEINKVKTQLSGEFEMKDLGPAKRILGMEIIRDRKIGRLCLSQKSYVEKVLERFGMHNAKAVIPYSNAVGSLMYAMVCTRPDIAHAVSVVSCYMANPGKSRWQAVKWILRYLRGSTNLGLVFGKATNECNSHVIGYCGSDYASDLDRRRSLSGYIFTLGGSAISWRATLQSTVALSTTEAEYMAATEAVKEALWLKGLVGDLGVSKKEVVVHCDSQSAIHLTKNQMYHERTKHIDIRMHFICDVVTQGDVSIEKISTLDNPADMMTKALPTIKFKQCLDSVGIKN

SEQ ID NO: 220551 - protein, 107 aa, Glycine max
  Coding DNA Sequence Number=SeqID_103773
MNPSGAVRDEACQPRQAHRLCPLHLRQIIYEDSTDDPPWHIDKRGGYGSDHCKCQGETDVVERAISLLRRVRLVLVGYHNLSFALGRQYNICRQVFDPRPCCLPPLP

SEQ ID NO: 220552 - protein, 159 aa, Glycine max
  Coding DNA Sequence Number=SeqID_103774
MDIHDDRSGEDNEVARGIEDASHLDGAFEEKVSEKIVINILLDIVNINLTNIDSNDVKRANGFVCKSKVLRNCKGETTQQNFLCYREGVKDYRDITIEMQKHEEKMIQDVIVDMTKFDIEFKTQRQWVIKLIIKNPKSQDIGLRFNKTKGGQLKTQGHP

SEQ ID NO: 220553 - protein, 68 aa, Glycine max
  Coding DNA Sequence Number=SeqID_103775
MGGWTIWDNEDTTKRDVCHMERPLTAEPNDNEVTCSNVKKCCEYFKSLGPPYSYENDLELVKASFLYP

SEQ ID NO: 220554 - protein, 165 aa, Glycine max
  Coding DNA Sequence Number=SeqID_103776
MGKSGEKPFSVVALLIDSGNNKKKFEKVVNIDDNVALTDFSLVLGYLTHVTLGYKIILELRKSFGDVDPLKLIEGEDVALKKAREYGDVLTGEFDKLKARGWDLELYRTYLGALSTINEDFVAEKVSNLETFDEEMVGGFIKTLGTNANDRVVGASNVDANLRGF

SEQ ID NO: 220555 - protein, 76 aa, Glycine max
  Coding DNA Sequence Number=SeqID_103777
MGLFLKTNLIPLLFVTGIWLHEAPRSEDVDWVDKQFCGRTILVGGRLNGPRMMVGFALKVGDKMLGCPLPLWKRRK

SEQ ID NO: 220556 - protein, 41 aa, Glycine max
  Coding DNA Sequence Number=SeqID_103778
MGWSILKRLKQPNALLMMSSCGVFVYCVFLQGYNDGVGGKT

SEQ ID NO: 220557 - protein, 290 aa, Glycine max
  Coding DNA Sequence Number=SeqID_103779
  Gene Ontology: Mol. function=serine-type endopeptidase activity; Cellular component=chloroplast; Biological process=proteolysis
  Homolog annotation: Hit_ID=Q1T3A6; Match level="QueryCoverage=97%, HitCoverage=59%, E-value=1e-130, Identity=86%"; Hit description =Peptidase S1 and S6, chymotrypsin/Hap
  Pfam annotation: Domain name=Trypsin; Domain location=2-174; Score= -21.0; E_value=0.00028; Accession=PF00089.16; Description=Trypsin
MLVMCRVTLADQSTLDAIVVGFDQDKDVAVLRVDAPKDKLRPIPIGVSADLLVGQKVYAIGNPFGLDHTLTTGVISELGSMKETKCKADKLLNKHLLEKKIKSGLRREISSAATGRPIQDVIQTDAAINPGNSGGPLLDSSGNLIGINTAIYSPSGASSGVGFSIPVDTVSGIVDQLVKFGKVTRPILGIKFAPDQSVEQLGVSGVLVLDAPANGPAGKAGLQSTKRDSYGRLILGDIITSVNDKKVTNGSDLYRILDQCKVGDKLIVEVLRGDHKEKIPVILEPKPDES

SEQ ID NO: 220558 - protein, 176 aa, Glycine max
  Coding DNA Sequence Number=SeqID_103780
  Gene Ontology: Mol. function=serine-type endopeptidase activity; Biological process=proteolysis
  Homolog annotation: Hit_ID=Q1T3A6; Match level="QueryCoverage=66%, HitCoverage=26%, E-value=2e-25, Identity=57%"; Hit description =Peptidase S1 and S6, chymotrypsin/Hap
MTFLVPNKARPGSLWNLQHVQCERILPKHETPNIETNQKDNRGSVFLEEANGGEFIGLELPGGGDDEGGGGVGVREEESEGEGERGAEKEKGFGNGEFGEERYYWKCWIWGAKEEEGGSVEMEGFGKEERENEEEEEGKSVEMSEKVAIVLVGVTKDVCYAKWLEMLFVVLRSVGI

SEQ ID NO: 220559 - protein, 850 aa, Glycine max
  Coding DNA Sequence Number=SeqID_103781
  Gene Ontology: Mol. function=RNA-directed DNA polymerase activity; Cellular component=extracellular region; Biological process=RNA -dependent DNA replication
  Pfam annotation: Domain name=Exo_endo_phos; Domain location=201-394; Score=12.0; E_value=0.0021; Accession=PF03372.13; Description =EndonucleaseExonucleasephosphatase family
  Pfam module annotation: Pfam domain module=Exo_endo_phos::RVT_1; Domain location=201-394::569-793
MKLIMVSWMKICRPLSVVGGPGLRSLKAINKASILSLTWKFISSVDHWAELMRARVLKDGFQDTTIDRRIIAQSVTGQSDDAHLQTHGREAKGTSQLALYQNGRIWHKGSCAPDEREDQNHERGNMGAELNVEDRGRTTITSEITRMHPDQQHKVEEQTEDQLSNSMQQHVALPQVRSDGIYQTENHNQDAENIWSMVTGLGMTTRNSQKNYVQQLMEMERRDVDEAERLGRLGRGVKWPTIRRMVKENHIDMLCLQETKKESVDKAMCIAMWGIQKSVGKHTLQSTQLAAFCAYGMRNRSRALWENVKQLKNQNPGGYWCIVGDFNNIRTAEERVGSAPWVGKRFTWFKPNGTAKSKLDRFLVSPERLSKWPGSSQFTLNRNFSDHCPVMLKSKSIDWGYVLKQKFKALKDKVKVWNKEQFGDTYSKYKKIEEDLNKMEEETGDRLLNHHESNCLNGVLIDGSWRDEPTIVKEEVRRYFLQHFQESDQARPRLDSTCFQTIDIQQNEMLVERFHEEEVKRAVWSCGSDKSLGPDGFNFKFIKQFWDIIKYDFLRFLDEFHVNGVFPRGLNASFIALIPKIVDPQALNDYRPISLIGCTYKILAKILANKVKKVDYEKVYDYVSWEFLNYMMTRMGFCTKWIHWIEGCLKSASVSVLVNGSPSSEFVPQKGLKQGDPLSPLLFNIVAEGLNGLMTNAMERRLYTGFLSGTNKVEVSLLQYANDTIFFGETTMENVRAIKAILRAFELASGLKINFTKSSCRAFGVTDQWISDAANYLHCSLMSFPFTYLGIPIGANPRRCQTWDPIITKCERKLARWKQRHLSFGERVTLINSVLMSVRQVASDILRRGS

SEQ ID NO: 220560 - protein, 145 aa, Glycine max
  Coding DNA Sequence Number=SeqID_103782
MEMEVISKSGGIVGKGAGIKGSEDTVSTSTAGAVIGQVDKMEGGGYQLLEKYPRLYIILDQQNQLIQHMGTHKDTGWADPTGQYSVKSTYSVLRQHVPAEAQGEEFTELWKLKVPSKAVNSGGECMPLVLSLQENNSDLVGIVVI

SEQ ID NO: 220561 - protein, 100 aa, Glycine max
  Coding DNA Sequence Number=SeqID_103783
MIESDGTQRQIMVILRLLSSRGGEADDIRRQIMVIKHTFFPSRDDRIRWHAGTNYGHYAPFVIQRRQTRRHAEIPYGHPRLSSTERNEFDSIRMMLVFRC

SEQ ID NO: 220562 - protein, 261 aa, Glycine max
  Coding DNA Sequence Number=SeqID_103784
  Homolog annotation: Hit_ID=Q9LK89; Match level="QueryCoverage=95%, HitCoverage=94%, E-value=2e-23, Identity=32%"; Hit description =Arabidopsis thaliana genomic DNA, chromosome 3, TAC clone: K16N12
  Pfam annotation: Domain name=DUF1645; Domain location=49-238; Score =78.1; E_value=2.7e-20; Accession=PF07816.2; Description=Protein of unknown function (DUF1645)
VMESLVCPSFSAYSSNTLDDIADQVTRNDDVRFEENDTDFEFVAFREVADGVFVDDNATPAFPIFDRDLATATAEDGGEVKRRVSGEEDDVVAIQITLGKLLMDDSSPSCSSSEVEDELENVPPGTYCVWTPRKAPPAPASPCRKSKSTGSSLSKRWKLLDLLRRSNSEGKESVVFLTPSSVNSAKKGTKSETGKKSLASSGGGEKRIAAVPAVSAHEALYVRNREMRREVKRRSYLPYRQDLVGFCVNLNPMGKAFPLHF

SEQ ID NO: 220563 - protein, 54 aa, Glycine max
  Coding DNA Sequence Number=SeqID_103785
MASIWACPDEDVKIETFCGTFLGGDVALILYYEGLSLSSNTGIGRQRKKLHRII

SEQ ID NO: 220564 - protein, 81 aa, Glycine max
  Coding DNA Sequence Number=SeqID_103786
MDIQVPECINKKLAQAKIKCAFIVYLDMKQIVITLDSSDILSLEKQEDKECLAKILDLGNYWHLISLTVIDLRDNDCLGLS

SEQ ID NO: 220565 - protein, 80 aa, Glycine max
  Coding DNA Sequence Number=SeqID_103787
MARPAHDLNALSARYGAERDYEGPPKKRTMYNEPQELSMQRNLFQGLIAWERVTPNRTSKEKNHWVSIARHRMITHCPCI

SEQ ID NO: 220566 - protein, 389 aa, Glycine max
  Coding DNA Sequence Number=SeqID_103788
  Gene Ontology: Mol. function=protein binding; Cellular component =membrane; Biological process=defense response
  Homolog annotation: Hit_ID=Q93VS9; Match level="QueryCoverage=99%, HitCoverage=39%, E-value=4e-97, Identity=49%"; Hit description=NBS -LRR resistance-like protein B8
  Pfam annotation: Domain name=NB-ARC; Domain location=112-389; Score =98.9; E_value=1.5e-26; Accession=PF00931.13; Description=NB-ARC domain
MAAEFVGGALLSAVLQVAFVRLASPKVLDFFRARKLDETLLDRLNTKLLFIDALADDAEHKQFRDPHIMNSPNVKWKINLSLKPSLARISCKPKGCSWFKKATNSDVGSGSKVSQKLPSTSLVVESVIYGRDDDREMILNWLTSETDSYQYLLLWAWVDWVRPPSPNIYTMTQGWRRLIFISKLGLTKIILEAITKSKDNSRELEMIHGRLKEKLTGKRFLLVLDDVWNERREEWESVQTPLNHGAPGSRILVTTRCEEVVCIMRSNKVYHLKQLQEDHCWQVFVKHAFQDDHSILNAELKEIGTKIVQKCKGLPLALKSIGSLLHTAKSSISEWESVLLSNIWDILKGESEIIPALLLSYHHLPSHLKMCLACCALFPKDYEFVKEHL

SEQ ID NO: 220567 - protein, 783 aa, Glycine max
  Coding DNA Sequence Number=SeqID_103789
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1T3B5; Match level="QueryCoverage=99%, HitCoverage=65%, E-value=0.0, Identity=81%"; Hit description=ATPase, E1-E2 type; Peptidase M, neutral zinc metallopeptidases, zinc- binding site
  Pfam annotation: Domain name=Hydrolase; Domain location=303-779; Score=24.2; E_value=0.00046; Accession=PF00702.16; Description =haloacid dehalogenase-like hydrolase
MAKEAVEDWRRRKQDIEANNRKVQVYGRNYTFVETRWKKLRVGDIIKVYKDEYFPADLLLLSSSYDDGICYVETMNLDGETNLKLKHALEVTIHLQDEKSLQKYKAMVKCEDPNENLYSFIGTLQYDGKEYPLSLQQILLRDSKLKNTDYIYGIVIFTGHDTKVMQNSTDPPSKRSKIERKMDKIIYILFSTLVLISFIGSVFFGVETKRDISSGRYRRWYLRPDNTTVFYDPRRATLAAVLHFLTALMLYGYLIPISLYVSIELVKVLQSIFINHDQEMYFEETDRPARARTSNLNEELGQVDTILSDKTGTLTCNSMEFVKCSIGGIPYGRGMTEVEKALVRRGSDVESEVDGGSSDILGQSNDAVDSRHSIKGFNFKDERIMMGQWVNEPYPDFIQRFFRVLAICHTAIPDVDKESREISYEAESPDEAAFVIAARELGFEFFARTQTSISLHELNYESGKKVDRVYRLLHVFEFSSSRKRMSVIVRNEENQLLLLCKGADSVMFERISQHGRQFEAETRDHIKSYSEAGLRTLVIAYRELDEEEYKLWDNEFSKIKTTVTEDRDVLVDAAADKMERDLILLGATAVEDRLQKGVPECIEKLARAKIKLWVLTGDKMETAVNIGYACSLLRQDMKQIVITLDSPDILSLEKQGDKEALSKASLESIKKQIREGISQIKSAKESSNTNKGSSSGFGLIIDGKSLDYSLNKNLERSFFELAINCASVICCRSSPKQKARVTKLVKLGTGKTTLSIGDGANDVGMLQEADIGVGISGAEGMQV

SEQ ID NO: 220568 - protein, 63 aa, Glycine max
  Coding DNA Sequence Number=SeqID_103790
  Homolog annotation: Hit_ID=Q1T3B5; Match level="QueryCoverage=98%, HitCoverage=5%, E-value=1e-23, Identity=79%"; Hit description=ATPase, E1-E2 type; Peptidase M, neutral zinc metallopeptidases, zinc- binding site
MPEGSKSRIRFSKLYSFSCLKSPFRDGHSQIGRKGYSRVVYCNDPDNPEAVQLNYGGNYVSTT

SEQ ID NO: 220569 - protein, 128 aa, Glycine max
  Coding DNA Sequence Number=SeqID_103791
MKSKRRTAKNFHGIAYRNFSEALRKRLGLDFFPFFLFSSLISKADNHPHPGYHRTCLSLDDKGDFNNLWIGRVQTNICCLRVSLDLLSLDDEGETKVVLINGLACLWLTKVADGHDWSPPVIELAVSG

SEQ ID NO: 220570 - protein, 212 aa, Glycine max
  Coding DNA Sequence Number=SeqID_103792
  Gene Ontology: Mol. function=structural constituent of ribosome; Cellular component=large ribosomal subunit; Biological process =translation
  Homolog annotation: Hit_ID=Q9FLF3; Match level="QueryCoverage=90%, HitCoverage=68%, E-value=3e-53, Identity=60%"; Hit description =Genomic DNA, chromosome 5, P1 clone:MUB3
  Pfam annotation: Domain name=Ribosomal_L15; Domain location=63-161; Score=115.8; E_value=1.2e-31; Accession=PF01305.8; Description =Ribosomal protein L15 amino terminal region
  Subcellular localization annotation: CTP_CleavageSite=15; ConfidenceScore=5.11e-01
MLRRRLSVLSTSITRSSNYSKPSLGYPSIQSHPFQLPHSPSAYQIISPNAFPDFQGFRAYSLLSLNDLRDKVPRKQPTRKGRGIGSGKGKTAGRGHKGQRARKGIKLGFEGGQTPLRRRLPKRGFKNPFSLTFQPIGLGKIAKFINAGKIDSSELITMKTLKDAGVLGKQMKDGVRLMGRGSEQIKWPIHLEFMIYLDVCLKVCSLLSPLAA

SEQ ID NO: 220571 - protein, 128 aa, Glycine max
  Coding DNA Sequence Number=SeqID_103793
MEREMIIVMVDTLPVFYYEKMVGYTPSSLADLVFADERIEVGLKKGKYDHPALMNAKTGANEKDENEGETLAMTTIPTRSNFPSPQQCHYSANNSPSHPILHKGHPPIIHKACPPHIRCQNTNQKGIL

SEQ ID NO: 220572 - protein, 113 aa, Glycine max
  Coding DNA Sequence Number=SeqID_103794
MFNTVHVIDQPYGEVSRSFAIRWKDELEPTWHLLHSSDNMHSVTYYQDLVSLVLLVGWMEHREFYELTGNHQVTLTHYGQSVFLLTIFKSSSKPKAFPKWAFLVPPSSQLSHF

SEQ ID NO: 220573 - protein, 174 aa, Glycine max
  Coding DNA Sequence Number=SeqID_103795
  Gene Ontology: Mol. function=endonuclease activity; Cellular component=cytoplasm; Biological process=regulation of translational termination
  Homolog annotation: Hit_ID=Q84UT6; Match level="QueryCoverage=72%, HitCoverage=65%, E-value=2e-44, Identity=73%"; Hit description =Perchloric acid soluble translation inhibitor protein homolog
  Pfam annotation: Domain name=Ribonuc_L-PSP; Domain location=70-173; Score=96.7; E_value=7.1e-26; Accession=PF01042.11; Description =Endoribonuclease L-PSP
  Subcellular localization annotation: CTP_CleavageSite=80; ConfidenceScore=5.64e-01
MASWCSVRSFQVPAMEGSALRNRASLAARVGCLSVAGTSFWRSSSSPKHSLSFTCLSISSETRIKENVQTEGAPAALGPYSQAIKSNNLLFVSGVLGLVPETGKFVSDDVEDQTEQLLKNMGEILKAGGASYSSVVKTTIMLADLKDFKKVNEIYAKCEACTDLFVCEKMNTLS

SEQ ID NO: 220574 - protein, 369 aa, Glycine max
  Coding DNA Sequence Number=SeqID_103796
  Gene Ontology: Mol. function=long-chain-fatty-acid-luciferin -component ligase activity; Biological process=bioluminescence
  Homolog annotation: Hit_ID=Q2KXJ0; Match level="QueryCoverage=95%, HitCoverage=95%, E-value=1e-106, Identity=57%"; Hit description=Acyl- protein synthetase
  Pfam annotation: Domain name=LuxE; Domain location=8-363; Score= -38.8; E_value=1.4e-07; Accession=PF04443.3; Description=Acyl-protein synthetase, LuxE
MPQSKEGTFMTEASIIAALLAFMQREETTEADFNQLALQLFAWQFEHNLPYARFARQRGRTPLTVKQWRQIPAVPITAFKDLTLSCRPVAEIPHIFMTSGTTGTGRGRSYHPTLAVYDRSMLINFRQRFMAGYPRLPMAILFPHSSELPNSSLAHYLTLAMQECGTPDSEVMVDAQGLKLPRLIAALEQAQASGQPYALLGASYSFVHLLDELARQQRRFRLPPGSRILDTGGFKGQSREVAAEAFYSALQQTLGVPRSHCINMYGMTELSTQFYDAGNEICPPVKSGPHWIRTRVVHPLTGADVPEGETGVLVHHDLAHFNSVSSILTEDAGVMVPGGFQLLGRVAGADAKGCSLAMESFLAAAQART

SEQ ID NO: 220575 - protein, 312 aa, Glycine max
  Coding DNA Sequence Number=SeqID_103797
  Gene Ontology: Mol. function=RNA-directed DNA polymerase activity; Biological process=RNA-dependent DNA replication
MSMYTDNHKLLIHFFQDSLTGAALKWYMNLDSASIRTFNDLGEAFIRQYKYNLDMAPDRDQLRAMTQKEKETFKEYAQRWREVAAQIVPPLEEREMTKIFLKTLSQFYYEKMVASAPTDFTEMVNMGVRLEEGVREGRLTGESVPAASNAKKFGGHFAKKKDQEVGMVAHGKPQQNFTPYRQVANVASAIPNPSYHQQRPHYPYPYPPQQYPPQQYPPQQYPPQQYPPQQYHQPQYPQKQQNRPQTPQQPYHSQNRQKTTFDPIPMKYADLLPGLLAKKLVQVRTPPRTPDVLPPWFRHDLNLRFPTRGPRS

SEQ ID NO: 220576 - protein, 137 aa, Glycine max
  Coding DNA Sequence Number=SeqID_103798
MLVATPCVFLSWNTHPASHASPSRRRIGCDTPLPYPHLVTLFLQHFNIPLDSEPYVPIKRSFLIGVVMVASFGYRKERDGSWDNYRLKETLLSFKVFWTEQVDTRFDEMDSRITKVEEDVTFIRTCFDLPPPPPPSS

SEQ ID NO: 220577 - protein, 33 aa, Glycine max
  Coding DNA Sequence Number=SeqID_103799
MVLTSTTSLKVGTLRRYLLQHRLRMPTFRDVGE

SEQ ID NO: 220578 - protein, 147 aa, Glycine max
  Coding DNA Sequence Number=SeqID_103800
  Homolog annotation: Hit_ID=Q1S717; Match level="QueryCoverage=83%, HitCoverage=13%, E-value=6e-18, Identity=34%"; Hit description =Ovarian tumour, otubain
MVCTKRLCRLVYRCRKKDFVRRDTTGSRNCGCPSKLRGKPVIGGQGWMVKLMCGIHNHELAKSLVGHPYVGKLTKDEKTIIDNMTKSMVKPRNIMLTLKEHNANSCTTIKQIYNARSAYCSYIRGIDNEMQHLMKLLEWDQYIHWHR

SEQ ID NO: 220579 - protein, 333 aa, Glycine max
  Coding DNA Sequence Number=SeqID_103801
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=4e-49, Identity=31%"; Hit description= UPI00006A17C9 related cluster
RLHVVTFRGLHILVFRGLHILALRGLHVLAVRALHVLAFRGLHALAFRRLHVVALRGLHALAFRGLHDLTFRGLHVLALRGLLALRGLHALAFRGLHALAFRGLHALAFRGLHVLAFRGLHVLAFRGLHVLAFRGLHALAFRGPHGLTFRGLRAFTFRELHALALRGLHALAFRGLHVLTFKGLHVFAFRGLHVVAFRGLHILVFRGLHVLAFRGLHALAFRGLHVLSFRGLHALTFRGLHVLAFRVLHALAFRGLHVLPFKGLHVLAFGGLHALAFRGIHVLAFRGLHAVAFRGPHVLTFRGLHALTFRGLHVLALRGLHAIAFRGLHVLPL

SEQ ID NO: 220580 - protein, 133 aa, Glycine max
  Coding DNA Sequence Number=SeqID_103802
MASSLLREDLHQVLLLVRHPFLKACSVYSYGSQLASHIVTCCCILCMSGQLAYPKPSLVQKDALGSALLPFAGHQIMISGGGSNNDSGDSGSDNNGNGGGNGESGDDRVRRKKGERESDNPMLLLCNLTPTSG

SEQ ID NO: 220581 - protein, 67 aa, Glycine max
  Coding DNA Sequence Number=SeqID_103803
EAVGLAKLADRPDHEVDDPLYLMTLIIPQIFLKPLQASDLDKYAIREFRCVWIPRATVHPEIWTIAV

SEQ ID NO: 220582 - protein, 42 aa, Glycine max
  Coding DNA Sequence Number=SeqID_103804
MGAKYLEAVERGSHPNTGWSPDKIRGAKFVYARLSTQLAALE

SEQ ID NO: 220583 - protein, 82 aa, Glycine max
  Coding DNA Sequence Number=SeqID_103805
MISDLGQECFHQADALLYDTLESDLKKPLYPGYKKSLTWLLVGMFPEENMLPKSYYKAKKILCPTVMQSYPPRALDRRLQED

SEQ ID NO: 220584 - protein, 278 aa, Glycine max
  Coding DNA Sequence Number=SeqID_103806
  Gene Ontology: Mol. function=nucleoside-triphosphatase activity; Cellular component=membrane; Biological process=cobalt ion transport
  Homolog annotation: Hit_ID=Q9A846; Match level="QueryCoverage=77%, HitCoverage=90%, E-value=8e-67, Identity=60%"; Hit description=ABC transporter, ATP-binding protein
MGRAALVPGVEAGSSTEQQPKHHAQHGHACPHVKALFPTGRHLLHQPAARDEAHAVGHIGRPQQVVRDHENGHALAAQLRDQPAEFGRGLRVQARSGFVQQQRRHLACQRQRNGHLLPHSLGKARDAPVMRGRIQPCSGQGLADGIPAGGLARQVQQIGHVLARAQVLVQRHVLGDIGDQAARLRGSRHRVHALHAHLAAARPHKAQEQAQRGGLARAVGAQQRIDLAGMHGQVQALEDGALAIVHHGAQCLEHGRGGRSGVGRNRKGWMHGGAQNLA

SEQ ID NO: 220585 - protein, 260 aa, Glycine max
  Coding DNA Sequence Number=SeqID_103807
  Gene Ontology: Mol. function=catalytic activity; Cellular component =cellular_component; Biological process=biosynthetic process
  Homolog annotation: Hit_ID=UPI00005FA308; Match level="QueryCoverage =98%, HitCoverage=99%, E-value=1e-102, Identity=71%"; Hit description= COG0384: Predicted epimerase, PhzC/PhzF homolog
  Pfam annotation: Domain name=PhzC-PhzF; Domain location=2-256; Score =148.9; E_value=1.4e-41; Accession=PF02567.7; Description=Phenazine biosynthesis-like protein
MAENYYHVVAFTGEGLRGNPAGVCLLTQPLPAARLQAIANEIGLPETSFVWDDGDMTAIRWFTPQREVDLCGHGTLAAAHVMFSVVNPALQDIRFRSAGGELFVKRDAQDGERLVLDFPARPPQKVAEPAGLAALLGVQPQEVWQAKALMVVLENEAQVRALRPDIPALIALAGRAVIVTAPGDTVDFVSRYFTLDAGEDPVTGSAHCTLMPYWTARLGRHRLQAQQVSARGGELFCELQGDRTLLGGYAHVFLHGTIAL

SEQ ID NO: 220586 - protein, 106 aa, Glycine max
  Coding DNA Sequence Number=SeqID_103808
  Subcellular localization annotation: CTP_CleavageSite=23; ConfidenceScore=5.40e-01
MVHDIFVKVKLEVTGTSAALNVFGSRRSSDVPRSFAPIFFKMVTSILQLDSMNLFVKARAWFNPITQGMAILIANTSSTIHRDERLGNMHAMHGKWENARVTHEQT

SEQ ID NO: 220587 - protein, 314 aa, Glycine max
  Coding DNA Sequence Number=SeqID_103809
MYHTKLDDFKAELERHNFYKCLTNLADGSIDLALIDADSLNTFLETPVVLAEGETLPAYSRYYRLPTDFREIEVALCIPGRGFILNSEGHPGRILKKDLTTLAQVWSVLLYSNLAPTSHTSNLSVDRARLIFGLVSHLDMNIEALISGQMTSIVQSNTSRLGFPALINALCRARGVVSDSLTFERLSLEAPTLASTSAAPFVPAQTNSQRFEAMLQSIHKGQIILLQSFQMIAPPDSIPSVELFNEMVALPGTQPYLHKEDEGPTTQVPQHMEDESSERFLNTREGLSLCGSDFGKGVLQREWKISSGLLEDWT

SEQ ID NO: 220588 - protein, 250 aa, Glycine max
  Coding DNA Sequence Number=SeqID_103810
  Pfam annotation: Domain name=GRP; Domain location=1-124; Score=-28.1; E_value=0.057; Accession=PF07172.2; Description=Glycine rich protein family
MEVHSNGVVVVFALCIALASCGSLVVGEVKDDKHLIHPPHLLGPGIIKRGFKRSGLGFGAGGGLGGGGGLGGGFGGGAGGGGGLGGGGGFGGGAGGGLGGGVGGGIGGGGGLGGGAGGGLGVGGGIGGGAGVGGGIGGGAGGGLGSGGGLGHGVGVGIGGGAGGGLGGGGGLGHGVGAGIGGGAGGGLGGGGGPGHGVGAGIGGGAGGGLGGGGGLGHGVGAGIGRGAGGGLGGRGGLAPCPYFWDLLGR

SEQ ID NO: 220589 - protein, 104 aa, Glycine max
  Coding DNA Sequence Number=SeqID_103811
MDDMPPHLALFWSAVLWIIDVGVEFFDHSDVDLLLQEFGKNLMPLSPLELSVKFIEHACGELHVPLRCLRSEARGIPGVFPPLVWALLGISVGSSKKIRNRTRF

SEQ ID NO: 220590 - protein, 116 aa, Glycine max
  Coding DNA Sequence Number=SeqID_103812
  Subcellular localization annotation: CTP_CleavageSite=51; ConfidenceScore=5.15e-01
MASIIVAICSIHGLLVGLHLFLHLLYFTHYSSSSTGSVPCSIIMSQPTLLRASEVRLTGASSKGGKCAESPPTFICGKHQKNRRKPVMKNIPDSGVVFTFEEGISTSHVCPKGQQP

SEQ ID NO: 220591 - protein, 143 aa, Glycine max
  Coding DNA Sequence Number=SeqID_103813
MVSFEHSWEVCIYQTFQRPKRPNIKHPLHNPNTKSSSTKTLWFGLEQRKEIFSSIRSDPEQVKVWFQSHPEFLKAADPETSVFLNQKSHLATFLAGSKSKEVLAKNLKEVLQMLQQEEKGSSSKKEETSSAEEEEEDPFFPNE

SEQ ID NO: 220592 - protein, 202 aa, Glycine max
  Coding DNA Sequence Number=SeqID_103814
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=3e-25, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MVHALAFRGLHVLVFRGLKVLAFRGLHALIFRGLHALTFRGLHVLAVRGLHTLTFRGLNVLTFRELRALTLRGLCVLAFRGLDVLAFRGLHDLTFRELHVLAFRGLNTLAFRGVHILTFRGLHVLAFRMLHALAFRGLHVLAFRGLQVLAFSGLHALAFRGLHVLTFRGLHALPFKGQHALALRGLQVLAFKGLCALAFRGL

SEQ ID NO: 220593 - protein, 154 aa, Glycine max
  Coding DNA Sequence Number=SeqID_103815
  Gene Ontology: Mol. function=copper ion binding; Cellular component =periplasmic space
  Homolog annotation: Hit_ID=Q1S4I6; Match level="QueryCoverage=93%, HitCoverage=18%, E-value=2e-68, Identity=84%"; Hit description =Copper amine oxidase
  Pfam annotation: Domain name=Cu_amine_oxidN3; Domain location=2-100; Score=155.5; E_value=1.4e-43; Accession=PF02728.6; Description =Copper amine oxidase, N3 domain
MEYAECEAVVKDFPPFREAMKKRGIEDMDLVMVDAWCVGYYNEADDPNRRLTKPLIFCRGESDSPMENGYARPVEGIYVLVDMQNMLVIEFEDRKFVPLPPVDPLRRYTHGETRGGFDRSDIKPLQIIQLEGPSFRVDGSYVAWQKVDVEFLLY

SEQ ID NO: 220594 - protein, 133 aa, Glycine max
  Coding DNA Sequence Number=SeqID_103816
  Homolog annotation: Hit_ID=Q9AVH2; Match level="QueryCoverage=35%, HitCoverage=16%, E-value=3e-20, Identity=97%"; Hit description =Putative senescence-associated protein
VDSRGSHGGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 220595 - protein, 118 aa, Glycine max
  Coding DNA Sequence Number=SeqID_103817
MAMTKYQWKIDDCVSKNRLIRLVELMGPRLRGLTELSCLSDLLCIEPSAIRWVNGGIDDGSSGGMMVVAATMMIEITKCDVVVVEAENVRCNDNGDYGDGGCGGMVIVKMTIMVWWWQ

SEQ ID NO: 220596 - protein, 98 aa, Glycine max
  Coding DNA Sequence Number=SeqID_103818
  Homolog annotation: Hit_ID=Q9FG37; Match level="QueryCoverage=49%, HitCoverage=5%, E-value=5e-09, Identity=67%"; Hit description=Gamma -tubulin interacting protein-like
  Subcellular localization annotation: CTP_CleavageSite=40; ConfidenceScore=5.58e-01
MARVSTVIASVNCFRLSLVTPPTPFFSSFPTPSTFSPTCMQEMKEKELKYANLEKRSAKERAWEEWSWEARRHLMELAMATASGATEGVRQLERIQRA

SEQ ID NO: 220597 - protein, 113 aa, Glycine max
  Coding DNA Sequence Number=SeqID_103819
  Gene Ontology: Mol. function=nucleoside-triphosphatase activity; Cellular component=membrane; Biological process=transport
  Homolog annotation: Hit_ID=Q9SVK5; Match level="QueryCoverage=97%, HitCoverage=23%, E-value=6e-32, Identity=62%"; Hit description =Putative mitochondrial protein
MDGLWFSGGEERIIIFTTNHRERIDPALLRPGRMDMHIHLSFLKGMAFQALASNYLGIEGYHPLFEQIKELLEKIEVTPAVVAEQLMRNEDPDVALEALVKFLKEMDKEKACI

SEQ ID NO: 220598 - protein, 165 aa, Glycine max
  Coding DNA Sequence Number=SeqID_103820
  Homolog annotation: Hit_ID=Q5NDD1; Match level="QueryCoverage=26%, HitCoverage=12%, E-value=3e-11, Identity=77%"; Hit description =Putative serine-threonine protein kinase
MVIDYQRVKTLCFASTPTIGKIINNQHNINSAPYGITSRALRCNLAFEMLHPSRVSLESGLNALYDFVNGGGDVWINEKCFRIVRQLGEGGFALMHPFKRYVEIGRVAQINYGKEYGRLVVIVDVIDQNRGKLPGNHITSETSKRVGLRPQKETTPENLVFHGFK

SEQ ID NO: 220599 - protein, 329 aa, Glycine max
  Coding DNA Sequence Number=SeqID_103821
  Gene Ontology: Mol. function=nucleoside-triphosphatase activity; Cellular component=membrane; Biological process=cell division
  Homolog annotation: Hit_ID=Q683K1; Match level="QueryCoverage=89%, HitCoverage=58%, E-value=2e-64, Identity=43%"; Hit description=AAA -type ATPase like protein
  Subcellular localization annotation: CTP_CleavageSite=49; ConfidenceScore=5.49e-01
MRSSYMQKNLSSSFPSASSSSWFEVYAAISTFMMLLRTSLNDLIPRQIRSFVISKLKSFFSERQLQHNHEVSLHINQFWDRQTNQLFQAAQEYLPDRITHSYRSLKVGKLMQHKNIVVALDGKQEVVDQFEDIKLLEWKLVESSKEDSDHHPKSNEKHSLTLTFDEKHREKIMNKYIPHVLSTYQAMQVAKRTIKIHSMGGGSRHCWQKSELTHPASFNTLALDFQQKHAIIDDLDRFLRRKELYKTVGKPWKRGYLLYGPPGTGKSSLVAAMANYLKFDVYDLELSSLCSSSGIMRALRDTSNRSIAVIEDIDCNRRGVRSINNKGIR

SEQ ID NO: 220600 - protein, 96 aa, Glycine max
  Coding DNA Sequence Number=SeqID_103822
MARRDKLWSFCAFCHPEAMSPMTCRDKLWSFRTPFRHLETIDSDDMQRQIMVTLRLLSSRGGKLDDMRRYLMVIPRLSSTERNEFGSIRMMLVVRC

SEQ ID NO: 220601 - protein, 92 aa, Glycine max
  Coding DNA Sequence Number=SeqID_103823
MGAKHLTRTKERSHVIKQRSPDEIRGADNRKVSPRVTRSWVMVTKSDLKKSPPEDAYIFGKGADDHIGLRLSITLEVRITVRCLRRLPALGS

SEQ ID NO: 220602 - protein, 177 aa, Glycine max
  Coding DNA Sequence Number=SeqID_103824
MGFVMNALSAPVALSLFITTAKRALCAKPECLSVEAELSAWERYTDIVVPQFYEFKEELERRHWDEKLTDFLDGNIDVAIVKEFYANLYDPEDKSPKQVRVRGHLIKFDEDTLNTFLKTNVLEEGETLCAYFRVALLRPNPQELAVKLCIPGRGFELNANGYPLKILRKNMTTVAQT

SEQ ID NO: 220603 - protein, 54 aa, Glycine max
  Coding DNA Sequence Number=SeqID_103825
PSPTRTLSTRHALSVQASTGTKRGVKHEDAGFITRAKCEPRAKRTIQQKHTLSL

SEQ ID NO: 220604 - protein, 131 aa, Glycine max
  Coding DNA Sequence Number=SeqID_103826
  Gene Ontology: Mol. function=protein binding; Cellular component =membrane; Biological process=defense response
  Homolog annotation: Hit_ID=Q1SW22; Match level="QueryCoverage=93%, HitCoverage=15%, E-value=2e-26, Identity=45%"; Hit description =Disease resistance protein; AAA ATPase
MESLTEEVRNRLRNKRYVVLFDDIWSETFWDHIESAVMDNKNGSRILITTRDEKVAGYCKKSSFVEAFQYSSDGDCPEELKDISLEIVRKCKGLPLAIVAIGGLLSQKDESAPEWGQFSRDLSLDIHGEEF

SEQ ID NO: 220605 - protein, 143 aa, Glycine max
  Coding DNA Sequence Number=SeqID_103827
  Gene Ontology: Mol. function=oxidoreductase activity; Cellular component=periplasmic space
  Homolog annotation: Hit_ID=P31545; Match level="QueryCoverage=97%, HitCoverage=33%, E-value=6e-64, Identity=80%"; Hit description =Hypothetical protein ycdB precursor
  Pfam annotation: Domain name=Dyp_perox; Domain location=1-131; Score=- 32.6; E_value=4.3e-11; Accession=PF04261.3; Description=Dyp-type peroxidase family
MWDRTPLGEQQTIFGREKLSGAPLGMQHEHDVPDYARDPDGEIIALDAHIRLANPRTPQTDSSLMLRRGYSYSSGITGAGQLDMGLLFVCYQHDLSKGFITVQKRLNGEALEEYIRPIGGGYFFVLPGVADKNHYLGQPLLEA

SEQ ID NO: 220606 - protein, 131 aa, Glycine max
  Coding DNA Sequence Number=SeqID_103828
MPPTRHPLDPDKSNKALGFPALITGLCQSFRVPVTPSKATDAPPPPHQADPAGSFGMERYLQHLVRQQAANHRGQVQTHECLYQLSLSLQSQGFAPFPCPTLDQFRAEVAWPGDWPEDQTEEASAEAPGDP

SEQ ID NO: 220607 - protein, 210 aa, Glycine max
  Coding DNA Sequence Number=SeqID_103829
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=100%, E-value=8e-37, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVHIFRELHALAFRGLHALAFIGLHVLAFKGIHLLAIRGVHVLILRGLHALTFRGLRLLSIRGIHVLTFRGLHVLTLRGLQALAFVGLHAQAFRGLHVLAIRGLHVLALRGLHVLTFKGLHTLTFRGQHVLAFRGIHVLTCRGLHVIPFRGIQALASIGLHALTFRGLHILAFRGLHGLPFKWLHVLTFRGLHLLAYRGLFILPFKGLH

SEQ ID NO: 220608 - protein, 242 aa, Glycine max
  Coding DNA Sequence Number=SeqID_103830
  Homolog annotation: Hit_ID=Q1SDS1; Match level="QueryCoverage=48%, HitCoverage=23%, E-value=2e-11, Identity=32%"; Hit description=IMP dehydrogenase/GMP reductase
MPTHYVWLVSHVLHHEGRPVCPLQGHHMCAEKGKANWNELLAGMLGASVSWFPRWKEGGAGVLCSCEGFPNIPLMGTRGGINYNPMLAIRQLGYPMRGAPSEETIVPFVARGFIEGNAKILQRICKAWSIVERKDKELRGSSNDVIGGYHKWLKARTQGVTWLSKLKDPSGKEAEVLKENEEVQALKVELERTSVVKEKLKTIVTRVQKECDKLRDVNMTMDEALEWETKRARKEEWGRNKF

SEQ ID NO: 220609 - protein, 107 aa, Glycine max
  Coding DNA Sequence Number=SeqID_103831
MHCEPDLGSLSEEVTSESMIRTVKANSAKVVSISGTTINRFLGIATRNIQGHLCYKQNQVENQGKSEVDKTRKGRTHPRIFSKVQQRSKGDHQHSLRHHPDASKRWS

SEQ ID NO: 220610 - protein, 335 aa, Glycine max
  Coding DNA Sequence Number=SeqID_103832
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=6e-49, Identity=32%"; Hit description= UPI00006A17C9 related cluster
RANALAIRRLHVLAKRGLHALTFRGLHALAKRGLHILTIRGLHALTIRGLHVLTFRWLHVFTFRGLHVLAIRGLHVLAFRGLHVLLFRGLHVLANRGLHVLAKRGLHALTFRGLHVLASRGLHVLAIKGLHALAIRGLHVLAKRVLHALTFRGLHALAFRGLHALSFRGLHVLAIRGLHVLAFKGLHVLPFIGLHVLAIRGLHILAKRGLHALTFRGLHAFAFSGLHVLTIRGLHVLTFKGLHVLPFKGLHVLAKRGLHALTFRGLHALTFRGLHALAFRGQHILTIRGLHVLTFKGLHVLTFRGLHALAFRGLRVLTFSGLHIRTLREFKVLCP

SEQ ID NO: 220611 - protein, 59 aa, Glycine max
  Coding DNA Sequence Number=SeqID_103833
MASVDFFFKSDFKNSECSKHMMGDVSKFTTISPKKGGHVTYGNNNISKISKEVTSKSSL

SEQ ID NO: 220612 - protein, 42 aa, Glycine max
  Coding DNA Sequence Number=SeqID_103834
MVKKWGIKPKRNNYITVDELKETSKALATCTYEEGTQWGEEV

SEQ ID NO: 220613 - protein, 100 aa, Glycine max
  Coding DNA Sequence Number=SeqID_103835
MKLYLEKVRSTTYSMLPLEAMNIHYHVRSSHESYPGKNNGWIFSQKWETDTSIVRKARTLSIFIQETTLKIRLPIGQFRDISLSVSQGTHPLPGWVGLLK

SEQ ID NO: 220614 - protein, 122 aa, Glycine max
  Coding DNA Sequence Number=SeqID_103836
MERDGGFDDVGAENDESFVVFFGEGSVCHARRRRSKLLKVYLTKEDQSNKHNTTGRVRMRVREQEWELQRRKESKTERPNRSERNKEFGLKTFSYKRLNNISFKIRMMVLKSNRCYSRETQH

SEQ ID NO: 220615 - protein, 410 aa, Glycine max
  Coding DNA Sequence Number=SeqID_103837
  Gene Ontology: Mol. function=kinase activity; Cellular component =nucleus; Biological process=regulation of progression through cell cycle
  Homolog annotation: Hit_ID=Q39878; Match level="QueryCoverage=91%, HitCoverage=96%, E-value=1e-121, Identity=55%"; Hit description =Mitotic cyclin a2-type
  Pfam annotation: Domain name=Cyclin_C; Domain location=265-392; Score= 155.2; E_value=1.7e-43; Accession=PF02984.9; Description=Cyclin, C -terminal domain
  Pfam annotation: Domain name=Cyclin_N; Domain location=187-315; Score= 125.7; E_value=1.3e-34; Accession=PF00134.13; Description=Cyclin, N -terminal domain
  Pfam module annotation: Pfam domain module=Cyclin_C::Cyclin_N; Domain location=265-392::187-315
MDRENAVMGGVREGEERGVRVTRAMARAALGWVSASSRPSFKKECKNNSRTALADVSNISRKSQARGGYKKTNTKGSSNVSIQVLSTQEDVRAELAKDLSTISMVQTHDAIVERPEDTELVQPSMSVMAGPLLSMQNSMKSDEILSPPNKDIDMITEKLKLSERLGIVDIDSVELKDPQVWSSYAPDIYNNIFVREFERRPLSDYMDKLQQDITPSMRGILIDWLVEVSEEYKLVPDTLYLTVNLIDRFLSQSLVQKQRLQLLGVTCMLIASRFILAAQSSYKVSYVELEFLANYLAELTLVEYSFLQFLPSLIAASAVLIARWTLNQSEHPWNSTMEHYTNYKVSELKTTVLALADLQLDTKGCSLNAIREKYKQQKFKSVANLSPKPVQSLFEAQVKTVNDAYVKTKY

SEQ ID NO: 220616 - protein, 58 aa, Glycine max
  Coding DNA Sequence Number=SeqID_103838
MVRTRGHGAGTCGGEALELDVDEDVARARKLEMGGGGTRWQRRRRTRWSQEAPKYLNL

SEQ ID NO: 220617 - protein, 265 aa, Glycine max
  Coding DNA Sequence Number=SeqID_103839
  Gene Ontology: Mol. function=zinc ion binding; Cellular component =COPII vesicle coat; Biological process=ER to Golgi vesicle-mediated transport
  Homolog annotation: Hit_ID=Q9LUG1; Match level="QueryCoverage=54%, HitCoverage=19%, E-value=6e-29, Identity=49%"; Hit description =Protein transport protein Sec23
  Pfam annotation: Domain name=Sec23_trunk; Domain location=63-250; Score=-70.9; E_value=1.3e-06; Accession=PF04811.5; Description =Sec23Sec24 trunk domain
  Subcellular localization annotation: CTP_CleavageSite=33; ConfidenceScore=5.40e-01
MIFRKSPLKCLTSSHLLRVSLRPLSLALRLKVSSGTVEGFQCCCRRCLVSSLKLFSGEEPPEKKVPHTIENTRELDEIVCKPADDKVSNNALVGFVSFEAQVQVYVFRDSKEIPVEQILDQLGLSASGKRPHKGVAPSVAGAGGFPNSGITCFLLPATECEYTLNALLDELQTDQWSVLHGRHPAHYTGVAFSVFAGLPSACNPGTSARIIALQLKGYSTIIKLCVRNVLMQSYPPRVLDRRLQEAWARATKEGPRVLMNLRVDF

SEQ ID NO: 220618 - protein, 108 aa, Glycine max
  Coding DNA Sequence Number=SeqID_103840
  Homolog annotation: Hit_ID=Q1S4E1; Match level="QueryCoverage=66%, HitCoverage=7%, E-value=4e-26, Identity=76%"; Hit description=Citron- like; WD40-like
MEKREGKRNESALLSCRKMQTRFCLAKQRNPQRWSQQKRLAPLALVMTAMVSKKGSLWNAMDSEIEMRKSRDSTTVIESTGFFTRLLDRSIYPVPTFTHQRQSISVTV

SEQ ID NO: 220619 - protein, 96 aa, Glycine max
  Coding DNA Sequence Number=SeqID_103841
  Subcellular localization annotation: CTP_CleavageSite=35; ConfidenceScore=5.54e-01
MQRLTQSSAPFVPPGTTKSFTCGNFMVTRDSRQPRGAKLVSYTDFRGPLLDDMRPFFGPCEVLGIHHQAICEILGTTSHGHPRLSSTERSEISVIH

SEQ ID NO: 220620 - protein, 216 aa, Glycine max
  Coding DNA Sequence Number=SeqID_103842
MGDPISRLSFPENTETFSSLTSYPELRRSEFLIGGYVGAKASLLSTAPLSVTMTQELRPMLSSAPFPEMSAFSDGDFSSLTSYPELRHVTCTLVSSGGGGPDDTRRYLTVIRTLLSSRGGGPDDKQRPKTKFGHSAPLYHPEAAGPMIRGDTLRFSAPFCHPEAAGPMTSRDQVWSFCTLVSSRGSGPDDTRRYLTVIRTLLSSRGGGPDDKQRPN

SEQ ID NO: 220621 - protein, 721 aa, Glycine max
  Coding DNA Sequence Number=SeqID_103843
  Gene Ontology: Mol. function=RNA-directed DNA polymerase activity; Cellular component=chromatin; Biological process=chromatin assembly or disassembly
  Pfam annotation: Domain name=RVP_2; Domain location=306-440; Score= -38.9; E_value=0.0011; Accession=PF08284.2; Description=Retroviral aspartyl protease
  Pfam module annotation: Pfam domain module=RVP_2::RVT_1; Domain location=306-440::491-660
MLDSHPHDTSPRSLEDILLRLGDTMNTVTLKLDEILHHLSPSSSSPNPQPTPIQPQPNPAPATLHKMKLEVLRFDGTEPLGWIFKINQYFEYHGTPERDRLTIASFYMEGRALAWFQWMTSNAQFTSWLGFLQALQTRFTPSQYEDPTGLSLEIRREVQALQPLTLVQAAGLARLQEEKLANIRPPPRPRPPPPPPVPPHTNLNPHPHNPRSPSLPPLLPAPPRQPPPVMKHLSQEEITSRRERGLCFNCDERYHRGHRCASSVFLLITEEEDPPLVNIDPNDPQPNTIPDPPDGTDPYSAHISLHSLSGHLVPETLRFEGVIHAHPLVLLVDGGSTHNFVQQQLVSRLGLPCRSTPPLRVMVGNGHHLECTIICEAVSISIKNIEFSVDLYVLPIAGANIVLGVQWLKTLGPILTDYNSLSMQIFYQHRLVQLKGERTSTDPGNRSSHTLVTPIRTRECAPYRYPHYQKNDIEHQVNLMLQKGLIQPSTSPFSSPVLLVRKHDGSRRFCVDYRALNAVMVRDRFPIPTIDELLDELGGAQYFSKLDLLQGYHQIRMHGPDIPKTTFRTHHGHYEFKVMSFGLCNAPSSFQATMNNIFWQYLRHFIIVFFDDILIYSNSFEAHLQHLTTAFQVEYLGHMVSKKGVEPIALKVEAILQWPIPQSSRAVRGFLGLTGFYRRFIKGYATIVAPLVKLTTKEPFQWTPQAQSAFEHLKTALSTTH

SEQ ID NO: 220622 - protein, 397 aa, Glycine max
  Coding DNA Sequence Number=SeqID_103844
  Gene Ontology: Mol. function=nucleic acid binding
  Homolog annotation: Hit_ID=Q1T493; Match level="QueryCoverage=90%, HitCoverage=75%, E-value=3e-36, Identity=27%"; Hit description =Nucleic acid-binding, OB-fold, subgroup
  Pfam annotation: Domain name=DUF223; Domain location=43-138; Score= -10.6; E_value=0.028; Accession=PF02721.5; Description=Domain of unknown function DUF223
MQNYGSTPDKIKFIDGSRETLKLAVRITDLWFVGTPNKSEQAEMVIVDSNGDEIHVVCKTDRLKSWKADLKENCTYVMHNFKVMKNDGQFRVYEHQYKLVFTGVSVVRQSNLDHLPFKEFKFVEFSNVIASDFEAGLLVDIIGVVDEVLFCHVSSKNTRVVFKIKDLSGQVLSYTLCENYCLQFLAYLNETENDGPMVIILTHARIKEGQGKSDVIFASCGSYPPSVSNSLKASKLLINEPVLEIQEFSERLSDLGIEVRLVLTPRGQGTCIQCHRKTDIEATPFTCGCGKYNDQPVLRYRLKVMVKHKDESTKFLLRDRECAELIGQSANEVNRVKIEERDVDLNASPQALDRLLGYVLTFKVKACSKVDSPNLDCNDAPQVESLSFDRPVAKLWN

SEQ ID NO: 220623 - protein, 48 aa, Glycine max
  Coding DNA Sequence Number=SeqID_103845
MDNWRTALRNNFAGLQTRREWRIGEQRYTITSRGSRLEGGGHMNSARQ

SEQ ID NO: 220624 - protein, 165 aa, Glycine max
  Coding DNA Sequence Number=SeqID_103846
  Gene Ontology: Mol. function=hydrolase activity; Cellular component =nucleus; Biological process=response to DNA damage stimulus
  Homolog annotation: Hit_ID=Q8LQQ4; Match level="QueryCoverage=99%, HitCoverage=38%, E-value=1e-41, Identity=51%"; Hit description=DNA cross-link repair 1B-like protein
MARRKIVDRIGVGIVKVNNVNSGNVPERVAKHVPGLGCSLARGFPPEVAGVEDAAEVAAEKEHDGTCWKKKGELERLPTGAVTGVHDGDVEGEGGEGDGVGGAGVEDAEEGEVETGELEGEEFGGDGGAEEGGVVPGGGEAVGVVGVEVGEEVRFASLCPTVYGD

SEQ ID NO: 220625 - protein, 80 aa, Glycine max
  Coding DNA Sequence Number=SeqID_103847
MMPRSGEGLLHQPVDSDNNWLFWRTLLRPRRNWSTSRQKHLFMKVLLMLKERPELKLSSHGRKVTKIGRPAPEIEGLVMA

SEQ ID NO: 220626 - protein, 229 aa, Glycine max
  Coding DNA Sequence Number=SeqID_103848
  Homolog annotation: Hit_ID=Q8LQQ4; Match level="QueryCoverage=67%, HitCoverage=37%, E-value=1e-30, Identity=44%"; Hit description=DNA cross-link repair 1B-like protein
  Pfam annotation: Domain name=DRMBL; Domain location=9-132; Score =103.8; E_value=5e-28; Accession=PF07522.4; Description=DNA repair metallo-beta-lactamase
MHLLGYDDIFTTNTSLTRVRAVPVYSFSINTVEELNYVCPTIGIMPSGLPWIKKSHQKNELQTGSFLTSRYKRGKLSANTETQIDKQIVKTGSPEKIHKYIYTVPYSDHSNYEEIEDFVKLVKPTTLKGIVSSSSCYIEPMYYFGRLCPGNQQTDQVHEGCKGKENGKREREEAVRSKTLFEGDNFETGRDRGKALKGRFSGVHVSRLSILRKKRRGAKIQEHDDSSES

SEQ ID NO: 220627 - protein, 800 aa, Glycine max
  Coding DNA Sequence Number=SeqID_103849
  Gene Ontology: Mol. function=protein binding
  Homolog annotation: Hit_ID=Q7XAK8; Match level="QueryCoverage=38%, HitCoverage=39%, E-value=5e-89, Identity=59%"; Hit description =Protein phosphatase regulatory subunit-like protein
  Pfam annotation: Domain name=LRR_1; Domain location=534-553; Score =7.3; E_value=12; Accession=PF00560.23; Description=Leucine Rich Repeat
  Pfam annotation: Domain name=LRR_1; Domain location=556-576; Score =11.2; E_value=2.2; Accession=PF00560.23; Description=Leucine Rich Repeat
  Pfam annotation: Domain name=LRR_1; Domain location=578-599; Score =13.1; E_value=1; Accession=PF00560.23; Description=Leucine Rich Repeat
  Pfam annotation: Domain name=LRR_1; Domain location=601-621; Score =13.3; E_value=0.89; Accession=PF00560.23; Description=Leucine Rich Repeat
  Pfam annotation: Domain name=LRR_1; Domain location=623-643; Score =7.4; E_value=12; Accession=PF00560.23; Description=Leucine Rich Repeat
  Pfam module annotation: Pfam domain module=LRR_1::LRR_1::LRR_1::LRR _1::LRR_1; Domain location=534-553::556-576::578-599::601-621::623-643
MEGASLVPWWRSLAGQGNGRRRRSSFSIQQCSFFHSFKEDCISYAYLSLDSAGCKGISFTLAAITKSNYSRTSRRWACRLIMAKGGFFLCCQKLFLKVVFRCSCLRHCIAAMFRFSCFHANVQGNKAKKTVQPSSEAMVKGLQDVTENHGCKDSSNLPCAYSSPSKEQAHKQINVMENHSNWDSVGRSCRSEDLNSKFSFENDNNVHQTRHIKKSQSLQSGLDQGIREADEDLGLSCDGAKSQNESTISISRRYHDANPIDQYGNNPNVEFQVSSGLANDGSLFSIGDPMPSDKDAHEISDTPLSVEFAGDIPDQTFVPGSLFLRKSRSLPNIRASILSSERDAFKHALSRSSDDLHALRMWQKEEFINEFDDQIRADQERENDMGKPEDGRMDSFFDDGFDSYLLSGSAKDWVMPITDDTSNVKTLQGDSLVDCAGEFPKKDFKIKRIEDWVIGLQHCGPPLEETNEDLPEVIEPLIDVNTVNGVTAASVNHKVTPGMEAAKRYISSLSANATAAQLGNHGLVVIPFLSAFVSLKVLNLAGNAIVRITAGALPRGLHALNLSRNKISTIEGLRELTRLRVLDLSYNRILRIGHGLASCSSLKELYLAGNKISEVEGLHRLLKLSILDLRFNKISTAKCLGQLAANYNTLQAINLDGNPAQKNVGDEQMKKYLQGLLPHLVYYNRQPMKVNSLKDGAERSVRLGMNSHQFDRSLRADRKTTRKGSQGVAATRRPSTASTHARRSVDSPKLSKGKQTLLPPTRTKVSTQSRYHFDSPSKVLNLVSERSMRKSRSEGNFGVL

SEQ ID NO: 220628 - protein, 67 aa, Glycine max
  Coding DNA Sequence Number=SeqID_103850
MVLSGFNEEGAGASQGSRGVRLDEMRWVKEPRRCWGWGREVLSLRVIWSLPNCLEGAGFTSLRSGIH

SEQ ID NO: 220629 - protein, 829 aa, Glycine max
  Coding DNA Sequence Number=SeqID_103851
  Gene Ontology: Mol. function=protein serine/threonine kinase activity; Cellular component=cell surface; Biological process =protein amino acid phosphorylation
  Homolog annotation: Hit_ID=O64477; Match level="QueryCoverage=94%, HitCoverage=95%, E-value=0.0, Identity=58%"; Hit description =Putative receptor-like protein kinase
  Pfam annotation: Domain name=B_lectin; Domain location=75-189; Score =140.6; E_value=4.3e-39; Accession=PF01453.15; Description=D-mannose binding lectin
  Pfam annotation: Domain name=PAN_1; Domain location=346-422; Score =14.8; E_value=0.0053; Accession=PF00024.16; Description=PAN domain
  Pfam annotation: Domain name=PAN_2; Domain location=346-412; Score =103.8; E_value=4.9e-28; Accession=PF08276.2; Description=PAN-like domain
  Pfam annotation: Domain name=Pkinase; Domain location=497-768; Score =168.6; E_value=1.6e-47; Accession=PF00069.15; Description=Protein kinase domain
  Pfam annotation: Domain name=Pkinase_Tyr; Domain location=498-768; Score=84.3; E_value=3.7e-22; Accession=PF07714.7; Description =Protein tyrosine kinase
  Pfam annotation: Domain name=S_locus_glycop; Domain location=204-329; Score=187.7; E_value=2.9e-53; Accession=PF00954.11; Description=S -locus glycoprotein family
  Pfam module annotation: Pfam domain module=B_lectin::PAN_1::PAN _2::Pkinase::Pkinase_Tyr::S_locus_glycop; Domain location=75-189::346- 422::346-412::497-768::498-768::204-329
MRNNKPQLWLSLSLIITCFSFHTSLAALTTISANQSLSGDETLVSQHGNFELGFFNTGNNSNKFYIGMWYKKISQRTYVWVANRDQPVSDKNSAKLTILEGNLVLLDQSQNLVWSTNLSSPSSGSAVAVLLDTGNLILSNRANASVSDAMWQSFDHPTDTWLPGGKIKLDKKTKKPQYLTSWKNREDPAPGLFSLELDPAGSNAYLILWNKSEQYWTSGAWNGQIFSLVPEMRLNYIYNFTFQSNENESYFTYSMYNSSIISRFVMDGSGQIKQLSWLENAQQWNLFWSQPRQQCEVYAFCGGFGSCTENAMPYCNCLNGYEPKSQSDWNLTDYSGGCVKKTKFQCENPNSSDKEKDRFLPILNMKLPNHSQSIGAGTVGECEAKCLSNCSCTAYAHDNSGCSIWHGDLLNLQQLTQDDNSGQTLFLRLAASEFDDSNSNKGTVIGAVAGAVGGVVVLLILFVFVMLRRRKRHVGTRTSVEGSLMAFGYRDLQNATKNFSEKLGGGGFGSVFKGTLPDSSVVAVKKLESISQGEKQFRTEVSTIGTVQHVNLVRLRGFCSEGTKKLLVYDYMPNGSLESKIFHEDSSKVLLDWKVRYQIALGTARGLTYLHEKCRDCIIHCDVKPENILLDADFIPKVADFGLAKLVGRDFSRVLTTMRGTRGYLAPEWISGVAITAKADVYSYGMMLFEFVSGRRNSEASEDGQVRFFPTIAANMMHQGGNVLSLLDPRLEENADIEEVTRVIKVASWCVQDDESHRPSMGQVVQILEGFLDVTLPPIPRTLQAFVDNHENVVFFTDSSSTQTSQVKSNASAASSQAKSNISSSNSST

SEQ ID NO: 220630 - protein, 163 aa, Glycine max
  Coding DNA Sequence Number=SeqID_103852
MIMVLISRKECNQQCVATYPSAEGKHKAHGCIFQGRKTHGVATNVYLRKTLEKPKSGSTNFKNKRFGSCLHTGKKNRGRRLQHSSPRRVGCFILKFSNGPRWAQGLRNAPKLTILPPFCVFYSFPSETSQNPTDYATIGVNQLNLAGKNPHVDKQLPPDKIRV

SEQ ID NO: 220631 - protein, 80 aa, Glycine max
  Coding DNA Sequence Number=SeqID_103853
MVTDKVLNKHKSKGIITGNIITAIVSSRAAQGKNSKNEDTIIGASKTTPFLNVSSPTSYPMKKKHVKRRAKQVGSPLAEH

SEQ ID NO: 220632 - protein, 136 aa, Glycine max
  Coding DNA Sequence Number=SeqID_103854
  Subcellular localization annotation: CTP_CleavageSite=22; ConfidenceScore=5.53e-01
MLPVTTSGKCNNLMPAVYYLTSCNTPKPSLSSKFCLSSFEKKHQLHAILKMSTTSSTTSSRVSSQVAEGKNNKGELNEKINYTGSGDRSVLQPWYDFLIESDFDHGDEVSFYYQRHEKNWEIVIKRQKDWGDSDTD

SEQ ID NO: 220633 - protein, 390 aa, Glycine max
  Coding DNA Sequence Number=SeqID_103855
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=P26205; Match level="QueryCoverage=56%, HitCoverage=60%, E-value=9e-73, Identity=56%"; Hit description =Cyanogenic beta-glucosidase precursor
  Pfam annotation: Domain name=Glyco_hydro_1; Domain location=1-310; Score=-50.6; E_value=3.7e-16; Accession=PF00232.9; Description =Glycosyl hydrolase family 1
MKYMNLDAYRFSISWSRVLPKGKLSAGVNHEGVNYYNNLINELMANGLQPYVSLFHWDVPQALEDEYGGFLSPHIVVKHWITLNEPRSVSKNGYANGRFAPGRCSDWLKLNCTGSDSRIEPYLTLHYQLLAHAATAKLYKTKYQEIRKECFNTSYGLHLHFWLGIWTHSQKVSIQKPCDLCWETGYEFSKEEARQLKGSFDFLGLNYYSSFYAAYAPHQPYMKTYCNACDREVTPWFADFHSQNEQSRCQKLEEIDIQPLKVVETKSTVQAPSKRTEGDHSTPVEYRDHSFEMVPFAICWLKDFVGAIGESTISKSSIDPFPIASVKSGEDLLDDLETEDRRDKCCEAYSGDSVYELNEVAAAKGCLGHFPRGEMMGIIKKFINLDAGTD

SEQ ID NO: 220634 - protein, 89 aa, Glycine max
  Coding DNA Sequence Number=SeqID_103856
MQALPLEAEWVQHVVLVKPSAKIKETRLREIECKDIELQVTGAKGVEGKDHLVSLNLEEVNKSEMKQWKSLGNGETTMQDEIEREMKRE

SEQ ID NO: 220635 - protein, 93 aa, Glycine max
  Coding DNA Sequence Number=SeqID_103857
MEEKEAEMNRLKHNAKGTPSPAFYRGRKVGNGLSKDYKAQKGFKFEPLSFLGDQGFDFLGFMWNHLSWVMEAVTIMAIALANGGNPAGMTLVS

SEQ ID NO: 220636 - protein, 753 aa, Glycine max
  Coding DNA Sequence Number=SeqID_103858
  Gene Ontology: Mol. function=DNA binding; Cellular component =chromatin; Biological process=DNA integration
  Homolog annotation: Hit_ID=Q1T2A5; Match level="QueryCoverage=74%, HitCoverage=80%, E-value=2e-94, Identity=41%"; Hit description =Integrase, catalytic region
  Pfam annotation: Domain name=zf-CCHC; Domain location=44-61; Score =13.1; E_value=0.0068; Accession=PF00098.13; Description=Zinc knuckle
  Pfam annotation: Domain name=zf-CCHC; Domain location=82-99; Score =11.9; E_value=0.011; Accession=PF00098.13; Description=Zinc knuckle
  Pfam module annotation: Pfam domain module=RVT_2::zf-CCHC::zf-CCHC; Domain location=389-593::44-61::82-99
MDPFPTISKIFSYVAQQERQLLGNNLMTGINLEPKGSLINVVKSTCDFCGQTGHTENVCYKKHGLPSNYDGRSKGSSIKSGKTCTHCGKSGHTVDVCYRKHGFPPRYKFSNTRNTANSIVTVDGKVTDDKTQHHESQEVHFSPEQYKALLALIQQPSHGNSVSTSSNVKQVASISSCSTDSASIMGKPLPSANLAHNFWCFALLHAAYLINCIPTPFLRNISPYEKLHGDPCDISNLRVFGCLCYISTLKAHRQKLDPRAHPCIFLGFKPHTKGYVVYDMHSHNITAPCHCPSHMISPFFSLSLHLLLPHPYPLTTLTFPNPCPHDARPEINTFLPIFTIIIVFSLQRLLLPRPTFGILSTQFYLILVFLLLIVIPLCPFLFLPNSLLMLKLLVMIVYKIKYKVDGSIERYKARLVAKGYTQMEGLDFLDTFSRVAKLTTVHFLLALAALNGWHLQQLDVNNVFLHGELHKEQASRQWFTPLSSFLISHGFQQAAADHSLFLSFTGNSTTVLLVYVDDIVLTRNNIDVIRHITTLLDHTFKIKDLGILKYFLGLEVALSQHGIHLCQQKYTLDILSDSGMLGSRPNTTPMDYVTRLHATLEDTLSTEASSSYRRLVGRLIYLTNTRPDIAHAGTLGSGIFFSAKGSLQLKAFNDSNWASCRDSHRSITETIYGVSQFLRSRVSSFSLNNLRDAVAHVFHEHTKHIDLDCHIVREKVQRGLIKLLPVSSSMQLVDIFTKALPPSMFKNLCFKLR

SEQ ID NO: 220637 - protein, 39 aa, Glycine max
  Coding DNA Sequence Number=SeqID_103859
MAAGCQIVTGRYWRAKADHFGCVPVCLIECTMEGHKTTL

SEQ ID NO: 220638 - protein, 85 aa, Glycine max
  Coding DNA Sequence Number=SeqID_103860
  Homolog annotation: Hit_ID=Q1SI48; Match level="QueryCoverage=44%, HitCoverage=7%, E-value=3e-11, Identity=84%"; Hit description=AMP -dependent synthetase and ligase
MKDLAHLLTPHQKPIEAPCIIIVSSMTLSKICARGRYDRYTSFSFNCKQEKGGKFVQEAEKTKTGNVSQSKHALNVHIVIADVAK

SEQ ID NO: 220639 - protein, 68 aa, Glycine max
  Coding DNA Sequence Number=SeqID_103861
MIHEKFATTKSVGTYPWEIFDGNSVGKDLWEIFEKTPSKSVLGKFSTENISLKLPTEIASRKFPTDYF

SEQ ID NO: 220640 - protein, 225 aa, Glycine max
  Coding DNA Sequence Number=SeqID_103862
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=100%, E-value=2e-23, Identity=24%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHALTFRGLHVLTFRGLQILTFRGLHVLVFRGLLALAFKGLQVLAIRGLHALTIRGLHVLAFRGLHVLTLRGLHVLVFRGLLALAFKGLHVLAIRGLHALTFKGLHVLAIRGMHALTFRGLHVLAISGLDALTFRELHGYTPSPSEDYMSSPSEGYMPSPLEDYASSPSDGLYALSFRGLQALAFKGRHVLDFRGLHTLTFRGLRILTFRGLHICAFREIKALCP

SEQ ID NO: 220641 - protein, 233 aa, Glycine max
  Coding DNA Sequence Number=SeqID_103863
  Gene Ontology: Mol. function=DNA binding; Cellular component=nucleus; Biological process=regulation of transcription
  Homolog annotation: Hit_ID=Q0PJC1; Match level="QueryCoverage=62%, HitCoverage=94%, E-value=3e-56, Identity=65%"; Hit description=MYB transcription factor MYB122
  Pfam annotation: Domain name=Myb_DNA-binding; Domain location=14-61; Score=49.1; E_value=1.5e-11; Accession=PF00249.21; Description=Myb -like DNA-binding domain
  Pfam annotation: Domain name=Myb_DNA-binding; Domain location=67-112; Score=55.7; E_value=1.5e-13; Accession=PF00249.21; Description=Myb -like DNA-binding domain
  Pfam module annotation: Pfam domain module=Myb_DNA-binding::Myb_DNA -binding; Domain location=14-61::67-112
MVRTPSCDKNGLKKGTWTAEEDKKLVDYITRYGHWNWRLLPKFAGLARCGKSCRLRWLNYLRPNLKRGNYTEEEEETIIKLHRRLGNRWSTIAARMPGRTDNEIKNHWHTNLKKRSQQHNSVATESQISNSNDQSPTEPTEDTAFQNFNSATQDCSPLSQHSSSSTSTECTTVASTENLLLLEDEFAFWDADTDLVSGNFWLEPYMLDISYLPASEPEYFSQVFDVELWSHDT

SEQ ID NO: 220642 - protein, 660 aa, Glycine max
  Coding DNA Sequence Number=SeqID_103864
  Pfam annotation: Domain name=Transposase_23; Domain location=324-394; Score=-12.9; E_value=0.03; Accession=PF03017.5; Description=TNP1ENSPM transposase
  Subcellular localization annotation: CTP_CleavageSite=36; ConfidenceScore=5.79e-01
MASPPASSPPSPPLPPPPSAPSDVSASPSAVKRTHKASRLRSLSTRPPGVERPVVHVNPVIGKADGPHRKKLRTYLGIVARDKVDVTYENWKEVPTAQKDLIWKDIQDVRKKAQAIQKQNTASHVLSRGGYDYLEQKQNTAQSGNVDGVIDPPSPVRCHVKWKMARTKKIGEMTTEAPKEIAEKIDSFEEQATQGSFVPHGRQDVLTAAIGCLEHPGRVCAAGAGVTIKQYFGSAPRTSRSSSSLPPEELQQLTQQIRDQLEESITEKVARQLMASFSQMQSQIQSQMQSQGLALPPEPLVGPSGPRVSTKGSCVDPSGNDPETGDSDRFGLYIKADPARLVALGRVYEGSTIVHNTPLLPGQVMVSVEEVTDADAPISVPTDEFSLMGHTLHTFLAWPTHLVKSLSQHVAVSPAKPPPKPDPEVDDPLYLMTLTIPELFLRPYQVTWDATVFGVFNPNFPLYIKHEDLSKIAHGGQCLNILVHLTDTSMPAGNSDIYGLLKPQSIQRSGQSQFESKSYIKTWMQSSKCDAYLGAYLNSEHWQMVVILPREHLVVWFCSLHNRPDNYLKGIINSALKGLDDAPQPKSKAHARWIVVKCNRQKESTECDYYVMHWMSTIILGTFRNNWEAYFNDARPLEPERLKALQIQWAQYYLRVRDQT

SEQ ID NO: 220643 - protein, 63 aa, Glycine max
  Coding DNA Sequence Number=SeqID_103865
MHETQCGPLRAHRMNRKAWFEGRWLPPSSPRRAGLLPPEATAFWRNIPEGPSGPGCYLHPHFY

SEQ ID NO: 220644 - protein, 122 aa, Glycine max
  Coding DNA Sequence Number=SeqID_103866
MEISELEPPRNVSNLDDDEDEDDDDYLVSNSYIEESLGEDDSVDGISDTDDEVTHMVEPVTIFQPREGVEGIQNSFWNDVLHYNNINWSHPDEEDICGLEMPSSFNVGQELYVGMDFDSKDA

SEQ ID NO: 220645 - protein, 133 aa, Glycine max
  Coding DNA Sequence Number=SeqID_103867
  Subcellular localization annotation: CTP_CleavageSite=53; ConfidenceScore=5.54e-01
MATPPASPPPPLPPPPADASASSSMLKQTHKATWLRSLVTRPPGAERPVVNIDLATGKANGPHKKKLRTYLGIVTRDKVDVTYETLKEVPAAQKDLIWEDIQRNLKSLKLLTVGQRRKLFRLSASGGGSLNLT

SEQ ID NO: 220646 - protein, 195 aa, Glycine max
  Coding DNA Sequence Number=SeqID_103868
  Subcellular localization annotation: CTP_CleavageSite=37; ConfidenceScore=5.13e-01
MAFLGETSSQTIVNSSYPTNNFWMKFTTGSHSPIQLLCTVGRTPDGIINLLERIMPRTHDAILYYNGKWNMPPQNKFVGCAFTGKNPKKFQIPSTCTIDELKNLIKQVAPKGIPPLGIHESQTVRRLFFRQPARFAYSDTVIKYEINELITNEELLKVLVQSNYWKKYGPIEILAVFTKYVVKIEDEVTGTSLNN

SEQ ID NO: 220647 - protein, 270 aa, Glycine max
  Coding DNA Sequence Number=SeqID_103869
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-30, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=41; ConfidenceScore=5.47e-01
MYARPSLYRATRPHLQRTTPSRLQRTTRPHLHRTTPPRLLRAARPSPSEGNMPSPLEDYTSTHSEDYRGQHALAFRGLHILPFRGLHALAFRRLHALAFTGLHVLIFRGLHILAFRGLHTLALKGLHALAMRGLHVLAFRELHVLTFRGLNVLAFRGLHDYTSSPFEGCTPVAFRELLALTFRGLHVFPFRGLQVLAFQGLHVLIFRVLNVLAFRGLHVLAFRGQHALTFKGLHDLTFKRLQALAMRGLQVLAFRGLHVLTFRGLHILAF

SEQ ID NO: 220648 - protein, 103 aa, Glycine max
  Coding DNA Sequence Number=SeqID_103870
EGDILTTCVFAVFHLALLFVVKEVSGLWKAKSSVGSSLGNWFDSKVLDSTGLSCCAITRNRVLVEFSLTRGICGRGLIRTRLGYHEESGSSSPGDNIGTHNHC

SEQ ID NO: 220649 - protein, 191 aa, Glycine max
  Coding DNA Sequence Number=SeqID_103871
DSLEEQASQGSFVPYGRQDLLTAAIRRPEHPGRVRAARASMQSQLQSQIQSQGLALTSEPEVGPSAARVSTKGSCVDPSATNPNTGDSDKCGLYIEENPSHLVALGRVYEGSIAVHNIPLLHGQMKVGVEEVKDAKAPVPIPTDEAILVMWDATVFGVFNQDFPLYIKHEDLSEIAHCSQCLSISVIQLWI

SEQ ID NO: 220650 - protein, 300 aa, Glycine max
  Coding DNA Sequence Number=SeqID_103872
  Homolog annotation: Hit_ID=UPI00005FA3D4; Match level="QueryCoverage =28%, HitCoverage=22%, E-value=2e-34, Identity=80%"; Hit description =COG3064: Membrane protein involved in colicin uptake
  Pfam annotation: Domain name=TolA; Domain location=1-299; Score =182.3; E_value=1.2e-51; Accession=PF06519.2; Description=TolA protein
AKQQAEQQKAAEAAAKQAQEQQKAAEAAAAKAKADAKAQADAQAKAAADAKAKAEEQAKQAAADAKKKAEEQAKAAAAEAAKEKAAQQAKAAAEAKAKAEAEAKAQAAADAKAKAAQEAKEKAAEAAKEKAAAEAKAKAEAAAKAKADAAAKAKAAADAKKKAAAEAAKNESDVDDLLGGLSSGKNAPKSGAASGGGAAAGQGNQKKAGASGAEVNAYLGQITSAIQSRFYDADLYRGKSCDLRIKLAPDGLLIDVKAEGGDPALCQAAITAAKHARIPKPSSQAVYEVFKNAPMRFKPE

SEQ ID NO: 220651 - protein, 115 aa, Glycine max
  Coding DNA Sequence Number=SeqID_103873
MAASDIAILRDRAHIPTKKSLLELTSQDALLAQNKLLSKQLEALTKTLRCAICGGAHNSGCCIPNEEPTHEVNYMGNQPRDSGGITLETRSTKTKVVHLQGHNSKSLVSMIEQRS

SEQ ID NO: 220652 - protein, 191 aa, Glycine max
  Coding DNA Sequence Number=SeqID_103874
  Subcellular localization annotation: CTP_CleavageSite=72; ConfidenceScore=5.27e-01
MNCVFVHVSSTFEFGALRSDCLVKFSILNLFRSPMNCVFVHVSSTFEFGAMRSDCLVQFSILNLFRSPMNCVFVHVSSTFEFGALRSDCLVQFSILNLFRSPMNCVFVHVSSTFEFGAMRSDCLVKFSILNLFRSPMNCVFVHVSSTFEFGAMRSDCLVQLSILNLFRSPMNCVLVHVSPTSNLEPMRRDG

SEQ ID NO: 220653 - protein, 200 aa, Glycine max
  Coding DNA Sequence Number=SeqID_103875
GHALRRPYRTRARARVMDEVEEIQEKMKADMEAIKEKMATMMEAMMSVKKIMEANAVAIAATSVVAKVNPTSPSGLKQMNHPTSNMVGKDLGSTGGPHDVQIQNEHAFPSYGLPLNYTPPNVAYTPNKNVNNSTPIPIESQQPQTDHAHGKQLVVYPTKPFGGPQYHPQLHLLHSTAVKNPYDYGRNGKVGSSRGKAQGH

SEQ ID NO: 220654 - protein, 136 aa, Glycine max
  Coding DNA Sequence Number=SeqID_103876
VGGAGLWPRAKFRIGWPPPPPRDQFCCQDFANFGLRPGRIKATRAESQWIVAARPLCHLQYPVAYLSRLQRILPAARWELRFKASRRANPPHEGHQRHVPLGGRGPLLLVGKRTAGARVASSPDSDLEAFSHNPTH

SEQ ID NO: 220655 - protein, 350 aa, Glycine max
  Coding DNA Sequence Number=SeqID_103877
  Gene Ontology: Mol. function=oxidoreductase activity; Cellular component=peroxisome; Biological process=hydrogen peroxide catabolic process
  Homolog annotation: Hit_ID=Q0X943; Match level="QueryCoverage=62%, HitCoverage=26%, E-value=2e-95, Identity=79%"; Hit description =Catalase
  Pfam annotation: Domain name=Catalase; Domain location=178-350; Score= 85.2; E_value=2.1e-22; Accession=PF00199.9; Description=Catalase
MPIRPSMAPSTTSGRLQVQLHQVLDHLAGQHAGVLVDVVRTEPGRVDLGRGTPDHVLARAQAQPPQHGLVDVGVTPLKVLDEKQHIRDGVEQGFDVGGLDSHGASIPEPAFACTFTSAGPRFNGAGSSVVVPSDDPEPTSMAASKPTGKRATAPAENHRRGDGDELHQQAGGTHPVMTTDQGIPVADNQNSLRQGPRGPTLLEDFILREKITHFDHERIPERIVHARGSAAHGYFELTRSLAAHTRARILTEVGVKTPVFTRFSTVAGGAGSVDTPRDVRGFAVKFYTKEGNWDLVGNNIPVFFIQDAMKFPDLVHAVKMEPDRAFPQAAKAHDTFWDFISLMPESMHMI

SEQ ID NO: 220656 - protein, 394 aa, Glycine max
  Coding DNA Sequence Number=SeqID_103878
  Gene Ontology: Mol. function=transporter activity; Cellular component= integral to membrane; Biological process=transport
  Homolog annotation: Hit_ID=UPI00006B8828; Match level="QueryCoverage =67%, HitCoverage=96%, E-value=1e-110, Identity=79%"; Hit description= putative ABC transporter permease protein
MKRRLRIAGLLALPMTWLIGIYIFSLVMLLVTAFWITDPFTSKVKPGFTLRNFEQLFVNPAYLSTSLRTLGIALAVTVLAILVSIPLGIFMAKIASPWLRALLAVSITLPLWAGYPGEGARDAHHFHRAGLRELAAGALRHHGTGFHGRDRRAHPDLSVAAVHGSAGVHRHPTTAAESVRRIGRPRRRRLAHHRHGRAPADQARDHRRLRVHVLAEPRRLPRRPVRRRRHPDDRQRDRLEHQPEPPAGCCLLAGADRVRRRLPGCESRMLRLSRTSKIVLGVVVAVVLAFMYIPLALVVLNSFNSARIVSWPVAGFSLEWWGKAFTSEPVRQALLNSVLVASGATVIAVILGTLVAFALQRYSFFGQRAVNLLVVLPIALPGIVTGVALNNTYN

SEQ ID NO: 220657 - protein, 325 aa, Glycine max
  Coding DNA Sequence Number=SeqID_103879
  Gene Ontology: Mol. function=protein binding; Cellular component =integral to membrane; Biological process=xylan catabolic process
  Homolog annotation: Hit_ID=Q949G8; Match level="QueryCoverage=99%, HitCoverage=80%, E-value=1e-60, Identity=30%"; Hit description =HcrVf2 protein
  Pfam annotation: Domain name=LRR_1; Domain location=12-34; Score =18.3; E_value=0.027; Accession=PF00560.23; Description=Leucine Rich Repeat
  Pfam annotation: Domain name=LRR_1; Domain location=132-154; Score =1.9; E_value=1.2e+02; Accession=PF00560.23; Description=Leucine Rich Repeat
  Pfam annotation: Domain name=LRR_1; Domain location=157-179; Score =14.0; E_value=0.53; Accession=PF00560.23; Description=Leucine Rich Repeat
  Pfam annotation: Domain name=LRR_1; Domain location=199-218; Score =10.6; E_value=3; Accession=PF00560.23; Description=Leucine Rich Repeat
  Pfam annotation: Domain name=LRR_1; Domain location=227-248; Score =5.3; E_value=29; Accession=PF00560.23; Description=Leucine Rich Repeat
  Pfam annotation: Domain name=LRR_1; Domain location=251-273; Score =13.2; E_value=0.93; Accession=PF00560.23; Description=Leucine Rich Repeat
  Pfam annotation: Domain name=LRR_1; Domain location=275-297; Score =16.2; E_value=0.12; Accession=PF00560.23; Description=Leucine Rich Repeat
  Pfam annotation: Domain name=LRR_1; Domain location=299-321; Score =6.8; E_value=15; Accession=PF00560.23; Description=Leucine Rich Repeat
  Pfam annotation: Domain name=LRR_1; Domain location=36-58; Score =16.2; E_value=0.12; Accession=PF00560.23; Description=Leucine Rich Repeat
  Pfam annotation: Domain name=LRR_1; Domain location=60-82; Score =18.9; E_value=0.019; Accession=PF00560.23; Description=Leucine Rich Repeat
  Pfam annotation: Domain name=LRR_1; Domain location=84-107; Score =5.5; E_value=26; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =12-34::132-154::157-179::199-218::227-248::251-273::275-297::299 -321::36-58::60-82::84-107
  Subcellular localization annotation: CTP_CleavageSite=98; ConfidenceScore=5.05e-01
GQIPQIISSLQNIKNLDLQNNQLSGPLPDSLGQLKHLEVLNLSNNTFTCPIPSPFANLSSLRTLNLAHNRLNGTIPKSFELLRNLQELRLSWTNLFLSVNSGWVPPFQLEYVLLSSFGIGPKFPEWLKRQCSVKVLTMSKAGIADLVPSWFWNWTLQIEFLDLSNNQLSGDLSNIFLNSSVINLSSNLFKGTLPSVPANVEVLNVANNSISGTISSFLCGKENATNKLSVLDFSNNVLYGDLGHCWVHWQALVHLNLGGNNLSGVIPNSMGYLSQLESLSLDDNRFSGYIPSTLQNCSTMKFIDMGNNQLSDAIPDWMWEMQYLM

SEQ ID NO: 220658 - protein, 70 aa, Glycine max
  Coding DNA Sequence Number=SeqID_103880
GQDHLGLPSGVETKHERQKPIKVLKDERKWGWGHDRPIVALLCAKQAKNVAAKQPRILCILQLSFTICLF

SEQ ID NO: 220659 - protein, 146 aa, Glycine max
  Coding DNA Sequence Number=SeqID_103881
  Gene Ontology: Mol. function=helicase activity; Biological process =protein amino acid phosphorylation
  Homolog annotation: Hit_ID=Q1SN45; Match level="QueryCoverage=90%, HitCoverage=7%, E-value=1e-23, Identity=40%"; Hit description=AAA ATPase
  Pfam annotation: Domain name=DUF889; Domain location=1-143; Score =39.8; E_value=3.3e-14; Accession=PF05970.5; Description=Eukaryotic protein of unknown function (DUF889)
MQATDQEETATFAQWIIDIGDGIIGDENDGYATIEIPQELLITEYNDPIHSIISSTFPYLSHHHNDPEYFQTRAILASTNETVQQVNDYMLTMIPGEQMEYLSSDSVDKSETIESCHFRSLTTEFLNSLTTSGLPNHCSNSRLEHQ

SEQ ID NO: 220660 - protein, 63 aa, Glycine max
  Coding DNA Sequence Number=SeqID_103882
MDLALCLPLALDLVAYCALIARCRPSPSCCGVSPCACLGVQYFLMKARLIGGLMNLLGATGTP

SEQ ID NO: 220661 - protein, 105 aa, Glycine max
  Coding DNA Sequence Number=SeqID_103883
  Homolog annotation: Hit_ID=Q5W7C9; Match level="QueryCoverage=53%, HitCoverage=21%, E-value=3e-20, Identity=82%"; Hit description =Unknow protein
SVLFLDGGKGYNSAVECHLDVVEVISSSLIIPKPNRTPVEYEAPGYKLCLGMEENSESALSTNKEAISNATRNLMESSILAQDERWRHALHMQVGRDVVFPVADR

SEQ ID NO: 220662 - protein, 158 aa, Glycine max
  Coding DNA Sequence Number=SeqID_103884
  Gene Ontology: Mol. function=DNA binding
  Homolog annotation: Hit_ID=Q1SWX1; Match level="QueryCoverage=57%, HitCoverage=17%, E-value=2e-12, Identity=38%"; Hit description=IMP dehydrogenase/GMP reductase
MGTNQTDKRFYQVKVKSLDTTSIKELGRLMEPLQMQAFRKTYGKILELTIAEVSIKAIASLTQYYDQPLRCFTFADFQLVPTIEEFEEILGCPLGGRKPYLSSGCLPSLSRIATVVKDSARGLDRIKQTRNGIAGLPQKKTKRGVWPIKENGSHLWMC

SEQ ID NO: 220663 - protein, 125 aa, Glycine max
  Coding DNA Sequence Number=SeqID_103885
MATAKALERETKRARKEEHDRNKFQGVVWGRNSELKLQRDERDQSRVECMILKDELKAYLRSKRSLSQQLSETEGNMLAIVDKYKEELNLAVAHEHRLVDEYAKVSVVKEARGRVTNSLHGEVMM

SEQ ID NO: 220664 - protein, 144 aa, Glycine max
  Coding DNA Sequence Number=SeqID_103886
  Homolog annotation: Hit_ID=Q6CQE5; Match level="QueryCoverage=28%, HitCoverage=38%, E-value=1e-07, Identity=66%"; Hit description =Protein TAR1
MADFAVIKWWMSLRSRPITCEPVSSGPIDDPLRATHAPNETSASSVADRAQVPWKGAPERVRAPSCPDPVAPRGAVGESGCLGMQPQSGGKFRPRLNTGERPIANNGWGPAMCPGRMWNGESRSADRLGTLTDADCDGGPSPGC

SEQ ID NO: 220665 - protein, 49 aa, Glycine max
  Coding DNA Sequence Number=SeqID_103887
MDLVLLLTFGFGLGRLLVDHGRLDDLAGGDEHSVELPEARDVPSFSSIF

SEQ ID NO: 220666 - protein, 63 aa, Glycine max
  Coding DNA Sequence Number=SeqID_103888
HLERFPKIPPVSPPTAPIEFPNLRHDIKIPNGENSQNCVANVVLKFHNDPTVNESEIVVFLRQ

SEQ ID NO: 220667 - protein, 106 aa, Glycine max
  Coding DNA Sequence Number=SeqID_103889
  Gene Ontology: Mol. function=RNA-directed DNA polymerase activity; Cellular component=signal recognition particle, endoplasmic reticulum targeting; Biological process=SRP-dependent cotranslational protein targeting to membrane
MMAHQCSTRRTMIMKADGEITSESEKNEKEEEVEEELEEEAMQGDMLMVKRLLGSQMQPLDNTQRENIFHTRLVSKLNMETKPHPRPYRLQWLSEDEEVKVTEQVE

SEQ ID NO: 220668 - protein, 285 aa, Glycine max
  Coding DNA Sequence Number=SeqID_103890
  Gene Ontology: Mol. function=receptor activity; Cellular component =outer membrane-bounded periplasmic space; Biological process =glycolysis
  Homolog annotation: Hit_ID=Q7WK24; Match level="QueryCoverage=78%, HitCoverage=68%, E-value=1e-101, Identity=81%"; Hit description =Putative exported protein
  Subcellular localization annotation: CTP_CleavageSite=50; ConfidenceScore=5.00e-01
PPPFGGRPVLPSPLFIAWLARPPVARTSCAPVWREPYAVHPPPRPGRACRAAVDASPGACPGPGQFPHPSRAPAGRLRARRPDRHRRARAGRTHGQGPEGQRGGREPAGRPGHHRHGGGGAGRTRRLHAGLCRHQRHDPEPLALQQPAVPAVGLQAAGFDGQVADAADRASGAGRQERAGIHRAGQEEAGRHHLRPCRARRHQPPGAAAFPVQDRHPVPGRALQGQRPGAAGPDGGHGAEHLRFPDVGAAQHPVGQAAGAGGDGRPAPVEPAGRAEHEGGRRRRL

SEQ ID NO: 220669 - protein, 84 aa, Glycine max
  Coding DNA Sequence Number=SeqID_103891
MFPFSRLRIWRPENLLATVTTCAGECGGNPIKGGNLVSVHDVDDTIYVQKSFNWQRLESEMMRTNLMLEGEEVDEGDNVESFGP

SEQ ID NO: 220670 - protein, 485 aa, Glycine max
  Coding DNA Sequence Number=SeqID_103892
  Gene Ontology: Mol. function=5-formyltetrahydrofolate transporter activity; Cellular component=membrane
  Homolog annotation: Hit_ID=Q1RSU5; Match level="QueryCoverage=96%, HitCoverage=94%, E-value=0.0, Identity=71%"; Hit description =Biopterin transport-related protein BT1
  Pfam annotation: Domain name=BT1; Domain location=46-459; Score =338.6; E_value=1e-98; Accession=PF03092.7; Description=BT1 family
  Pfam annotation: Domain name=DUF81; Domain location=105-336; Score= -65.1; E_value=0.031; Accession=PF01925.9; Description=Domain of unknown function DUF81
  Pfam annotation: Domain name=MFS_1; Domain location=34-412; Score =18.4; E_value=4.6e-05; Accession=PF07690.6; Description=Major Facilitator Superfamily
  Pfam module annotation: Pfam domain module=BT1::DUF81::MFS_1; Domain location=46-459::105-336::34-412
MGENDNKTKKNLLSLLTEPIQWIQSLSSQLNPTFVIGVFIIYGIGQGFSGSLFKVVSDYYWKDVQKIQPSTVQLYVGFYFIPWVLKPLWGILTDAFPVRGYRRRPYFIISGVIGAISAAVVAFAGNLAAVAALMCFLGVSASLAIADVTIDACIARNSIEMRKLAPDLQSLCGFCSGAGALVGYLASGFFVHRLGTQESLGLMALSPALTIVLGFVIYENRTSASHIEKQAVESVGMKIRSMYQTMLYPHVWKPSLYMFLALTLNVTTHEGHFYWYTDPKAGPAFSQEFVGVIYAIGAVASLIGVLIYHKALKDYQFRDLVFYAQLLYGISGVLDLIFILRWNLVIGIPDYFFVVLEESATRITSKIRWMPMMVLSTQLCPLGIEGTFFALLMCIDSIGALFSKWGGGMLLRVLHITRTDFTNLWLAVLIRDMLRFATLALVFLVPKTDQYEELLPSEVSGKNTSEKVHEEETLELVPIHGKTEV

SEQ ID NO: 220671 - protein, 141 aa, Glycine max
  Coding DNA Sequence Number=SeqID_103893
  Gene Ontology: Mol. function=RNA binding; Cellular component=cellular_ component; Biological process='de novo' pyrimidine base biosynthetic process
  Homolog annotation: Hit_ID=O81977; Match level="QueryCoverage=73%, HitCoverage=84%, E-value=1e-53, Identity=97%"; Hit description =Rudimentary enhancer
  Pfam annotation: Domain name=ER; Domain location=42-141; Score=211.3; E_value=2.2e-60; Accession=PF01133.8; Description=Enhancer of rudimentary
MSKLAGASEFRYSTLLCACGRSLQTQKPEHSLQLNPSFSMANRHTIILMQTSQNRATRTFMDYESITQAMDGICALYERKLKELNPTIRNLSYDITDLYNFIDGLADMSALVYDSSIHAYMPHDRQWIKQRTFQHLKKLAH

SEQ ID NO: 220672 - protein, 43 aa, Glycine max
  Coding DNA Sequence Number=SeqID_103894
MVKSHMNLVWRGLVQGGGRVDLVEGGDNMTRREEKVSGDGCTW

SEQ ID NO: 220673 - protein, 166 aa, Glycine max
  Coding DNA Sequence Number=SeqID_103895
  Gene Ontology: Mol. function=nucleic acid binding; Biological process= DNA integration
LQQFFGHNTNERPTRSNFSQVTTIVVYEDVGDFSDNEDLMPSEITFYRDVCGEEIFEGKMVSSDEKTKEYMLVYRRVDNLEVVRNLMTGLRIVDFIASPLKIFCDNYVAPFYTKCNKTSRGSKHLELKYLTVRDLVKDGSIVVDHVDTNSMLVDPLTKGLRLVVFK

SEQ ID NO: 220674 - protein, 106 aa, Glycine max
  Coding DNA Sequence Number=SeqID_103896
MLEYTVSKARKKFFHTSSRKNLLPQLILTTAEEHSSVHSCGRLLPQECTEEGSSVEVFFGQLNYVVIILKLVSTSVGRKNLLEETQALGNMVVPSSFVGNQCMEEK

SEQ ID NO: 220675 - protein, 254 aa, Glycine max
  Coding DNA Sequence Number=SeqID_103897
MDGVIGECVKLRDFSAQRGTFFNFVYAYGLTYLRCNRLSLIAITIFEHLLSGLSEKAIIKEFFDALGKRYQVSDNAEFGYLMERLLNMRYDNVGGVKEFIMKMGHKKFDCGKFKAWLENKQKSRGNNLAFVYLESNLVDVPIDSWWLDSGSITHIVVSFQGFKNLREPSLRENKLRLDVVDPIVPSDDIDVNSLETISLPLPIPIFSVSIVVSIETGVPIFPVETIIAIGDIVDSQANDMLDLPTANESAQPVE

SEQ ID NO: 220676 - protein, 128 aa, Glycine max
  Coding DNA Sequence Number=SeqID_103898
  Pfam annotation: Domain name=zf-CCHC; Domain location=28-45; Score =19.3; E_value=0.00065; Accession=PF00098.13; Description=Zinc knuckle
MWKKRNGTIWKGSKKPHRERKDKEKSSIICFECKKPGHFKLECLDLDKSAYKKKYFKSKDKKVLMKTWEELDDTLFDVEIEEEEETNLCLTTNTASKGSDSKSDEEVGHMTSKCRHLPKIRSSNAFEN

SEQ ID NO: 220677 - protein, 278 aa, Glycine max
  Coding DNA Sequence Number=SeqID_103899
  Gene Ontology: Mol. function=calcium ion binding
  Homolog annotation: Hit_ID=Q6UY57; Match level="QueryCoverage=43%, HitCoverage=18%, E-value=2e-21, Identity=48%"; Hit description =Lectin-like receptor kinase 1;1
  Pfam annotation: Domain name=Lectin_legB; Domain location=138-278; Score=-38.1; E_value=8.1e-08; Accession=PF00139.10; Description =Legume lectin domain
MRLDQYRVIKTKCTGDAAILKEIIEHDRVYNFLVGMNSEFDQIKIQILEKQITCVNDMPVITQSEDGRNFPISLAKSKGDHEAQVLPQEGFPSCGRTFFRRNIWKNLLPRLCAEEGSSARSHDLRLLPCATSKTQRSSNLKPAYTIKRERRIIIQNGTIVLNSDIGNGVGRATYGQPLCFKNSSNGHVTDFSTRFSFTIDVSNKTFFGDGFAFYVAPHPYQIPLNSGGGRLGLYDDNAPAPHSNIVAVEFDTYVNRYVDPNMRHVGINNNSAMSLAYD

SEQ ID NO: 220678 - protein, 268 aa, Glycine max
  Coding DNA Sequence Number=SeqID_103900
  Gene Ontology: Mol. function=protein serine/threonine kinase activity; Biological process=protein amino acid phosphorylation
  Homolog annotation: Hit_ID=Q6UY57; Match level="QueryCoverage=90%, HitCoverage=34%, E-value=1e-28, Identity=34%"; Hit description =Lectin-like receptor kinase 1;1
  Pfam annotation: Domain name=Lectin_legB; Domain location=30-264; Score=116.5; E_value=7.6e-32; Accession=PF00139.10; Description =Legume lectin domain
MLATSACFHYLETFLLLCTLMILPIVKPQPPLSFNITNFNDSTGIASLIGCVGVARIGNGTIVLTNSLNNNNDNNSSFDFGRAIYGQPMRLKNTSNGHVVVTDFSTRFSFSSFSIDGSTESDFGEGFAFYMAPIAYHIPLGSGGSRLGIYGDKVHDPTNIVAVEFDTFQNVGFDPPLNQHVGINNNSVVSLAYARLDIEGNIGNMGHVLITYNASAKLLAVSWFFEGRNSSSSAPEASLSHQIDLGEILPEWVTVGFSGGNGNSKGKN

SEQ ID NO: 220679 - protein, 190 aa, Glycine max
  Coding DNA Sequence Number=SeqID_103901
  Gene Ontology: Mol. function=protein binding; Cellular component =integral to membrane; Biological process=xylan catabolic process
  Homolog annotation: Hit_ID=Q1SWI7; Match level="QueryCoverage=97%, HitCoverage=81%, E-value=5e-62, Identity=42%"; Hit description =Leucine-rich repeat
  Pfam annotation: Domain name=LRR_1; Domain location=117-139; Score =8.1; E_value=8.6; Accession=PF00560.23; Description=Leucine Rich Repeat
  Pfam annotation: Domain name=LRR_1; Domain location=141-163; Score =9.6; E_value=4.7; Accession=PF00560.23; Description=Leucine Rich Repeat
  Pfam annotation: Domain name=LRR_1; Domain location=165-187; Score =13.4; E_value=0.81; Accession=PF00560.23; Description=Leucine Rich Repeat
  Pfam annotation: Domain name=LRR_1; Domain location=20-42; Score=3.3; E_value=70; Accession=PF00560.23; Description=Leucine Rich Repeat
  Pfam annotation: Domain name=LRR_1; Domain location=93-112; Score =11.2; E_value=2.3; Accession=PF00560.23; Description=Leucine Rich Repeat
  Pfam module annotation: Pfam domain module=LRR_1::LRR_1::LRR_1::LRR _1::LRR_1; Domain location=117-139::141-163::165-187::20-42::93-112
MSNTGIIDSIPTQMWEALSQVLHFNLSHNHIHGELVTTLKNPISNQIVDLSTNHLRGKLPYLSNAVYGLDLSTNSFSESMQDFLCNNQDKPMQLQFLNLASNNLSGEIPDCWINWPFLVEVNLQSNHFVGNFPPSMGSLADLQSLQIRNNTLSGIFPTSLKKTGQLISLDLGENNLSGSIPPWVGENSQI

SEQ ID NO: 220680 - protein, 1091 aa, Glycine max
  Coding DNA Sequence Number=SeqID_103902
MMMKSKFECGNQDAIVDDGEISLNNGQLLLQDIQEISKALYAPSRPSFSSVHNRSKSAGKTHLSKPQVALTPGFLKEDLFPRDKKLSSAWNWKKPLKVLTHIGGQKFKCCFNLHVHSIEGLPLSFDGIRLCVHWKRKNNILQTRPARVFQGVVEFNETLSHGCSVYASRAVSGHSVKYESKRFLIYASIAGAPEHDIGIHQVDLTRLLPLTLAELGGDRSSGKWSTSFRLTGKAVGASLNVSFSYQVMKHELMEFGGDNLNVLNLVNLKPGRPSSTSSVLDFSPIPFHSDDMILSRETLMNSSSSLSKSISFLYQKLDEGNIHNSAQADSEHFGPLKSHVVTESESPLESNQHEPDDNEFSIIEQVETLEGDSLELGQIGNQTVDLSTVEIIDVDDIIKEDDIFIDKNTRFDSMDNICTSCVNDTMADDSKHKRSSSCVSITCIKDADILPETSKFLDQECYLNVKSNYKSHRMEKKSSSLDFITESIANDFLNMLAMESGSFGSSCDGDPKSPREKLLREFEEEALASGNFTFDFIANEEELGTGTVVDSYGDCTVDSDLSLFIQAAEEEHARENQLLMQRRKAKILEDLETDSLMQLWGLNEKDFENSQGTYSGGFGSPIELPNEESSVLPSIGQGLGSFVQTMGGGFLRSMSPSLFRNAKNCGNLITQASNPVVLPAKMGNDILEILQHVASDGVEELCHHIYKLMPLQDITGKFIEHIVQKATTDEGAPVRQGSWQHDLFEEFPCGYLTDEGTSLDTVSPEAVGPMTVNKIEARLIDGLRIQSGMLNEEAPSYIRPQHAKTPAVGGRRTNWKGFPTSERIAKLQLEDCGESGNDNDGLMGLSITFDQWLRLDSGTIEGDQNSEQILKILEVHHSKIRELDELKNATDWLKSYGRKLGHYGLLGNHLTVAFMIQLRDPLRNYEPVGVPMLVLTQVERVCISATPQDYSDFLDEKEKGMDNEALLNETSSKSMEYTNTDNEATQFRFKIKEIHLSGVLSKAGSKQRWGTATQQQSGIRWLLASGMASAAKHSSSTSKAIVLSSPLFTKKLLNEDALWSISCVNSIMGPNSKELPAENVHIRNPDIIFPS

SEQ ID NO: 220681 - protein, 68 aa, Glycine max
  Coding DNA Sequence Number=SeqID_103903
MPLRHFTKHLVGVCLGMKIKGMGAMWHAPLLQNTTPQFNENKQQSKDKSLTFLSKHIHLEHQNTSMES

SEQ ID NO: 220682 - protein, 72 aa, Glycine max
  Coding DNA Sequence Number=SeqID_103904
GDRALVIDYQMGVIDYTVLPATAQLIHDRVVMEYLEGVWETLEGNERCRFRGTIQLTATSLVHPEKLWRDNE

SEQ ID NO: 220683 - protein, 108 aa, Glycine max
  Coding DNA Sequence Number=SeqID_103905
  Gene Ontology: Mol. function=sequence-specific DNA binding; Cellular component=nucleus; Biological process=regulation of transcription
  Homolog annotation: Hit_ID=Q5ND90; Match level="QueryCoverage=82%, HitCoverage=58%, E-value=7e-14, Identity=43%"; Hit description =Putative WRKY transcription factor 10
  Pfam annotation: Domain name=WRKY; Domain location=88-108; Score= -11.5; E_value=0.018; Accession=PF03106.6; Description=WRKY DNA -binding domain
MTDKIPKPPPPDTPDSDDFTNQWPFELSEYLKFDDNQWMHDGLESFASENVSNQVHQVSNAEDTSSGRENREVRERVAFKIMSEIEVLDDGYRWRKYGKKMVKNSPNP

SEQ ID NO: 220684 - protein, 340 aa, Glycine max
  Coding DNA Sequence Number=SeqID_103906
  Gene Ontology: Mol. function=binding; Cellular component =mitochondrial inner membrane; Biological process=transport
  Homolog annotation: Hit_ID=Q8L9F8; Match level="QueryCoverage=95%, HitCoverage=97%, E-value=2e-85, Identity=52%"; Hit description =Mitochondrial carrier-like protein
  Pfam annotation: Domain name=Mito_carr; Domain location=134-225; Score=87.4; E_value=4.3e-23; Accession=PF00153.17; Description =Mitochondrial carrier protein
  Pfam annotation: Domain name=Mito_carr; Domain location=240-335; Score=82.5; E_value=1.3e-21; Accession=PF00153.17; Description =Mitochondrial carrier protein
  Pfam annotation: Domain name=Mito_carr; Domain location=41-123; Score= 44.9; E_value=2.8e-10; Accession=PF00153.17; Description =Mitochondrial carrier protein
  Pfam module annotation: Pfam domain module=Mito_carr::Mito_carr::Mito_ carr; Domain location=134-225::240-335::41-123
MSSIPTTTYEDSSAVNISEFQPQSHAPKEIEWHMLDKSKFFFLGAALFSSLSAALYPAVVLKTRQQVSSAKISCRNMSRAIIRYEGFRGFYRGFGTSLMGTIPARALYMSALEVTKSNVGTATAHLGFSDASAAAIANAAGGVASAMAAQLVWTPVDVVSQRLMVQESNKMCYRNGFDAFRKILGVEGPRGFYRGFGVSIVTYAPSNAVWWASYSMVNRLIWGVFGGCGNSNFGRDSKVMVGVQGLSAVMASGVSTIVTMPLDTIKTRLQVLDAEEINGRRRPLTLVQAVHNLVKEGGILACYRGLGPRWASMSMSAATMITTYEFLKRVSAKNLDRFIV

SEQ ID NO: 220685 - protein, 147 aa, Glycine max
  Coding DNA Sequence Number=SeqID_103907
  Gene Ontology: Cellular component=endoplasmic reticulum; Biological process=response to oxidative stress
  Homolog annotation: Hit_ID=P05477; Match level="QueryCoverage=87%, HitCoverage=81%, E-value=2e-61, Identity=89%"; Hit description=17.9 kDa class II heat shock protein
  Pfam annotation: Domain name=HSP20; Domain location=53-145; Score =123.5; E_value=6e-34; Accession=PF00011.11; Description=Hsp20alpha crystallin family
MDFRVMSLESPLFHTLQHMMDMPDDSAGDNKTYNAPTRSYVRDAKAMAATPADVKEYSNSYMFEIDMPGLKSGDIKVQVEDDNVLLISGERKRNEEKEGAKYLRIERRVGKLMRKFVLPENANTDAVSAKLPPPEPKKPKTIEVNVA

SEQ ID NO: 220686 - protein, 114 aa, Glycine max
  Coding DNA Sequence Number=SeqID_103908
  Gene Ontology: Mol. function=zinc ion binding; Cellular component =integral to membrane
  Homolog annotation: Hit_ID=Q06A76; Match level="QueryCoverage=87%, HitCoverage=40%, E-value=6e-35, Identity=70%"; Hit description=PHD4
  Pfam annotation: Domain name=C1_3; Domain location=59-89; Score=15.1; E_value=0.0086; Accession=PF07649.3; Description=C1-like domain
  Pfam annotation: Domain name=PHD; Domain location=60-110; Score=57.2; E_value=5.3e-14; Accession=PF00628.19; Description=PHD-finger
  Pfam module annotation: Pfam domain module=C1_3::PHD; Domain location= 59-89::60-110
VLAGVLNSGKGGVNYLSDCPLLSSVRGSESKYTKAMQSKDEDDEGVGVEEEDEDEHGETLCGACGESYAADEFWICCDICEKWFHGKCVKITPARAEHIKQYKCPSCSNKRARP

SEQ ID NO: 220687 - protein, 116 aa, Glycine max
  Coding DNA Sequence Number=SeqID_103909
  Subcellular localization annotation: CTP_CleavageSite=81; ConfidenceScore=5.52e-01
MGSTLVIKKDTNQNPINNATQSYYFNSVNFSSNEPKNTILKTSCNCQGRQHYMRQLRTFSTTHVPMIQTAGPSLSYLRLVLSTMVDGGIWPKDKIPPLQPVAQPTGLPSQIAYGGG

SEQ ID NO: 220688 - protein, 68 aa, Glycine max
  Coding DNA Sequence Number=SeqID_103910
MWTHYGYIERNRKAWFEQNRGGGCRPARPGDLSSPRRAGLLPPEATAFWRNIPEGTSGPACYLHPHFY

SEQ ID NO: 220689 - protein, 131 aa, Glycine max
  Coding DNA Sequence Number=SeqID_103911
  Gene Ontology: Mol. function=catalytic activity
  Homolog annotation: Hit_ID=Q84IX6; Match level="QueryCoverage=83%, HitCoverage=33%, E-value=7e-33, Identity=65%"; Hit description =Hypothetical protein aom5
MAAELAPDVKLVQQFPAVYLEREGCHAATAILSLTHDARIDDLTMMEAVNLPAFYLGAMGSQRNSAKRKARLSAIAELTPAQLQRIQAPVGLDIGSKTPAEIALAIMADIVRHKNGLAATDALSPVHAASE

SEQ ID NO: 220690 - protein, 92 aa, Glycine max
  Coding DNA Sequence Number=SeqID_103912
MPVSMVIRLTRVCRTACRPAETESADILCFTPLRYLTLSGDSHTQAVKSRGEDVKNFLTRQRARIDPQIYGFSRQNRRVSGLRREEVAQLAA

SEQ ID NO: 220691 - protein, 359 aa, Glycine max
  Coding DNA Sequence Number=SeqID_103913
  Gene Ontology: Mol. function=transporter activity; Cellular component= integral to membrane; Biological process=transport
  Homolog annotation: Hit_ID=Q66C87; Match level="QueryCoverage=88%, HitCoverage=84%, E-value=4e-54, Identity=40%"; Hit description =Possible MFS Superfamily transporter precursor
  Pfam annotation: Domain name=DUF1228; Domain location=1-80; Score =85.0; E_value=2.3e-22; Accession=PF06779.4; Description=Protein of unknown function (DUF1228)
  Pfam annotation: Domain name=MFS_1; Domain location=1-320; Score =34.0; E_value=5.1e-07; Accession=PF07690.6; Description=Major Facilitator Superfamily
  Pfam module annotation: Pfam domain module=DUF1228::MFS_1; Domain location=1-80::1-320
MGIGRFSLTPQIPLMIANGHLTLSSAGVLAAMNYIGYLLGALHVSRITAHHVRYLKAGLLATALVTLLSGFSHAWVLQCLFRVVAGIGGAWALIIVTSWTQMVLAQQQAPRMSAAVFAGPGAGITLSGVLAWLITRLHLNDDRAWQCYGVVALAGVLLLWRALPASLPARQRESASAAPGRAVKRLWLAYTLAGFGYILPATFLSQMAHSLFAQGQLAALFWPLFGLCAVAGVVLIMLFSARLNTRLSLAWVMILQGLGVASGVLIPGVSGLLISTVMVGLGFLSIMQLSMQLAHAVSNISVAKTVAILTSGYATGQLIGTKPLRRQRADFLLPCTPRCCWPLVNWVLAGLLVLRIRPH

SEQ ID NO: 220692 - protein, 486 aa, Glycine max
  Coding DNA Sequence Number=SeqID_103914
  Gene Ontology: Mol. function=glyceraldehyde-3-phosphate dehydrogenase (phosphorylating) activity; Cellular component=chloroplast; Biological process=glycolysis
  Homolog annotation: Hit_ID=UPI00005F8D64; Match level="QueryCoverage =68%, HitCoverage=100%, E-value=1e-148, Identity=79%"; Hit description=COG0057: Glyceraldehyde-3-phosphate dehydrogenase/erythro se-4-phosphate dehydrogenase
  Pfam annotation: Domain name=DapB_N; Domain location=152-271; Score= -37.0; E_value=0.058; Accession=PF01113.11; Description =Dihydrodipicolinate reductase, N-terminus
  Pfam annotation: Domain name=Gp_dh_C; Domain location=307-464; Score =324.4; E_value=2e-94; Accession=PF02800.10; Description =Glyceraldehyde 3-phosphate dehydrogen
  Pfam annotation: Domain name=Gp_dh_N; Domain location=152-302; Score =318.3; E_value=1.4e-92; Accession=PF00044.14; Description =Glyceraldehyde 3-phosphate dehydrogen
  Pfam annotation: Domain name=HTH_AraC; Domain location=30-76; Score =39.5; E_value=1.1e-08; Accession=PF00165.13; Description=Bacterial regulatory helix-turn-helix proteins, araC family
  Pfam annotation: Domain name=HTH_AraC; Domain location=82-126; Score =33.1; E_value=9.9e-07; Accession=PF00165.13; Description=Bacterial regulatory helix-turn-helix proteins, araC family
  Pfam module annotation: Pfam domain module=DapB_N::Gp_dh_C::Gp_dh _N::HTH_AraC::HTH_AraC; Domain location=152-271::307-464::152-302::30- 76::82-126
MVMYLRRPGGQMQFSRFHLQSVSESGPIAQLQSWIAAHLAEDLSVEKLAAQVAMSPRNFTRVFSRETGVSPARYVAEARLAAARERLEQTRETLERIATATGFGSSINLRRSFERQLHLTPNEYRQRFHSRKMATPPAYSDCSNFTKESVMIKVGINGFGRIGRNVFRAALGSSDIDIVAINDLTDSKTLAHLLKHDSLLGRLPAEVSAGDGELRIDGKPVRVFSERDPANIRWRDVGVDIVIEATGFFTERDKAAVHITHGGAKRVIISAPGKNDDLTIVMGVNDQRYDPQQHFVVSNGSCTTNGLAPAAQVLHQAFGIEHGLMNTTHAYTNSQALHDQPEKDLRGARAAALSIVPYSSGAAKALGRVIPELEGRLTGYSLRVPVPVVSVVDLTVTLKRDVTAEEVNDAFKAAAAAGPLQGILGYSDEPLVSSDYQGDARSSIIDGLSTLVIGGNLVKILAWYDNEWGFSNRLVDLARLMAQRGL

SEQ ID NO: 220693 - protein, 108 aa, Glycine max
  Coding DNA Sequence Number=SeqID_103915
MCAYHGGAPGHSIEHCMTLKRKDFQVYAIIVNHSYNAKIDEFDILVSLILSQTHLCLFNFHWNVSVVKTKMDTSEPYTGAMRGIVHEPQVNLGADYKFPPNRFPATRS

SEQ ID NO: 220694 - protein, 342 aa, Glycine max
  Coding DNA Sequence Number=SeqID_103916
  Gene Ontology: Mol. function=protein binding; Cellular component =integral to membrane; Biological process=defense response to fungus
  Homolog annotation: Hit_ID=Q1ST34; Match level="QueryCoverage=99%, HitCoverage=81%, E-value=2e-72, Identity=42%"; Hit description =Leucine-rich repeat
  Pfam annotation: Domain name=LRR_1; Domain location=105-128; Score =11.0; E_value=2.5; Accession=PF00560.23; Description=Leucine Rich Repeat
  Pfam annotation: Domain name=LRR_1; Domain location=129-151; Score =1.8; E_value=1.3e+02; Accession=PF00560.23; Description=Leucine Rich Repeat
  Pfam annotation: Domain name=LRR_1; Domain location=153-176; Score =14.4; E_value=0.41; Accession=PF00560.23; Description=Leucine Rich Repeat
  Pfam annotation: Domain name=LRR_1; Domain location=178-201; Score =5.1; E_value=31; Accession=PF00560.23; Description=Leucine Rich Repeat
  Pfam annotation: Domain name=LRR_1; Domain location=223-241; Score =2.8; E_value=86; Accession=PF00560.23; Description=Leucine Rich Repeat
  Pfam annotation: Domain name=LRR_1; Domain location=249-270; Score =10.3; E_value=3.4; Accession=PF00560.23; Description=Leucine Rich Repeat
  Pfam annotation: Domain name=LRR_1; Domain location=27-49; Score =11.8; E_value=1.8; Accession=PF00560.23; Description=Leucine Rich Repeat
  Pfam annotation: Domain name=LRR_1; Domain location=273-295; Score =12.8; E_value=1.1; Accession=PF00560.23; Description=Leucine Rich Repeat
  Pfam annotation: Domain name=LRR_1; Domain location=297-319; Score =11.2; E_value=2.3; Accession=PF00560.23; Description=Leucine Rich Repeat
  Pfam annotation: Domain name=LRR_1; Domain location=3-25; Score=19.8; E_value=0.0099; Accession=PF00560.23; Description=Leucine Rich Repeat
  Pfam annotation: Domain name=LRR_1; Domain location=56-78; Score=6.5; E_value=17; Accession=PF00560.23; Description=Leucine Rich Repeat
  Pfam annotation: Domain name=LRR_1; Domain location=80-103; Score =15.6; E_value=0.18; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=105-128::129-151::153-176::178-201::223-241::249-270::27 -49::273-295::...
  Pfam module annotation: Domain location=297-319::3-25::56-78::80-103
MNSLEVLYLSDNKLQGEIPSFFGNMCALQRLDLSNNKLNGEFSSFFRNSSWCNRDIFRMLRLSYNRLTGMLPKSIGLLSELEYLNLAGNSLEGDVTESHLSNFSKLKYLRLSGNSLSLKFVPSWVPPFQLIQLGLRSCELGPTFPSWLKTQSSLYELDISDNGINDSVPDWFWNKLQNMILLNMSHNYIISAIPNISLKLPNRPSILLNSNQFEGKIPSFLLQASELMLSENNFSDLFSFLCDQSTASNLATLDVSRNQIKGQLPDCWKSVKQLLFLDLSSNKLSGKIPMSMGALVNMEALVLRNNGLMGELPSSLKNCSSLFMLDLSEICCRVQYHHGLEK

SEQ ID NO: 220695 - protein, 89 aa, Glycine max
  Coding DNA Sequence Number=SeqID_103917
LLDILCARIGLPCDKLQPFEFLESIRCLISSVSIYYVMRIMKLAKYRLKAQVEKNEGPSGEGQSPRVEKDEGPEAETLSRLLIDAECPD

SEQ ID NO: 220696 - protein, 100 aa, Glycine max
  Coding DNA Sequence Number=SeqID_103918
  Gene Ontology: Mol. function=binding; Cellular component=membrane coat
  Homolog annotation: Hit_ID=Q2RBN7; Match level="QueryCoverage=99%, HitCoverage=7%, E-value=3e-25, Identity=68%"; Hit description =Clathrin heavy chain, putative, expressed
MTANLPHELIELLEKIVLQNFSFSGNFNMQNLLILTAIKADPSRVMDYKNRLDNFDRSTVGLLMSYYITSILLIVLWSLLSRSKKMLFGAKWLKHYLTKA

SEQ ID NO: 220697 - protein, 155 aa, Glycine max
  Coding DNA Sequence Number=SeqID_103919
NNTVYNFPNWFLQWWNYFGPIPQIFPEEVQQGFQQFTKLFNSKESRIPADLKYGKTENSKQYPPLQRHAFVKWWSQFDTSKAAPEQSQLAAFLASSKSKESLAQNLKEVLQLLQQEEEEEPPKKEAESSENNDDQEDDPFYQNEDDCFGISLDDD

SEQ ID NO: 220698 - protein, 417 aa, Glycine max
  Coding DNA Sequence Number=SeqID_103920
MYNLEKPQRDDKQFLTPSFSSTLLDQIYRSIDEGERKNGETKFYRHTTMSSSKRHNRSDSKSMDAGDRKIVGGAKNNNRKHLHRDEDVMFFSSTSISSTDSSSLGFSSSDTESISRASCFAPQVGRGGGGSASFRSEKQGMRIFDSFCRTSSHRSSEHAHSQFCITSRRHLSVSEDHKQIRHGHRQVTACDEEEEALMIKSKSRALKIYNNLKKVKQPISPGGRVTSFLNSLFANTKKTTTTTTSTSSRTCGEVNTPSSSSSCYYSSTCSSASSFSRSCLSKTMSSERDRLRNGVKRTVRFYPVSVIVGEDSRPCGHKRLCEEKEASREFLREYNNRHNPKIKSNDKLVLKDLSLRTTNVDVDDNDDDDDASSYASSDLFELDHLAVFGSDRYSEELPVYETTHVSTNRAIANGLIV

SEQ ID NO: 220699 - protein, 80 aa, Glycine max
  Coding DNA Sequence Number=SeqID_103921
  Subcellular localization annotation: CTP_CleavageSite=47; ConfidenceScore=5.62e-01
MSFKNSPKIQHIGASPNVSRQSSTSSFRDKQQKNVEPPSPLPVGCCRGFSIAKTIGSPASTSQQNMQQLQYQRLEVKNSF

SEQ ID NO: 220700 - protein, 84 aa, Glycine max
  Coding DNA Sequence Number=SeqID_103922
MERTQDYLRNCLQIAQENGILDVIVNCKGEFQQSPVSIHTISSITSPQIQIPTPPHHGHHTNLASIIDQAKINGWYIDPNEVSK

SEQ ID NO: 220701 - protein, 214 aa, Glycine max
  Coding DNA Sequence Number=SeqID_103923
  Gene Ontology: Mol. function=protein serine/threonine kinase activity; Cellular component=membrane; Biological process=protein amino acid phosphorylation
  Homolog annotation: Hit_ID=Q67UT0; Match level="QueryCoverage=95%, HitCoverage=54%, E-value=4e-67, Identity=63%"; Hit description =Putative serine/threonine protein kinase
  Pfam annotation: Domain name=Pkinase; Domain location=4-207; Score =65.4; E_value=1.8e-16; Accession=PF00069.15; Description=Protein kinase domain
  Pfam annotation: Domain name=Pkinase_Tyr; Domain location=9-205; Score=-32.5; E_value=1.8e-10; Accession=PF07714.7; Description =Protein tyrosine kinase
  Pfam module annotation: Pfam domain module=Pkinase::Pkinase_Tyr; Domain location=4-207::9-205
MGACIDPPRRAWVVTEHLSTTLKEWLHGPGTRLRERMVPLPLFKDRVIRALEIAQAMQYLHEQKPKLVHRDLKPSNIFLDDAMHVRVADFGHARFLGDEEMALTGETGTYVYMAPEVIRCEPYDEKCDVYSFGVMLNELLTGHYPYVETEYGPTKIAIEVVEGNLRPKLPCDDVGQPRELIDLICLCWDKNPSTRPSFATITLCLKSYAKKNLL

SEQ ID NO: 220702 - protein, 187 aa, Glycine max
  Coding DNA Sequence Number=SeqID_103924
  Gene Ontology: Mol. function=acyltransferase activity; Cellular component=integral to membrane
  Homolog annotation: Hit_ID=Q2HTC9; Match level="QueryCoverage=93%, HitCoverage=34%, E-value=2e-44, Identity=55%"; Hit description =Chalcone and stilbene synthases, N-terminal
  Pfam annotation: Domain name=FAE1_CUT1_RppA; Domain location=39-187; Score=17.2; E_value=2e-17; Accession=PF08392.2; Description=FAE1Type III polyketide synthase-lik
MLAITLLLMFSVTGSLKLSKLCSHNHQLDTETVVAASAVLLSLAALYVVDFACYKPEKERKISVEGFLKMGEESVGFEEESRQFQRKISTRAGLGDETYFPRRITSCSPKLCMSKARLEVEAVMFGALDALLVITGVVPKDIDISMVNCSLFNPTPSLPAMIVNHYRPRSNIKSYNAHNHTIFGNQV

SEQ ID NO: 220703 - protein, 247 aa, Glycine max
  Coding DNA Sequence Number=SeqID_103925
  Gene Ontology: Mol. function=oxidoreductase activity; Cellular component=membrane; Biological process=metabolic process
  Homolog annotation: Hit_ID=Q5F4T6; Match level="QueryCoverage=98%, HitCoverage=98%, E-value=2e-95, Identity=72%"; Hit description=YgfF
  Pfam annotation: Domain name=Epimerase; Domain location=4-238; Score=- 36.6; E_value=0.00089; Accession=PF01370.11; Description=NAD dependent epimerasedehydratase family
  Pfam annotation: Domain name=KR; Domain location=5-192; Score=-18.3; E_value=2.7e-06; Accession=PF08659.1; Description=KR domain
  Pfam annotation: Domain name=adh_short; Domain location=2-175; Score =113.1; E_value=8e-31; Accession=PF00106.15; Description=short chain dehydrogenase
  Pfam module annotation: Pfam domain module=Epimerase::KR::adh_short; Domain location=4-238::5-192::2-175
MNLALVTGGSRGIGRATSLLLAQAGYRVAINFRQREAEALQVVADIEAQGGNAFALQADIADEAQVVRMFRQLDQQPGALRVLVNNAGILFSQCRVEDLDAARIQRVLATNVTGTFICCREAVKRMSTAHGGQGGAIVNVSSAAARTGSPNEYVDYAASKGAMDTLTRGLSLEVAAQGIRVNSVRPGLIYTDMHADGGEPGRVDRLAASLPMQRGGQAEEIAAAIVWLASDAASYVTGSFIDASGGR

SEQ ID NO: 220704 - protein, 251 aa, Glycine max
  Coding DNA Sequence Number=SeqID_103926
  Gene Ontology: Mol. function=transcription factor activity; Biological process=regulation of transcription, DNA-dependent
  Homolog annotation: Hit_ID=UPI00005FAA22; Match level="QueryCoverage =82%, HitCoverage=79%, E-value=2e-69, Identity=60%"; Hit description =COG1737: Transcriptional regulators
  Pfam annotation: Domain name=HTH_6; Domain location=1-92; Score=0.0; E_value=0.00092; Accession=PF01418.8; Description=Helix-turn-helix domain, rpiR family
  Pfam annotation: Domain name=LacI; Domain location=17-42; Score=15.6; E_value=0.071; Accession=PF00356.11; Description=Bacterial regulatory proteins, lacI f
  Pfam annotation: Domain name=SIS; Domain location=93-222; Score=55.6; E_value=1.6e-13; Accession=PF01380.12; Description=SIS domain
  Pfam module annotation: Pfam domain module=HTH_6::LacI::SIS; Domain location=1-92::17-42::93-222
MQVYHFIIKHRESVSYMTIRELAAQAGVSTTTVLRFCRKMHCDGWSEFRIRFRLAQEQSAPVLLPSGVGEMLSFFKSINNAEFDQQIATAAQMIIEAEHIFFIGAGTSGSLGKYGARYFSNIGKFSHHIDDPYYPVSKSAWENALAIILSVSGETEEILRFASQFSLHHCKIISITNHDNCSLAKMADFNLSYHVPQEKLPDRFDITTQDCSYPADFSGAARWQPIRLRAAGIRAAKASVSPMFSPAAHTA

SEQ ID NO: 220705 - protein, 252 aa, Glycine max
  Coding DNA Sequence Number=SeqID_103927
  Gene Ontology: Mol. function=DNA binding; Cellular component=integral to membrane; Biological process=cytolysis
  Homolog annotation: Hit_ID=P67153; Match level="QueryCoverage=61%, HitCoverage=70%, E-value=4e-71, Identity=87%"; Hit description =UPF0073 inner membrane protein yqfA
  Pfam annotation: Domain name=HlyIII; Domain location=109-252; Score =91.1; E_value=3.5e-24; Accession=PF03006.10; Description=Haemolysin -III related
MQAELTGKAQDLFAVTVHFAAEAQHRGGRDARLRRQFADGHITDTFPVFDDEVINLHLKVIQTGQNNFSVHVYSEIVLRYSGAQKKHNFRYDVQESDAMVQNRLIAQGYSLAEEIANSISHGLGCVFGIVGLVLLLTQAVEMQANITAITSYSLYGGSMILLFLASTLYHAIPHQRAKYWLKKFDHCAIYLLIAGTYTPFLLVGLQSPLAQGLMVVIWSLALAGIIFKLTIAHRFKVLSLVTYLSMGWLSLV

SEQ ID NO: 220706 - protein, 638 aa, Glycine max
  Coding DNA Sequence Number=SeqID_103928
  Gene Ontology: Mol. function=DNA binding; Biological process =transposition, DNA-mediated
  Homolog annotation: Hit_ID=Q8ZHK1; Match level="QueryCoverage=46%, HitCoverage=98%, E-value=1e-140, Identity=83%"; Hit description =Tyrosine recombinase xerD
  Pfam annotation: Domain name=DUF339; Domain location=62-134; Score =90.6; E_value=4.7e-24; Accession=PF03937.6; Description=Protein of unknown function (DUF339)
  Pfam annotation: Domain name=Phage_integr_N; Domain location=348-430; Score=106.7; E_value=6.8e-29; Accession=PF02899.8; Description=Phage integrase, N-terminal SAM-like domain
  Pfam annotation: Domain name=Phage_integrase; Domain location=461 -629; Score=241.0; E_value=2.5e-69; Accession=PF00589.13; Description= Phage integrase family
  Pfam module annotation: Pfam domain module=DUF339::Phage_integr _N::Phage_integrase; Domain location=62-134::348-430::461-629
MLKEQCAIATCLRNLAHKSRDNPVTGGMAVRHRAQRLVARLQRGEKAGTLSATVISCGRRHMDIHDKARVQWACRRGMLELDVSIMPFFKYEYDSLSDSDKQVFVALLKSDDPDLFNWMMNHGEPADPDARVLNVTLFGLCGALLLSCRWPAGWAWVQIAVVILLTLQCWRNARRLQQRSGALMLDDKGDWYWRALAAVAAARQHAARRVARATRPLFFAGWRDAALKQRGGFGQNLFTPLLDALFAQLKLINIVERQTDKLLTIGGQRFFTGELVAVERPVTDKLHAHRQQQFVQHTQRIKEPFAVLDLVAHAVQRHNFALQKQASFRHNEHDFTRRGATVQDSDLIEQFLDALWIERNLAQNTLASYRQDLQTLTAWLHHHERTLLTLEAADLQQFLAERIEGGYKATSSARTLSAMRRLFQYLYREKLRSDDPSALLSAPKLPQRLPKDLSENQVERLLQAPATDIPLETRDKAMLELLYATGLRVSELVGLTLSDVSLRQGVVRVIGKGNKERLVPLGEEAIYWLEHYMEHGRPWLLNGQTIDVLFPSNRAQQMTRQTFWHRIKHYATLAGIDSEKLSPHVLRHAFATHLLNHGADLRVVQMLLGHSDLSTTQIYTHVATERLRQLHQQHHPRA

SEQ ID NO: 220707 - protein, 40 aa, Glycine max
  Coding DNA Sequence Number=SeqID_103929
QSMSVTADHDPLFRLPLTPTKRQAFQDCDDEAGSSQISPA

SEQ ID NO: 220708 - protein, 108 aa, Glycine max
  Coding DNA Sequence Number=SeqID_103930
  Gene Ontology: Mol. function=oxidoreductase activity; Biological process=electron transport
  Homolog annotation: Hit_ID=Q0H210; Match level="QueryCoverage=43%, HitCoverage=9%, E-value=2e-14, Identity=87%"; Hit description =Abscisic acid 8'-hydroxylase
MINLRKLVQRSLSLEALRNLVPHIEALALSAMNSWGGDGQVINTFKEMKRWDSDSNSATEHHIGHIAEATNRPRRLGAQHKAVHTCTSLLLLIPIVYILVVSNLTAAN

SEQ ID NO: 220709 - protein, 63 aa, Glycine max
  Coding DNA Sequence Number=SeqID_103931
MAGHSSYTSGRCHTERAKGTTERVVRVRAQQREGREQGSAERRERTKGTMLWKERVKFSRERG

SEQ ID NO: 220710 - protein, 268 aa, Glycine max
  Coding DNA Sequence Number=SeqID_103932
  Gene Ontology: Mol. function=protein serine/threonine kinase activity; Cellular component=nucleus; Biological process=protein amino acid phosphorylation
  Homolog annotation: Hit_ID=Q5FAM4; Match level="QueryCoverage=92%, HitCoverage=95%, E-value=7e-41, Identity=42%"; Hit description =Putative bZIPtranscription factor protein
  Pfam annotation: Domain name=HLH; Domain location=158-208; Score =35.9; E_value=1.4e-07; Accession=PF00010.16; Description=Helix-loop -helix DNA-binding domain
MAEFTENLQNISSSSPFLDIDPSMELLNQFIGMNQLYVLDNSNLMPYFSCDTFLGPQEPEFPGNLEEDFPFLFHHVNHNAPPVSLPIFQAENEIHEGNKRKSMDLLETSFANSTSAVSETGSKIKHSSGRGKRLKNNVTEEEEKAKEVVNARARRGQATDSHNLAERVRRGKINEKLRYLQNIVPGCYKTMSMAVMLDEIINYVQSLQHQVEFLSLELTAASTFYDFNSEIDAFETMQRSRAYEAKELGKYKREGHGGVSLLQPTWHL

SEQ ID NO: 220711 - protein, 81 aa, Glycine max
  Coding DNA Sequence Number=SeqID_103933
MAFWRSLAFSAILLSLFIHGALCFYLPGVAPQDFQKQELRYWYLEIIVAVHLIRRSVVVVAICVNFTLIWCRWRDLDTSVM

SEQ ID NO: 220712 - protein, 230 aa, Glycine max
  Coding DNA Sequence Number=SeqID_103934
MNILTAHDQEWEQELSPYNQYEEERTPNLESVFEEFMAYHTSSKANQNSMKNHEIHFGKSYSIENFHGGPKLQPYHQNEAERGSNLDKLLMQFMETTKSTQQALQSVEIQVGELAKAMTQFVVRQEKSFVEVEAQKKSPVKEHESREKDEEKDEEQAQQQWEKYSTVENQQENILQTNNLPHQLIDKKGRQGEHKETLSAILSLIINTFLEMIWNVLPDYMKFMKFLAKR

SEQ ID NO: 220713 - protein, 42 aa, Glycine max
  Coding DNA Sequence Number=SeqID_103935
MAPKTCSQPASIPDHASSIKWHLNYLGKKKENHAREILCKDK

SEQ ID NO: 220714 - protein, 101 aa, Glycine max
  Coding DNA Sequence Number=SeqID_103936
VKLDSDQLTVIEKLKQKHLEQEKRELLVMEQEGGLCDGKEVDQFHQPSGSNEVAIANEDGISYGSELIEVDKMVLSGIFFGDRDVPKLQEIWKKNFREFRH

SEQ ID NO: 220715 - protein, 169 aa, Glycine max
  Coding DNA Sequence Number=SeqID_103937
  Gene Ontology: Mol. function=transcription coactivator activity; Biological process=progression of morphogenetic furrow during compound eye morphogenesis
  Homolog annotation: Hit_ID=Q949K3; Match level="QueryCoverage=90%, HitCoverage=23%, E-value=1e-58, Identity=71%"; Hit description =Suppressor-like protein
  Pfam annotation: Domain name=SGT1; Domain location=1-169; Score= -267.8; E_value=0.013; Accession=PF07093.2; Description=SGT1 protein
MHRVRVRVPVSVAQVLKHEPRLISLAVEGFYDRDIDTMKFASRMERFVERGKAEELVCVSVKMSRAMYAQLVQQRFQAPKCYPGMPARSEKEGFAEAELGMKIACGLEMMYQQRKRDGVEGKGSSWEAFRKSLESSGYFQGMLPGSSEYQRLMQSAQEYYRNTSLHSKA

SEQ ID NO: 220716 - protein, 274 aa, Glycine max
  Coding DNA Sequence Number=SeqID_103938
  Gene Ontology: Mol. function=3-isopropylmalate dehydratase activity; Cellular component=3-isopropylmalate dehydratase complex; Biological process=branched chain family amino acid biosynthetic process
  Homolog annotation: Hit_ID=Q8ZRJ0; Match level="QueryCoverage=100%, HitCoverage=57%, E-value=1e-128, Identity=83%"; Hit description=3 -isopropylmalate dehydratase large subunit 2
  Pfam annotation: Domain name=Aconitase; Domain location=5-274; Score =72.8; E_value=8.1e-19; Accession=PF00330.10; Description=Aconitase family (aconitate hydratase)
MAGKTLYEKLIEQHVVRHLDDEGHVLLYIDRSILNEYTSPQAFSGLRDRSRRVRHPATILLNVDHVNPTRPVRDAAMTDAGGQLQVDYFRKNAEHFGIELFDVLDPRQGIEHVVAHEQGLVMPGMVIAAGDSHTTTYGAFGALGFGIGTSEIEHLLATQTLIYRTLKTMRVEVTGELPFGCAAKDIVLALIEQIGASGATGYAIEFTGSAIDALSMEGRMTLCNMAVEAGARGAIIAPDDKVYAYIAGKPQMPVGELWQQALAEWRTLRSDDDA

SEQ ID NO: 220717 - protein, 45 aa, Glycine max
  Coding DNA Sequence Number=SeqID_103939
MEMEETFNSCFLHVFLATITPIVNHEDLRVAAVWGCTSTSMITSR

SEQ ID NO: 220718 - protein, 630 aa, Glycine max
  Coding DNA Sequence Number=SeqID_103940
  Gene Ontology: Mol. function=potassium ion transporter activity; Cellular component=integral to membrane; Biological process =potassium ion transport
  Homolog annotation: Hit_ID=Q6DB92; Match level="QueryCoverage=59%, HitCoverage=71%, E-value=1e-111, Identity=52%"; Hit description=Low affinity potassium transport system protein kup
  Pfam annotation: Domain name=K_trans; Domain location=266-588; Score=- 525.9; E_value=0.038; Accession=PF02705.7; Description=K+ potassium transporter
  Pfam annotation: Domain name=Lipoprotein_9; Domain location=1-162; Score=-8.3; E_value=1.4e-10; Accession=PF03180.4; Description=NLPA lipoprotein
  Pfam module annotation: Pfam domain module=K_trans::Lipoprotein_9; Domain location=266-588::1-162
TVKQVAHDKYQLDVDVVAFNDYVQPNEALFNKDVDANAFQSLPYLEMQSKERGYKFAVVTHTFVFPIAGAGPAEGETRSRSAADHAGYYRQPEKAEDCGSGYAAAGAHAGRSAGKASPYVNAIVAREDNKDSPNVQKLKEAFQSQPEQDYRTHRSGAIYCAFGQLCGVSLSAINRAATMCAGWWMVVPKYNAARIVAAQFIAHSGNCEVIAISCIFNHLAICAPPSHFLPVSPLLLLSESSTLQVEKAAAVKCMSQSEKQSLPAGMLAAAGIVFGDIGTSPLYTLKECLSILPDGAPSALAVMGFLSLIFWALTLIVTLKYVCFVMRADHDGEGGILTLMSLARRNVGRKAGHIIVLAGGLARAGKICGAAGAHHSRAAVHYPETRHGKGQPGVWPGDVCLVCGHRRTWHTRYSAQPGSAARAQSVLCADLPAQPQSALARGNGHGGAGGDRRGSAVRGHGPPGQSADSSRLAGDCHAGADTELLRPGRADSTDCAVNAGHGHRGAGGDFRRLYPDASGHSPRLFTADAHHFYFAYRVRADLHSGVVGVVLGVRHRSDRHHGDHRLSGGRGGAAKLALAAAAGAVVPAVYAGGRRAAVHRQPDEAAVRRLGAGAAGADHDGIDADLEQRA

SEQ ID NO: 220719 - protein, 227 aa, Glycine max
  Coding DNA Sequence Number=SeqID_103941
  Gene Ontology: Mol. function=helicase activity; Biological process =protein amino acid phosphorylation
  Homolog annotation: Hit_ID=Q1SN45; Match level="QueryCoverage=82%, HitCoverage=11%, E-value=3e-37, Identity=40%"; Hit description=AAA ATPase
  Pfam annotation: Domain name=DUF889; Domain location=1-201; Score =212.3; E_value=1.1e-60; Accession=PF05970.5; Description=Eukaryotic protein of unknown function (DUF889)
MRLHSNLESVDEQETATFAKWILDIGDEIIDDENDGYATIQIHAHLLITQYDDPISAIVKSTFPDLDQHHNNPEFFKSKAILASTNETVEQINDYVLSFIPGDHMEYLSSDSIDKSETNENSYFQSITTEFLNSLKTSGLPTHSIKLKIGSPIMLLRNLDQNQGLCNGTRLVVTKMAKHVIAAEIISEKPKMSTSSSTASTRIRYAIVRPPAIKQFRVAFHNDQVIV

SEQ ID NO: 220720 - protein, 183 aa, Glycine max
  Coding DNA Sequence Number=SeqID_103942
  Gene Ontology: Mol. function=transcription factor activity; Biological process=regulation of transcription, DNA-dependent
  Homolog annotation: Hit_ID=Q89N36; Match level="QueryCoverage=98%, HitCoverage=93%, E-value=2e-49, Identity=52%"; Hit description =Transcriptional regulatory protein
  Pfam annotation: Domain name=TetR_N; Domain location=1-46; Score =39.8; E_value=9.4e-09; Accession=PF00440.13; Description=Bacterial regulatory proteins, tetR family
MACTRQLLTAGGYKSFSYADIAAQVDIRKASIHHHFPGKADLVKAVVEEYRAEAQAGMQAMDEQINDPLNEVKAYVDYWAHCIKEGASPFCICAMLAAEMPTLPPDVATEVSGHFSDLSGWLARQLSKGAASGVFQLSDSAENEAKTLMASVHGAMLAARAFNNAGMFEQITHPLLHKLIKTA

SEQ ID NO: 220721 - protein, 152 aa, Glycine max
  Coding DNA Sequence Number=SeqID_103943
  Homolog annotation: Hit_ID=Q9HZG4; Match level="QueryCoverage=96%, HitCoverage=19%, E-value=2e-07, Identity=26%"; Hit description =Probable two-component sensor
  Pfam annotation: Domain name=Hpt; Domain location=55-139; Score=30.8; E_value=4.9e-06; Accession=PF01627.13; Description=Hpt domain
MNECVFRPVKLAQLTTILSQIHSASALSVGDDFSDWVDIAEIEKYMPNSPGAIADFLDIVINEARTDLTQAIDVVQSGDLVTAASLFHRITGSLRVTGIRQLTEQCEMLEELAEMQEDREIILLHLREALTLVDRMEASLRQQTTSAQAGAH

SEQ ID NO: 220722 - protein, 75 aa, Glycine max
  Coding DNA Sequence Number=SeqID_103944
MTICKMYNISKDMRKKAQVIQKQNTFPHVLFHGGYEFLENKLIEQKKSKQLEEAAKFGSTDTVIDPPSPIRRHVT

SEQ ID NO: 220723 - protein, 135 aa, Glycine max
  Coding DNA Sequence Number=SeqID_103945
MGEVEEVQEKMKADMEAMKEQMATMMEAMMIMKKIMEANAVAVAATSTVAKVNPMPPSGLNQMNHPTLAMVGKDLGSTGGPHDVKIQNEHAFPPYGLPLNYTPPNVVYTPNKNVNNSIPIPIESQQHQTDHAHVS

SEQ ID NO: 220724 - protein, 69 aa, Glycine max
  Coding DNA Sequence Number=SeqID_103946
MNRQEAFQSYPLGWYKPIGGHHVQRNQTFNCQSVHPQMSFFEISIGSNEREWKKKKFGLCGGVIWTRIE

SEQ ID NO: 220725 - protein, 67 aa, Glycine max
  Coding DNA Sequence Number=SeqID_103947
MAVIPDQTTATLAFVSQDNLVFEEPVPLEGNKEKRRKGYAHNRMDSALWNWQASKGQDCQVSFSRYK

SEQ ID NO: 220726 - protein, 47 aa, Glycine max
  Coding DNA Sequence Number=SeqID_103948
MLWKERANGASERGVRVRAQQREGRERGSAMLWKERVRFSKERGCAT

SEQ ID NO: 220727 - protein, 81 aa, Glycine max
  Coding DNA Sequence Number=SeqID_103949
  Homolog annotation: Hit_ID=A0FKR1; Match level="QueryCoverage=44%, HitCoverage=6%, E-value=6e-08, Identity=64%"; Hit description =Vacuolar citrate/H+ symporter
AQRRFRPPGSVGDQDEGEEKETVHWKNAVNGLVLSILVWASALAKPTTFDGVEVGSQKANSVAIPPGIIRIRGCTCIVPAM

SEQ ID NO: 220728 - protein, 178 aa, Glycine max
  Coding DNA Sequence Number=SeqID_103950
  Subcellular localization annotation: CTP_CleavageSite=64; ConfidenceScore=5.47e-01
MQRLTSSTAPFAIAANEPVDTQRFTSSSALSVILTLKSGDVRRYTNSKHDSAQRPTSSSAPFVVLTREVSQVTCGGYRMVTRTFRQQGENEPVDAKRLTSSSTPFAIQGQRVRWQAKIPYGHPHLSSIEGNKFDGFTLVVRKHSSPTTHEILFYWAGTIECNGVGKCCGCPTLSLSRR

SEQ ID NO: 220729 - protein, 161 aa, Glycine max
  Coding DNA Sequence Number=SeqID_103951
  Homolog annotation: Hit_ID=Q6CQF3; Match level="QueryCoverage=34%, HitCoverage=59%, E-value=3e-08, Identity=72%"; Hit description =Kluyveromyces lactis strain NRRL Y-1140 chromosome D of strain NRRL Y- 1140 of Kluyveromyces lactis
AYCRDRKMVNYAERGEARGNSGGGRSDTDVQSIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKIPEPGRGG

SEQ ID NO: 220730 - protein, 77 aa, Glycine max
  Coding DNA Sequence Number=SeqID_103952
  Homolog annotation: Hit_ID=Q6R3K4; Match level="QueryCoverage=53%, HitCoverage=5%, E-value=2e-08, Identity=69%"; Hit description=Metal -nicotianamine transporter YSL8
MTATLTNSQRHRIECKKEGTAKGYARGCHNTGLDDSVLLPCEGLPQHVRFLQIPSQDFKTMYFTCDNTKYKYFLIMA

SEQ ID NO: 220731 - protein, 91 aa, Glycine max
  Coding DNA Sequence Number=SeqID_103953
MENLHEIAYENVSEAGNEGGGCRPARPGQLGCFLQKAPPSVGTPWKVQIVQQCFLSTFGTSRNFTDCLTMGVKYLKAVKRRLHPTKQMVPK

SEQ ID NO: 220732 - protein, 126 aa, Glycine max
  Coding DNA Sequence Number=SeqID_103954
  Subcellular localization annotation: CTP_CleavageSite=31; ConfidenceScore=5.68e-01
MPSPLRRGFGTCAQGKTSSANSARGGARKTVSMRKPSPSCCAYRGRISPGPLQGGSNVLPSDHNSDLPLPKCQLVYAILTWMSVHVAQEWRLLAPFGPREVQQGPGVSGSNHGPLPVLRSSCHPQQ

SEQ ID NO: 220733 - protein, 176 aa, Glycine max
  Coding DNA Sequence Number=SeqID_103955
  Gene Ontology: Mol. function=transferase activity; Cellular component= intracellular; Biological process=translation
MRVDALRRKGLSPLQKCTTTIHILAYGSPADSVDEYVRIGETTAVECLERFVLGICTIFGNEYLRRPNNEDIKRLLQMGAAHGFPGMLGSIGCMHWEWKNCPVAWKGQFCRDDHRNPTIILEAVASQDLWIWHAFFGTADDIYPDFVTFMKTISMSQGEKRKLFAQRQESARKDVE

SEQ ID NO: 220734 - protein, 126 aa, Glycine max
  Coding DNA Sequence Number=SeqID_103956
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q9LT92; Match level="QueryCoverage=94%, HitCoverage=46%, E-value=4e-38, Identity=66%"; Hit description =Arabidopsis thaliana genomic DNA, chromosome 5, P1 clone:MJM18
MTEKSTRKRKMGDTEETAPKKPAAKWPLIKPKKNLQISHLLDFDLFSVQNFFSSAESKAFVKIAEEIGFAHQGSRGGEAYRDNDRISVDDPVLADTIWESGLSKLFSDIKIRGKVAVGLNPNVRFY

SEQ ID NO: 220735 - protein, 103 aa, Glycine max
  Coding DNA Sequence Number=SeqID_103957
  Gene Ontology: Mol. function=sequence-specific DNA binding; Cellular component=nucleus; Biological process=regulation of transcription, DNA-dependent
  Homolog annotation: Hit_ID=Q9ATE7; Match level="QueryCoverage=59%, HitCoverage=28%, E-value=7e-22, Identity=80%"; Hit description=MADS -box transcription factor FBP22
  Pfam annotation: Domain name=SRF-TF; Domain location=41-91; Score =107.6; E_value=3.5e-29; Accession=PF00319.9; Description=SRF-type transcription factor (DNA-binding and dimerisation domain)
MDGIREYTLFCGLNNSYHKCHFAGSGDPRTREMARGKVQLKKIEDTTSRQVAFSKRRSGLLKKAYELSVLCDAEVAVIVFSQNGRLYEFSSSEYVFLHYTCSA

SEQ ID NO: 220736 - protein, 61 aa, Glycine max
  Coding DNA Sequence Number=SeqID_103958
  Subcellular localization annotation: CTP_CleavageSite=38; ConfidenceScore=5.47e-01
KKLKSVKLLLSAQDRSSASPHLARRKSTKKSKGALNVKARTKREVASKLNYLNTNPYATTN

SEQ ID NO: 220737 - protein, 93 aa, Glycine max
  Coding DNA Sequence Number=SeqID_103959
  Gene Ontology: Mol. function=sequence-specific DNA binding; Cellular component=nucleus; Biological process=regulation of transcription, DNA-dependent
  Homolog annotation: Hit_ID=Q9FIS1; Match level="QueryCoverage=79%, HitCoverage=35%, E-value=1e-14, Identity=50%"; Hit description=MADS box protein-like
  Pfam annotation: Domain name=K-box; Domain location=1-82; Score=26.5; E_value=2.6e-06; Accession=PF01486.8; Description=K-box region
MQQLKLDSVSMTKKIELLEHSKRKLLGQSVSSCSFDELKGIEEQLRTSLQRVRQRKTQLYTEQIDRLRSQGEKLIFSAIYMEMLTSVIEILCA

SEQ ID NO: 220738 - protein, 314 aa, Glycine max
  Coding DNA Sequence Number=SeqID_103960
  Gene Ontology: Mol. function=DNA binding; Cellular component =chromosome, pericentric region; Biological process=DNA integration
  Homolog annotation: Hit_ID=Q3KCJ9; Match level="QueryCoverage=100%, HitCoverage=81%, E-value=1e-100, Identity=59%"; Hit description =Integrase, catalytic region
MKRRTRINYTPEQKAIIWDRYKQGDSLHDIARMFDRYHSSIMPTIHQTGGYRPPVRKRHPLALSLDEREEISRALVAKISIRAIANKLSRAPSTISREIKRHGGANQYRASKADTAAWENALRPKPCKLIERPTLCKIIAEKMHQDWSPEQIAGWLKRCYPDNQEMHVSHETIYKTLFIQTRGALKKELQQCLRSGRVVRRSRTSSLKGKGLGSIRDTISISERPPEAADRAIPGHWEGDLIQGSKNSYIVTLVERHSRFVMLAKIRDNKTITVISALIKQARELPAELYKTLTWDRGAEMTSHTRFTVATDIQ

SEQ ID NO: 220739 - protein, 202 aa, Glycine max
  Coding DNA Sequence Number=SeqID_103961
MVQNKDKELRGSSNGPIGGYHRWLKAYMQVEVPEEDEEVQALKTEIEKAQIVKEKFKSAALKIRKENAELRDVNIATTKALEQETKRARREEHGRNKFRGALWGSNNELKLRREERDQSRVDSLILKDELRICLRSKRSLSQRLCETETNMLAIISKYQEELNLATAHEHKVADEYARVYVEKEARGRVIDSLHQEATMWMD

SEQ ID NO: 220740 - protein, 372 aa, Glycine max
  Coding DNA Sequence Number=SeqID_103962
  Homolog annotation: Hit_ID=Q9FIS0; Match level="QueryCoverage=74%, HitCoverage=39%, E-value=5e-33, Identity=38%"; Hit description =Arabidopsis thaliana genomic DNA, chromosome 5, P1 clone:MTG10
MGKEWHRDGRSSKRGGGAQTEIPSGCMCAMFQVFDYHPFHFSIDQQQSSFKSRTPEDHTVPKGVEAPRSSLESETGTTVSSISKEENFKIPKNIRIKTRGSTRSRTESFSDFSSEIGASPGTKTPTLVARLMGLDLLPDAHSSSSPCLSTPNLHKPQQHIKIIKHRNSTGSNALPETPRMSSARRSDVEHRQSLQINKENNTVPYEDSESPRFSFSKRKYDENNFRSPSHYARQIVKQIKESVSRKVGLDITNTVKNREQGREESVGQFKFKKKSKTSVNESSPVKHSNSSYSPRLNRFIDTKHKPSTTTQSPTTPKNQNIHILKPPSTTTPKNLNTHSVLKPPSPPPVVNIETQLSRVSTKPKPQASPETE

SEQ ID NO: 220741 - protein, 282 aa, Glycine max
  Coding DNA Sequence Number=SeqID_103963
  Homolog annotation: Hit_ID=Q9FIS0; Match level="QueryCoverage=46%, HitCoverage=18%, E-value=9e-13, Identity=36%"; Hit description =Arabidopsis thaliana genomic DNA, chromosome 5, P1 clone:MTG10
  Subcellular localization annotation: CTP_CleavageSite=75; ConfidenceScore=5.41e-01
NQKSVTKGKNTGSGKLSSRVNKPPQTSIRNKQEESFITRPPSATKANDIKTKSKRTHPLSSNLLNNLNTVPNLLPVKTGPSPQKQSQPQVRDDDARDERRSAQLFSSSRPTYKQEAPRSHPPRGATTSSDDDKLHGTSATTTGADDDEGPEYQYITSILTRSTTTGPHNSNSATALIPHLQFQWFSPTHPLDPSVFHCLEHYPTSNSFVSFPGDNKDCIFQRKQHLGPRCNRRLLFDLVDELLSEILVRPRRYREALLETTVWERVRRFPRAKCEVLEDMMR

SEQ ID NO: 220742 - protein, 134 aa, Glycine max
  Coding DNA Sequence Number=SeqID_103964
  Homolog annotation: Hit_ID=Q3SC87; Match level="QueryCoverage=86%, HitCoverage=45%, E-value=5e-40, Identity=72%"; Hit description=ACI13
MCIIGKKYIQENYSKIRNVERELANLSLEMKLTAGPKKAALEHLRKKIEESTERIRVAKLKEEQARKVWESASKVVRDEEALKQKLCEDLSNLVQESSNSQFARLEELKRRLEALNPTRASTNLYHIYLVSGGF

SEQ ID NO: 220743 - protein, 70 aa, Glycine max
  Coding DNA Sequence Number=SeqID_103965
MDDFNPFTRLHVLNTLASHKLTQKVFKRESLAKTEIRLFNFYLVDANALALAPADYRAAPASQSSQRFKN

SEQ ID NO: 220744 - protein, 158 aa, Glycine max
  Coding DNA Sequence Number=SeqID_103966
  Gene Ontology: Mol. function=sequence-specific DNA binding; Cellular component=nucleus; Biological process=regulation of transcription, DNA-dependent
  Homolog annotation: Hit_ID=Q56NI6; Match level="QueryCoverage=93%, HitCoverage=58%, E-value=1e-53, Identity=72%"; Hit description=MADS box protein M3
  Pfam annotation: Domain name=K-box; Domain location=93-157; Score =14.7; E_value=2.5e-05; Accession=PF01486.8; Description=K-box region
  Pfam annotation: Domain name=SRF-TF; Domain location=17-67; Score =113.6; E_value=5.7e-31; Accession=PF00319.9; Description=SRF-type transcription factor (DNA-binding and dimerisation domain)
  Pfam module annotation: Pfam domain module=K-box::SRF-TF; Domain location=93-157::17-67
AERGIEASMGRGKVVLERIQNKINRQVTFSKRRNGLLKKAFELSVLCDAEIALIIFSSRGKLFQYSSTEYFSSLILYIPSINRIIDKYRQCCFNMSQTGDVTEHQSEQELLILRVKHESLQRTQRNLLGEELEPLSMKELHSLEKQLDRTLGQARKHL

SEQ ID NO: 220745 - protein, 147 aa, Glycine max
  Coding DNA Sequence Number=SeqID_103967
  Homolog annotation: Hit_ID=Q2HRE1; Match level="QueryCoverage=76%, HitCoverage=39%, E-value=4e-14, Identity=50%"; Hit description =Lipopolysaccharide-modifying protein
  Pfam annotation: Domain name=DUF821; Domain location=4-141; Score= -220.3; E_value=9.6e-08; Accession=PF05686.3; Description=Arabidopsis thaliana protein of unknown function (DUF821)
IGFENYKRGSTNQTCQVNALIDIRCTLKVLLGQSVKNTFCHVTLPLYVYDYMFHLLNSYAKLFRYKPSISANATELCVESMVCGAEGSVKKFMMESLVKVPANTDPCTMPAPFDPPTLYATSQRKESSIQQVESWEKSYCDNQTITS

SEQ ID NO: 220746 - protein, 50 aa, Glycine max
  Coding DNA Sequence Number=SeqID_103968
MNSLPGVVHVSSVIKRGASEKRRSRDESRHHGKGRTDQISVLSLLSSYLR

SEQ ID NO: 220747 - protein, 95 aa, Glycine max
  Coding DNA Sequence Number=SeqID_103969
MEINTIPCCASASNESDINNIFPNGCLKVMKSYLLVKDNLEKKQLCDNTITLQIVSQIRILPWTTGSKYGSSCWKAQDCTLIGIKALLVINNLEA

SEQ ID NO: 220748 - protein, 112 aa, Glycine max
  Coding DNA Sequence Number=SeqID_103970
MAVAAESGANARPAGDLPSGGCRKNGMDSSMAFVSYTLTIAYLISPITLLHCEKSIPIICIKWKVCNNPDPLGREIDIGSYKIAFHPYHECIDYHPFASSLPCRQTNSPCVT

SEQ ID NO: 220749 - protein, 128 aa, Glycine max
  Coding DNA Sequence Number=SeqID_103971
  Homolog annotation: Hit_ID=Q8W486; Match level="QueryCoverage=98%, HitCoverage=23%, E-value=6e-31, Identity=57%"; Hit description =Similar to auxin-independent growth promoter
MARATVSTISLDIAFIMAFGLACLGVIVRVSKHAITLNRKSLAPIFIDRENGRTTSFKEAVRKVMLKINFGEPHKRVSPKSFYTNSWPECFCQTSAQNPAEKCLPNDILNIMNNELDKTKTAANSTIS

SEQ ID NO: 220750 - protein, 619 aa, Glycine max
  Coding DNA Sequence Number=SeqID_103972
  Gene Ontology: Mol. function=intramolecular transferase activity, phosphotransferases; Cellular component=chloroplast; Biological process=carbohydrate metabolic process
  Homolog annotation: Hit_ID=Q9SM59; Match level="QueryCoverage=99%, HitCoverage=100%, E-value=0.0, Identity=75%"; Hit description =Phosphoglucomutase, chloroplast precursor
  Pfam annotation: Domain name=PGM_PMM_I; Domain location=84-252; Score= 69.9; E_value=8.3e-18; Accession=PF02878.6; Description =Phosphoglucomutasephosphomannomutase, alphabetaalpha domain I
  Pfam annotation: Domain name=PGM_PMM_II; Domain location=258-367; Score=106.7; E_value=6.8e-29; Accession=PF02879.6; Description =Phosphoglucomutasephosphomannomutase, alphabetaalpha domain II
  Pfam annotation: Domain name=PGM_PMM_III; Domain location=369-482; Score=107.6; E_value=3.7e-29; Accession=PF02880.6; Description =Phosphoglucomutasephosphomannomutase, alphabetaalpha domain III
  Pfam annotation: Domain name=PGM_PMM_IV; Domain location=503-608; Score=70.0; E_value=7.5e-18; Accession=PF00408.10; Description =Phosphoglucomutasephosphomannomutase, C-
  Pfam module annotation: Pfam domain module=PGM_PMM_I::PGM_PMM_II::PGM_ PMM_III::PGM_PMM_IV; Domain location=84-252::258-367::369-482::503-608
  Subcellular localization annotation: CTP_CleavageSite=54; ConfidenceScore=5.48e-01
MAFSCKLDCFILPAYKPQNSILPLSIQPSSFLPSPSSFKPQKLPFGIRYGSTIRVTSSSSTPSTTIAEPEGIKIKSIPTKPIEGQKTGTSGLRKKYMDCVSVDMDGGEVMIGDTFMLENEIKLKCWVKVFMQDNYLANWIQALFNSLPPEDYKNGLLVLGGDGRYFNREAAQIIIKIAAGNGVGKILVGQEGILSTPAVSAANGGFIMSASHNPGGPEYDWGIKISVIKIADILDVDISKVGVTKFGSFSVEVIDPVSDYLELLETVFDFQLIKGLLSRPDFRFIFDAMHAVTGAYAKPILVDKLGASLDSISNGIPLEDFGHGHPDPNLTYAKDLVNILYAENGPDFGAASDGDGDRNMILGRSFFVTPSDSVAVIAANAREAVPYFKNGVKGLARSMPTSGALDRVPTGWKFFGNLMDAGNLSVCGEESFGTGSDHIREKDGIWAVLAWLSIIAHRNKDKKPGEKLISVSDIVTEHWATYGRNFFSRYDYEECESEGANKMIEHLRDIVSKSKPGDQYGSYVLQFADDFAYTDPVDGSVVSKQGVRFVFTDGSRIIYRLSGTGSAGATVRVYIEQFEPDVSKHDVDAQIALKPLIDLAISMSKLKDFTGREKPTVIT

SEQ ID NO: 220751 - protein, 383 aa, Glycine max
  Coding DNA Sequence Number=SeqID_103973
  Gene Ontology: Mol. function=oxidoreductase activity; Cellular component=cytoplasm; Biological process=response to gibberellin stimulus
  Homolog annotation: Hit_ID=O04281; Match level="QueryCoverage=92%, HitCoverage=91%, E-value=0.0, Identity=90%"; Hit description =Gibberellin 20-oxidase
  Pfam annotation: Domain name=2OG-FeII_Oxy; Domain location=228-327; Score=166.5; E_value=7e-47; Accession=PF03171.10; Description=2OG -Fe(II) oxygenase superfamily
MAIDCITSIPMMPQAPPQETTKEQQEQQPLVFDASVLRHQLHIPSQFIWPDEEKACLDEPELLVPFIDLGGFLSGDPVAAAEASRLVGEACQKHGFFLVVNHGIDQRLISDAHLYMEHFFGLPLSQKQRAQRKPGEHCGYASSFTGRFSSKLPWKETLSFQYSADKNSSPTLVKDYLCSKMGNEFEQFGKVYQDYCDAMSRLSLGIMELLGMSLGVGRACFREFFEENSSIMRLNYYPPCQKPDLTLGTGPHCDPTSLTILHQDQVGGLQVCVDNEWHSIKPDFNAFVVNVGDTFMALSNGRYKSCLHRAVVNSQTTRKSLAFFLCPRSDKVVSPPCELVDNLGPRLYPDFTWPMLLEFTQKHYRADMKTLEAFANWLQRKSN

SEQ ID NO: 220752 - protein, 117 aa, Glycine max
  Coding DNA Sequence Number=SeqID_103974
  Homolog annotation: Hit_ID=Q0ZPV6; Match level="QueryCoverage=49%, HitCoverage=26%, E-value=2e-10, Identity=39%"; Hit description=CXE carboxylesterase
  Pfam annotation: Domain name=Abhydrolase_3; Domain location=1-99; Score=-91.0; E_value=0.084; Accession=PF07859.3; Description =alphabeta hydrolase fold
MDRLPAAYEDAMDALHWIKTTNEDFFTSHVDYSRCFLMGERGGLILVQPFFGGTKRTPSEGCDGDLLVNRRVGFEKFLEEKGVHVEGHFFRGGYHGVFLSDPSMENNLYHLFIQIQK

SEQ ID NO: 220753 - protein, 664 aa, Glycine max
  Coding DNA Sequence Number=SeqID_103975
  Gene Ontology: Mol. function=RNA-directed DNA polymerase activity; Cellular component=chromatin; Biological process=chromatin assembly or disassembly
  Pfam annotation: Domain name=RVP_2; Domain location=224-348; Score= -38.2; E_value=0.00095; Accession=PF08284.2; Description=Retroviral aspartyl protease
  Pfam module annotation: Pfam domain module=RVP_2::RVT_1; Domain location=224-348::473-645
  Subcellular localization annotation: CTP_CleavageSite=28; ConfidenceScore=5.49e-01
MGLTTGPSFITTTIMSMDHQERRKKTVSQSPPSTLMELRSAGSNGCLGTLIQRGSVTEFERLTNRIVGLSPPVLLSCFISDLNPKIRREVQALQPTSLPHATALARLQEDKLNDRQKYSRSSFPSPEPRASAPLNQSQTPRLKTPFIQRTQEDMAYRCEKGLCYNCDEKWNSSHRCKGRVLFFIADFEDPFFPEPSSLEKPPSPTVEPTQSFDPSSLHPHISLHAMAGVPATDTFRLYGVVNHARVTILVDSDSTHNFVQPRVVKFFNLLMEDMMLLRVQMGNGSVLDCRQLCSSTTLLIQNHSFTVTLCVLPLSGVDIVLGVEWLRTLGLIITDYSSFTMQFTHLGQPITLRTDVQSNIEPALAHQVKRMIHTHSTSTLFHLSLLPVSQPEPSIDPVHLISAINKLLLKFSSLFHQPTTLPLPCQHDHHINLIPSANPVNVRPYRYPHFQKIKIEKQVMALLDSSLIQPSRSPFSSLVLLVKKKDGMWRMCVNYRALNSITVRDRFLLPTIEELIDELGRALWFSKLDLRQGFHQILMVDKDVPKAVFRTHHGHYDESLADHLHHLECVFNSLSQAQYYLKLSKCLFGQRQLDYLGHVVSGEGIQPNPSKESQAAFDTLKTTMTKAPVLALPNFTLPFCPGKRCFGHCYGCRPPSTESPHRIL

SEQ ID NO: 220754 - protein, 211 aa, Glycine max
  Coding DNA Sequence Number=SeqID_103976
  Gene Ontology: Mol. function=chromatin binding; Cellular component =chromatin; Biological process=chromatin assembly or disassembly
  Homolog annotation: Hit_ID=Q1SAV4; Match level="QueryCoverage=99%, HitCoverage=61%, E-value=5e-66, Identity=49%"; Hit description =Integrase, catalytic region
  Pfam annotation: Domain name=rve; Domain location=34-158; Score=35.1; E_value=2.5e-07; Accession=PF00665.16; Description=Integrase core domain
MATDVKTFIRQCNVCQQVKHVARKSADLLQPIPIPNGIWEDLSMDFVTHLPSSHGFTVVFVVVDRFSKGVHLGALPTHFTMFKVANLFLNTVCKLHDFPHSIISDQDPIFIGSFWRELFRLSGTTLCMSTAYHPQSDEWAYNTSQHFSIGVTPYEVVYGKPPPSIPSYLLGSSRNDVVETMILTREEIHATLRRKLLKAHNAMKHFADKKQ

SEQ ID NO: 220755 - protein, 94 aa, Glycine max
  Coding DNA Sequence Number=SeqID_103977
MCIGPILKHSHEQETRLSGTQITSYVHQTASCSLKPLVTTEIGQSSIIAGNTKTILRVTMQMAMPQACHSPLMVMPSTMQMCLFNGFLDGPKVL

SEQ ID NO: 220756 - protein, 60 aa, Glycine max
  Coding DNA Sequence Number=SeqID_103978
MTTKGSALEVKDFEHKPIHRSCSFITFYGIARSCKQMQLIYNHNFGCVAIINMPKTLRCG

SEQ ID NO: 220757 - protein, 94 aa, Glycine max
  Coding DNA Sequence Number=SeqID_103979
MDHPKHLEAFAQLSLDGTDHRMALAEAGTIPILIDLMNDVDEVEELRDNDVEALVNYYVDPLYHDRVSDAIKIPSFRNMHNKIDSYSCIERAHG

SEQ ID NO: 220758 - protein, 104 aa, Glycine max
  Coding DNA Sequence Number=SeqID_103980
SKSPAFVDHPTFCYRDPRVRWHAEPHDRGIPRSIFSFMFPLLSALNEYRSGVIDILIGSVHHIGWRIVGRQAIWWVSQPTLRREGDAGLIGASSKEGRHTESPP

SEQ ID NO: 220759 - protein, 39 aa, Glycine max
  Coding DNA Sequence Number=SeqID_103981
DYAIQLHDAIDKNLLLQEPLVVMLTLGKIKDATSVSGVG

SEQ ID NO: 220760 - protein, 171 aa, Glycine max
  Coding DNA Sequence Number=SeqID_103982
  Gene Ontology: Mol. function=transcription regulator activity; Cellular component=nucleus; Biological process=regulation of transcription
  Homolog annotation: Hit_ID=Q1S0Z9; Match level="QueryCoverage=96%, HitCoverage=85%, E-value=1e-56, Identity=68%"; Hit description=Helix- loop-helix DNA-binding
  Pfam annotation: Domain name=HLH; Domain location=18-70; Score=29.2; E_value=1.5e-05; Accession=PF00010.16; Description=Helix-loop-helix DNA-binding domain
MAQENQHIILVTSDNDERKIIRREVEKQRRTNMSILCASLRSSLPFELIKGKRSASDHIGEAVNYIQILKQKINALQVKRDRLKLMVNSSLLETSIDQPEHSGAVVKCVNINLIPGGVEIAICSSGLEEGSNSPLSEFMEILLQEGCDVVSCVSTLANGRIFHAIKCEVPC

SEQ ID NO: 220761 - protein, 62 aa, Glycine max
  Coding DNA Sequence Number=SeqID_103983
MPISPCERITLARHPVDPKKSNRALGFPTLVMGLCQFYRVPVPPARSCHRDIGKYALLSTDF

SEQ ID NO: 220762 - protein, 231 aa, Glycine max
  Coding DNA Sequence Number=SeqID_103984
  Gene Ontology: Mol. function=peroxidase activity; Biological process =aromatic compound metabolic process
  Homolog annotation: Hit_ID=Q35N56; Match level="QueryCoverage=90%, HitCoverage=64%, E-value=9e-78, Identity=66%"; Hit description=Non -heme chloroperoxidase
MQPLRAAGGDSSQVHRAPLERRILDKGQQIGVEAIGIDLRQPVSAVGVYVQLRLLHKLSGFQRRGADRHDPIGVAMHQQRRPVDRQQIGGEVHFGERAHAVVLPFHAALHAHQPEVVDQPRIALHLVAVETVERHRQIFEELRAVARHAAANAVEGRHRCAFRVDRRLQHQRRHGAHQHHLRHPIAAVAADVARHFAAADGVADQDQIAQIQRFDQQGQIVGVLVDVVAVP

SEQ ID NO: 220763 - protein, 256 aa, Glycine max
  Coding DNA Sequence Number=SeqID_103985
  Homolog annotation: Hit_ID=Q1SKD7; Match level="QueryCoverage=78%, HitCoverage=53%, E-value=9e-14, Identity=27%"; Hit description =Ankyrin
  Subcellular localization annotation: CTP_CleavageSite=22; ConfidenceScore=5.02e-01
MEFMHKAPVPPWSLIVTVFGVSSTNSASRPSRDGLSTGRDKYPDFQGDISCRHWARLVTPMAKFDPEIVIEFYANAWPTEEGVRDMRSRVRGHWVPFDADVNSQFLGDPLILKKDQQCEFSQRRRQADGFDEEAIAQLLCMPGQDFARTAAGRQVWIMRTNMTTLTQIWMTLLHSNVLPSDHNSDLPLPKCQLVHAILTQMSVHMAQVIADAIYLFAGMAPTRHPLDLEKSNRALGFPALITGLCQSYGVPITPSK

SEQ ID NO: 220764 - protein, 146 aa, Glycine max
  Coding DNA Sequence Number=SeqID_103986
  Pfam annotation: Domain name=Transposase_23; Domain location=37-106; Score=-0.5; E_value=0.0013; Accession=PF03017.5; Description =TNP1ENSPM transposase
MQSQGLALPPEPEVAPSGPRVGTKESCVDPSGNDPKMGDSNKCGLYIEANPPHLVALGRLYEGSTVHNIPLLPGQVKVGVEEVKDAQAPVLVPTDEVTLVGQTLNTFLAWPTHLMKALSVQRNYLTMFDQQAVVSPAKPPQRPDPE

SEQ ID NO: 220765 - protein, 101 aa, Glycine max
  Coding DNA Sequence Number=SeqID_103987
  Subcellular localization annotation: CTP_CleavageSite=26; ConfidenceScore=5.13e-01
MSRASSSSAFVLPKNTQNLEAICVVRCQNSNRAYLGMTKQRCLGSSLAGPSILHGWAPSLGPSERLSSPTPGDVPHPHLSYPNFVRGPLLDDMRPFFGPCE

SEQ ID NO: 220766 - protein, 63 aa, Glycine max
  Coding DNA Sequence Number=SeqID_103988
  Gene Ontology: Cellular component=chloroplast
MDRTWTDQAGPCEQLDALSPFNPLSEMWQKEKESMDRPHRLHPVGTTRSPQGRLRHPGVADRP

SEQ ID NO: 220767 - protein, 124 aa, Glycine max
  Coding DNA Sequence Number=SeqID_103989
QFERLTISGIPGSTLIFNSPKHFVAYYALPRLWVPSSRVGDKRTRTADIRHRDPATGEPGTESFPRPPFFSARLFALKNTGFYGRSATPGCRRRPWGDLVVPTGEIVHQAVRKGQLDPLPQDPK

SEQ ID NO: 220768 - protein, 158 aa, Glycine max
  Coding DNA Sequence Number=SeqID_103990
MVETHEGGGDYAFANMAELCLVPDVIIPPKYKVSDFNKYKGTTCSNNHPKTYCRKMGAYAKDEKLLMHFFQESLTGAAVTWYTNLEPSRVRSWKDLMLQHMCKKEHKSFKEYTQRWRDLAAQVAPPITEKEMITMIVDTLLVFYYEKMVDTCLQDLPI

SEQ ID NO: 220769 - protein, 176 aa, Glycine max
  Coding DNA Sequence Number=SeqID_103991
MRLSFAQEKCLLEAILVVGVQITMANALPEASTSFKSQFHHGKIGSFEARWQGQIVSHTRSQFLLRRGSNQRRQHLQSKLLKLLSLNNLKCEMNLLMTLRGFSTSILKLYIMPISRGEIYNERIKLKEDEFPNEKQVFEDRGWNQLMKLGVCNESLVREFYANVVLNNVEQVASIT

SEQ ID NO: 220770 - protein, 88 aa, Glycine max
  Coding DNA Sequence Number=SeqID_103992
  Subcellular localization annotation: CTP_CleavageSite=33; ConfidenceScore=5.41e-01
MTSQKRSSSKPTCKVWDPTFAASTLTCPGSGFRLEHLASTVEPRTRSGLRRETPLEDSHPHSAAVVDMDILRLLQNRIARWSNAMKRS

SEQ ID NO: 220771 - protein, 211 aa, Glycine max
  Coding DNA Sequence Number=SeqID_103993
  Gene Ontology: Mol. function=RNA-directed DNA polymerase activity; Cellular component=mitochondrion; Biological process=RNA-dependent DNA replication
  Pfam annotation: Domain name=rve; Domain location=5-123; Score=4.9; E_ value=0.0023; Accession=PF00665.16; Description=Integrase core domain
MWGMNILRPLSKVTGVVKYLLVVIDYFIKWIEARPLWEIMASEVEKFTWKHLICRMGIKHLVTSVEHPQTNGQAEAANKVILRAMCTRLNKFKGLWIDLYSILWVYHCSPQTKTNETPYRLTYDTNVMIRIEVGKPSTRRLLFQQQQNEENMRVELETTEEVKEMARIREDATKLQAARRYNIKVQPQTFQPSSIKPSTHPITSHSLTLRA

SEQ ID NO: 220772 - protein, 817 aa, Glycine max
  Coding DNA Sequence Number=SeqID_103994
  Gene Ontology: Mol. function=nucleic acid binding; Cellular component= nucleus; Biological process=meristem development
  Homolog annotation: Hit_ID=Q6J738; Match level="QueryCoverage=95%, HitCoverage=93%, E-value=0.0, Identity=77%"; Hit description=AML5
  Pfam annotation: Domain name=RRM_1; Domain location=174-240; Score =52.8; E_value=1.1e-12; Accession=PF00076.12; Description=RNA recognition motif. (a.k.a. RRM, R
  Pfam annotation: Domain name=RRM_1; Domain location=259-325; Score =55.1; E_value=2.3e-13; Accession=PF00076.12; Description=RNA recognition motif. (a.k.a. RRM, R
  Pfam annotation: Domain name=RRM_2; Domain location=673-746; Score =140.8; E_value=3.6e-39; Accession=PF04059.3; Description=RNA recognition motif 2
  Pfam module annotation: Pfam domain module=RRM_1::RRM_1::RRM_2; Domain location=174-240::259-325::673-746
MVHGRLCLDLIPSMLHLMLASSLAHYLFFRMKNVCDVNLNETANGYQSIDDISSGFKKLHQDADGNGSLEDGDTHAIGPALPDDEEELLAGITDDFDLSGLPGSLEDLEEYDLFGSGGGMELETDPQEGLTVGLSKLSFADSTVGNGLPPYSFPNGVGTVAGEHPYGEHPSRTLFVRNINSNVEDSELRALFEQYGDIRTLYTACKHRGFVMISYYDIRAARTAMRALQNKPLRRRKLDIHFSIPKDNPSDKDINQGTLVVFNLDPSVSNEDLRQIFGAYGEVKEIRETPHKRHHKFIEFYDVRAAEAALKSLNRSDIAGKRIKLEPSRPGGARRNLMLQLNQELDQDESRSFRYQVGSPVANSPPGNWLQFNSPVEQNSMQTINYSPGSRIISPTTGNHLPGLASILQPQVSNTVKAAAIGNDLERSSQGEHIFTGMNSSHGATFQSHSLPEPKFSQYRGALSSIGPSTSNGSSVETLSGPQFLWGSPTLYSEHTKPSAWPRSSVGHPFASNGKSHAFPYSTQNSSFVGSSQHLHHHHVGSAPSGLPFERHFGFHPESSETSFMNNVGYGGIGPGHNDGNHMVNVGGSVNPNITIPRNISDNGSSNFRMRSSPRLSPVFLGNGPFPGLPPTTLEGLADRARSRWIENNGSQVDSKKQFQLNLDKIKSGEDTRTTLMIKNIPNKYTSKMLLAAIDENHRGTYDFLYLPIDFKTFNGKKWEKFNSEKVASLAYARIQGKSALVSHFQNSSLMNEDKRCRPILFHSEGSEVCDLIVQDHHLPSNSNNLNIQAPRPSEFYSSDFAGSPPKAGPSASLDAN

SEQ ID NO: 220773 - protein, 102 aa, Glycine max
  Coding DNA Sequence Number=SeqID_103995
  Gene Ontology: Mol. function=RNA-directed DNA polymerase activity; Cellular component=nucleus; Biological process=RNA-dependent DNA replication
MGSLKVPEPDGFHAIFYQCEWHIVGNDLVNLVHNFYWNSHQVDKVNGAHISLIPKTNNVNKLYKVVTKMLASRLKSIIQKLVNPCQCGFVPNHQASDNIIVA

SEQ ID NO: 220774 - protein, 423 aa, Glycine max
  Coding DNA Sequence Number=SeqID_103996
  Gene Ontology: Mol. function=RNA-directed DNA polymerase activity; Biological process=RNA-dependent DNA replication
VFLKRYFSLMKTDQYIKNIGNFVQREQESLPEVWKRLQEMIKSCPHHGITQQRLVHIFYGGVSLHNMTSLVVACRGNPMIKPLVDAIRIIEDVCFNPYNNSGDRRTMKRVNLPSQPEPNPKKEDVNVVMIKSKRIQEDSKDKKGSYTYENPMPKKEGDAKKDILTSLQISLPFPYRVKNSQRDMQFKKFLEVMSKVHINLPFVKAISHMSSYAKHLKENLSNKGKLANFGTMGLNEDLTPYSFFKKLSITDLEPTNIFILLIDHSVVYPRGVIEDVLVKVNKFIFLANFVILDMEVDEDIPIILGQPFLSTFDLLVELRDLDWELNPKVEEILTFLHSQHGPGPPSFERMGWGNVPKLTTLVEEPLGLELKPPPSNLEYVFLKPPSSLLVVIAASLHENEEEKLLQVLKEKRKLLSLGGAFVT

SEQ ID NO: 220775 - protein, 38 aa, Glycine max
  Coding DNA Sequence Number=SeqID_103997
MGPGMQCRMTMAVIDADENWLGRGQLSTTIVLAGILSY

SEQ ID NO: 220776 - protein, 275 aa, Glycine max
  Coding DNA Sequence Number=SeqID_103998
  Gene Ontology: Mol. function=nucleic acid binding; Cellular component= intracellular; Biological process=DNA integration
MESGMPPPGTTDAGPKDVRPPWARGGFDNMLTRSFDMKDLGDALGIEIHKDRSCHTLRLSQKAYIVRVLERFNMQNCKPGDIPVVKGDKFNKDQCPKNEIERAKMNDKPFGSALGNLMYAQVMRYLKKTKKYMLVYKRVDNLEVVRYTDSDLGGCLDDRRSTSGYIFMMIGGAISWKRLRIMDSIAKPLKIFCDNNTVGFYAKHNKTSRRSKLLDLKYLTDRDLVKDDSIVVDYVDTNSMLVDSLIKALRLVVFKQHVENMGIVSSFDIFGQWEL

SEQ ID NO: 220777 - protein, 102 aa, Glycine max
  Coding DNA Sequence Number=SeqID_103999
MSRVCFETNFNGGLLFTWIPPFLPAASLYRHWHQRYTCIAIGNSGTKADSLRPCRYSDWRDMLSHCMLPLVLAGHANVGSPAIGACGTCRGWHSMCVCSVSV

SEQ ID NO: 220778 - protein, 89 aa, Glycine max
  Coding DNA Sequence Number=SeqID_104000
MVTHNAIGMSDVVREWRQTIEVVLAEMATGVAASTDLTPPLVDIDVVESVISHNIKQGFIKQGLTREVWNWKPESKIRIENLGLEKKET

SEQ ID NO: 220779 - protein, 290 aa, Glycine max
  Coding DNA Sequence Number=SeqID_104001
  Gene Ontology: Mol. function=G-protein coupled photoreceptor activity; Cellular component=membrane; Biological process=regulation of transcription, DNA-dependent
  Homolog annotation: Hit_ID=Q2HRN2; Match level="QueryCoverage=99%, HitCoverage=25%, E-value=1e-121, Identity=77%"; Hit description =Phytochrome e
  Pfam annotation: Domain name=PAS_2; Domain location=73-186; Score =198.8; E_value=1.3e-56; Accession=PF08446.1; Description=PAS fold
MSFGSRGKLKDTSLSTSAESNTNTKRDKILAQYSADAEILAEFELSGVSGKSFDYSRMVLDPSRLVSEQKMTAYLSKIQRGGLIQPFGCMLAIEESTFRIIGYSDNCFQLLGLERQIDSKQFMNLIGVDATTLFTPPSGASLAKAAASREISLLNPIWVYARTTQKPFYAILHRIDVGVVIDLEPARMSDPTLSLAGAVQSQKLAVRAISRLQSLPGEDIGLLCDTVVEEVQKLTGYDRVMVYKFHEDDHGEVVSEIRRSDLEPYLGLHYPATDIPQASRFLFKQNRVRM

SEQ ID NO: 220780 - protein, 75 aa, Glycine max
  Coding DNA Sequence Number=SeqID_104002
  Subcellular localization annotation: CTP_CleavageSite=20; ConfidenceScore=5.41e-01
MARSTKPSTFRKRTTPKISNANMSTNETHSSRFAISLALPSKYFRVSKHEAFQRLVIVLGERYNGLREYLRYGQI

SEQ ID NO: 220781 - protein, 166 aa, Glycine max
  Coding DNA Sequence Number=SeqID_104003
  Homolog annotation: Hit_ID=Q5FRD6; Match level="QueryCoverage=30%, HitCoverage=82%, E-value=2e-15, Identity=76%"; Hit description =Transcriptional regulator
MPRGDKSAYTEKQKRQAEHIEESERDRGASEGTAERIAWATVNKQDGGGKRSGGARKGAKKATSKKAAKKAPARTSATKKATKKATTKATAAKKAPAKKAVAKKAPARKTATKKAAKKTAKKVAANKGSTAASRSAAAKKAAATRARKAATRKTAAKKAARTRSRD

SEQ ID NO: 220782 - protein, 782 aa, Glycine max
  Coding DNA Sequence Number=SeqID_104004
  Gene Ontology: Mol. function=G-protein coupled photoreceptor activity; Cellular component=membrane; Biological process=regulation of transcription, DNA-dependent
  Homolog annotation: Hit_ID=Q2HRN2; Match level="QueryCoverage=96%, HitCoverage=67%, E-value=0.0, Identity=75%"; Hit description =Phytochrome e
  Pfam annotation: Domain name=GAF; Domain location=3-118; Score=29.7; E_value=1e-05; Accession=PF01590.16; Description=GAF domain
  Pfam annotation: Domain name=HisKA; Domain location=608-671; Score =28.8; E_value=1.9e-05; Accession=PF00512.15; Description=His Kinase A (phosphoacceptor) domain
  Pfam annotation: Domain name=PAS; Domain location=335-451; Score =95.7; E_value=1.4e-25; Accession=PF00989.14; Description=PAS domain
  Pfam annotation: Domain name=PAS; Domain location=466-588; Score =93.6; E_value=5.9e-25; Accession=PF00989.14; Description=PAS domain
  Pfam annotation: Domain name=PAS_4; Domain location=341-456; Score =7.0; E_value=0.041; Accession=PF08448.1; Description=PAS fold
  Pfam annotation: Domain name=Phytochrome; Domain location=129-308; Score=407.1; E_value=2.6e-119; Accession=PF00360.10; Description =Phytochrome region
  Pfam module annotation: Pfam domain module=GAF::HisKA::PAS::PAS::PAS _4::Phytochrome; Domain location=3-118::608-671::335-451::466 -588::341-456::129-308
MKMLLIPHDASSNGACIRMICDCHAKPVKVIQSEELRQPLCLVNSTLRLPHGCHTQYMANMGSIASLVMAIIVNGKDATRLWGLLVCHHTSPRSVSFLVRYACEFLMQTFGLQLYMEIQLASQMAEKRILKTQTLLCDMLLRDAPFGIVNQSPSIMDLVKCDGAALYYEGNCWLLGTTPTEAQVKDIAEWLLSNHGDSTGLTTDSLADAGYPGAASLGDAVCGMATARINSKHFLFWFRSHTAKEVKWGGAKHHPEDKDDGGKMNPRSSFKAFLEVVKSKSLPWEVLEINAIHSLQLIIRDSFQDTENTGPKTLSYVQKSDTAAGGMDELSSVALQMVRLIETATVPIFGVDLGGVINGWNTKIAELTGLQASEAMGKSLVNEIIHADSGDTFKNTLSRALQGQEDKNVELKIKHFGLDQQQEVACLMVNACISRDYTDAIVGVCFVGEDITYEKVVQDKFIKLEGDYKAIIQSLSPLIPPIFSSDENVCCSEWNAAMERLTGWKRDEVIGKLLPGEIFGSFCRLKGQDTLTNFMILLYRGISRQDSEKLPFGFFHRNGEFIETYITANKKIDAGGNMLGCFCFLQIVMPDLNQPSEEHNPRGRESISESEEAYILQEMKKPLNGIRFTRKLLENTTVSENQKQFLDTSDACERQIMAIIEDTHLGSINEDTLQLNVEEFVLGNILDAIVSQVMMLIREKNLQLFHEIPDEIKMLSLYGDQIRLQVVLSDFLLNVVSHTASPNGWVEIKVSPTLKIIQDGDEFIHLQFSCPLWKLTLVTRCR

SEQ ID NO: 220783 - protein, 181 aa, Glycine max
  Coding DNA Sequence Number=SeqID_104005
  Gene Ontology: Mol. function=RNA-directed DNA polymerase activity; Biological process=RNA-dependent DNA replication
MLEERLRAVEGSNYDVGEVVDFGTSCPKGHLMMYYRKMASHACNEKLLIHCFQDSLTEATLNWYMHIKQAHIRSWKDLVYAFLKQYRYNIYMTLDRFELQMMSKKNGDTFKEYAQRWQEVATQVKPPSSDKETMMLFIDTLRAPFYDKMIGNISSSFSDIVVIGERVENGLRSGKITLDFF

SEQ ID NO: 220784 - protein, 93 aa, Glycine max
  Coding DNA Sequence Number=SeqID_104006
  Homolog annotation: Hit_ID=Q2HRN2; Match level="QueryCoverage=84%, HitCoverage=7%, E-value=1e-26, Identity=69%"; Hit description =Phytochrome e
MGTISGTKLPIHSIAHSGQGIPSNVIHEMVEGGNQWTTQEGLGLYMSRKILRRMSGHVRYQRGQDMCYFLIDLEIRTRKERQRNLHAKTSMLS

SEQ ID NO: 220785 - protein, 547 aa, Glycine max
  Coding DNA Sequence Number=SeqID_104007
  Gene Ontology: Mol. function=RNA-directed DNA polymerase activity; Cellular component=intracellular; Biological process=RNA-dependent DNA replication
  Pfam annotation: Domain name=rve; Domain location=270-426; Score =87.9; E_value=3.2e-23; Accession=PF00665.16; Description=Integrase core domain
MVEEDREKTIFITPWGTFCYKVMPFKLKNVGATYQRAMVTFFHDMIHKEIEVYVDDMIAKLKNEEDHLEKLLGFVVSQRGIEVDLDKVHTILDMPPPCSEKHVQFPGKPLIMYLTVLDGSIGYVLGQHDESRRKDVGTSLLKEIHAKPYDLVLLLEYEIVYVTQKAIKDNLEKASNEFLFEWRCVIRRNHVMVLLIFVDIAEAQRIIKEVHEGLFGTHTNGHAMARKILRVGYYWLTMEVDCFSYVRKCHKCQTYADNINAPPTSLNVLASPRPFSMWGMDVIGPIKPKASNGHDFILVAIDYFTKWVEAASYARVTQNVIVKFIKRELICCYGVPSKLITNNATNLNNKMMTKLCVDYKIQRHNSSPYLLKMNGAIEAANKNLKKIIQKMVVTYKDWHEMLPFALHGYHTSVFTSTGATPFFLVYGMEAILPIKVEIPSLIAICHGQLYQKRLKKAFERKVYPKEFQVGDLVLKKILPNKKDRLGKWTPNYKGHYVVKKTFLGGALILTNMDGKQFSYPGDLGKVRVTYQVERDILRRCGARNWGK

SEQ ID NO: 220786 - protein, 473 aa, Glycine max
  Coding DNA Sequence Number=SeqID_104008
  Gene Ontology: Mol. function=RNA-directed DNA polymerase activity; Cellular component=intracellular; Biological process=RNA-dependent DNA replication
MDKKLVQVGYCESNASTIDTSPMFPKPLVIHYTKGVTSLTLSTPRLSLYKYRRLSHRKTTKQCHGSMVWKFVLMDMMEKKLLIQSEYAVIDQLNRIPAKISLLSLILNSKPHRKMLFKVLNEAHFIHDISEEKFEGIVGNITTSNHLTFTDDEIHVEGARHNKALHISMKCKDHILAKVLVDNGSSLNVMPRTTLTKLPYDESYIRPSALVVRAFDGSHRKVIGEISLPIHIGHVTFEVVFQVMDIVPAYSCLLGRPWIHCTRALPFTFQQHVKFVVDEKLVIIFYEEDLLVSKPSFQGLEIANATYVKEGKTISKFQPSSASMMVAKVMLENEYHYRNGLGRNAQGLSPLPNLIENKDCFGLGYKPPKEDKRRIAHEKKRKEDEHINWVHACPPNAELSNWEIIELHMIFNSKLNFECLDNQVDEEIEDDLEPSLELLRLVEQEAKEINPHEETTEVDMPGLDARIMEHKLP

SEQ ID NO: 220787 - protein, 233 aa, Glycine max
  Coding DNA Sequence Number=SeqID_104009
  Subcellular localization annotation: CTP_CleavageSite=19; ConfidenceScore=5.33e-01
MCPPPFESGAPRIDCLALVANSPFSTFIRSPMNSLPSAGHVSSTVESGALRIDCLALVANSPFSTFIRSPVNSLSSAVHASSTIESGVPRIDCLALFANSPFSTFIRSPMNSLPSAVHVSSTFESGAPRIDCLALFANSPFSTFIRSPMNLLPSAVHVSSTFESGALRIDCLALLANSPFSTFIQSPMNSLPSAVHASSTNESGGPRIDCLALFASSPFPTFIRSPMNLLPSA

SEQ ID NO: 220788 - protein, 259 aa, Glycine max
  Coding DNA Sequence Number=SeqID_104010
MQKKGRDIHPQQAQQTLHILTTAHHNCFSSITIIHLPLSFQYSHATMNDLHFPSHSNSRQLQPFRKTSHHLFITCYLSPTAHAKIQLFPDTSLVVLNTILVLIKQSSSPRHYQHDFTIIHCLEHYNGGTHQIKVRQHHKKFYFADGLTEFRRDLQIYESTTIDFYACDQNWIFNLHFTPPLEQQTCGRPRLSTRKYVWTVEATQSMLGAPYPLALPPCVVPYVDACVQHMIILRKYVPPLQWNVTIIDPGIGEKSIVRP

SEQ ID NO: 220789 - protein, 624 aa, Glycine max
  Coding DNA Sequence Number=SeqID_104011
  Gene Ontology: Mol. function=helicase activity; Biological process =viral genome replication
  Homolog annotation: Hit_ID=Q9LTU4; Match level="QueryCoverage=99%, HitCoverage=70%, E-value=4e-64, Identity=49%"; Hit description =Helicase-like protein
  Pfam annotation: Domain name=DUF889; Domain location=539-624; Score= -87.4; E_value=1.4e-05; Accession=PF05970.5; Description=Eukaryotic protein of unknown function (DUF889)
MARDRLAHSEVHNIRLKLIADHEKDGRIYNVPTVSEVAALIAGDFDTYSRRDIILETRNGQLKRIDELHSSYLGLQYHLLFPYGEDGYRPDILHRATSSGQKRKRNRLTMREWFAFRLQCMSNEAQTLLHSRKLFQQFVVEGYTMVESKRLSFIRNNQKKLRVNKFCSLQQSLDAGTTKGLQKEFQKRGLPHVHLLLFLHPDNKYPSSDDIDQITSAEIPSQEDDPELYTLVQNHMFHGLCGILRRESPCMKEGRCSCFYPKMFQPHTDADGYLVYHRRDDGQTISKNGVTIDNRYIVPYNPKLLRRYQAHINIEWCNQNTSIKCLFKYINKGYDRVIVVIVHDDNDAIYHATTQNDEIKEYLDCIMNKPKEVWDQTWHWLADDIAYHNRKTTTNTDQQASIYKQIIQVVNKDEGAMFFLYGYGGTGKTFIWKTLASSLRADNKIVIMIASSGIASLLLPRDRIAHSKFKIPVPIFEDSTCNIHQGSQLVELLNQTCLIIWDEAPMTHKFCFEALDESLRDIIKGKSSSNQIFGGKVMVLGGDFWKILPVIPRGSCSDIVHATINSSYLWNHCQVLTLTKNMRLQSNTQATDKEEIATFAQWILDIGDEIIGNPNDGYAIVEIP

SEQ ID NO: 220790 - protein, 94 aa, Glycine max
  Coding DNA Sequence Number=SeqID_104012
  Homolog annotation: Hit_ID=Q1SRJ5; Match level="QueryCoverage=60%, HitCoverage=7%, E-value=3e-13, Identity=57%"; Hit description =Probable helicase [imported]-Arabidopsis thaliana-related
MVHGPCGTSNPGSPCMKEGKCSRHTIEKNGVIIYNSYIYLPDRYICPCESTWRIFGFPIHGREPAVERLHFHLLGQHSVVYEDHDDIDDVLSKP

SEQ ID NO: 220791 - protein, 51 aa, Glycine max
  Coding DNA Sequence Number=SeqID_104013
MEGERKRNYTYELRILHLIFKPLDLYSLGRMNNLLWLVSLTSKVFSFVDSR

SEQ ID NO: 220792 - protein, 190 aa, Glycine max
  Coding DNA Sequence Number=SeqID_104014
  Gene Ontology: Mol. function=methyltransferase activity; Biological process=metabolic process
  Homolog annotation: Hit_ID=Q83DA4; Match level="QueryCoverage=91%, HitCoverage=53%, E-value=1e-19, Identity=31%"; Hit description =Conserved domain protein
FVQWDISNPLPGSQKFDYVICRAALHHTPDPAKTYSSLVSQLKPGGKVAVSVYAKKAPMREALDDAFRAAIVPMGNDEAFAVANQFTRLGADLQACAGEIRITQDLPFLGIKTGTYSIQEFIYDHFLKCWHNKNFSSEHCDLINFDWYHPTFAYRYSAAEAVAFAERNGLEIVRFTSIKAQHYLEAMLAE

SEQ ID NO: 220793 - protein, 216 aa, Glycine max
  Coding DNA Sequence Number=SeqID_104015
  Gene Ontology: Mol. function=hydrolase activity; Cellular component =soluble fraction; Biological process=aromatic compound metabolic process
  Homolog annotation: Hit_ID=Q7WP59; Match level="QueryCoverage=62%, HitCoverage=46%, E-value=6e-56, Identity=73%"; Hit description =Putative hydrolase
  Subcellular localization annotation: CTP_CleavageSite=43; ConfidenceScore=5.21e-01
MSNAGRTHAGTLLAQGLPPVRMFFPGEAAMSLVVFDSHAPTAPAVTKAERCARSTLAAAQRLLYPESNLSPMSQVELELARSARRRPGYPASRPRRRRAGKRDRSCPTRPAAAAGACGSTPGTPDTSGRWRRSPAAGRAGRRYCRAGKPGGFRAQSRRGPQGSGPERLRGIATGSRPAWRTRAGRRGWRAMGPSSISGWAPSPSPAPLRTRCRSAK

SEQ ID NO: 220794 - protein, 171 aa, Glycine max
  Coding DNA Sequence Number=SeqID_104016
  Homolog annotation: Hit_ID=Q9AVH2; Match level="QueryCoverage=27%, HitCoverage=16%, E-value=4e-20, Identity=97%"; Hit description =Putative senescence-associated protein
MCPVVGFGPWLGLGKPLVEILPPGQLRGFCPLLAWLGSAVLGYGPVLSFGLVGPLLPPVISFVARILPTLACAPLAKSVPRWILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 220795 - protein, 37 aa, Glycine max
  Coding DNA Sequence Number=SeqID_104017
MNEGNSLSMSMRHSHLGKLDNKCQGHPVMHSQLPPPW

SEQ ID NO: 220796 - protein, 215 aa, Glycine max
  Coding DNA Sequence Number=SeqID_104018
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=1e-30, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VDSRGSHKGLHALTFRGLHALAFRGLHVLAFRGLHVLAFRGLHVLTFRGLHALTIRGLHVLAFVGLQALTFRGLHVLTFKGLHALNFRGLHALAFRGLHVLAFRRLHVLTFRGQHVLAFRGLRVLAFRRLHTLTFRGLHALTFKGLHVLTIRGLHALAFRRLHVLAVRELHVLAFKGRHVLDFRGLHALAFRGLHVLIFSGLHIRTLREFKVLCP

SEQ ID NO: 220797 - protein, 256 aa, Glycine max
  Coding DNA Sequence Number=SeqID_104019
MAVKELFHSSDQEAGYEESTLLQQQVDPYEEEETLSLSDLPIYSTSGSISARWGGTDDFSKEDGKDFGGDHDDNNDDNLFEFFSEEFTTSSTNNYATAENIIFCGKLIPFKNINIPPRADERNIINTERMINVQKGIAKRSSKGSKSSFESCDYSSLGKVSLVRSPTNSRWFLFMFGMSKLSTTTEMELKDIRNRQSRRRGPAATMIPAPENGKDEVAVKEKRSCKGMWKMLKSISMVLGCHSSKIANDVVKAAFV

SEQ ID NO: 220798 - protein, 65 aa, Glycine max
  Coding DNA Sequence Number=SeqID_104020
MDIPFVYHGLMVGGNPRKASIRDGFLEECRSKLAKWKKELCGGGGGVGGLTVLGNGIGLLGSAKR

SEQ ID NO: 220799 - protein, 305 aa, Glycine max
  Coding DNA Sequence Number=SeqID_104021
  Gene Ontology: Mol. function=high molecular weight B cell growth factor receptor binding; Cellular component=extracellular region; Biological process=cell proliferation
  Homolog annotation: Hit_ID=Q9FGD8; Match level="QueryCoverage=69%, HitCoverage=57%, E-value=3e-81, Identity=72%"; Hit description =Arabidopsis thaliana genomic DNA, chromosome 5, TAC clone:K16E14
MGAAPLRPAAIAAATAAIDNYGLALAVRDKLESLCRELQRQNKMLMVFFYCTATLETDCIIIIFTPPFSFQLTFPSIQKEECKRVSTEGQNLRLDLSAKFQDAIKDVSNKLEERKDECLSQLKENDMLRNKLRQLVEQYELSEQQHAQKLKQKSLELQLADLKIKQHEEKLVQERSQIKVYAEQVSQLLATEKSLRLQLTTDGEKFQQFQEALSKSNEIFETFKQEIEKMAKSIKELKKENQFLKSKSEKSDVTLIELVDERERMKKQLEKTKNQKEKLESLCRSLQAERKQNSSENKSNNSVQT

SEQ ID NO: 220800 - protein, 71 aa, Glycine max
  Coding DNA Sequence Number=SeqID_104022
MIQKGQIQGSEGTKSTRKRTKLKYFTFQTPLYENQKSLCKLRQQRSPTITVGPPLPKSTLTIFLGFLFGQS

SEQ ID NO: 220801 - protein, 380 aa, Glycine max
  Coding DNA Sequence Number=SeqID_104023
  Gene Ontology: Mol. function=calcium ion binding; Cellular component =membrane; Biological process=transport
  Homolog annotation: Hit_ID=Q1RUY8; Match level="QueryCoverage=98%, HitCoverage=45%, E-value=1e-113, Identity=60%"; Hit description =Mitochondrial carrier protein, putative
MVSGSDPVESFFNSVQVVKDSLSPLEVGIRKAAKDLEHCLAGSKNKVNGVCLIAPVRESGEFQICNVKKKKGLSMKVPLKALWGMFSQNGTGNGGSSNRAQVGKEDGPSCTNCLQFAVTWSLLVNGFLQSLPLPFKSGKKKCQKVCDEDKLCSCTKPTVSSCEVKQNESKGGQFGRAVREKGVRRKDGKNVSLECLIGFIFDQLSQTLQSLDYGVHENNDDLDNGKTSLPQPSFSHFGHVNALAGFLEEHKVYVNSFLGNLRFAKVGGVPSSVPGEESPSTNGEGDISSNNGNNGNGNNENKDENGGNSPQKVANNIFSIPLSNVERLKSTLSTVSLTELIELLPQLGRTSKDHPDKKKLISVQDFFRYTETEGMTSYIG

SEQ ID NO: 220802 - protein, 153 aa, Glycine max
  Coding DNA Sequence Number=SeqID_104024
MARTRGLGRAIGRLVGRDRHDDHAAADVPERRRPTASARRQQVHQMTTDARYLAEEVADMTDDVPDLAEEAPEMLADVEGADGAEGSDADDATEGFPGRPRDPSVLTSFADHVAHAVWSGHERPDLKLVLHGRKVTLIGGQCLRLKDWLLPQD

SEQ ID NO: 220803 - protein, 78 aa, Glycine max
  Coding DNA Sequence Number=SeqID_104025
  Subcellular localization annotation: CTP_CleavageSite=63; ConfidenceScore=5.24e-01
MGVQIATRPTWALQKIPPEGGCFWRKPPCSPGRAGKSEPRRFRKVSVGIFAKIFSRSSTFFVRSSSFFDLQPVIFSPK

SEQ ID NO: 220804 - protein, 69 aa, Glycine max
  Coding DNA Sequence Number=SeqID_104026
  Pfam annotation: Domain name=DUF1330; Domain location=2-68; Score =4.5; E_value=4.7e-05; Accession=PF07045.2; Description=Protein of unknown function (DUF1330)
SEEAGGRILHFGSVSEVLEGDEVPLPLAGVFEFPTLNQALAFYNSEKYAPIKAERREAQEARMFIVETD

SEQ ID NO: 220805 - protein, 67 aa, Glycine max
  Coding DNA Sequence Number=SeqID_104027
MIQTSWNGSGMCCILEMRLLQSPITWSPPPMGVIKANFDASSVRRGTAKSKDLIFRNHLGGVIFGET

SEQ ID NO: 220806 - protein, 311 aa, Glycine max
  Coding DNA Sequence Number=SeqID_104028
  Gene Ontology: Mol. function=calcium ion binding; Cellular component =membrane; Biological process=transport
  Homolog annotation: Hit_ID=Q1RUY8; Match level="QueryCoverage=99%, HitCoverage=37%, E-value=1e-120, Identity=71%"; Hit description =Mitochondrial carrier protein, putative
  Pfam annotation: Domain name=Mito_carr; Domain location=131-210; Score=22.8; E_value=2.9e-05; Accession=PF00153.17; Description =Mitochondrial carrier protein
  Pfam annotation: Domain name=Mito_carr; Domain location=215-303; Score=97.2; E_value=4.9e-26; Accession=PF00153.17; Description =Mitochondrial carrier protein
  Pfam annotation: Domain name=Mito_carr; Domain location=22-106; Score= 51.0; E_value=4e-12; Accession=PF00153.17; Description=Mitochondrial carrier protein
  Pfam module annotation: Pfam domain module=Mito_carr::Mito_carr::Mito_ carr; Domain location=131-210::215-303::22-106
SIWFEAATVVAVPPAVEIPAGSVLRSALAGGLSCALSCALLHPVDTIKTRVQASTMSFPEIISKLPEIGRRGLYRGSIPAILGQFSSHGLRTGIFEASKLVLINIAPTLPELQVFRFCALYNLVLVKAVRKVVENIAKLCAVRIPCEVLKQRLQAGLFDNVGEAFVATWEQDGLRGFFRGTGATLCREVPFYVAGMGLYAESKKVAERLLERELGPLETIAVGALSGGLAAVVTTPFDVMKTRMMTAQGRSVSMTLIAFSILKHEGPLGLFKGAVPRFFWIAPLGAMNFAGYELAKKAMNKNEEGKAGRSE

SEQ ID NO: 220807 - protein, 132 aa, Glycine max
  Coding DNA Sequence Number=SeqID_104029
MCTLRVLPSHHISTKQSNIEVESSYSQTPKLYIFHQLVSYSNKISLRVLLCESYDNDDGSSGSDNGRDISDDSDNRSDNGGDNDIDGVGDNDSDGGSSIGVNRVVVIGDCGGYYKGGIGSDVMVMVTVMEVV

SEQ ID NO: 220808 - protein, 103 aa, Glycine max
  Coding DNA Sequence Number=SeqID_104030
  Subcellular localization annotation: CTP_CleavageSite=25; ConfidenceScore=5.11e-01
MGLKTWHYQQHDYTSPLLLLHFKMKCSNVVVPFRRQYSHTLFNFPLSQYPQNWVPCFVSIVPKIVGVATISVSQQWHARTDSMHMKIGYHMKGTKTTVIPSGF

SEQ ID NO: 220809 - protein, 90 aa, Glycine max
  Coding DNA Sequence Number=SeqID_104031
MQYVIVKVRKSNLGFLLSEEWLVKHELKRCLLVVAEKSCDEVDSGTDKGIFRKPLCYIMTKEVDKRKKGIRGRKGRGRRGEGAIGGGGFH

SEQ ID NO: 220810 - protein, 176 aa, Glycine max
  Coding DNA Sequence Number=SeqID_104032
  Gene Ontology: Mol. function=RNA-directed DNA polymerase activity; Cellular component=intracellular; Biological process=RNA-dependent DNA replication
  Homolog annotation: Hit_ID=Q1SYR3; Match level="QueryCoverage=77%, HitCoverage=6%, E-value=1e-33, Identity=46%"; Hit description=RNase H, putative
RAHEASTNVARWDLSCLRSWLWALALVPPFQDVFPYIGDDSHRVNPWLVQQATIGWVNIHHLKGNPVGVGPYMNWEVDLPFYFPATANESPYHYGAWPQAQAVVDDHLGHDVLHAFDRYMQSPIMPSSFGRNLLLVEGEVVVGCDVVDSPLEAFYEDVLGHMGLVQNLNQQCSVRL

SEQ ID NO: 220811 - protein, 110 aa, Glycine max
  Coding DNA Sequence Number=SeqID_104033
MQPSLTALSAPLPMPALYLPDLDRVRAATFFDNLFNIVLCYGHVAAPHDKPWENRDMTLFEMGPESYRATMVARKRQPATFINACMTMMSEEVNMNEENGEEADVNEENG

SEQ ID NO: 220812 - protein, 129 aa, Glycine max
  Coding DNA Sequence Number=SeqID_104034
MRSFNADFSPWRCSGRQRRRGEGRHHPLGNKPWKKELHHHECTSYKKLEEDGLMEEKKERRGEHRIEGIKEGEKWNFEAKGHFGAVAAHPGKLKLKLEVVSSPRQAVFFTMKLFSGPGEPNASLGEIGP

SEQ ID NO: 220813 - protein, 251 aa, Glycine max
  Coding DNA Sequence Number=SeqID_104035
  Gene Ontology: Mol. function=glutamyl-tRNA(Gln) amidotransferase activity; Biological process=regulation of translational fidelity
  Homolog annotation: Hit_ID=Q1RV01; Match level="QueryCoverage=67%, HitCoverage=83%, E-value=6e-28, Identity=45%"; Hit description =Glutamyl-tRNA(Gln) and/or aspartyl-tRNA(Asn) amidotransferase, C subunit, putative
  Subcellular localization annotation: CTP_CleavageSite=57; ConfidenceScore=5.79e-01
MTSKGLLRGASLTANAVWHRSSFFPKVTVSVHPKLVKFQSFSSTTACSSLPPPDLPRLAKTAQISLTPNEVEEIAPKIQQVIEWFGQLQGIDLESVEPSIRAAENALLVCLFYANPVFEGTSNVKSSIPCSRINSWFRDRTSNLMLKSHGYLSTIPDHIETENNLRGNAPETFDHRDALIASVPSYEEPYIKVPRVFPIPRKGAMGIEKAKINIVMVGHVDYEKSITIKELNKPVAEKQIAEMNLTAIYKA

SEQ ID NO: 220814 - protein, 341 aa, Glycine max
  Coding DNA Sequence Number=SeqID_104036
  Gene Ontology: Mol. function=chromatin binding; Cellular component =chromatin; Biological process=chromatin assembly or disassembly
  Homolog annotation: Hit_ID=Q1SAV4; Match level="QueryCoverage=81%, HitCoverage=58%, E-value=6e-44, Identity=46%"; Hit description =Integrase, catalytic region
MGFGWTKPGFTTMDPVTYSELNVVTDPCKYRVIDGGSFPQVTSKGERLVLECTDVLYEHSVRDKNLNHCDGNPIMKSRDKSSHMDEGIGKGLPPSNGLTSIQVVMDRYSKRAHFGALTSHYTEHKVVVLFPGYGLQITRVPTPSQWFKFLSLAEWSYNTSVHPSTGLSPFEVTYGKPPPSIPQYLQGSSHVEAISTVQFVVNDWVYVRLHPYCQTSLTLAYTKLSKRFYGPFFIKECIGPIAYRLKLPETSKIHPPLQVLEWKWNNANVSPIKLALVQWIGLAPKDTSWEHWDNVRVSYNLKDKVLLLDGVMIALVSWPLTDQGGPPGGQHTSAITHKGQL

SEQ ID NO: 220815 - protein, 93 aa, Glycine max
  Coding DNA Sequence Number=SeqID_104037
MQEEERISEFVNEIVEIFWMLVLFLSCPLCIIAEVCWHPGGPPWSISGHGPPWSISGHGTIAIITTVREKNLVLKVIGYPDIVPMFPAGVFGS

SEQ ID NO: 220816 - protein, 82 aa, Glycine max
  Coding DNA Sequence Number=SeqID_104038
MDPTVATRDEAGRPIDHVPSTFTREIVKVLLMTRLTIPIEEKAIGATTVGAKSRLCVWATTSTQLTSMSPTSSTLATWMTAI

SEQ ID NO: 220817 - protein, 58 aa, Glycine max
  Coding DNA Sequence Number=SeqID_104039
MRIKLTSSYIYSDFFTTKPTYHAHALICHGAEEGKWMIEISSMHWSKNPSNCLYETIF

SEQ ID NO: 220818 - protein, 49 aa, Glycine max
  Coding DNA Sequence Number=SeqID_104040
  Subcellular localization annotation: CTP_CleavageSite=39; ConfidenceScore=5.18e-01
MKPVSAAAILHKQAKLPIKPTRKGITKNRKSSPSVRGPPASSLPPDNLQ

SEQ ID NO: 220819 - protein, 483 aa, Glycine max
  Coding DNA Sequence Number=SeqID_104041
  Gene Ontology: Mol. function=hydrolase activity, acting on glycosyl bonds; Cellular component=membrane; Biological process=metabolic process
  Homolog annotation: Hit_ID=Q1WLP5; Match level="QueryCoverage=94%, HitCoverage=82%, E-value=0.0, Identity=90%"; Hit description =Neutral/alkaline invertase
  Pfam annotation: Domain name=Invertase_neut; Domain location=80-483; Score=873.3; E_value=1.1e-259; Accession=PF04853.3; Description =Plant neutral invertase
MDGHMGMRKISSHCSIPDLDDSDILRLLEKPKLNIERQRSFDERSLSELSIGLARAGLDNYDTYSPGGRSGFNTPASSTRNSFEPHPMVADAWESLRKSLVYFRGQPVGTIAAVDHQSEEVLNYDQVFVRDFVPSALAFLMNGEPEIVRNFLLKTLHLQGWEKRVDRFKLGEGVMPASFKVLHDPIRKTDTLIADFGESAIGRVAPVDSGFWWIILLRAYTKSTGDLSLAESPDCQKGMKLILTLCLSEGFDTFPTLLCADGCCMVDRRMGIYGYPIEIQALFFMALRCALSMLKQDDAEGKECVERIVKRLHALSYHMRSYFWLDFQQLNDIYRYKTEEYSHTAVNKFNVIPDSIPEWVFDFMPMRGGYFIGNVSPARMDFRWFALGNCVAILSSLATPEQSMAIMDLIESRWDELVGEMPLKISYPAIESHEWRIVTGCDPKNTRWSYHNGGSWPGSSFLLIYSNFKMHLMWDLVNWDFDR

SEQ ID NO: 220820 - protein, 111 aa, Glycine max
  Coding DNA Sequence Number=SeqID_104042
MYMNHEDVGCMSDFTKEGCTTQHIYHTTYHRDLVPHNTFFGHCRNLPFGGRTTRELMGVSSKGGKCTESPPTFIRGKRRTNQKARYILTEQKVIKGVGPLNDLLILKGEKR

SEQ ID NO: 220821 - protein, 242 aa, Glycine max
  Coding DNA Sequence Number=SeqID_104043
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=3e-38, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LTFRGLHILAIRGLHVLAIRGLHVLTFRGLHVLTFRGLHALAIRGLHILTIRELHALAFVGLHVLTFRGLHVLTFRGLHVLIFRGLHILAFRGLHVLAIRGLHVLAFRGLHILAFKGLHVLAIRGLHVLTFRGLHALTLRGLHVLTFIGLHALTFRLHALAFRGLHTLAFRGPHALAFIGLDSLTFRGLHALAFRGLDILAFRGLHAFAFRVLHILAFRGLHVLAFRGLHICTLRKFKVLCP

SEQ ID NO: 220822 - protein, 62 aa, Glycine max
  Coding DNA Sequence Number=SeqID_104044
MPISPYRSISWSVPSRHRGRTHKTPSGLREVQQDPGVASSGYGPLSVLQGSHTPQQGHAIMT

SEQ ID NO: 220823 - protein, 70 aa, Glycine max
  Coding DNA Sequence Number=SeqID_104045
  Homolog annotation: Hit_ID=Q9LE80; Match level="QueryCoverage=73%, HitCoverage=20%, E-value=5e-13, Identity=63%"; Hit description =Arabidopsis thaliana genomic DNA, chromosome 3, P1 clone: MJK13
MLDHVHFQHSAMHLSNTKAHKESVVRMVGKEIFESFLGNLRLLGTFVRCRAVELLRWMRKRFVEYRQHFD

SEQ ID NO: 220824 - protein, 240 aa, Glycine max
  Coding DNA Sequence Number=SeqID_104046
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=5e-34, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=65; ConfidenceScore=5.29e-01
MQSSEGEACSPLKVRMCRPLKVRTCSPLKVRACSPLNARACSPLKVRTCSLLKVRTCSPLKVRVCSPLKAKACSPLKVRMWSPLKVRTCSPLKVRTCSPLKVRVCYPLKVRTCSPLRVRVCSPLKAKTCSPLKMRMWSPLKVRTCSPLKVRTCSPLKVRACYPLKVRTCSPLKVRACSPMKVRTCSPLKWRACSPLKVTACSPLKVRTCSPQKVRTCSPQKVRTCSPLKVRVLVPKGPPL

SEQ ID NO: 220825 - protein, 90 aa, Glycine max
  Coding DNA Sequence Number=SeqID_104047
  Subcellular localization annotation: CTP_CleavageSite=70; ConfidenceScore=5.16e-01
MSSTIHRDRVHKTPNGPGGAQQGPGVSSSVQQGLLQSYRDRARKTPNGPGEVQQGILQSPFAIWRQSTPMARRDKYGHFPLLLKTPMSFD

SEQ ID NO: 220826 - protein, 103 aa, Glycine max
  Coding DNA Sequence Number=SeqID_104048
MVICPFCRRLQCLATETIAVSLCHPETIKFDGMQRQIWSSGALAEDSNVFRPRLLKSPFYIWRQSTPMARRDKYGHLPFLLKTPMSFDRDYCSPPLSSRDNQV

SEQ ID NO: 220827 - protein, 95 aa, Glycine max
  Coding DNA Sequence Number=SeqID_104049
MLEVPLPTNPLIITYMILQDLVEDSLYREHRGGGDGDFLTIWISDWGSLRESEAYVSVAICPSMGGRREAHGCIFQGRKTCGVATNIFLTKTLEK

SEQ ID NO: 220828 - protein, 156 aa, Glycine max
  Coding DNA Sequence Number=SeqID_104050
MLNSKARNALPCALSKEEYAKVHNFRSAKQMWDILAIRYEGSLQNFKHNEGLKKEMFWLLAFKRTKRPYCPKGHPQNHCPEAHPKLLEWKTPLMKNMRMSLTKISSFSSPERSVKYGRIKAYPNGGTLPKRCSMRGKIKTKLHNMIQMKEAWTLQI

SEQ ID NO: 220829 - protein, 149 aa, Glycine max
  Coding DNA Sequence Number=SeqID_104051
MRVKFSCDTGMSVIHRCTEKETDLRRRKGNKRYCEVKRGENLKEDGNGERDLPAETTVTRRRLRRKTVRGENGEMERKRREKMSSSSEAVIYRRRRTVERESWRGCNQRTVPSYPVFGYRVRDLTVTAGSWAKGLPAPSTWAQRRRFYE

SEQ ID NO: 220830 - protein, 259 aa, Glycine max
  Coding DNA Sequence Number=SeqID_104052
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=5e-32, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
ALRGLHTLAVRGLHALTFRRLLALTFRGLHVLAFRGLHALTFRGLHVLAFRGLHALTFRGLHVLAIGGLHALTFRGLHILTFRGLHILTFRGLHVLTFRGLHVLTVRGLHVFAFRGLHVLTFRGLHALAIRRGLHALTFRGLHVLAIRGLRALTFRGLDVPTFRGLNILAFRGLHSLSFRGLHVLSFRGLHVLTFRGLHAVTFHGQHFLTFRGLHVLTFRGLHVLAFTGLHVLAFGGLHTLAIRGLHVLTFRGLHDLTL

SEQ ID NO: 220831 - protein, 106 aa, Glycine max
  Coding DNA Sequence Number=SeqID_104053
  Subcellular localization annotation: CTP_CleavageSite=15; ConfidenceScore=5.62e-01
EQGRARGPTTSGSACQATTSGRAWGPTTTGSAWQVGTTGSAWQAGTTTPVTSSCPDKSRVAFWWNALLRMKGIGKGPNNILEEKDLIGGVRNIIGQVAQREGASGV

SEQ ID NO: 220832 - protein, 588 aa, Glycine max
  Coding DNA Sequence Number=SeqID_104054
  Homolog annotation: Hit_ID=O48768; Match level="QueryCoverage=89%, HitCoverage=86%, E-value=1e-144, Identity=50%"; Hit description =Expressed protein
MYILVDNRPWLLSDLGSRGVHIWQLMVTKSRLSPFAYSKARRERKEGKEICPQSSSSKPKKFMRWFPLIEAVMLSRKKVLLPVKNLRNSLQLSSELHRTLYGFIVFEVAWAGVRGINYYNELQTDTSLAIEAKLMKRWEFDSIAQAAGCMSSWFSGTPSEQLLLKEHLDSASGDIFYDASEDFSGTVSVDDGDDNICRILTVEDSLGTNVGVYTDDTEETTDMLHAPPPSGPNKRRKLMNSFSAGVEVDSYSTAEIDNSLDYSQTSSCVSDDTVETTQDDTLETTQDDIVETTQDDTVEATQYSDVLLSFRFDDHDLPFKFREVIVSDLRLLTLLEAGLPSWVIFLQSYPVLCNLYRPWMCPLARLLYFLISFVTVLIGFYDLYKNVPVLKATASRLCGPLLDWIETWEMVSRVKYLGTMLFLHNFQKAVRWFLAFTHTMRSFFSILVQPLVESLVEIFGFLLPSLKFLFELAESIFSVIWLVVDTSFDIVGNVLELLFSPLWFVLNVVWSIATCILYPLFWVLWELLYAPVRLVLVIFSFVASISSYICNTLGNTWQFVSSIFQFAASSEATVSVSEVSMWQRTLWE

SEQ ID NO: 220833 - protein, 196 aa, Glycine max
  Coding DNA Sequence Number=SeqID_104055
MAPRKLPTKRSIKDTAGDGSSAAPRADVEFDRHRDEEYVEFQEEIGWKQWAQLASPMAKFDPEIVMEFYANAWPTEEGVRDMHYWVRGQWVPFDGDAINQFLGHPLILEEGQQCEYSQRRSQALGFDEEAIDQLLCVPGQIWMTFLLSNILPNDHSSDLPLPKGYASETPSEPGEVQQGPGVSYSDHMPLSVLWSI

SEQ ID NO: 220834 - protein, 397 aa, Glycine max
  Coding DNA Sequence Number=SeqID_104056
  Homolog annotation: Hit_ID=Q1RVU0; Match level="QueryCoverage=23%, HitCoverage=50%, E-value=1e-22, Identity=63%"; Hit description=NUDIX hydrolase
  Pfam annotation: Domain name=NIF; Domain location=56-227; Score= -75.3; E_value=0.062; Accession=PF03031.8; Description=NLI interacting factor-like phosphatase
  Pfam annotation: Domain name=NUDIX; Domain location=183-306; Score =3.6; E_value=0.047; Accession=PF00293.18; Description=NUDIX domain
  Pfam module annotation: Pfam domain module=NIF::NUDIX; Domain location=56-227::183-306
VDPEGNTMNTESTTTDKRKNDKELSSFTDEMKMTLAASVIKEDLSSEISKFSLDGTQVRSLKKRLIVLDINGLLADVVSPPPKGHKADATIARRAIFKRPSYLEFLEFRFDKFEVGIWSSRMKKNVDRVIDYLMGDMKKRLLFCWDLSHCIETTFKTLENKHKSVVFKDLRKLWDKHDLDLPWEKGYFNESNTLLLDDSPYKALFNPGGWENDETVEEAAVREAIEEAGVRGDLMVTWFQDFLGNYEFRSKTLQDECSPEGLCKAAMFALFVKEELESWPEQSTRKRSWLAVSEALANWLKKKKEDDAGPNHLSCKNPWHLYIAPPNMNPTPFKKLQWPKIPSALTPLPLSYATQAFSLLEYECGIAQGGAGPGNYVRMTMVVVGLGEKVVHDGAEV

SEQ ID NO: 220835 - protein, 1145 aa, Glycine max
  Coding DNA Sequence Number=SeqID_104057
  Gene Ontology: Mol. function=nucleic acid binding; Cellular component= chromatin; Biological process=DNA integration
  Homolog annotation: Hit_ID=Q1S4N1; Match level="QueryCoverage=98%, HitCoverage=97%, E-value=0.0, Identity=53%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=475-625; Score =78.7; E_value=1.8e-20; Accession=PF00665.16; Description=Integrase core domain
  Pfam annotation: Domain name=zf-CCHC; Domain location=265-282; Score =18.0; E_value=0.0011; Accession=PF00098.13; Description=Zinc knuckle
  Pfam module annotation: Pfam domain module=RVT_2::rve::zf-CCHC; Domain location=692-948::475-625::265-282
MESETSFTTISVPVFDGLNYQMRAVKMEAYLDANNVWEAVEEEYEVLPLPNNPTVAQMKSHKERRLRKSKAKSILFTAVSLVIFNRIMTMKTAHKIWNFLKEEYEGSEKIKGMQALNLIRELEMQRMKDLETIKDYADKLLGIANKIRLLGTEIPDSRIVQKILVTIPEKYEATLTSLENSKDLSTITLAELLTALQAPEQRRLMRQEGTTEGALVAKSLDKKKKGKSGSFNHKNGSKSSHDFPSCPFCKKNNHPQTKCWWRPEVKCHKCGLLGHVEKICKSSQKQENVQAAVEEVDEEELFVVSCFAIARSTESWLIDSGCTNHITYDQELFKDLDAIYNTNVRIGNGEKIAVKGKGTIVIEGCTGLKLIPDVLYVPEINQNLLSVGQLLEKGYKVLFEDKSCMIKDSDNKELFRVQMKGKSFALNLIDEEQLAVHKVEDNMLVWHKRMGHFRHGALLYLRKNDLVQGLPELEDKSPVCAACQYGKQMRLSFPKGKSWRAISKLQMCWIYFMKNKTEVAIIFYKFKAWVENQSERKMQILRSDNGTEYTSDKFSKFCEDAGIEHQLTTPYTPQQNGVVECKNRTILEMARCLLHDKDLPKKFWAEAASTSVKRDKLDKKAEAGIFVGYSSTSKAYRIFLPQSNKVIVSRDVLFFEEEKWSKESEKLQVQEESEEDPVDYNEATTDSKWVSAMKEELDMIEKHQTWELTEKPKDKNVIGVKWVYRTKLNADGSVNKHKARLVVKGYAQMFGVDFSKTFSPVARLDTIRLLLALAAQKGWIIHHMDVKSAFLNGHLEEEIFVEQPEGFVVHGQEEKVYRLKKALYGLKQAPRSWYGRIDAHLISLGFEKCLSEFTLYVKKTDVGIVIVSLYVDDLLMTGRSKELIEEFKGGMKEAFEMTDLGKMSFFLGMQVQQDRGEVFVSQEKYAKEILTKFKMEECKPIATPMNQKEKFSNEDGAEKVDEKLYRSLIGCLMYLTATRPDITYAVSLLSRYMHCASEIHFKAAKRILRYINGTIGYGVKFQPVKDFSLYGYSDSDWAGNVIAQSTAEAEYVAAVAAANQAIWLRKLMADLHMEQKESTQVLVDNQAAISISKNPVFHGKTKHFKIKLYFLREVQKQVSSTKTWCMLPLSQGGDCWDFVTPTAYG

SEQ ID NO: 220836 - protein, 92 aa, Glycine max
  Coding DNA Sequence Number=SeqID_104058
MEYERVYKIGQHQMELEWPQTLGVASEWRDDNTGGSVTGKVLPRARGIFPLGCSAHRETSIIMYRSSSKDYIVRAKDQGKTTLETVEKLVCR

SEQ ID NO: 220837 - protein, 128 aa, Glycine max
  Coding DNA Sequence Number=SeqID_104059
  Homolog annotation: Hit_ID=Q8W0W3; Match level="QueryCoverage=44%, HitCoverage=18%, E-value=4e-09, Identity=54%"; Hit description =Transcription initiation factor IIB
MKFKRRCFYLFFVGFEVFHPYFQVVGFWPIDEIWLFGGGGGCRDGVICGEDSATTIVLKERMRGVRIRAMILLVAKGAGRELVFAIVLGYDDGETVVGEEGVGGPVDMVGVIVEGVRLKGRTPPLGLV

SEQ ID NO: 220838 - protein, 85 aa, Glycine max
  Coding DNA Sequence Number=SeqID_104060
MMCDDAQCDNLRCAKAATMCDNDVRRAQVVMIYYVLKLPRGATMKGCPCDFEIVYLDSRDKSNNNGDMDGGDGAKTLSLSSSMAA

SEQ ID NO: 220839 - protein, 48 aa, Glycine max
  Coding DNA Sequence Number=SeqID_104061
MVPLLEKASPNAPIITVSSYGMYTTPLTKDVKRKHGTKANGSEGVQEG

SEQ ID NO: 220840 - protein, 55 aa, Glycine max
  Coding DNA Sequence Number=SeqID_104062
MKDGDCLVTPNRLEMGRGVSAGGGQSSLDYLFGSGVPASSANGARTQNASAPSPP

SEQ ID NO: 220841 - protein, 86 aa, Glycine max
  Coding DNA Sequence Number=SeqID_104063
  Gene Ontology: Mol. function=oxidoreductase activity
  Homolog annotation: Hit_ID=Q6D4P4; Match level="QueryCoverage=98%, HitCoverage=30%, E-value=6e-22, Identity=60%"; Hit description =Putative aldo/keto reductase
AGRLRQALFDDATLQQIAQQKGISIAQLLLSWVIRQPGVMAIPKAGSVAHVQENAAALNITLTSDELALLDRAFPPPQHKLALDVV

SEQ ID NO: 220842 - protein, 214 aa, Glycine max
  Coding DNA Sequence Number=SeqID_104064
  Gene Ontology: Mol. function=protein-methionine-S-oxide reductase activity; Biological process=protein metabolic process
  Homolog annotation: Hit_ID=P65449; Match level="QueryCoverage=53%, HitCoverage=83%, E-value=3e-49, Identity=75%"; Hit description =Peptide methionine sulfoxide reductase msrB (EC 1.8.4.12) (Peptide- methionine (R)-S-oxide reductase)
  Pfam annotation: Domain name=DUF1315; Domain location=124-212; Score =173.4; E_value=5.8e-49; Accession=PF07023.2; Description=Protein of unknown function (DUF1315)
  Pfam annotation: Domain name=SelR; Domain location=7-118; Score =213.7; E_value=4.2e-61; Accession=PF01641.9; Description=SelR domain
  Pfam module annotation: Pfam domain module=DUF1315::SelR; Domain location=124-212::7-118
MAKDTAPEAKIAQLSEMQRYVTQHRGTEPPFTGALLHNKQEGIYHCLVCNAPLFLSETKYDSGCGWPSFYQPYNDEAIRYLEDDSHGMHRVEIRCGNCDAHLGHVFPDGPQPTGQSARGLSMKQELEAMLAAMTPEVYERLATAVETGKWPDGVVLTQDQKDNCLQLVMLWQARHNDEPQHMTISKGGEMVMKSKKQLKEEWGIESDVTRINLH

SEQ ID NO: 220843 - protein, 263 aa, Glycine max
  Coding DNA Sequence Number=SeqID_104065
  Gene Ontology: Mol. function=hydrolase activity; Cellular component =integral to membrane
  Homolog annotation: Hit_ID=UPI00005F9C1E; Match level="QueryCoverage =69%, HitCoverage=95%, E-value=3e-72, Identity=75%"; Hit description =COG0494: NTP pyrophosphohydrolases including oxidative damage repair enzymes
  Subcellular localization annotation: CTP_CleavageSite=38; ConfidenceScore=5.18e-01
MAAAVKNRAGNSDIVKGPCGGVSAFAQAPLAVIAPAFRAERRRLNPCFYSGLSRAVVFYSGRRRPCQIASQITQCGLNTDLLRQAANDGGGQPPDKLAVIPGEINAVRAAGAMNIQRVVTRQGQRFPQGHLEHVRHFTLVGAKLHVRRDQADDRRDLKSGAAVERRHLAEDGHRVRRYRHFFLSFPQRRDDRRSVFGVGLAAGEGHLAGMFAQRVGAAGQQQRRLGAADDRDKHRRRAHIVRDLRRLRQLQLKTADKGVQRGR

SEQ ID NO: 220844 - protein, 397 aa, Glycine max
  Coding DNA Sequence Number=SeqID_104066
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=Q7CHV2; Match level="QueryCoverage=71%, HitCoverage=89%, E-value=1e-125, Identity=80%"; Hit description=PTS enzyme IIAB, mannose-specific
  Pfam annotation: Domain name=EIIA-man; Domain location=57-173; Score =172.1; E_value=1.4e-48; Accession=PF03610.6; Description=PTS system fructose IIA component
  Pfam annotation: Domain name=PTSIIB_sorb; Domain location=214-362; Score=288.2; E_value=1.6e-83; Accession=PF03830.5; Description=PTS system sorbose subfamily IIB component
  Pfam module annotation: Pfam domain module=EIIA-man::PTSIIB_sorb; Domain location=57-173::214-362
MGLPGDGRRAEQHMQRQRVAGRAEALHSLVMKEGITVSGFFWGTKRLFQRRFRRVAIAIIIGTHGAAAEQLLKTAEMLLGEQDNVAFIDFVPGENAETLIVKYNEKISGLDTSGGVLFLVDTWGGSPFNAASRIAVDKENYEVVTGVNIPMLVETFMARDDNPAFDELVALALETGREGVKALKKPQEEPAKPAAPVAKAAAPQAPLGPNDHMKIGLARIDDRLIHGQVATRWTKETNVSRIIVVSDEVAADHVRKTLLTQVAPPGVTAHVVDVAKAIRVWNNPKYANDRVMLLFTNPTDVLRLVEGGVDIQSVNIGGMAFRQGKTQVNNAVSVDEKDIEAFKKLNDRGIELESFFGHRRSAMEITTLQIVLIFIVACIAGMGSVLDEFQFHRPLVA

SEQ ID NO: 220845 - protein, 56 aa, Glycine max
  Coding DNA Sequence Number=SeqID_104067
  Gene Ontology: Cellular component=nucleus; Biological process =response to DNA damage stimulus
  Homolog annotation: Hit_ID=Q9STA6; Match level="QueryCoverage=94%, HitCoverage=13%, E-value=3e-14, Identity=72%"; Hit description=RAD23 protein
IADVKKNTETSQGVDVYLITQQMLIHHGKVLKDATTLEENKVVEDNFVVIILNKVM

SEQ ID NO: 220846 - protein, 141 aa, Glycine max
  Coding DNA Sequence Number=SeqID_104068
MCLHCYLFEAKLVDLHHNHRDPNNTDSSVPLACRVLVGAQRSCRGLVGAQQSCRGLVTDDDVSPCRSKPILIVCDKEMVLESVEHVPVVAKEKEVVPFDDWGGSGGEFNGGVVDVCSRGKEEALFQCRLEGGFEREQHEGF

SEQ ID NO: 220847 - protein, 464 aa, Glycine max
  Coding DNA Sequence Number=SeqID_104069
MLSKRKPLYRFPLIPVSALIICLFFLVLYHYHAKPDSQFHGLSKTSSTSSHTPRCSGQALALGEKFVSYAPHSGFSNQLSEFKNAVLIVGILNRTLVVPPILDHHAVALGSCPKFRIVDPKDVRMSVWDHVIEVIQSRRYISIAEIIDVSSLVSPSVVQSSVSERLKQCGSLLAGVHGSIGKCIYAVNEDCRTTVWTYHKYGHEDDKLDSFQADEQLKQKKKISYVRRWKDVFKTLGPGSEVESASLLVFGSLFSAAYKGSELHVDIHESHQDQRFLSLMKKIKRIPFVLEIMIAGKQFVKETIKAPFLCAQLRLLDGQFKNHQKATFHGLRQKIESMRKEGLLPIHIFIMTDLPGDNWTGTYLGDLISDKRNYKVHFLKENDKLVRRAAVKLMAVGHGQRFISNSDTSISKRYCSSQRLPDLLLYVEQTVCSCASLGFIGTPGSTIAENIELMRKIGSSSQYC

SEQ ID NO: 220848 - protein, 84 aa, Glycine max
  Coding DNA Sequence Number=SeqID_104070
  Homolog annotation: Hit_ID=Q1SDN9; Match level="QueryCoverage=52%, HitCoverage=38%, E-value=8e-07, Identity=53%"; Hit description =Polynucleotidyl transferase, Ribonuclease H fold
MVFCLQTSRTTCCAPTKPTHYKLAATIDSFSVNLFVGTHGAFIQARTLLFLGLPEPQEIEAWGLLEALKWTKSMNLANVTYELD

SEQ ID NO: 220849 - protein, 115 aa, Glycine max
  Coding DNA Sequence Number=SeqID_104071
MKSGVEEVGHTVHANTFTRAAQKNAKERRGGAKGSNAGETEEGVTVAEGVCGIGLVTGAGEISLIGFLQFHWRNKFDRISPIPLAKQVQKCPFEVHNMSKCSKLNKESPDKNITR

SEQ ID NO: 220850 - protein, 93 aa, Glycine max
  Coding DNA Sequence Number=SeqID_104072
  Subcellular localization annotation: CTP_CleavageSite=34; ConfidenceScore=5.20e-01
MFTDHLIHKAPSDFRQRFPPSPATLDQKSTTATMAATSSTKKKNKRHKEDAQLQCVIQVRDEPGGITVVKSDHFFNEVRISMIFYIIQLLLHH

SEQ ID NO: 220851 - protein, 67 aa, Glycine max
  Coding DNA Sequence Number=SeqID_104073
MTKEEHPTKNDVEIDHGRDLEMRGFGTLAARPGELLLQPEVTLLAQASWLLHPKLFGGLGEPGSKKF

SEQ ID NO: 220852 - protein, 111 aa, Glycine max
  Coding DNA Sequence Number=SeqID_104074
MPVGLRYLDPGITPPRHPVDSKKSNKALGFPALITGLYQFYGVPITPTKLIQPPINKSFIEKYCMPRQQMTNHRGQVQLNKSFYQYILHQQRQDPNPYPWPTPEQFKATIA

SEQ ID NO: 220853 - protein, 121 aa, Glycine max
  Coding DNA Sequence Number=SeqID_104075
MKKIFLKVLRLIKRLPSLTSKPYPPLSVRKEVPKKRTHHKMKKGLLIVLLIIQIHYNVVVNGNELESEFSFDSHVARMLYDLLDVHKAKVTVAACHPEMDDVALDNVVLISLGFAKNMFQS

SEQ ID NO: 220854 - protein, 136 aa, Glycine max
  Coding DNA Sequence Number=SeqID_104076
  Homolog annotation: Hit_ID=Q1STZ2; Match level="QueryCoverage=57%, HitCoverage=16%, E-value=2e-08, Identity=39%"; Hit description=IMP dehydrogenase/GMP reductase
MGSNQAPSFKKRFYHVKVKNLELASLRELGQQMDQVRHQAFSKAYGKIWDLTMIEVSVEAIASLAQYYDQSLRCFTFGDFQLVLTIEEFEGILGCLLGGRKSYLFFRFHPSMARVAKVVKISAQELDRVKQNKNGV

SEQ ID NO: 220855 - protein, 246 aa, Glycine max
  Coding DNA Sequence Number=SeqID_104077
FDEFRREIERRNWHKELTNFSLGSIDVAIVKEFYANLYGPKDKSHKQVRVRGHLIKFFIDTLNTFLKTPVVIKEGESLLTYSRFANLRSVPQELTTCLCIPRRGFELNADGLPLKILRKNLTTLAQTWSVLSFSNIAPTSHTSNITLDRAKLIYGLVMHMDMNLGSLISGQISLIVQHDSSRIGFPALITALCKARGVTSDSLTFESLSLTINLAYIKNNYGNMDDPSVTFWGTLHRRTLQQLPHK

SEQ ID NO: 220856 - protein, 37 aa, Glycine max
  Coding DNA Sequence Number=SeqID_104078
MAPKTCSLSASASDRTSSIKWCVYGHKELGLAGMSST

SEQ ID NO: 220857 - protein, 105 aa, Glycine max
  Coding DNA Sequence Number=SeqID_104079
MKHASWSALVVDPLPTPQQSQPQYTKDMIYRYPLTTGQGLLRSMKHASWSAPVVDPMPTPQQSQPQYAKDGAPIEEVGPISEDDKEINLNNDDVDEDDNQNLNIE

SEQ ID NO: 220858 - protein, 151 aa, Glycine max
  Coding DNA Sequence Number=SeqID_104080
  Gene Ontology: Mol. function=nucleic acid binding
  Pfam annotation: Domain name=zf-CCHC; Domain location=121-138; Score =10.3; E_value=0.02; Accession=PF00098.13; Description=Zinc knuckle
TYQGNPCGVYPDLSSFTGSGVYPDLSSFTGSGIIQKLYSLYQAIRSYSGSHHKLINNVYKLNYVSNVYNRSFGQMKHASYWPKYEGPTMCHDPQIWKRKNDHPRSTRIHTKMDQREREQPKCCSLCKTVGHSKNKCPNTRGSTSQSRQCTH

SEQ ID NO: 220859 - protein, 251 aa, Glycine max
  Coding DNA Sequence Number=SeqID_104081
  Homolog annotation: Hit_ID=Q337M4; Match level="QueryCoverage=30%, HitCoverage=20%, E-value=7e-21, Identity=68%"; Hit description =Uncharacterized conserved protein, putative, expressed
MKFMKLGTRPDTFYSEQATSTMYYVISSFPYLKIQNLLADDMEEREPLKFPTKYNIQMGMRWLIQGSQSGDSLLMSSDCLDRQLGPRLHGRTDDSGVNNRFTYKTTSYQDPVVEINYERADIIILKLKMTIASLSPDCLLQQSSTVEDSISFKFSYGITESVPCSYTEFAERLVLPQYKNLPDTEVKEFHRRDGFEVASADKMAKSCMMTRELKEECRASILSYPIPIHGLRMLQEFGILAVTRVEDFTKS

SEQ ID NO: 220860 - protein, 181 aa, Glycine max
  Coding DNA Sequence Number=SeqID_104082
MAERIHAVEKESGEWVTVEQRNTDYPRRCSSNLDDGQHDEQRAILPSGHSQKPMGNSIIRQTTTNWQKSEAEETIGVNIVEQVASHSRGSETNQDDESGEEGSFVGSPTAERTQVVEKEVGEWVMVERTHVAEKESGEWVMAEQPNSEDPRRCSSGLDDGHNDEQRVTLPSGHSHRPMGNS

SEQ ID NO: 220861 - protein, 105 aa, Glycine max
  Coding DNA Sequence Number=SeqID_104083
MNHIAFVSISFQKRRGKQNEERSLLGVGDHSDHPRTSKHRATSSEEVMGNDLESKFSFGSHVTRIDAILPRKGPITRTMSKRLQEDWARAAEEGPRVLMNLRVDF

SEQ ID NO: 220862 - protein, 489 aa, Glycine max
  Coding DNA Sequence Number=SeqID_104084
MATISPMWFILLGITCFCVTDSYGANMPLRTLYGGTHQEALLGLEAFKASITRRDSIASTPPSFSPSPSPSPLPSQDLKKSHVYLVTSYGADPTGNSDSTEALLAAIADAAKGPSVGFLMKDIKDLGGAQINLEGGKYIISKPLQLPLAGVGNLMIHGGTIRASYNFPPDGHLIDLSTSGESNSYNYEYITLKDLLLDSNFRGGGISVKKTLRINIENCYITHFNTTGILVQGGHETYIRNTFLGQHITAGGDKHERDFSGTGISLLGNDNAVTDVVIFSAEIGIIVTGQANTLSGVHCYNKATGFGGKGIYLKLPGLTQTRIVNCYMDYTNIVAEDPVQLHISSSFFLGDAGIVLKSVNGIVSGLNIVDNMFSGLNKGVDIVKLDQSNSPFNQIDQVFVARNVVRGMNLKATTAKMSLLGNGTTWTSDFTKVLLFPNLIKHVVYSLSANGNTFPNHALRNVSQNRVVIETDEAVNANVFVTVDQGNAS

SEQ ID NO: 220863 - protein, 611 aa, Glycine max
  Coding DNA Sequence Number=SeqID_104085
MFVNKVLTGTNDWTAYKVGAHAACQGEWLLATNIFRTLIEKVKSDSCCSWLKALFHYAHSEGKIQLLSQPKQGTTSMELMETIKFPITSCDYKGDTCPRLARSINDCNYYDQLTQSHMAVFSSLKILEASVTSSQAFCFQRWFLSLRARVLENLVGVLGALREVSLNVAQNFNQVEIESSDKLQCLKSYQDITQASLQLFRLVEEFDLLRASFIGMDSETSAVLAAHGLSCSILAFATAFGVSNIDQHSQRILIGGKTSNLQALTIQSLRRLFWSVDHETRASFSLLLNYFHPNENCLSPLPSYQNWNIGYKDREVLNVCSYAISGAVRLFEKIAPQFTENALSLTFNTLMKWMHIHFRLPRPFIGSKLFVHNKDSSNGVDISVSQGSHLTLNICLQLKNVPPKLLVKSTKLYCILHVPCGQRQAPGNSHSGYEAWKDDEIVEMNQKLFCLVLDSAAGKRRIGMRSRGHGNSRAVETFMDFRPNEKGQGFSHCSLDVSNFPFLSLRSVERKLQVMLKQVCLLASVEFSHIVESPVIQTEISTVPLGWNNGGVKDGEPLKVYITGFGWHLCTHVQVNERRNGLVFLKCTVVSILHSQECKTSFIVEGLMGVL

SEQ ID NO: 220864 - protein, 457 aa, Glycine max
  Coding DNA Sequence Number=SeqID_104086
  Gene Ontology: Cellular component=nucleus; Biological process=snRNA processing
  Homolog annotation: Hit_ID=UPI0000519BDE; Match level="QueryCoverage =90%, HitCoverage=40%, E-value=2e-16, Identity=25%"; Hit description =PREDICTED: similar to integrator complex subunit 7 isoform 1
MEPTSVAQAMEWSIQLEMGLRSTKPGVPVKAISDMEPRLQQWSTEPEFGIAPYAMFGLVPGEDKLFANTILLRLVDAFRGGDIETKLSVVRVFLSERKHRDKEKKKQCKGLLSEAKVANHLELLKRVKSVFDSGELKSKALALVLFGCWADFVKDNAQIRYLIFSSLVSPHDCEVRASLYATGCICEISDDFASISVEMLFNIMNSSSVPLPIKLDAAQVLAKCKSSYSVAYKAYKTGMELVLNSSDEEFLVAMLFSLSKLACILIPCISYQVDFLLSFLNRDRTSHVQDTTLKCLHFLFRRGLYEHSDNLGLIRGLFSIMEGPEISLAMQYKALRVLHKVLLSIPPSSLHKELREFVRLLTVVENASQYPASRKRCLSIRILADLCCRTKDIADIDEVFCCSLPSRVISLIKDHIKLLLKTLLEGCQNDLTIFQELQGLLKILLNIVERHPNLGSL

SEQ ID NO: 220865 - protein, 367 aa, Glycine max
  Coding DNA Sequence Number=SeqID_104087
  Gene Ontology: Mol. function=phospholipase C activity; Cellular component=membrane; Biological process=intracellular signaling cascade
  Homolog annotation: Hit_ID=Q10JM3; Match level="QueryCoverage=90%, HitCoverage=88%, E-value=1e-132, Identity=67%"; Hit description =MAP3K-like protein kinase, putative, expressed
MDFLRCLLLVIILPLCYSIDAACSNGKCKLDDECSSNGDCGAGLYCFSCPHGFSGSRCVRSSITDQFKLINDSLPFNKYAFLTTHNAFAINGEPSHTGVRRATLSNQEDSVTQQLKNGVRGLMLDTYDFDGDVWLCHSFRGHCHDFTAFEPAIDTLKEIAAFLSSNPKEIVTLILEDYVEAPKGLTKVFTDAGLVKFWFPVTRMPKNGGDWPLVSDMVAKNQRLLLFTSVSSKEKSEGIAYQWNYMVENQFGDKGRKALKEGSCPNRKESSPLDDKSKSLVLVNYFRTIPLKPISCEDNSGGLIEMLQTCHRAAGNRWANFVAVDYYKRSEGGGSFQAVDTLNGKLLCGCNDVHACVHGSTAKACSA

SEQ ID NO: 220866 - protein, 172 aa, Glycine max
  Coding DNA Sequence Number=SeqID_104088
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=89%, HitCoverage=20%, E-value=3e-35, Identity=51%"; Hit description =Receptor-protein kinase-like protein
MEATLANLYWHGAQAALSSQISCNCTIIHDEVKTTNILLDEDWVAKGSFGYIDPEYYKRKHLTEKFDMYSFGVVLFEVLCARLALICTTESNQESLAYWVRYCYQNGTIEHIVAPECFKMFCEIGMMSCLSGTERSSMNDIVRMLQFALPIFSSQDFFLRDYRPKAVFGESN

SEQ ID NO: 220867 - protein, 252 aa, Glycine max
  Coding DNA Sequence Number=SeqID_104089
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=81%, HitCoverage=34%, E-value=3e-18, Identity=48%"; Hit description =Receptor-protein kinase-like protein
MGFKLMGIDTLYGLRTNTALEIEYRIKVGEINDLATNMNSKMNIMVNPDYVAPKELYRTTRGMGLNKSLELTWEFPVDSGFTYMARFHFCELDPNITNIGDMVFFTYIGSELAEDHADVISWSQKQKGLAVYKDYAILIPRMILIKSLLLLSTNTQDYKLPTNMWDYRLPTNMQDYSEKCWPYNRLCQCFSLDEIKAATNNFDNTSVVGEGGFDHVYKGYIDDISIPVDIKHLKPGSKQGFEEVLAEIGMLS

SEQ ID NO: 220868 - protein, 77 aa, Glycine max
  Coding DNA Sequence Number=SeqID_104090
MEWNAKTTSFRRLDLEKVEEEEDEDEVEEEDDRKEGGDGLSLLRWSQCAVAAIVAIEPLVGCRRKRNQVEATRFLKM

SEQ ID NO: 220869 - protein, 49 aa, Glycine max
  Coding DNA Sequence Number=SeqID_104091
MGASESWWMIEMTMDAGDFLGPKVEEKNWGFAGKRNARRKSVVLLCTRM

SEQ ID NO: 220870 - protein, 158 aa, Glycine max
  Coding DNA Sequence Number=SeqID_104092
  Gene Ontology: Mol. function=nucleic acid binding; Biological process= DNA integration
  Homolog annotation: Hit_ID=Q1T010; Match level="QueryCoverage=91%, HitCoverage=10%, E-value=7e-31, Identity=47%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MNAILGFQELDEIKISKVATSKQAWDILQQVYNNTGRTKKVKLQSLIRQYELLSMTEQETITDYFNRTQVVTNSMQACDEAMVDSKIVEKVLRTLTPKFDHIVVAIEESKDCENMTMEELENSLEAHEQRVLERKSNDKVAKQALQARTNHKSSGRGG

SEQ ID NO: 220871 - protein, 59 aa, Glycine max
  Coding DNA Sequence Number=SeqID_104093
MPRGMRIRATWGYVSLVEGGQLGMSGTWRYVAGVRRPWGRQVGCYCPKPSLINPDPSRA

SEQ ID NO: 220872 - protein, 95 aa, Glycine max
  Coding DNA Sequence Number=SeqID_104094
MRKLIKERMENKVVNFVGLNKVVSGIKWMNGMKYRNGNNGSYRAPNEVIPKREVDFLELWFERTRVEMIGRKESLFPARATHKGCESPLIQPGCS

SEQ ID NO: 220873 - protein, 109 aa, Glycine max
  Coding DNA Sequence Number=SeqID_104095
  Gene Ontology: Mol. function=oxidoreductase activity, acting on single donors with incorporation of molecular oxygen, incorporation of two atoms of oxygen; Biological process=aromatic amino acid family metabolic process
  Homolog annotation: Hit_ID=Q56H33; Match level="QueryCoverage=64%, HitCoverage=15%, E-value=8e-11, Identity=47%"; Hit description=4 -hydroxyphenylpyruvate dioxygenase
MHREEEVEEVATNGSPRRPHRLRGGAPLWRHGAPLRQLQGRRAASATRRSIAVVFAGIQGLSVVIFVSRARPRDSAAGPRHRDSRPWVSESPRSLTWLRLALSIAGSTR

SEQ ID NO: 220874 - protein, 51 aa, Glycine max
  Coding DNA Sequence Number=SeqID_104096
CLDRGSVDDALAIVEGHANNMQCHHGFPSKGVEREREVLGGFYSGVSLRRR

SEQ ID NO: 220875 - protein, 92 aa, Glycine max
  Coding DNA Sequence Number=SeqID_104097
MTKDNDCTSKPNTGAMKGIVHEPQVNIGADQKFSPVDVDPWVLVPITFRGLYVLAIRGLHILACRELHTLAFRGLRVLIFSVLHIHTLGEYK

SEQ ID NO: 220876 - protein, 68 aa, Glycine max
  Coding DNA Sequence Number=SeqID_104098
MRTRSPLKARVCSSLQARMCSPLMARTYSPLKIDCPFEKGDNSCNLILSFANLSGNSLRVYILFDLVT

SEQ ID NO: 220877 - protein, 129 aa, Glycine max
  Coding DNA Sequence Number=SeqID_104099
GAEDDISQCVLSGFSSYRQQKVYTDNHSGISARQRDSKVSMTDLVSAEDDQQKVYTDNHSGISARQRDSKVSMTDLVSAEDYKTTLVSCAMRLFGLQQPKVYTDNHSGISARQRDSKVTMTNLVSAKDD

SEQ ID NO: 220878 - protein, 34 aa, Glycine max
  Coding DNA Sequence Number=SeqID_104100
MPISGKELWRQQEEQLLQRYLGFSRPNLTRGIYG

SEQ ID NO: 220879 - protein, 147 aa, Glycine max
  Coding DNA Sequence Number=SeqID_104101
  Gene Ontology: Mol. function=nucleic acid binding; Biological process= DNA integration
  Homolog annotation: Hit_ID=Q1T010; Match level="QueryCoverage=93%, HitCoverage=12%, E-value=3e-26, Identity=35%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
IDNNNAHRKYKKNDQAHLAQEEDGSDSDQVLLMVTTSSKEDYSSWYLDTECSNYMTGNRDWLVDFNPNVTTSVRFVDNSTILAKGIGKLLEKGFTMAMQENYIEIFYDKQRLVLKVPLSRNRTFKVNLSIAAIQCLSTINTEEDSWQ

SEQ ID NO: 220880 - protein, 354 aa, Glycine max
  Coding DNA Sequence Number=SeqID_104102
  Gene Ontology: Mol. function=nucleic acid binding; Cellular component= intracellular; Biological process=DNA integration
MAPQRAKQPLRIVHSDMCGPFDNPSLGVERQSKLELKILRTDGGGEYNSKEFKEFCEVKGIEHKGEAVTTTTYVLNRCPTKRLQSVTPEEDWTGDKPMVNHLRIFGSLSYRHIPDERRRKLDNKSEALILVGYHPIGAYKLYSPLKQQVVISRDVVVDETAAWKWDNESKIPSSFILEDNPRTKDVNPASSMQPPALDIREWKAAMKEELDAIEKNRTWELVDLPHNKHSIDVRWVFKVKLKTDDSIAKHKPKLVAKGFLQKQGIDYTEVYAPVARMETIRLVIVVASSRNWTICQLDVKYDFLNGPLEEEEIQHKNLLFVCLYVNDLIITGDANEEIEQFKEKMKSEFDMADL

SEQ ID NO: 220881 - protein, 355 aa, Glycine max
  Coding DNA Sequence Number=SeqID_104103
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=5e-38, Identity=29%"; Hit description= UPI00006A17C9 related cluster
GLHVLSFRGPHVLAIVGLHVLAFNGLHVLAFSGLHVLAFRGVHALSFRGLHVLAFRGLHVLAFKGLHVLAMRGLHVLAFIGLHILTFRELHIPPIRGLHTLPSEDYASSLSEDYTSSPSEGYTSSPSKDYTSSPLEKYTSYPSEDYTSSASEGYTPSPSEDYTSSPSEDYMCYPFSGLHVLTITGLHTLTFGGLHAITFRGLHVLANKGLHALTLRGLHVLSFRGLHIAAFIGLYVLAIRGLHLLAFIGLHALTIRGLHILTFRGLHVLAFRGLHTLEFRGLHVLAFSGVHVLPFQGLHILAFRGLHALTSRGLHVLAIRGLHVLPFRVLHVLLFRGLHALAFRGVHVLPFRGLH

SEQ ID NO: 220882 - protein, 100 aa, Glycine max
  Coding DNA Sequence Number=SeqID_104104
  Subcellular localization annotation: CTP_CleavageSite=71; ConfidenceScore=5.93e-01
MPPTASSLKTASPSKTLSLVSSLPAASTTFTTRFHSTTSKQRDQIEGLTNFVGDCGSRGSRGSRAIVASCSCATTEVRTREVKVLELGKYGFENEGVKES

SEQ ID NO: 220883 - protein, 169 aa, Glycine max
  Coding DNA Sequence Number=SeqID_104105
MYEIPTSVGTLSHTHPHDLSKEEKRKLEREKRKEGIRLEKRRRKSKKRKKKGLRCQDPMPKNHFHVLPEVSASSIVHLFLKFVVFFFLPLNPKLGGKEILRIINSIFGPNVEFNSVCRPKKRRCKKLLMNSLSEADWLSESHSLSEAASSLSGWETLEEDKSEIHALDT

SEQ ID NO: 220884 - protein, 104 aa, Glycine max
  Coding DNA Sequence Number=SeqID_104106
  Gene Ontology: Mol. function=microtubule motor activity; Cellular component=microtubule associated complex; Biological process =microtubule-based movement
  Homolog annotation: Hit_ID=Q9AVP4; Match level="QueryCoverage=59%, HitCoverage=8%, E-value=6e-23, Identity=85%"; Hit description=BY-2 kinesin-like protein 10
MGNSSTGTRGANEESSRSHAILQLCIKGSADGTKSKPARLVGKLSFIDLAGSERGADTTDNDKQTRDPLSSSNLRDSAVLPGSSVLSHDDTLEDEVTYVSGDKN

SEQ ID NO: 220885 - protein, 111 aa, Glycine max
  Coding DNA Sequence Number=SeqID_104107
MVGYTPSSFADLVFTGKRIKMCLERGISDHPALINAKTGANEEDENEGETLAMTAIPTRSNFPSAQQCHYSANICPSHYPPSSHPERPSLNQPQSLPAAHLVPKHQPKGIL

SEQ ID NO: 220886 - protein, 194 aa, Glycine max
  Coding DNA Sequence Number=SeqID_104108
MALDKVSNCGCEPLIMVCFGGLCNHIAIAIAAASDTFFCNCQTPELSDAYSHEGSSDSEENKKGKSLSSNEILKKLRRYGISGILSYGLLNTAYYLTTFLFVWFYIAPAPAKMGYGAAVKRFLKVMAMVWAGSQVTKLVRAGGALALAPFVDRGLSWFTHKFKFQTQGKAFMAIVGLCLGLALIVFFVITLLWA

SEQ ID NO: 220887 - protein, 75 aa, Glycine max
  Coding DNA Sequence Number=SeqID_104109
MLTLSLLKLEQSLLPWKVRHKRLLFFSSGKCHGMKRVPALFSEKRGKPSNANLRHTQTAENEKGHKFGFKWQKRV

SEQ ID NO: 220888 - protein, 258 aa, Glycine max
  Coding DNA Sequence Number=SeqID_104110
  Gene Ontology: Mol. function=metal ion transporter activity; Cellular component=membrane; Biological process=metal ion transport
  Homolog annotation: Hit_ID=Q1C7B9; Match level="QueryCoverage=57%, HitCoverage=44%, E-value=4e-51, Identity=64%"; Hit description=CorA -like Mg2+ transporter protein
TQEWKTYIDSRNSGNFDVIRASWVGDYNEPSTFLSLLTASHSGNISRFSNAEYDAVLSKASNETSVAARNADYNKAEQIIADQVPIAPIYQYTNGRLIKPWGGERPGEYVNVIEGKALQVSDAIVACQFDGKGGVIAIEDKDVINCERHCWLHLNYTQRQSADWLQHTPLIPDAVRDALAGDSMRPRVTRLGDGFMIVLRSVNHNADSRPDQLVAMRVFINDKLIVSTRRRKVYAIDEVLTDLQNGNGPVDGGSWLVD

SEQ ID NO: 220889 - protein, 49 aa, Glycine max
  Coding DNA Sequence Number=SeqID_104111
MSPNFMGQDDKGAEDDKTTLVFAYYQTLSLTDSEIVFIRITTWVSPSAT

SEQ ID NO: 220890 - protein, 51 aa, Glycine max
  Coding DNA Sequence Number=SeqID_104112
YLSWSLRVPGHVLARSIPCVFMGCMDRISHPELALVVGVNLKFEQVYGSEK

SEQ ID NO: 220891 - protein, 93 aa, Glycine max
  Coding DNA Sequence Number=SeqID_104113
MAKGCGMTKFCLRMSSGPPPLDDKECRMTNFCLCAPSDTAVSEWQRGADNRKVSPRVTSSWVMTAKSGVVDKSEALAPTYPPMRNSDVVLDNL

SEQ ID NO: 220892 - protein, 89 aa, Glycine max
  Coding DNA Sequence Number=SeqID_104114
MEIIRKDELVLWMLQMVRGGDGQQQRWWRTFPFASSMILPFDEVLMNFNRWNRKRSENEEDWALWDVIWLRIEGDMKATVIDYRLSVLV

SEQ ID NO: 220893 - protein, 115 aa, Glycine max
  Coding DNA Sequence Number=SeqID_104115
MVWINKVQTNLESKSREREGGGNCALRGRERERWINKVALLDLELVDEHDVVEVAIDDKDVDAVKEILGCTQKPFFLLEESLPAARDSSKIAPTPPSRFRKPAQAHKSMINDAAR

SEQ ID NO: 220894 - protein, 65 aa, Glycine max
  Coding DNA Sequence Number=SeqID_104116
MAAAATAKPLLSLSFVLLLPSFLSIAVAYRPDDIIPMSCMVVNRVAVPHWPPLPHLRCELRGVKN

SEQ ID NO: 220895 - protein, 122 aa, Glycine max
  Coding DNA Sequence Number=SeqID_104117
  Gene Ontology: Biological process=cell division
  Homolog annotation: Hit_ID=UPI00005FA9A7; Match level="QueryCoverage =98%, HitCoverage=41%, E-value=4e-35, Identity=60%"; Hit description =COG4972: Tfp pilus assembly protein, ATPase PilM
  Subcellular localization annotation: CTP_CleavageSite=78; ConfidenceScore=5.03e-01
MAGRAGYTNRLRAGGGGSTPPQRLAVAPLVAAGAAAGGFARWLPATFRIPDPGAAAMARPAAATYFLTHCSTGATRVTAAHDAAGRAAARAGTQRLYRWPRFEAVPARRPDVGARLSRRAGG

SEQ ID NO: 220896 - protein, 212 aa, Glycine max
  Coding DNA Sequence Number=SeqID_104118
  Gene Ontology: Mol. function=chitin binding; Cellular component =extracellular region; Biological process=chitin metabolic process
  Homolog annotation: Hit_ID=UPI000044A8F0; Match level="QueryCoverage =75%, HitCoverage=99%, E-value=1e-18, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSKSFEFGMTDSLDESISCFLIRMDPRRTARPHLKRTVCPHFQRTACPYLQRATRPRHQRTACPHLQRATRPRHQRTAWLHALTFRGLHVIANRGLHALTLRGLHVLANVGLHALTFRGLPVLANRGLHALTFRGLHILAFRGLHVLTFVGLHALTFRGLHILANRGLHALTSRGLHVLALRGLPALALGTSYPHLQRTTCPHLRRAARPHL

SEQ ID NO: 220897 - protein, 114 aa, Glycine max
  Coding DNA Sequence Number=SeqID_104119
  Pfam annotation: Domain name=Transposase_23; Domain location=1-71; Score=-4.9; E_value=0.0039; Accession=PF03017.5; Description =TNP1ENSPM transposase
MGDSDKCGLYIEENLSCLVALGRIYEGSTIVHNILLLHGQVKVGVKEVKDEEALVPVPTDEVQLVGQALNTFLAWSTHLMKRVSKHAAVSPAKPPDRPDPEVDDPLYLMTLTIP

SEQ ID NO: 220898 - protein, 103 aa, Glycine max
  Coding DNA Sequence Number=SeqID_104120
  Subcellular localization annotation: CTP_CleavageSite=45; ConfidenceScore=5.12e-01
MQRIPKSRGKRVFLLSFRDLSSPRLASGSLGPPTNFNVKKPARLRVEEGGGEHSVVKKIERIRREEKETKSRWYRILAIVINLYIVPRSVFFVLPSVSFVFED

SEQ ID NO: 220899 - protein, 324 aa, Glycine max
  Coding DNA Sequence Number=SeqID_104121
  Gene Ontology: Mol. function=protein binding; Cellular component =integral to membrane; Biological process=protein amino acid phosphorylation
  Homolog annotation: Hit_ID=Q9ZTK0; Match level="QueryCoverage=97%, HitCoverage=36%, E-value=4e-17, Identity=28%"; Hit description=Hcr2 -0A
  Pfam annotation: Domain name=LRR_1; Domain location=116-138; Score =7.8; E_value=9.9; Accession=PF00560.23; Description=Leucine Rich Repeat
  Pfam annotation: Domain name=LRR_1; Domain location=12-34; Score =14.7; E_value=0.34; Accession=PF00560.23; Description=Leucine Rich Repeat
  Pfam annotation: Domain name=LRR_1; Domain location=141-162; Score =10.6; E_value=3; Accession=PF00560.23; Description=Leucine Rich Repeat
  Pfam annotation: Domain name=LRR_1; Domain location=164-187; Score =4.1; E_value=50; Accession=PF00560.23; Description=Leucine Rich Repeat
  Pfam annotation: Domain name=LRR_1; Domain location=189-214; Score =6.3; E_value=19; Accession=PF00560.23; Description=Leucine Rich Repeat
  Pfam annotation: Domain name=LRR_1; Domain location=218-242; Score =6.1; E_value=20; Accession=PF00560.23; Description=Leucine Rich Repeat
  Pfam annotation: Domain name=LRR_1; Domain location=244-266; Score =12.2; E_value=1.5; Accession=PF00560.23; Description=Leucine Rich Repeat
  Pfam annotation: Domain name=LRR_1; Domain location=269-291; Score =17.6; E_value=0.046; Accession=PF00560.23; Description=Leucine Rich Repeat
  Pfam annotation: Domain name=LRR_1; Domain location=293-315; Score =14.1; E_value=0.51; Accession=PF00560.23; Description=Leucine Rich Repeat
  Pfam annotation: Domain name=LRR_1; Domain location=61-84; Score=3.4; E_value=66; Accession=PF00560.23; Description=Leucine Rich Repeat
  Pfam annotation: Domain name=LRR_1; Domain location=87-110; Score =6.8; E_value=15; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =116-138::12-34::141-162::164-187::189-214::218-242::244-266::269 -291::293-315::61-84::87-110
GELPYQLGNLSQLRYLDLGENSFSGALPFQVGNLPLLHTLGLGGNFDVKSKDAEWLTNLSSLTKLKLSSLHNLSSSWLQMISKLIPNIRELRLFDCSLSDTNIQSLFYSPSNSSTALTIVDLSSNKLTSSTFQLLSNFSLNLQELYLRDNNIVLSSPLCPNFPSLGILDLSYNNMTSSVFQGGFNFSSKLQNLHLQNCGLTDESFLMSSSFIMSSSSSLVSLDLSSNLLKSSTIFYWLLKSTTDLHNLFLYDNMLEGTIPDGFGKVMNSLEILDLAGNKLQGVIPSFFGNMCTLQLLDLSNNKLNGEISSFFKNSSWCNRDIFK

SEQ ID NO: 220900 - protein, 121 aa, Glycine max
  Coding DNA Sequence Number=SeqID_104122
MPMMDPTDLPWGGLGKIYFPHIAQEMKTLESEECNNNKVNRAFPDEFLGSKGKIVNWVELKLDKGGNGLILKGEIRKKVDQLLGNEDIKARSLKLKELTVNNSVNGDQSSKNLEKFINWAK

SEQ ID NO: 220901 - protein, 124 aa, Glycine max
  Coding DNA Sequence Number=SeqID_104123
MGEKESEKLIWEQMRTPTVATPITPQHPTLPKLLVLLILFFFVTYIIYTLKLVSTSRTCKDTLFSTDTFSKTIIAVNAIASAIAVLKRGSRETNLEDRTNLFHLVFGIAASTKLWDQRKSYIKL

SEQ ID NO: 220902 - protein, 100 aa, Glycine max
  Coding DNA Sequence Number=SeqID_104124
  Gene Ontology: Mol. function=transferase activity, transferring glycosyl groups; Cellular component=membrane
  Homolog annotation: Hit_ID=Q9FN55; Match level="QueryCoverage=77%, HitCoverage=15%, E-value=4e-24, Identity=68%"; Hit description =Arabidopsis thaliana genomic DNA, chromosome 5, P1 clone:MYC6
MLKYTNKQGHRSAIRISRIVSEALRLGMKDMQWFMMSDDDSIFFTENLIHILRKYNHNRSIRWGVCRRVTCKTFSSLTTWPMAEEVHAHSNLGNLMKAQG

SEQ ID NO: 220903 - protein, 191 aa, Glycine max
  Coding DNA Sequence Number=SeqID_104125
  Gene Ontology: Mol. function=DNA binding; Biological process =regulation of transcription
  Homolog annotation: Hit_ID=Q8LFS2; Match level="QueryCoverage=72%, HitCoverage=37%, E-value=7e-24, Identity=39%"; Hit description =Regulatory protein
MDNPKQTLGSFAVVTLLFAGVILLYNWSTSFSNELVLSQKEPLCEQSNSTTTNVEAYGDSLDYALAKASMGNKTVIIAIVNKAYVEQDVESDTTMLDIFLGSFWLGEGTRSLIDHLLIVAVDQTAYNRCQFLRLNCFRLETDGVGFEGEKIYMSQDFIKMMWRRTQFLLEVLKRGYNFVFTIYRYAVGISI

SEQ ID NO: 220904 - protein, 622 aa, Glycine max
  Coding DNA Sequence Number=SeqID_104126
  Gene Ontology: Mol. function=nucleic acid binding
  Homolog annotation: Hit_ID=Q6YH14; Match level="QueryCoverage=42%, HitCoverage=77%, E-value=1e-126, Identity=84%"; Hit description =Putative heterogeneous nuclear ribonucleoprotein
  Pfam annotation: Domain name=RRM_1; Domain location=132-203; Score =94.3; E_value=3.8e-25; Accession=PF00076.12; Description=RNA recognition motif. (a.k.a. RRM, R
  Pfam annotation: Domain name=RRM_1; Domain location=212-289; Score =23.2; E_value=0.00095; Accession=PF00076.12; Description=RNA recognition motif. (a.k.a. RRM, R
  Pfam annotation: Domain name=RRM_1; Domain location=309-382; Score =42.4; E_value=1.5e-09; Accession=PF00076.12; Description=RNA recognition motif. (a.k.a. RRM, R
  Pfam module annotation: Pfam domain module=RRM_1::RRM_1::RRM_1; Domain location=132-203::212-289::309-382
MGIVSTRNDDEEEVKESIDEYEKDERLDLEDNDPEYEPEEYGGVDYDEKEIEQDEGHEVGNEVEEEEAEDNVGEEEGDTGEEEVEDVHDELEGEEEHEHAGEEREHPDFADVEEEEHREVVKERQKRKEFEVFVGGLDKDATESDLRKAFGEVGVVTEVRLMMNPQTKKNKGFAFLRFETVEQAKRAVAELKNPVINGKQCGVTPSQDSDTLYLGNICKTWTKEALKEKLKHYGVTNVEDLTLVEDTNDEGKNRGFAFLEFPSRSEAMDAFKRLQRRDVVFGVDKPAKVSFADSFIDPGDEIMAQVKTVFIDALPPSWDEDYVRDLLRKYGEIEKIELARNMPAARRKDYGFVTFGSHDAAVKCADSITGTELGEGDKKAKVRARLSRPLQRGRGKHISRGDYRSSRGSGMMTRPSWSRPAPRSFPSRSVRGVGSRAPPVRPVSVRDRRPMMSIPARSRPVPPPSRSYDRRPVAPAYPKSSMKRDYGRREDIPPPRSRVAVDYGSRVASERRTSYRDYPARGPGYTELPRSTSRAAPRRGYVDDGYGQRFERAPPPPPPPHLSYREGRPRDYDALSGSKRSYAAIDDVPPRYADTGARQSRARLDYDYGGSASQYGDAYGDR

SEQ ID NO: 220905 - protein, 64 aa, Glycine max
  Coding DNA Sequence Number=SeqID_104127
LVAAHIHQCILEGVWVVVAVIWVVADQDLIIEHLLFFSQVPAKVALWSPVHLSVNRSDMIKWLL

SEQ ID NO: 220906 - protein, 279 aa, Glycine max
  Coding DNA Sequence Number=SeqID_104128
MHAFFYTTCIKTRLIDSRDFGLTFNFRCSKTRFHIEFRHQHHDSIGKNCLRCVLVSDFHISSSWSKIYRARELDSCAGNYYQIMSVPNSSCFELTNLFAKILNQRQNIHEKEEQGDDEKGKLVSLGQMNSLSSKQDVPMLDLVRAMCSVHDEKSGQPLAFEYTLNTIMHFVLVVCSEVKEDSRTSKNISSEGERRTPEIMGRCASWWATFTFFVCLCSLKFSKPLLQPQGPNSLWLAILGMFSFTVFVSAASVMVVVEAQFTRMQITVMLSAFLALLLA

SEQ ID NO: 220907 - protein, 83 aa, Glycine max
  Coding DNA Sequence Number=SeqID_104129
  Subcellular localization annotation: CTP_CleavageSite=62; ConfidenceScore=5.36e-01
MTKNVLDPNTSSSSSLCHPSTMPLEATEFLRTMSLEATKKARGWVVKSQSLSMRMGGGGPTRGFEFQEGKKGSTAYSRTTILE

SEQ ID NO: 220908 - protein, 80 aa, Glycine max
  Coding DNA Sequence Number=SeqID_104130
MAMLYSKIHYHEQIAMLYTSTQRYPAVDVVPAHDGAALVVDGAVAVDVGDGARDHREARVEARVSMGESGGGRRRVVEVE

SEQ ID NO: 220909 - protein, 221 aa, Glycine max
  Coding DNA Sequence Number=SeqID_104131
MGHDPKLLEEKENRHSHPPNHAVIKIDDNGVLKVDKRETKRLNTFLKFYGNRIFQSHSTDENRVAKWAALHGMQWAQLSVLGNPLDKLSQSTGIDTMELSMGKACSITVWTSIFFLNFLFAAMLTWSLPLRIPAYSMLGFSLLYYILALIVAMSGYSVAWGGSAKMSGLLFVFGGATSLVLLLSIIIIVVLYAAWCSSPNEVGGELTEKHSPECIIKFQDN

SEQ ID NO: 220910 - protein, 502 aa, Glycine max
  Coding DNA Sequence Number=SeqID_104132
  Gene Ontology: Mol. function=hydrolase activity; Cellular component =intracellular; Biological process=protein amino acid phosphorylation
  Homolog annotation: Hit_ID=Q1SZI6; Match level="QueryCoverage=82%, HitCoverage=56%, E-value=5e-57, Identity=26%"; Hit description =Tetratricopeptide-like helical
  Pfam annotation: Domain name=PPR; Domain location=107-141; Score =36.7; E_value=8e-08; Accession=PF01535.11; Description=PPR repeat
  Pfam annotation: Domain name=PPR; Domain location=303-337; Score =29.3; E_value=1.4e-05; Accession=PF01535.11; Description=PPR repeat
  Pfam annotation: Domain name=PPR; Domain location=404-438; Score =37.1; E_value=6.2e-08; Accession=PF01535.11; Description=PPR repeat
  Pfam annotation: Domain name=PPR; Domain location=439-473; Score =14.7; E_value=0.13; Accession=PF01535.11; Description=PPR repeat
  Pfam module annotation: Pfam domain module=PPR::PPR::PPR::PPR; Domain location=107-141::303-337::404-438::439-473
  Subcellular localization annotation: CTP_CleavageSite=47; ConfidenceScore=5.62e-01
MFCARPTNTVTHPSFKSSSEMQTSISPFLSLHPQSHSFLPSTRHTLSLSAPQSYAPPSSPPLLIHPRPPRFDYAPSYETRPNGIYLKRRKVELARQVFDEIPKRDVNAWSTMITGFARNGMLREVWEYTRLMLEEGINPNLVVMTVILDVIGKFGGRNLGREAHGFVLKMNIYYKELSIQSALIDMYWNCGDVGSGSRVLYSVMKRYGDCWIGLMSGRLEVEMRSIVRLKRFRPGAVAVASLLPICAQLRALKQGKEIHAYALRHWLLPNVPIVSSLMVLYSKCGMIEYSLRLFDGMEQKNVVSWTAMIDSCVENGHLCEATGVMRSMVLTEHRPDTVTVARMLRVCQELKVLKLGKEVHGQVLKRGFVSVHYVAAELIDMYGICGYVDKAKLVFRAIPVKGSMAWSALIRAYGYKEWYQEAVDLFDNMISNGCSPNRFTFEAVLSICDRAGFVEDAFRIFDLMSRYKIDASEEHCTCMIRLLTRYGKLDEVQRFVEMSSSL

SEQ ID NO: 220911 - protein, 185 aa, Glycine max
  Coding DNA Sequence Number=SeqID_104133
  Gene Ontology: Mol. function=transferase activity, transferring glycosyl groups; Cellular component=integral to membrane; Biological process=dolichol-linked oligosaccharide biosynthetic process
  Homolog annotation: Hit_ID=UPI00004BB525; Match level="QueryCoverage =82%, HitCoverage=39%, E-value=1e-42, Identity=55%"; Hit description =Dolichyl-P-Man:Man(7)GlcNAc(2)-PP-dolichyl-alpha-1,6- mannosyltransfe rase (EC ...
  Homolog annotation: Hit description=2.4.1.-) (Mannosyltransferase ALG12 homolog) (hALG12) (Membrane protein SB87).
MASSSKSKIFLQRYGYDFLLGSIAAVYVITVPYTKVEESFNVQAMHDILHHRLNLDNYDHLEFPGVVPRTFLGALLVSIIASPFVLTASLLHLPKFYALLIVRMALGGIVLYTLRFFRHQIRNKFGHQVEAFFVILTATQFHFLFYCTRPLPNILALSLVNLAYGYWFEGRFYAALNSLRQIQCP

SEQ ID NO: 220912 - protein, 80 aa, Glycine max
  Coding DNA Sequence Number=SeqID_104134
MVVKMIHGYNPSLQFAFRDYPDLCPCKPVIIPPKEVSIIYPQRNCHLEEQTGDHFILLNDPANIISLKGGRVVINPAGHC

SEQ ID NO: 220913 - protein, 61 aa, Glycine max
  Coding DNA Sequence Number=SeqID_104135
MYIRIESVTLLVSAQLFYHFYSLINIFVTRFGRNPPPPPPPTTTAAAAKSSDQDAPSSKDS

SEQ ID NO: 220914 - protein, 235 aa, Glycine max
  Coding DNA Sequence Number=SeqID_104136
  Homolog annotation: Hit_ID=Q1SKD7; Match level="QueryCoverage=58%, HitCoverage=31%, E-value=5e-09, Identity=30%"; Hit description =Ankyrin
MAQKKLSEKRSRRDAAAEGTSAAPEFDSHCFRSAEHQQRFEAIKGWSFHRERRVQLRNDEYTDFQEEIARQRWTSLVTPMAKFDPDIVLEFYANAWPTEEGVRDMRSWPVPGDPLVLEEGQECEFSQWRNRADGFDEEDIAQLLCIPGMPPTRHPLDPDKSNRALGVPVTPSKVIRPPITRAFIEKYCTPRQTQGDAPQAAHAPPPPHQADPAGSLGVERYLQHLVRQQAANHRG

SEQ ID NO: 220915 - protein, 74 aa, Glycine max
  Coding DNA Sequence Number=SeqID_104137
MGIEDQMISFDLFDEEKQLLDQNVCLQVKEFEEKVLKGLNSFFEAMDEKINSEKFSAVHSLSAHPALSKFSFLC

SEQ ID NO: 220916 - protein, 483 aa, Glycine max
  Coding DNA Sequence Number=SeqID_104138
  Gene Ontology: Mol. function=phosphopantetheine binding; Cellular component=nucleus; Biological process=metabolic process
  Homolog annotation: Hit_ID=Q1XME5; Match level="QueryCoverage=100%, HitCoverage=14%, E-value=1e-131, Identity=48%"; Hit description=Non -ribosomal peptide synthase:Amino acid adenylation
  Pfam annotation: Domain name=Condensation; Domain location=6-248; Score=73.5; E_value=6.8e-19; Accession=PF00668.10; Description =Condensation domain
MVYSQKEGKWNQYNAGSEGHHYHFEYFDIREEGSFENEQSSLQKIGDRLQSAVNIESGILFHIGHVSMSDGDRIILVIHHLVVDGVSWRILLEDLGSLYESGMKGVSYELPSKTDSFQSWGAALEKYSNSSSLSQERLYWEGIESEIYPVIPTDYPAKGKHILDSSISFSLNELSTKLLQTRAGKKYSAEINDVLLTGLALSLQDQFGINKTKVLMEGHGREVMSTDLDISRTVGWFTSVYPFSLDISNESQPALVSVKENLRGIPHKGIGYGVLNYLGDSFSSTGSPTIQFNYLGDFDDTIGSAFNYSSEFIGNPVSEENLGTDILLDVSGITMSGAMTITIRYSGDLFTEATVQKLMDSYQNQLEKMIGESEDSEVILTPSDLTYKGLSFNTIQEINKKGDIEDIYELSPMQQGLYYHWLVEPKGATYFMQTSYRTKSEDFDLSEVEKAFGILVNRYTVLRTSFDNRYGEVPLQIVHKKAQ

SEQ ID NO: 220917 - protein, 257 aa, Glycine max
  Coding DNA Sequence Number=SeqID_104139
  Subcellular localization annotation: CTP_CleavageSite=44; ConfidenceScore=5.30e-01
MGARVSSFMNRGKPGIPGVTSGVSSGVTSGSGYGSWAVGASPPPAGEGWTPVEGLDGAVSAGGAGAGAGGGAGAEVEAGVEVEASEGPRALVLGVPEKVIVGSSGFQQFFRIYAKLMARHIDSKAICEIWPEMMEPNSMSIFITNLALSILRSDELLGCSLNIQYKTSPWNRQSGGELLRVWVHAVETGGHIYVVIRLPGQGFMPSPPLELLAELVILGHVQVNIPLWEDVSGMHARLARQARLARQARLARLPKIT

SEQ ID NO: 220918 - protein, 118 aa, Glycine max
  Coding DNA Sequence Number=SeqID_104140
MTRSARQIRSASGIRSMRHTARLVDWETLEEDKPEICTLSAQPACPARTLSLLTLSVPSLAKPKLTYSCLVSLQKLKGPRAFITLRLTDLKKRVHREQKRACFWKNKRQKESSRESLG

SEQ ID NO: 220919 - protein, 44 aa, Glycine max
  Coding DNA Sequence Number=SeqID_104141
MAKRAWLAKPYSKPEKKLRLAMGQGPLSVFIRKPRNSSKMDELA

SEQ ID NO: 220920 - protein, 165 aa, Glycine max
  Coding DNA Sequence Number=SeqID_104142
  Subcellular localization annotation: CTP_CleavageSite=33; ConfidenceScore=5.68e-01
MVLNFLVATRCGTSPHTCTPTVFPPSMSLFHMVASPSSSSHFQFTSIQCPEALTLPPPLLPTTIGGHHEPPLLAVGPLHEEEHFNQSEILRFYLKDLVENKLPILSFVVFLRLALFEVLGSVNLRHEIYVYGAVTKLDIPGGGNRVVKEFKHLWSEGLELPYDSG

SEQ ID NO: 220921 - protein, 84 aa, Glycine max
  Coding DNA Sequence Number=SeqID_104143
MHGAQAVCPAIMTWWKAWWCKDYALKETTMWKGFTPEGEIVGIQPMDPSTKGRKSKLKVQILLHILHEHHCSGSNPASFSQVVV

SEQ ID NO: 220922 - protein, 33 aa, Glycine max
  Coding DNA Sequence Number=SeqID_104144
DTDVMWLRNPFIRLSKNETEDFQISTDSYLGNP

SEQ ID NO: 220923 - protein, 141 aa, Glycine max
  Coding DNA Sequence Number=SeqID_104145
MWMLCWGIPLHAWDMENIKKIASTVGEVVEVDDDVEELQRLDRARVLIKTPWYPIIQHVVAVSINGEEYRVHMAEETCYNFGRCKCWTRSLIGSLEEISSEKSEIKTPLLVDDVSSKNECSSIITKVIADETELLGEVGEL

SEQ ID NO: 220924 - protein, 313 aa, Glycine max
  Coding DNA Sequence Number=SeqID_104146
  Gene Ontology: Mol. function=tryptophan-tRNA ligase activity; Cellular component=soluble fraction; Biological process=tRNA aminoacylation for protein translation
  Homolog annotation: Hit_ID=Q2QP62; Match level="QueryCoverage=98%, HitCoverage=67%, E-value=1e-116, Identity=68%"; Hit description =Tryptophanyl-tRNA synthetase, putative, expressed
  Pfam annotation: Domain name=tRNA-synt_1b; Domain location=6-296; Score=-99.1; E_value=0.0045; Accession=PF00579.15; Description=tRNA synthetases class I (W and Y)
MVCRYLQDVFKVPLVIQLTDDEKFFWKNLSIDECRRLARENAKDIIACGFDISKTFIFSDFNYVGGSFYKNMCEVGKRVTYNQAVGIFGFVGEDHIGKVSFPPVQAVPSFPSSFPHLFSGKENLRCLIPCAIDQDPYFRMTRDVAPKMGFHKPALIESLFFPALQPLCICKGKAAYNIPPPYLRIAKSLWAMGNTDQGETGKMSASDPNSAIYVTDSAKDIKNKVNKHAFSGGQDSIEKHRQLGANLEVDIPVKYLTFFLEDDDELEHIKKEYGEGRMLTGEVKQRLIQVLTELVERHRRARASVTEEVHIQH

SEQ ID NO: 220925 - protein, 200 aa, Glycine max
  Coding DNA Sequence Number=SeqID_104147
  Gene Ontology: Mol. function=RNA-directed DNA polymerase activity; Cellular component=nucleus; Biological process=RNA-dependent DNA replication
MKGVFVDGCWIDDPGKVKEEICLFFKKRFEEVEWERPKLDEECGSDKSPGPDGLNFKFIKKLWEIIKPIVLCFLDEFIVNEVFLKGSNTLFLALIPKVHDPQNLNEYRPISLIGYMYKIMAKLRARRLKKVLPIIIDETRFAFIEGRHMLHNILIANEVVEEAKRCNKSCLVFKVDYEKVLRLGLLGFLVVHAEEDGCLL

SEQ ID NO: 220926 - protein, 208 aa, Glycine max
  Coding DNA Sequence Number=SeqID_104148
MGRGLKELVGWKDQNHEHHIIKVPTTTKSPKTYEHGTQMRLKGCEIGRTKKEQIDKVVCQALWGDSKLNGHGFIYLDGIWVLDGQKVTIVNIYSPCDMAQKKNMWEHIKQLRNSNFGGLWGLDERSAKEFNEWITDIEVEDTTNPIRDWGGYVLKEKIKQIKVRLKAWNKDQFGDMQKKLTRIKMDLNKLEIEGDERKLSDQELMAPK

SEQ ID NO: 220927 - protein, 306 aa, Glycine max
  Coding DNA Sequence Number=SeqID_104149
MSPNIVGEEEANNVHANRKWLHHLALLLLLLLTRKVTCLRSLGTRPVGVDRPLVHVDPTTGKANGPLRKKLRTYLGIVAHDKVDVTYENWKKSPCYPEGFDMGGYSVDKDNVDDTVCEKCGNSKEKWAQFCQSHRDPSWEDVRKKAQAIQKQNTALHVLSRGGYEYLENKLMEEKKKKQLEEAAQSRSTDTVIYPPSPIRRHVKWKMAHTKKTGQMTSEATKEIADKIDSLEEQTSQGSFVAHGHQDLLTAIIGRLEHLGRVCVAGAGVTIKQYFGPAPRTSHTSSSMALEDLEQLTQKIKDQSIT

SEQ ID NO: 220928 - protein, 216 aa, Glycine max
  Coding DNA Sequence Number=SeqID_104150
  Gene Ontology: Mol. function=aminoacyl-tRNA ligase activity; Cellular component=mitochondrion; Biological process=tRNA aminoacylation for protein translation
  Homolog annotation: Hit_ID=Q9LJE2; Match level="QueryCoverage=99%, HitCoverage=34%, E-value=2e-71, Identity=66%"; Hit description=Lysyl- tRNA synthetase
  Pfam annotation: Domain name=tRNA-synt_2; Domain location=1-214; Score=-74.3; E_value=2.7e-10; Accession=PF00152.11; Description=tRNA synthetases class II (D, K and N)
MHNLVKETAGIDFNELANDLEVAKRVTLDTLGKNLDNKDKGSIEACQSVGHLLNEVFESFVEPKLIQPTFVLDYPIEISPLAKPHRRSTGLTERFELFICGRELGNAFSELTDPIDQRGRLEDQIRQHEKKRAAVSTNDDKKEGTEDDDDSYEVTLDDDFLTALEYGMPPASGMLLKCYLQRCSFQGLGIDRLVMLLTNSPSIRDVIPFPVLKVQQ

SEQ ID NO: 220929 - protein, 104 aa, Glycine max
  Coding DNA Sequence Number=SeqID_104151
MRDVYLGAYLNGAHWQMVVILPKENVVICVLKGLDDIPQSKSKTAARWIVVKVIQKGSTECGYYIMHWMPTIILETFKNNWEMHRFWKIDVNDNTFNVGTFNIG

SEQ ID NO: 220930 - protein, 159 aa, Glycine max
  Coding DNA Sequence Number=SeqID_104152
  Gene Ontology: Mol. function=aminoacyl-tRNA ligase activity; Cellular component=cytoplasm; Biological process=tRNA aminoacylation for protein translation
  Homolog annotation: Hit_ID=Q6K1T2; Match level="QueryCoverage=94%, HitCoverage=19%, E-value=3e-47, Identity=66%"; Hit description =Putative lysyl-tRNA synthetase
  Pfam annotation: Domain name=tRNA-synt_2; Domain location=1-156; Score=-90.4; E_value=2.7e-09; Accession=PF00152.11; Description=tRNA synthetases class II (D, K and N)
MDSLGFVEVETPVLQGAAGGAEARPFITYHNSLGRDLYLRIATELHLKRMLVGGFEKVYEIGRIFRNEGISTRHNPEFTTIEEKERITKEGRRWKIRLAYRENVITKLGQVACEKRMYEAYSDYQSMMNLAEEIVTRCALAVHGKLTIDYQERMPKPLE

SEQ ID NO: 220931 - protein, 109 aa, Glycine max
  Coding DNA Sequence Number=SeqID_104153
MSINEFATSVSREKDEEIEGAVVGVSLSEINALSEYHPLNEASARLASQGESGRESVTQARTQCAISLSSESFVSSALSAPCSLSQKEFLEEKKRKERSVKNREQKRKA

SEQ ID NO: 220932 - protein, 389 aa, Glycine max
  Coding DNA Sequence Number=SeqID_104154
  Gene Ontology: Mol. function=RNA-directed DNA polymerase activity; Biological process=RNA-dependent DNA replication
MEEFNEFCDSMELLNIPMIGRTFTCYRNYNSSEENGFHEFVKLTYENFQVIGRGLYKVKEKLKAFKKEIRDWNKGKFDNQEERVFKIQKDIVVFDLKDEKNSIISEETKKRIHLWEEHWEISEKLESLLHQRSRCANGYKRNGSWLDDPKKVKEEIKTFSQQNYKEKVDVAIKLDGVFFKSLGVEDNVSLTRPFFEDEIKCAVWDYDVVCALREFLANGKIPGCAEERKIYWVKLSKVCLSKKKGGLGVKDLALFNKAFVGKWGWRLLMEQDSLWARVVYSKYGHLLEHNITQSQRLQSLWWSDVKYLCLGEEEEIWFKNNIMSLMGNGDLTEFWEHCWVGERPLRDTFPRLHSISLQKELRISEAGDVGVIVIQVGESGGAEGIHDRL

SEQ ID NO: 220933 - protein, 539 aa, Glycine max
  Coding DNA Sequence Number=SeqID_104155
  Gene Ontology: Mol. function=protein binding; Cellular component =integral to membrane; Biological process=xylan catabolic process
  Homolog annotation: Hit_ID=Q1SWI7; Match level="QueryCoverage=99%, HitCoverage=98%, E-value=1e-169, Identity=40%"; Hit description =Leucine-rich repeat
  Pfam annotation: Domain name=LRR_1; Domain location=115-137; Score =5.4; E_value=27; Accession=PF00560.23; Description=Leucine Rich Repeat
  Pfam annotation: Domain name=LRR_1; Domain location=139-158; Score =5.3; E_value=29; Accession=PF00560.23; Description=Leucine Rich Repeat
  Pfam annotation: Domain name=LRR_1; Domain location=160-182; Score =2.9; E_value=82; Accession=PF00560.23; Description=Leucine Rich Repeat
  Pfam annotation: Domain name=LRR_1; Domain location=17-40; Score =11.0; E_value=2.5; Accession=PF00560.23; Description=Leucine Rich Repeat
  Pfam annotation: Domain name=LRR_1; Domain location=188-207; Score =11.6; E_value=1.9; Accession=PF00560.23; Description=Leucine Rich Repeat
  Pfam annotation: Domain name=LRR_1; Domain location=212-234; Score =8.1; E_value=8.6; Accession=PF00560.23; Description=Leucine Rich Repeat
  Pfam annotation: Domain name=LRR_1; Domain location=236-258; Score =10.5; E_value=3.1; Accession=PF00560.23; Description=Leucine Rich Repeat
  Pfam annotation: Domain name=LRR_1; Domain location=260-283; Score =11.5; E_value=2; Accession=PF00560.23; Description=Leucine Rich Repeat
  Pfam annotation: Domain name=LRR_1; Domain location=297-319; Score =12.3; E_value=1.4; Accession=PF00560.23; Description=Leucine Rich Repeat
  Pfam annotation: Domain name=LRR_1; Domain location=369-391; Score =7.9; E_value=9.6; Accession=PF00560.23; Description=Leucine Rich Repeat
  Pfam annotation: Domain name=LRR_1; Domain location=393-415; Score =15.1; E_value=0.25; Accession=PF00560.23; Description=Leucine Rich Repeat
  Pfam annotation: Domain name=LRR_1; Domain location=417-439; Score =17.0; E_value=0.068; Accession=PF00560.23; Description=Leucine Rich Repeat
  Pfam annotation: Domain name=LRR_1; Domain location=42-65; Score=7.8; E_value=10; Accession=PF00560.23; Description=Leucine Rich Repeat
  Pfam annotation: Domain name=LRR_1; Domain location=441-462; Score =6.8; E_value=15; Accession=PF00560.23; Description=Leucine Rich Repeat
  Pfam annotation: Domain name=LRR_1; Domain location=90-112; Score =5.8; E_value=24; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1; Domain location=115-137::139-158::160-182::17 -40::188-207::212-234::...
  Pfam module annotation: Domain location=236-258::260-283::297 -319::369-391::393-415::417-439::42-65::441-462::90-112
MNKFSGNPFESLGSLSKLSSLFINDNNFQGVVNEDDLANLTSLRAFDASGNNFTLKVGPNWLPNFHLSYLDVTSWHIGPNFPSWIQSQNKLRYVGLSNTGILDSIPTWFWEAQSQVLYLNLSHNHIHGELVTTIKNPISIQTVDLSTNHLCGKLPHLSNDVYELDLSTNSFSESMQDFLCNNQDKPMQLEFLNLASNNLSGEIPDCWINWPFLVEVNLQSNHFVGNFPPSMGSLAELQSLEIRNNLLSGIFPTSLKKTSQLISLDLGENNLSGCIPTWVGEKLSNMKSSAFDQTMSLLQVLDLAKNSLSGNIPSCFRNLSAMTLVNRSTYPLIYSQAPNHTQYFSVSGIVSVLLWLKGRGDEYGNILGLVTSIDLSSNKLLGEIPREITDLNGLNFLNLSHNQLIGPIPEGIGNMGSLQTIDFSRNQISGEIPPTISNLSFLSMLDVSYNHLKGKIPTGTQLQTFDASSFIGNNLCGPPLPINCSSNGKTHSYEGSHGHGVNCFFVSATIGFVVGLWIVIAPLLICRSWRHAYFHFLDH

SEQ ID NO: 220934 - protein, 54 aa, Glycine max
  Coding DNA Sequence Number=SeqID_104156
QLRHEIVYPDVDMLFFKGGRHDNILSISGSFAMTKDIRIWLGMFCIDWAIEIAK

SEQ ID NO: 220935 - protein, 37 aa, Glycine max
  Coding DNA Sequence Number=SeqID_104157
MKVALRDWKKFKKLEANSTDADPLLLDCSPAASLCVG

SEQ ID NO: 220936 - protein, 185 aa, Glycine max
  Coding DNA Sequence Number=SeqID_104158
  Gene Ontology: Mol. function=electron carrier activity; Cellular component=anchored to membrane; Biological process=electron transport
  Homolog annotation: Hit_ID=Q949E8; Match level="QueryCoverage=62%, HitCoverage=57%, E-value=7e-30, Identity=52%"; Hit description =Uclacyanin 3-like protein
  Pfam annotation: Domain name=Cu_bind_like; Domain location=32-112; Score=143.0; E_value=8.2e-40; Accession=PF02298.8; Description =Plastocyanin-like domain
MARAIAVSFLVLLLAFPTVFGADHEVGDTGGWALGVNYNTWASGKTFRIGDNLVFKYDSTHQVDEVDESGYNSCSSSNIIKNYKDGNTKIELTSTGKRYFLCPISGHCAGGMKLQINVVAGTPPTTPSGTPPTTPSNPSPSPPSDSGSTNTTSPPKPSGAVTVSSGIGLLVGSFFASAIMFGFMG

SEQ ID NO: 220937 - protein, 188 aa, Glycine max
  Coding DNA Sequence Number=SeqID_104159
  Gene Ontology: Mol. function=DNA binding; Biological process =regulation of transcription
  Homolog annotation: Hit_ID=Q8H883; Match level="QueryCoverage=64%, HitCoverage=22%, E-value=9e-23, Identity=45%"; Hit description =Putataive InsB from Escherichia coli
MDIPKQTLGSLAMVILLFAGIILVYHWNSSFSNEFVLTVKEPLCKQSNLTTPNIEANGDGLDTALAKASMGNKTVIIAVVNKAYVDQDVESDTTMLDIFLGSFWLGEGTRSLIDHLLLVAVDQTAYDRCQFLKLNCFKLETDGVDFKGEKIYMSQDFIKMMWRRTFFLLEVLKRGYNFVFTLIALSHV

SEQ ID NO: 220938 - protein, 139 aa, Glycine max
  Coding DNA Sequence Number=SeqID_104160
  Subcellular localization annotation: CTP_CleavageSite=40; ConfidenceScore=5.40e-01
QVTCGVTLWLPAPFVNPGANEPVDAQRLRSSFEPFFVVTRANEPVDAQRLTSSRAPSIVLTRANEPIDAKRLTSSSAPFAIQGQRVRWQAEIPFGHLHLLSTEGNEFDGIRMMLDVRDDRMQWHREVSWLSNFVASNTL

SEQ ID NO: 220939 - protein, 197 aa, Glycine max
  Coding DNA Sequence Number=SeqID_104161
MVERGKFDDIKERLRVIEGGGNYAFADMAELCLVPDVVIPLKFKVSDFDKYNGTTCPKNHLKMQYQYNSDMTPDRIQLQNMCKKEHESFKEYAQRWRDLTTQVAPPMMEKKMITMIMETLQMFYYEKMVGYMPLSFADLVSADERIEVGLRRDKFDYLALVNRKPGENGENKKEGGTHVVTVIPTWPNFSPAQQYQY

SEQ ID NO: 220940 - protein, 97 aa, Glycine max
  Coding DNA Sequence Number=SeqID_104162
  Gene Ontology: Mol. function=DNA binding; Cellular component=nucleus; Biological process=regulation of transcription, DNA-dependent
  Homolog annotation: Hit_ID=Q2HTS2; Match level="QueryCoverage=99%, HitCoverage=12%, E-value=2e-36, Identity=75%"; Hit description =Lissencephaly type-1-like homology motif; WD40-like
  Pfam annotation: Domain name=WD40; Domain location=25-62; Score=32.1; E_value=2e-06; Accession=PF00400.22; Description=WD domain, G-beta repeat
FQPCFGKFLATATGNNIKIFDVETDSLLYNLEGHVKDVRSICWDKNGNYVASVSEDSARIWSSDGQCISELHSTGNKFQSCIFHPEYHNLLVIGGYQ

SEQ ID NO: 220941 - protein, 71 aa, Glycine max
  Coding DNA Sequence Number=SeqID_104163
MIAITSTRFPQPPFFGGYDSNATCAYHRGVPGHSIEHCRTSKRKVPCYKVMKKDNDWYLKALHWGNEGHRA

SEQ ID NO: 220942 - protein, 115 aa, Glycine max
  Coding DNA Sequence Number=SeqID_104164
MSFMPLLENEEEGLCWASRACGSGSLTREGGVEVEACSCKGRGSEPQWFPQRVEDFVEENLERRVTCTSLMVAAICHSWLLGYRQKENEGGSERAVVGPVMNVMRSSMWKLKQAA

SEQ ID NO: 220943 - protein, 884 aa, Glycine max
  Coding DNA Sequence Number=SeqID_104165
  Gene Ontology: Mol. function=protein serine/threonine kinase activity; Cellular component=membrane; Biological process=protein amino acid phosphorylation
  Homolog annotation: Hit_ID=Q9FLJ8; Match level="QueryCoverage=88%, HitCoverage=94%, E-value=0.0, Identity=54%"; Hit description =Receptor protein kinase-like protein
  Pfam annotation: Domain name=Pkinase; Domain location=528-796; Score =145.6; E_value=1.3e-40; Accession=PF00069.15; Description=Protein kinase domain
  Pfam annotation: Domain name=Pkinase_Tyr; Domain location=528-796; Score=100.5; E_value=5e-27; Accession=PF07714.7; Description=Protein tyrosine kinase
  Pfam module annotation: Pfam domain module=Pkinase::Pkinase_Tyr; Domain location=528-796::528-796
MEVENKVIIVKLSNFVSSLSLILHLFLFTLAKCDSSFSPNVNYLIDCGSSHPTQLKDGRIFKSDRETTSLLSTTEDLHISLNSNLSPSIPSLSLPLYQTARVFQEESTYSFYISKSGRLWIRLYFFPLPDPSFNLTSAVFSVQTNHHVLLHEFSAWNNDTPVFKEYLVNVSDSIFSLEFKPKKNSFAFINAIEVVSAPDTLISDSATALSPLGEFKGLLNSALEVSYRINVGGPVITPDNDTLSRTWETDGSYNIFPQGSVNVSVSNKSIKYPRTGILTPLIAPNSVYASAVHMKDARVMEPNFNLSWVVNVESGYSYLIRIHFCDIVSKSLNRLYFNVYINGIEGVSSLDLSLQTKALATAFYKDFVLNAFSITSGSILVQVGPANLQHGMTDAIANGIEVMKMSNNADSLDGFFSVDGKYKGPSSPTKAIKIFACVGIALAVTTMLLLAMICIRWKKRPQDWETHNRFSSWLLPFHSARMVSSKSSFRSSNAFSSHKSNKHGHGVSQKGRERFFPFSEMLQATNNFDEKKVIGIGGFGKVYLGTLEDGTKVAIKRGSGSSEQGINEFRTELEMLSKLRHRHLVSLMGFCDENSEMVLVYEYMANGPFRSHLYGSNLPLLSWEKRLEICIGAARGLHYLHTGAAQSITHRDVKTTNILLDENYVAKVSDFGLSKAVPEKAQVSTAVKGSLGYLDPEYYRTQQLTQKSDIYSFGVVLIEVLCARPVICPTLPREEINLADWAMAQHRRRVLNEVIDPRIIKSISPQSLNVFVQIAERCLSDSGVDRPSVGDVLWHLEYALRLQDDATRIKELDEKIESIVTNECNDNDNVAGHSGDPASDVSNSTDANSALFSQIANFQGRFKGKVTKGVGLVAPLFLAANIQF

SEQ ID NO: 220944 - protein, 251 aa, Glycine max
  Coding DNA Sequence Number=SeqID_104166
  Gene Ontology: Mol. function=actin binding; Cellular component =cytoskeleton; Biological process=actin cytoskeleton organization and biogenesis
  Homolog annotation: Hit_ID=Q1SZ88; Match level="QueryCoverage=87%, HitCoverage=12%, E-value=3e-84, Identity=72%"; Hit description=IMP dehydrogenase/GMP reductase
  Pfam annotation: Domain name=FH2; Domain location=1-212; Score=76.4; E_value=8.7e-20; Accession=PF02181.13; Description=Formin Homology 2 Domain
LMKVPRVESKLRVFAFKIQFGSQVTEFKKSLNTVNSACEEVRNSVKLKEIMKKILYLGNTLNQGTARGSAVGFKLDSLLKLTDTRASNSKMTLMHYLCKVLADKSPRLLDFHLDLIQLKSLAEEMQAIIKGLEKVKQEFAASANDGPVSEVFHKTLKEFIAVSESEVASLTNLYSVVGRSADALALYFGEDPARCPMEQVTTTLLNFIRLFRKAHEENIKQAELEKKKAEKEAEMEKAKGINLTKKGAKDS

SEQ ID NO: 220945 - protein, 157 aa, Glycine max
  Coding DNA Sequence Number=SeqID_104167
MVPNDLVFPPIDHENLKILSSEYHAPLSPPPPQPSPFAWISIPLHILHSKLSSFRLRGPIWSFGLPAAALLMSCWILIAIRKNKRTLTPNEARLINIINNKDRLLNYTMLKLKPKQNNSSDGDNSPVLKIAKLLHQIAQMNEILIDRHKALAAKVMK

SEQ ID NO: 220946 - protein, 451 aa, Glycine max
  Coding DNA Sequence Number=SeqID_104168
  Gene Ontology: Mol. function=protein serine/threonine kinase activity; Cellular component=intracellular; Biological process =protein amino acid phosphorylation
  Homolog annotation: Hit_ID=Q9FLJ6; Match level="QueryCoverage=92%, HitCoverage=85%, E-value=1e-160, Identity=64%"; Hit description =Arabidopsis thaliana genomic DNA, chromosome 5, P1 clone:MFB13
  Pfam annotation: Domain name=PPR; Domain location=109-143; Score =13.3; E_value=0.2; Accession=PF01535.11; Description=PPR repeat
  Pfam annotation: Domain name=PPR; Domain location=179-213; Score =29.6; E_value=1.1e-05; Accession=PF01535.11; Description=PPR repeat
  Pfam annotation: Domain name=PPR; Domain location=256-290; Score =32.5; E_value=1.4e-06; Accession=PF01535.11; Description=PPR repeat
  Pfam annotation: Domain name=PPR; Domain location=291-325; Score =20.9; E_value=0.0046; Accession=PF01535.11; Description=PPR repeat
  Pfam annotation: Domain name=PPR; Domain location=326-360; Score=6.6; E_value=1.2; Accession=PF01535.11; Description=PPR repeat
  Pfam annotation: Domain name=PPR; Domain location=361-395; Score =12.5; E_value=0.25; Accession=PF01535.11; Description=PPR repeat
  Pfam annotation: Domain name=PPR; Domain location=74-108; Score=0.0; E_value=7.4; Accession=PF01535.11; Description=PPR repeat
  Pfam module annotation: Pfam domain module=PPR::PPR::PPR::PPR::PPR::PP R::PPR; Domain location=109-143::179-213::256-290::291-325::326 -360::361-395::74-108
MSVHPQLQELCSIVMSTVGGLDELELSLNKFKDSLTSSLVAQAIDSSKHEAQTRRLLRFFLWSCKNLSHRLEDKDYNHALRVFAEKKDYTAMDILMGDLKKEGRAMDAETFSLVAENLVKLGKEDEALGIFKNLDKYKCSIDEFTVTAIVNALCSKGHGKRAEGVVWHHNDKITGTKPCIYRSLLYGWSVQRNVKEARRIIKEMKSNGVIPDLLCYNTFLRCLCERNLRHNPSGLVPEALNVMMEMKSHNVFPTSISYNILLSCLGKTRRVKESCQILETMKISGCDPDWVSYYLVAKVLFLSGRFGKGKEMVDQMIGKGLVPNHKFYYSLIGILCGVERVNYALELFEKMKKSSMGGYGPVYDVLIPKLCRGGDFEKGRELWDEASGMGITLQCSEDVLDPSITEVYKPTRPEKSSHVDSSRAKSPQKLTKFSGKMKMRKKTAAMKKKKK

SEQ ID NO: 220947 - protein, 341 aa, Glycine max
  Coding DNA Sequence Number=SeqID_104169
  Gene Ontology: Mol. function=exonuclease activity; Cellular component= intracellular
  Homolog annotation: Hit_ID=Q9FLR0; Match level="QueryCoverage=98%, HitCoverage=65%, E-value=4e-69, Identity=46%"; Hit description =Exonuclease-like protein
SLDDVRMNLEVLKYCATVLFLESSLPDIFTANSWVSPNSITRSRSNEKSLSQGGLLNINKDSVLSSPATESKDKNHPIISFALSSLKGNVPNIADPNIDQSDPFNLSALEAEIKRESIKSDAAMEEKTMQESPDLASSSSVSQPCSSSIAVLEPDGICIPFIDASLVPSFLGSQRIELLHEGFPFLLHCTDLKVRFGINSRFFDRAGRPRLSFVVDPSPSLCNVLDACDRVAQKLNMDSGSSSDWRPVVIRKEGFFNYPTIRLHIPTAVVADVDIYATEIYQRESSGTVQRLLFSKFDAAELGSLFMPGTFVDAFLSLDPYDYQQNAGIKLVSKKLIIHGK

SEQ ID NO: 220948 - protein, 585 aa, Glycine max
  Coding DNA Sequence Number=SeqID_104170
  Gene Ontology: Mol. function=two-component response regulator activity; Cellular component=nucleus; Biological process=two -component signal transduction system (phosphorelay)
  Homolog annotation: Hit_ID=Q56TL2; Match level="QueryCoverage=91%, HitCoverage=93%, E-value=0.0, Identity=67%"; Hit description=Timing of CAB expression 1 protein
  Pfam annotation: Domain name=CCT; Domain location=512-550; Score =70.6; E_value=5e-18; Accession=PF06203.4; Description=CCT motif
  Pfam annotation: Domain name=Response_reg; Domain location=37-153; Score=46.6; E_value=8.3e-11; Accession=PF00072.14; Description =Response regulator receiver domain
  Pfam module annotation: Pfam domain module=CCT::Response_reg; Domain location=512-550::37-153
MDAETEAEELINLNNISSNCGGNNSKSGDGFIDRSKVRILLCDNDSKSSEEVFTLLLGCSYQVISVRSARQVIDALNAEGQYIDMILAEVDLPIKKGMKLLKYIARDKELCRIPVIMMSAQDEVSIVVKCLRLGAADYLVKPLRTNELLNLWTHMWRRRRMLFLFWQLGLVENNILNYDFDLVASDPSDANTNSTTLFSDDTDDKSKRGTNPETGVLIQQEQEASIATIAAVVVELPSYLVSQYQPDVPGISDRRTGTPRQHPSSSRTIDGHFSSGPKKSELKIGESSAFFTYVKATTLKSNIEESAHVDNSNNTTTTTTTTEVRMEDMNQACIEQGDNGLKTHKNGEMFGNHSQDDLPSSNSILDSFSIERSCTPPASMEVSQQKHYKEEHSQGVVHPRNGSHGSVPAQHAYPYYISGVVNHVMMPSSAQLYQKNIQDLQIHAGSSMIAQYNHLPQCPPHANGMTNFPYYPMNICLQPGQISTNSWPSLGSSSSCEVQISKVDRREAALMKFRQKRKERCFDKKIRYVNRKRLAERRPRVRGQFVRKLNGINVDLNGQPASTDYDEDDEEEDNHRARDSSPEVA

SEQ ID NO: 220949 - protein, 241 aa, Glycine max
  Coding DNA Sequence Number=SeqID_104171
  Gene Ontology: Mol. function=actin binding; Cellular component =nucleus; Biological process=actin cytoskeleton organization and biogenesis
  Homolog annotation: Hit_ID=Q1SZ88; Match level="QueryCoverage=61%, HitCoverage=8%, E-value=8e-46, Identity=63%"; Hit description=IMP dehydrogenase/GMP reductase
  Pfam annotation: Domain name=FH2; Domain location=85-241; Score= -95.8; E_value=0.00013; Accession=PF02181.13; Description=Formin Homology 2 Domain
  Subcellular localization annotation: CTP_CleavageSite=11; ConfidenceScore=5.40e-01
MYGAPPPPPPPGGQGPPPPGGRGPPPPPPPVGRGPPPPPPPGVPGAPSPPGGGPPPPPPLGAKGANVGADPRGRGRGYARPAGGGAMAPRRSSLKPLHWSKVTRALQGSLWEELQRHGEPQIAPEFDVSELEKLFSANVPKPTDSGKSGGRRKSVGAKTDRITLVDLRRANNTEIMLTKVKMPLPDMMAAVLALDESVLDVDQVENLIKFCPTKEEMDLLKGYTGDKEILGKCEQVCYDLY

SEQ ID NO: 220950 - protein, 193 aa, Glycine max
  Coding DNA Sequence Number=SeqID_104172
  Gene Ontology: Mol. function=heat shock protein binding; Cellular component=integral to membrane; Biological process=protein folding
  Homolog annotation: Hit_ID=Q93V89; Match level="QueryCoverage=62%, HitCoverage=71%, E-value=2e-11, Identity=33%"; Hit description =Putative DnaJ-like protein
  Pfam annotation: Domain name=DnaJ; Domain location=52-118; Score =102.2; E_value=1.5e-27; Accession=PF00226.21; Description=DnaJ domain
  Subcellular localization annotation: CTP_CleavageSite=38; ConfidenceScore=5.35e-01
MDALTLSSSVNISKPFHFLTLSKKQQRERHPRTQFGVSCRGRKELGGGVEDNLYKVLSLSPKSATTDDIKKAYRSMALRYHPDVCQDCSKKEESTRMFVQLNAAYQTLSNPRLRAEYDCELGLRSEKIGVGDETWRYIWQNQLAELKRRSHIPNEMKGTSGTKSVKRNQVTDKGRTLSTILSEDNSILVLAYC

SEQ ID NO: 220951 - protein, 86 aa, Glycine max
  Coding DNA Sequence Number=SeqID_104173
  Gene Ontology: Mol. function=protein dimerization activity
  Homolog annotation: Hit_ID=Q1T3H7; Match level="QueryCoverage=98%, HitCoverage=15%, E-value=1e-11, Identity=38%"; Hit description=Zinc finger, BED-type predicted; HAT dimerisation
MDNVSSNDIRIQHLKKRFLFQYNVLLKGDYIHMRFCAHIFMLDCEAWPETIKYIKFSPSRLAQFKGYAEQEQILYKGLICLDVKTR

SEQ ID NO: 220952 - protein, 526 aa, Glycine max
  Coding DNA Sequence Number=SeqID_104174
  Gene Ontology: Mol. function=protein serine/threonine kinase activity; Cellular component=nucleus; Biological process=protein amino acid phosphorylation
  Homolog annotation: Hit_ID=Q9SBZ2; Match level="QueryCoverage=93%, HitCoverage=79%, E-value=1e-127, Identity=50%"; Hit description=Cdc2- like protein
  Pfam annotation: Domain name=Pkinase; Domain location=1-276; Score =264.9; E_value=1.6e-76; Accession=PF00069.15; Description=Protein kinase domain
  Pfam annotation: Domain name=Pkinase_Tyr; Domain location=1-276; Score=12.0; E_value=3.3e-13; Accession=PF07714.7; Description =Protein tyrosine kinase
  Pfam module annotation: Pfam domain module=Pkinase::Pkinase_Tyr; Domain location=1-276::1-276
GTYSSVFRAKEVETGKIVALKKVRFDNFEPESVRFMAREIMILRRLDHPNIIKLEGLITSRLSCSIYLVFEYMEHDITGLLARPEIKFSESQIKCYMKQLLSGLEHCHSRGVMHRDIKGSNLLVNNEGILKVADFGLANFSNSGNKQPLTSRVVTLWYRPPELLLGSTAYGPSVDLWSVGCVFAELLIGKPILQGRTEVEQLHKIFKLCGSPPEEYWKKTRLPHATLFKPQQPYDSSLRETFKDFHASTVNLLQTLLSVEPSKRGTASSALSLEDLTSQTQTSHKMNDRSAHIIKQEDTNTCEEAPKQSSGKPEDASSYMKNASQVDIPFPGPLQVSKSSGFAWAKRRRDDTSVRSHSRSISRGFIFNSLETSTLNSRDNSESRNHENKEFFGARTNSRGNHLLEISKLAMQNQWSKFDRPDSFDTCDEYHSQELSLAIYNRQDSLSKRSNLDQEEKVEFSGPLLSQMHTVDELLERHERHIRHTVRRSWFQRGNYATPNILTCDPWIAGPSTLSKLTCCCDFEQQ

SEQ ID NO: 220953 - protein, 129 aa, Glycine max
  Coding DNA Sequence Number=SeqID_104175
  Gene Ontology: Mol. function=oxidoreductase activity; Cellular component=vacuole; Biological process=hydrogen peroxide catabolic process
  Homolog annotation: Hit_ID=P22196; Match level="QueryCoverage=86%, HitCoverage=74%, E-value=3e-32, Identity=64%"; Hit description =Cationic peroxidase 2 precursor
  Pfam annotation: Domain name=peroxidase; Domain location=1-97; Score =30.7; E_value=8.2e-11; Accession=PF00141.13; Description=Peroxidase
MAAGLLRIHFDDCFVQGCDASVLIAGDATERTAFANLGLRGYEVIDDAKTQLEAACPGVVSCADILALAARDSVSLSDQALWNDPSTKSFVQRYLQDGFKGLLFNVEFAKSMFCHQLAIVHVKINLYMA

SEQ ID NO: 220954 - protein, 174 aa, Glycine max
  Coding DNA Sequence Number=SeqID_104176
  Gene Ontology: Mol. function=hydro-lyase activity; Cellular component= cytoplasm; Biological process=fatty acid biosynthetic process
  Homolog annotation: Hit_ID=Q6I5L0; Match level="QueryCoverage=53%, HitCoverage=43%, E-value=3e-38, Identity=85%"; Hit description =Putative beta-hydroxyacyl-ACP dehydratase
  Pfam annotation: Domain name=FabA; Domain location=79-166; Score =15.3; E_value=1.1e-08; Accession=PF07977.3; Description=FabA-like domain
MEEAGAWVRPRLNTMLSLGEYFLRQGCHHARAVDSGVVVQMLGKRRNDNSLCSEPFNNNNDNGTCKPVSSESSKKKKGWPRKYLPDGNIVLAMAQVGGLVMLQPEVGGSRENFFFAGIDKVRFRKPVIAGDTLVMRMTLTKLQKRFGIAKMEGKAYVGGEVVCEGEFLMAMGSE

SEQ ID NO: 220955 - protein, 88 aa, Glycine max
  Coding DNA Sequence Number=SeqID_104177
  Gene Ontology: Mol. function=protein dimerization activity
  Homolog annotation: Hit_ID=Q5UDR1; Match level="QueryCoverage=79%, HitCoverage=10%, E-value=4e-13, Identity=53%"; Hit description =Transposase
  Pfam annotation: Domain name=hATC; Domain location=1-48; Score=8.9; E_ value=0.0038; Accession=PF05699.5; Description=hAT family dimerisation domain
MAQEVLAIPISNVVSESSFGVGGRIFYPYRSSLTPRMVEVLICMQDWLKGTSFSMFADENFKELEKFEQDMLSPHEGTSLTTTINLDD

SEQ ID NO: 220956 - protein, 108 aa, Glycine max
  Coding DNA Sequence Number=SeqID_104178
  Homolog annotation: Hit_ID=Q00M75; Match level="QueryCoverage=28%, HitCoverage=5%, E-value=9e-09, Identity=93%"; Hit description=PPR -repeat containing protein
MVKIVVGLGGSVPPFLLSPRKRKRWWGLHTTNFSLAIRILKKQHTENKASTLIMQARFWSSNHHAILLSLKKLEGLMRASPDTAVKLCLGDLLVMGSNPETASLHMQG

SEQ ID NO: 220957 - protein, 104 aa, Glycine max
  Coding DNA Sequence Number=SeqID_104179
MGYTVFGLETVFNYLNKLGINVFMLELREKIDNYIRAESIEIQSGHYSYNCITEKPTRGNEMGYEIRFVDGRWLLKIRSVTAFLLVHDGFATTATRAGYPLRVA

SEQ ID NO: 220958 - protein, 76 aa, Glycine max
  Coding DNA Sequence Number=SeqID_104180
MVWFREFNELKTDTRSWILETTLYAPSNFFILSKTSFVFQAYTYGCGTHEHSDAATISLAPISKLPLEVITYIYSA

SEQ ID NO: 220959 - protein, 270 aa, Glycine max
  Coding DNA Sequence Number=SeqID_104181
  Gene Ontology: Mol. function=protein kinase activity; Cellular component=integral to membrane; Biological process=protein amino acid phosphorylation
  Homolog annotation: Hit_ID=Q2LJM0; Match level="QueryCoverage=66%, HitCoverage=29%, E-value=1e-29, Identity=37%"; Hit description =Putative receptor kinase
  Pfam annotation: Domain name=Pkinase_Tyr; Domain location=84-268; Score=-116.4; E_value=2.5e-05; Accession=PF07714.7; Description =Protein tyrosine kinase
MAQRNVLLGSKIFFSSSRIFFGEVHLCENEKDYIGFGQHRQFKDHLNLALAPIPTTVQEKESDDVEISVDKKMEIGEGTKMAKFQMGELLRASAEALGHGILGNSYKAMLNDGSTIVVKRLRDLKPLSKEEFAKILNVIADMKHPNLLSLLAYYHSRDEKLMLYRYAENGNLFSRLHVARGVARALVYLQLNHNNIVPHGNLRSSNEDDTVLVSDFGLASLIAQPIAAQHMGAVREEWTAEIFDKEICGQKSALAGMLMLLQIAMRCIER

SEQ ID NO: 220960 - protein, 79 aa, Glycine max
  Coding DNA Sequence Number=SeqID_104182
LPQQMAFAFESKNLGLFSPSPRERCGEEELIPSHFTLYREKKKDPVTLRMHYAPREFAIVISSMSSIKQSLIQKIKINS

SEQ ID NO: 220961 - protein, 245 aa, Glycine max
  Coding DNA Sequence Number=SeqID_104183
  Gene Ontology: Mol. function=RNA binding; Cellular component =cytoplasm; Biological process=loss of chromatin silencing during replicative cell aging
  Homolog annotation: Hit_ID=Q9C9R6; Match level="QueryCoverage=61%, HitCoverage=23%, E-value=2e-51, Identity=66%"; Hit description =Putative RNA-binding protein; 42664-44784
  Pfam annotation: Domain name=PUF; Domain location=116-150; Score =29.8; E_value=9.5e-06; Accession=PF00806.9; Description=Pumilio -family RNA binding repeat
  Pfam annotation: Domain name=PUF; Domain location=152-186; Score =44.9; E_value=2.8e-10; Accession=PF00806.9; Description=Pumilio -family RNA binding repeat
  Pfam annotation: Domain name=PUF; Domain location=191-226; Score =23.6; E_value=0.00068; Accession=PF00806.9; Description=Pumilio -family RNA binding repeat
  Pfam module annotation: Pfam domain module=PUF::PUF::PUF; Domain location=116-150::152-186::191-226
VQELLQYGLSQPNNPNARSVPLSNARTRIPQGNLDAITSEGSFIIQGEGLNYLGVSRGSDPLRCQRDVQHKSGFAKQQLHRSELDIRHQVLGYENPRSPRNACSFPLLPKYNSLAEARGLIYLIAKDQHGCRFLQRIFDEGTPEDVQVIFNEIIDHVAELMMNPFGNYLMQKLLDVCDEKQRMQIILMVTEEPGQLVRISLNIHGTRVVQKLIETLKTRQQISLVVAALEPGFLALIKDLNGNHV

SEQ ID NO: 220962 - protein, 154 aa, Glycine max
  Coding DNA Sequence Number=SeqID_104184
  Homolog annotation: Hit_ID=Q9ZQ71; Match level="QueryCoverage=91%, HitCoverage=78%, E-value=1e-40, Identity=59%"; Hit description =Expressed protein
  Pfam annotation: Domain name=DUF538; Domain location=12-153; Score =176.1; E_value=8.6e-50; Accession=PF04398.3; Description=Protein of unknown function, DUF538
MLIPCLQFQSLSNTVEEKAKLFINKLKGKTQKALPDLLREYSIPPGLFPRNITCYEFDASKGKLIVYLSSPCEVCFKDSSIVRYANRVKGTLSKGKLSVTDGMKTKVLVWVKVTSVVVESYKSDKVWFTTTGVKKSRPKDAYEMPRDAIKVEEF

SEQ ID NO: 220963 - protein, 112 aa, Glycine max
  Coding DNA Sequence Number=SeqID_104185
  Gene Ontology: Mol. function=nucleic acid binding
  Homolog annotation: Hit_ID=Q1SJY4; Match level="QueryCoverage=89%, HitCoverage=29%, E-value=2e-09, Identity=28%"; Hit description=Zinc finger, CCHC-type
MGYHHECDIPIPKLEVEWTNVDLAIMELNTKVRYPLTCALSKNGYNKIYRLKTTKEIWNSLTINYEGTKDLKLRKAQINLKVLENFPKVWEPKTIAIQEASDLRNLAWDELL

SEQ ID NO: 220964 - protein, 1091 aa, Glycine max
  Coding DNA Sequence Number=SeqID_104186
  Gene Ontology: Mol. function=protein serine/threonine kinase activity; Cellular component=integral to membrane; Biological process=protein amino acid phosphorylation
  Homolog annotation: Hit_ID=Q9CA77; Match level="QueryCoverage=95%, HitCoverage=97%, E-value=0.0, Identity=58%"; Hit description =Putative receptor protein kinase; 10992-14231
  Pfam annotation: Domain name=APH; Domain location=802-986; Score=3.0; E_value=0.0033; Accession=PF01636.13; Description=Phosphotransferase enzyme family
  Pfam annotation: Domain name=LRRNT_2; Domain location=30-74; Score =20.5; E_value=0.0061; Accession=PF08263.3; Description=Leucine rich repeat N-terminal domain
  Pfam annotation: Domain name=LRR_1; Domain location=102-124; Score =18.3; E_value=0.028; Accession=PF00560.23; Description=Leucine Rich Repeat
  Pfam annotation: Domain name=LRR_1; Domain location=126-146; Score =8.4; E_value=7.6; Accession=PF00560.23; Description=Leucine Rich Repeat
  Pfam annotation: Domain name=LRR_1; Domain location=148-170; Score =12.2; E_value=1.5; Accession=PF00560.23; Description=Leucine Rich Repeat
  Pfam annotation: Domain name=LRR_1; Domain location=173-195; Score =6.2; E_value=19; Accession=PF00560.23; Description=Leucine Rich Repeat
  Pfam annotation: Domain name=LRR_1; Domain location=197-216; Score =8.6; E_value=7; Accession=PF00560.23; Description=Leucine Rich Repeat
  Pfam annotation: Domain name=LRR_1; Domain location=218-241; Score =8.2; E_value=8.2; Accession=PF00560.23; Description=Leucine Rich Repeat
  Pfam annotation: Domain name=LRR_1; Domain location=243-265; Score =13.6; E_value=0.71; Accession=PF00560.23; Description=Leucine Rich Repeat
  Pfam annotation: Domain name=LRR_1; Domain location=267-289; Score =15.4; E_value=0.21; Accession=PF00560.23; Description=Leucine Rich Repeat
  Pfam annotation: Domain name=LRR_1; Domain location=291-313; Score =14.4; E_value=0.42; Accession=PF00560.23; Description=Leucine Rich Repeat
  Pfam annotation: Domain name=LRR_1; Domain location=315-337; Score =12.7; E_value=1.2; Accession=PF00560.23; Description=Leucine Rich Repeat
  Pfam annotation: Domain name=LRR_1; Domain location=339-362; Score =0.6; E_value=2.2e+02; Accession=PF00560.23; Description=Leucine Rich Repeat
  Pfam annotation: Domain name=LRR_1; Domain location=364-386; Score =11.5; E_value=2; Accession=PF00560.23; Description=Leucine Rich Repeat
  Pfam annotation: Domain name=LRR_1; Domain location=388-410; Score =14.5; E_value=0.39; Accession=PF00560.23; Description=Leucine Rich Repeat
  Pfam annotation: Domain name=LRR_1; Domain location=412-434; Score =18.3; E_value=0.027; Accession=PF00560.23; Description=Leucine Rich Repeat
  Pfam annotation: Domain name=LRR_1; Domain location=436-458; Score =14.2; E_value=0.48; Accession=PF00560.23; Description=Leucine Rich Repeat
  Pfam annotation: Domain name=LRR_1; Domain location=460-482; Score =13.2; E_value=0.97; Accession=PF00560.23; Description=Leucine Rich Repeat
  Pfam annotation: Domain name=LRR_1; Domain location=584-606; Score =0.9; E_value=2e+02; Accession=PF00560.23; Description=Leucine Rich Repeat
  Pfam annotation: Domain name=LRR_1; Domain location=607-629; Score =10.0; E_value=3.9; Accession=PF00560.23; Description=Leucine Rich Repeat
  Pfam annotation: Domain name=LRR_1; Domain location=631-653; Score =11.9; E_value=1.7; Accession=PF00560.23; Description=Leucine Rich Repeat
  Pfam annotation: Domain name=LRR_1; Domain location=655-677; Score =3.5; E_value=64; Accession=PF00560.23; Description=Leucine Rich Repeat
  Pfam annotation: Domain name=LRR_1; Domain location=78-100; Score =2.6; E_value=94; Accession=PF00560.23; Description=Leucine Rich Repeat
  Pfam annotation: Domain name=Pkinase; Domain location=800-1074; Score= 153.8; E_value=4.5e-43; Accession=PF00069.15; Description=Protein kinase domain
  Pfam annotation: Domain name=Pkinase_Tyr; Domain location=800-1074; Score=101.2; E_value=3e-27; Accession=PF07714.7; Description=Protein tyrosine kinase
  Pfam module annotation: Pfam domain module=APH::LRRNT_2::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::Pkinase::...
  Pfam module annotation: Pfam domain module=Pkinase_Tyr; Domain location=802-986::30-74::102-124::126-146::148-170::173-195::197 -216::218-241::243-265::267-289::291-313::315-337::339-362::364 -386::388-410::412-434::...
  Pfam module annotation: Domain location=436-458::460-482::584 -606::607-629::631-653::655-677::78-100::800-1074::800-1074
MSEQETDSCGLLLFFFLILLSGKVAVGESLDKDKEVLLKLKFYLDSKILADRGGYIYWNANSSNPCEWKGISCSATKRVVGIELSNSDITGEIFMNFSQLTELTHLDLSQNTLSGEIPEDLRHCHKLVHLNLSHNILEGELNLTGLIGLRTLDLSNNRFYGDIGLNFPSICANLVVANVSGNKLTGVIENCFDQCLKLQYLDLSTNNLSGSIWMKFSRLKEFSVAENHLNGTIPLEAFPLNCSLQELDLSQNGFAGEAPKGVANCKNLTSLNLSSNKFTGAIPVEIGSISGLKALYLGNNSFSREIPEALLNLTNLSFLDLSRNQFGGDIQKIFGKFKQVSFLLLHSNNYSGGLISSGILTLPNIWRLDLSYNNFSGLLPVEISQMTGLKFLMLSYNQFNGSIPTEFGNMTQLQALDLAFNNLSGSIPSSLGNLSSLLWLMLANNSLTGEIPRELGNCSSLLWLNLANNKLSGKLPSELSKIGRNATTTFESNRQNYRMVAGSGECLAMRRWIPADYPPFSFVYSLLTRKTCRELWDKLLKGYGVFQICTPGERIRRTQISGYIQLSSNQLSGEIPSEIGTMVNFSMMHMGFNNFSGKFPPEIASIPIVVLNITSNQFSGEIPEEIGNLKCLMNLDLSCNNFSGTFPTSLNKLTELNKFNISYNPLISGVVPSTGQFATFEKNSYLGNPFLILPEFIDNVTNNQNNTFPKAHKKSTRLSVFLVCIVITLVLAVFGLLTILVCVSVKSPSEEPRYLLRDTKQWHDSSSSGSSSWMSDTVKVIRLNKTAFTHADILKATSSFSEERIIGKGGFGTVYKGVFSDGRQVAVKKLQREGLEGEKEFKAEMEVLSGHGFGWPHPNLVTLYGWCLNGSEKILIYEYIEGGSLEDLVTDRTRLTWRRRLEVAIDVARALVYLHHECYPSVVHRDVKASNVLLDKDGKAKVTDFGLARVVDVGDSHVSTMVAGTVGYVAPEYGHTWQATTKGDVYSFGVLVMELATARRAVDGGEECLVEWARRVMGYGRHHRGLGRSVPVLLMGSGLVGGAEEMGELLRIGVMCTADSPQARPNMKEILAMLIKISNPKGYSSYGHYLV

SEQ ID NO: 220965 - protein, 111 aa, Glycine max
  Coding DNA Sequence Number=SeqID_104187
MVFRGCHFSLISPCALKTKGNSVRQGINHVLGFVDDALFRCKDSKGSVGNMEEGDVVAEKFVGVYHPLYDIPLHYGGLNVEEGDVATEVMDDFFGYVKDDNQDAMLSIEHY

SEQ ID NO: 220966 - protein, 112 aa, Glycine max
  Coding DNA Sequence Number=SeqID_104188
MAACMDMLVIPGQRNEASIPWKIAKKLKKEPDEINFTYYGRGNYQIRPSSKHKQDRWNIVSKIALAYELWREGRCVEFVDPSLDDTTSPFKIMRCMEVALLIDLPCWKLIHC

SEQ ID NO: 220967 - protein, 261 aa, Glycine max
  Coding DNA Sequence Number=SeqID_104189
  Gene Ontology: Mol. function=RNA-directed DNA polymerase activity; Biological process=RNA-dependent DNA replication
MVGYTPSSFVDIVFAGKGIKVSLKRGKFDHPALTNKKPGANREDEKKEGTHVVTAIPTWPNFPPAQQYHYLANVTPSHYPTSYQPRTLNQPQRPSLNQPQSLPTANPMSNTTLNTNQNTNQGRNFLAKKVVEFTPILVSYANLLPYILNNSMVAITPTKVPQPPFFQGYYLNATCAYHVGVLGHSIEHCMTLKHKVQGLIDDFMTFQKEMYKILKMRAKGSLLGHFSAPGPIRKLRDEVTSAPGRASYFRRKQAARMGELL

SEQ ID NO: 220968 - protein, 81 aa, Glycine max
  Coding DNA Sequence Number=SeqID_104190
MILRDKPDLSRWSLKYKAFGRDIEFSWLAFHSKIRKITADLWKVFQTVQHRVMIFEMYDNKEKFRYRILEPDQKLVGIYVI

SEQ ID NO: 220969 - protein, 165 aa, Glycine max
  Coding DNA Sequence Number=SeqID_104191
MSIEQDYFSHTLVIQRQSSPIACGDTSWLSTPFINQRQASPFTCRDQYEIIESDKIRRHLTVICTLSSKYGESDDMRRHLMVIHTFCQPEASEPVDTQRPIWLSASFVEDSMSIDRDYSSLTFAIHRQSGLIACGDTSRLSAPCHPETVSPMILFAFGKCTGSRK

SEQ ID NO: 220970 - protein, 68 aa, Glycine max
  Coding DNA Sequence Number=SeqID_104192
MNLGIPRSSGSACHRSLGTRISFLNDHLEETRRPTKIGENHSKCINLTQCEARKSHRILSAIKGRGPL

SEQ ID NO: 220971 - protein, 108 aa, Glycine max
  Coding DNA Sequence Number=SeqID_104193
MHVRQDLPIMVRTRGLGHALGRIIGKALGREDHHDLDDVPQGQRPTAFVRRQREVAPIAEDDPVLHEDVYAHAAEAIHDVEGFPSGPRDPSVLTNYGDHVAVIVWNGE

SEQ ID NO: 220972 - protein, 304 aa, Glycine max
  Coding DNA Sequence Number=SeqID_104194
  Homolog annotation: Hit_ID=Q47522; Match level="QueryCoverage=19%, HitCoverage=77%, E-value=5e-19, Identity=74%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDLSWAGYWFNTTYPSPSPPGDTFPLKVEDVIRLQMEGELEFSVGDWVYLKVQPYRLKPLARVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 220973 - protein, 48 aa, Glycine max
  Coding DNA Sequence Number=SeqID_104195
MKANKTRNELKVTDLKTNQLKNKERTKNGGKSSRNCSRKRLRRVTEAP

SEQ ID NO: 220974 - protein, 226 aa, Glycine max
  Coding DNA Sequence Number=SeqID_104196
  Homolog annotation: Hit_ID=Q1RWU1; Match level="QueryCoverage=42%, HitCoverage=25%, E-value=1e-12, Identity=38%"; Hit description =Resistance-like protein HAAS-2-related
  Pfam annotation: Domain name=DUF1723; Domain location=17-66; Score =40.1; E_value=7.4e-09; Accession=PF08330.1; Description=Protein of unknown function (DUF1723)
MVARTRLSHLIACSVDTSDRGLISLFVERWHREISSFHLPVGEVLITLDDIASLLHLLIIGDLHVFQPLHIDVAVLMLVELLMVSPEVAMAETGHYALRDLTQTRRYAWRAASLVHMYDHLNDASNSTSRHVTGYITLLQCWIYEHFSSVAECNADPDYDEVSPRQLRWGAVAIRYRSERVMRQFGYVQGIPAHPDDSWVSFDDVDDRWTHYSDHLAPTGDICVVP

SEQ ID NO: 220975 - protein, 80 aa, Glycine max
  Coding DNA Sequence Number=SeqID_104197
MHIVVVRQGQDHLELPSGVRTKCGQQKPIKGRMQVGMGLRPTDRCPFSARNKQRTSLQGSPVSSPGRAELAWASHPCTKL

SEQ ID NO: 220976 - protein, 105 aa, Glycine max
  Coding DNA Sequence Number=SeqID_104198
MSGFTRDSPQISASPHQLDLAPYASEPYNAQWNAPGLLRDKHTLRSSRILGEMEVDERWLGLWLPLNYQVDMGARIAFVDNWAVGKEKEWQSQHGLEGEDHIIKA

SEQ ID NO: 220977 - protein, 38 aa, Glycine max
  Coding DNA Sequence Number=SeqID_104199
MEMAQRKLSAKKSRRDAVAEGTSAAPEFGSHRFRSAEH

SEQ ID NO: 220978 - protein, 469 aa, Glycine max
  Coding DNA Sequence Number=SeqID_104200
  Gene Ontology: Mol. function=exodeoxyribonuclease V activity; Biological process=unidirectional conjugation
  Homolog annotation: Hit_ID=Q7CW18; Match level="QueryCoverage=100%, HitCoverage=38%, E-value=0.0, Identity=75%"; Hit description=AGR_L _66p
MAQIVRDYVADSVKRADGSRVAMAHRRADVRTLNAAIRSELQNRQRLERGHGQNAGADRGDRGDVEDRGNSENVGELTFQTSTGKRAFAAGDRIIFLENNRDLGVKNGMLGTVEHVEQGRIVARLDGRGGDSVSIATDSYQAIDHGYATTIHKNQGATVDRAFVMASGTMDRHLAYVAMTRHRDSVQLYADITEFSNAGRLVDHGVAHYEHNPQSRDSYFVTLENDKGDQRTVWGVDLKRAMREASPKIGDRIFLQHEGATPVSLPDGTKAERNAWRVVKGDELAYQQLENRLSRSGAKETTLDYISDFAERRGIASDGSIGQEFAVKSEIELASARYARQEVLSRAAHLQREQQDRPSERQQVDEERAGDLAGPVGSEDPHRTEDNKGHRRIRWSDLMSQASAVPAQTEAAGPQNSLEPGKPTPLVPAITRYQRSIEEVAQQMAMSVIDRQFDTVDSLVRHVFRDPAE

SEQ ID NO: 220979 - protein, 127 aa, Glycine max
  Coding DNA Sequence Number=SeqID_104201
  Gene Ontology: Mol. function=ATP binding; Cellular component =mitochondrion
  Homolog annotation: Hit_ID=Q2PMM5; Match level="QueryCoverage=92%, HitCoverage=6%, E-value=7e-58, Identity=92%"; Hit description =Protein ycf2
MESIPNIYTMVPYLGQDILWRIRQIPLCLPQWNLISEIWNLISEIPGNCLHNLLLSEEIIHRNNELLLISTHLRSLNVQEFFYSILFLLLVAGYLVRTHLLFVSRVYSELQTEFEKVKSFDDSIIHD

SEQ ID NO: 220980 - protein, 34 aa, Glycine max
  Coding DNA Sequence Number=SeqID_104202
MARHDLCRDIGLANGSEGLQMKPFSYPGLWRIRP

SEQ ID NO: 220981 - protein, 109 aa, Glycine max
  Coding DNA Sequence Number=SeqID_104203
MDISEDTDIPIILGRPFMLTASCIVDMGKRKLELGFEDQKIDIDLFIEDKPAPEHNVCLQVMEGGQEVLKPNRLATPYPWLSATQCRQAQFLTAITKVHEAKRQSWQLS

SEQ ID NO: 220982 - protein, 323 aa, Glycine max
  Coding DNA Sequence Number=SeqID_104204
SVGPSPKQVRVRGHVVKIDAHSLNTFLETLVVLVEGETLLTYSRYYRLPVDIREIEVALCIPGRGFVLNVEGHPGKILRKDLTTLAQVWSVLSYSNLAPTSHTSDLTVDQARLIFGLVSQMDMNVRAFISGQITSMAQSNSSRLGFPALITALFTIRGAKRARTRPAEAPSTSTTLLPARTLTAPSASAPADFQCFEAMLQSIHQGQIILLQSLQMVAPPDTIPSIEQFNEWEAWPVTQSSLHKEDEGPTAQVPQQMEDESSETTIPEPLVRRKKADQTQEVAATFDKSLQATSEPSVPVADTASLQQATYPSTPVLDQVASE

SEQ ID NO: 220983 - protein, 76 aa, Glycine max
  Coding DNA Sequence Number=SeqID_104205
MGFPLSAVTYPAEKFIWSEDLLFSFLILSIRYSLSLEEILLSFALGERMRILFMGQGSKQLKVVSQHGLFIVQTRF

SEQ ID NO: 220984 - protein, 51 aa, Glycine max
  Coding DNA Sequence Number=SeqID_104206
MAPKKLSIKRSRKDIAGEGSNAAQDFDSHRFRSAEHQQCFEAIKGWSFLRE

SEQ ID NO: 220985 - protein, 141 aa, Glycine max
  Coding DNA Sequence Number=SeqID_104207
MSISPCGSISWSASFRHRDRARKTLSGPEEVQQGPGASSSDYGPLSVLQGITPARHPVDPEKSYRVLELPALITGLCRFYGVPVAPSKVIRPPTNRAFIKKYCAPRQAQGETPQQPGDGLQRVTNAPPPPLEFISAHPQKG

SEQ ID NO: 220986 - protein, 103 aa, Glycine max
  Coding DNA Sequence Number=SeqID_104208
MKHSSNLEGGGHMNSRQAMTFMGLRKKWFVGRTERSTGGGTSPPIYSKIGEELATQLAQASKVASSRSNSLLEEESGRPNYKNSQIAKTPPFDFRHITEFSRI

SEQ ID NO: 220987 - protein, 79 aa, Glycine max
  Coding DNA Sequence Number=SeqID_104209
  Subcellular localization annotation: CTP_CleavageSite=57; ConfidenceScore=5.26e-01
FYGVPVAPSKVIRPPTNRAFIKKYCAPRQAQGKTPQQPGDRRQRATDTPSPPPKPLSSSTKAGVFPMTRPASDQVQSQR

SEQ ID NO: 220988 - protein, 67 aa, Glycine max
  Coding DNA Sequence Number=SeqID_104210
MMLSYNPRQGRWRLHFASLGFKSVNQIFSSTWVQGIIHSCTRDSCKNRYSMLVVLSHLKITHSPGCG

SEQ ID NO: 220989 - protein, 181 aa, Glycine max
  Coding DNA Sequence Number=SeqID_104211
  Subcellular localization annotation: CTP_CleavageSite=25; ConfidenceScore=5.38e-01
MKAKILENVLIMSRLLRSFSRISFRSNSSSSSSSRNTNLLNDQDNQTQEVAPKHNLFDEEVRFEDINQNMDDWNIPEIPQDQLYVPETIKDKHNFDYIIKTVENNIPLRQDIGEEFHLLSKNSIYEHSRKYKYLHIGCVQVAIKPLIDMGIDAAVLMCLRDIRHNQFEDSLIGTVETSLGQ

SEQ ID NO: 220990 - protein, 114 aa, Glycine max
  Coding DNA Sequence Number=SeqID_104212
  Gene Ontology: Mol. function=oxidoreductase activity; Cellular component=glyoxysome; Biological process=hydrogen peroxide catabolic process
  Homolog annotation: Hit_ID=Q01297; Match level="QueryCoverage=80%, HitCoverage=18%, E-value=3e-47, Identity=97%"; Hit description =Catalase isozyme 1
  Pfam annotation: Domain name=Catalase; Domain location=1-114; Score= -151.5; E_value=8.5e-09; Accession=PF00199.9; Description=Catalase
MGWWLIYLFVSLCCPILLEDYHLVEKLANFDRERIPERVVHARGASAKGFFEVTHDISHLTCADFLRAPGVQTPVIVRFSTVIHERGSPETLRDPRGFAVKFYTREVKIYEYIA

SEQ ID NO: 220991 - protein, 262 aa, Glycine max
  Coding DNA Sequence Number=SeqID_104213
  Homolog annotation: Hit_ID=Q9FLX7; Match level="QueryCoverage=32%, HitCoverage=55%, E-value=1e-12, Identity=45%"; Hit description =Probable NADH dehydrogenase [ubiquinone] 1 alpha subcomplex subunit 5, mitochondrial precursor
  Subcellular localization annotation: CTP_CleavageSite=81; ConfidenceScore=5.61e-01
MLSLNTEDSVRKKGFYKSCPPPPPPTMFQKSVFMKPRFDGSSNEAPSFNKELKRSFTSERTTPVGKKSHEENKSMQGTLFRSNKFMGHASVRLMSQPAEKESLLVESDDDDDDDDTETKDQDIEGGRTVAQNNDRGKGPPVIGGESSKTDGDEGPDVDKKANEFIAKFIEQPRLQRIESIKRSARNSSRTRKLLWSNRVSSNVIYSLQHMHSDTSTLAVGGIDEWDPWGVPDDYRCEVIENDAPVPKHVPLPIEFDKTLEAL

SEQ ID NO: 220992 - protein, 104 aa, Glycine max
  Coding DNA Sequence Number=SeqID_104214
MGSHSPVQCGALSDKECGGLSYDDAWNACYNHWNILTSISVRNNVSNTRGTERKEIQSTSGVALQKKTQTNPTGKATPHRLTKGVRYVGRPVVKTSVEAFLSNF

SEQ ID NO: 220993 - protein, 115 aa, Glycine max
  Coding DNA Sequence Number=SeqID_104215
MVIMHPLSFRTSKLSYKHAETNYGHFAPFVIQEQSSKLSDKRAETNYGHSAPFVIQGQLDRARWHAETNYGHFAPHHPGSIVSEGTQRQIMVILRFVSTKRNEFDSIRMMLVVRY

SEQ ID NO: 220994 - protein, 120 aa, Glycine max
  Coding DNA Sequence Number=SeqID_104216
  Homolog annotation: Hit_ID=O80783; Match level="QueryCoverage=31%, HitCoverage=28%, E-value=4e-07, Identity=66%"; Hit description =Expressed protein
MAEEFTESEVVFPDHRAVHDWVVEMAPQPQRKERENCRRTAANSMPGGAAAVGLPRGGGGGGGDDAAARDREEKGGRKNGVFGVHGEWENVEGTRFESGQEFDPQLEIVFGVSLIVKGNI

SEQ ID NO: 220995 - protein, 197 aa, Glycine max
  Coding DNA Sequence Number=SeqID_104217
  Homolog annotation: Hit_ID=Q6ZFC1; Match level="QueryCoverage=56%, HitCoverage=39%, E-value=1e-30, Identity=61%"; Hit description =Pentatricopeptide (PPR) repeat-containing protein-like protein
  Subcellular localization annotation: CTP_CleavageSite=41; ConfidenceScore=5.20e-01
MAMTCESSIVSPLFLSRICQAKTDPTRAFLLENKFSTITVTASPRQVVSAARLCNPNLATKVVVPWRRSRKGKKTTGKKEHHLWKSRDSAQSGQKALALVRTIMEVQMNVEKLVYKLPNEKEAVYGALDKWTAWETEFPVIAVSKALKILRKRGHWVRAIQVAKWMISKGQGATMGTYDTLLLAFDMDKRVFADMEE

SEQ ID NO: 220996 - protein, 94 aa, Glycine max
  Coding DNA Sequence Number=SeqID_104218
MALQAKQLLLLVQPYTSYFIHIRLIVQSLINNTHNISMEGALAEGLARVYLDTNNDNGNNLAASGSEKEEPWRGEEHLRGQHQSYDRDEDALQM

SEQ ID NO: 220997 - protein, 288 aa, Glycine max
  Coding DNA Sequence Number=SeqID_104219
  Gene Ontology: Mol. function=identical protein binding; Cellular component=cellulose and pectin-containing cell wall; Biological process=negative regulation of enzyme activity
  Homolog annotation: Hit_ID=Q9FK76; Match level="QueryCoverage=98%, HitCoverage=37%, E-value=7e-92, Identity=58%"; Hit description =Subtilisin-like protease
  Pfam annotation: Domain name=Peptidase_S8; Domain location=36-284; Score=-93.8; E_value=0.094; Accession=PF00082.12; Description =Subtilase family
MEGVVFVHKNQPKIYSLHTTRSWNFVGLDGPLNPWEEESDHTDGNLLARAQYGKDIIVGMIDSGVWPDSKSFSDEGMEPVPTKWKGVCQNGTAFDSSQCNRKIIGARYYLHGYQSAFGPLNEKEDYKSARDKDGHGSHTASIVAGRVVPNASAIGGFAKGTALGGAPLARLAIYKACWPIKGKSKHEGNICTNIDMLKAIDDAIGDGVDVLSISIGFSAPISYEEDVIARGALHAVRKNIVVVCSAGNSGPLPQTLSNPAPWIITVAASTVDRSFHAPIKLSNGTIIE

SEQ ID NO: 220998 - protein, 209 aa, Glycine max
  Coding DNA Sequence Number=SeqID_104220
  Subcellular localization annotation: CTP_CleavageSite=55; ConfidenceScore=5.73e-01
MATVRSNSITVFFVAFIILTTAPSPSQSLSFSSFFRYRNLFSLSHSLLIGVANLRAARGDVAGADRARSIADGLDQGTVFGFLKLLWTLSWTDMSFTDLYGAVSDMNELLRGLTELTRLESVAERSAWVSRNYQSVLTVFKSLSRKLLKALGQSGVMREIGETFQKEVVEGGLIRDCLELGNNDLKALIQIVKDLLLQFFPVRDKDHDL

SEQ ID NO: 220999 - protein, 594 aa, Glycine max
  Coding DNA Sequence Number=SeqID_104221
  Gene Ontology: Mol. function=transcription regulator activity; Cellular component=nucleus; Biological process=regulation of transcription
  Homolog annotation: Hit_ID=Q5N802; Match level="QueryCoverage=73%, HitCoverage=86%, E-value=1e-54, Identity=36%"; Hit description =Putative bHLH transcription factor
  Pfam annotation: Domain name=HLH; Domain location=391-441; Score =34.6; E_value=3.4e-07; Accession=PF00010.16; Description=Helix-loop -helix DNA-binding domain
  Subcellular localization annotation: CTP_CleavageSite=52; ConfidenceScore=5.36e-01
MENQFFLNSGVSQTQHHHPLHLESSPPSNPSSVPSWQSLSPPNMGIQPTVMNCASEQTQQDCFYNSNWDKSTTTDQGLHHFDSSALSSMVSSPAASSNPNNNMSNENFIIRELMGKLGAIGNSDEIPQHSPHPLVVASSYMNTKGNNSTNTSCYSTPLSSPPKVNIVNSLVNLRLANLGGGKSTTTVLNSSVAEFSADPGFAERAAKFSCFGSRSFNDRSVQLRVNNAELAQRSAPAMEHGGKLPRVSSSPLLKTLGSQMGAQENKNSAIHQEQEKMEGANSQEESTISEQTPNGEIGVKTSQDIMNSRKRKASSKGKAKETSNTTNPTKGVEGSEYSNSKRSKPNEGNENGQVKVEEESKAEEEKQSKSNSKPPEPPKDYIHVRARRGQATDSHSLAERVRREKISERMKLLQDLVPGCNKVTGKALMLDEIINYVQSLQRQVEFLSMKLASVNTRMDLSIESLVTKDVFQSNNSLATHPNAIIFPLGSSAQAFYGHQPQQNNPVFHNNIPNRTVTHCSVDPLDTSLCQNLAMQLSPLDVFNEGGSQFPLAFLEDDLHTIVQMGFGQAANRKTPIQSSSFNGSNNVPQMKVEL

SEQ ID NO: 221000 - protein, 173 aa, Glycine max
  Coding DNA Sequence Number=SeqID_104222
  Gene Ontology: Mol. function=molecular_function; Cellular component =nucleus; Biological process=biological_process
  Homolog annotation: Hit_ID=Q8C5X2; Match level="QueryCoverage=91%, HitCoverage=55%, E-value=3e-25, Identity=37%"; Hit description=Adult male testis cDNA, RIKEN full-length enriched library, clone:4930597G02 product:...
  Homolog annotation: Hit description=hypothetical protein, full insert sequence
  Pfam annotation: Domain name=DUF298; Domain location=64-167; Score =81.1; E_value=3.5e-21; Accession=PF03556.6; Description=Domain of unknown function (DUF298)
MKFSILFGWLVSPDGIEALCKDVHVDHTDVRMLILAWKLKAEKQGYFSKDEWRKGLKCLGADTLPKLRKAINGLKKEGIILSEEKQRSIDIETICELLNVVLRSEFPTQVNLLTEYLKIQNDYRALNIDHWRNFYRFFKEVSLIDLRSYDSSQAWPVILDNFVDWLKEKEEKI

SEQ ID NO: 221001 - protein, 98 aa, Glycine max
  Coding DNA Sequence Number=SeqID_104223
MEKVEGLHNLKMMVYESFTHGEVDKGVSLTLTYPRQKKGGGCITACQGKLSSPRRAICFLLKFPCLPRRAQLAQVDPSLGDFMERTKITNITLERRVE

SEQ ID NO: 221002 - protein, 174 aa, Glycine max
  Coding DNA Sequence Number=SeqID_104224
MSEVEEVQERMKADIEAIKEKMTTMMEVMMSMKKIMEVNMAAIAATSAIAEVDPTPPSGLNQMNHPTLDMVGQGGKELGSTNNPHFVRIRNKHAFPPYGLPPNYAPPNVTHIHIGSQQTQSDHAHVSQPMEETHEAPRDHNQADFEPRLGYATKGQPVSGVPLPNTLEGHLWRP

SEQ ID NO: 221003 - protein, 274 aa, Glycine max
  Coding DNA Sequence Number=SeqID_104225
  Homolog annotation: Hit_ID=Q6YS10; Match level="QueryCoverage=78%, HitCoverage=56%, E-value=3e-33, Identity=35%"; Hit description =Transducin / WD-40 repeat protein-like
  Pfam annotation: Domain name=WD40; Domain location=161-199; Score =20.9; E_value=0.0045; Accession=PF00400.22; Description=WD domain, G- beta repeat
  Pfam annotation: Domain name=WD40; Domain location=73-112; Score=3.3; E_value=15; Accession=PF00400.22; Description=WD domain, G-beta repeat
  Pfam module annotation: Pfam domain module=WD40::WD40; Domain location=161-199::73-112
MADARESRYSDSSFLYSLMGMAQTQKEAQDAIASVARVVPGSITDVRSFPSSNVKMIAAANNIGNLGFWNVGQSEFHLYCPHLAFISGILIQPHCFSKIYTSCYDGILRLMDTEKEIFDLVFESDESIYALSQSTNETNCLYLGEGSGACTWDLRYTDGDKLAALRIFTHKRGVQSAYFSPSGCSLATTSADATIGIYSGVNLEDGAVIHLNNQNSTYLSTLSYGFSGKRNGVGMTHISSLEIRTEELMSSQQFKGSSYDSCEPAHVCQSVQIR

SEQ ID NO: 221004 - protein, 43 aa, Glycine max
  Coding DNA Sequence Number=SeqID_104226
MPRPKRKAAPPITSSDVDSSLRTAMSFPLLKCPKLANFDLVRS

SEQ ID NO: 221005 - protein, 118 aa, Glycine max
  Coding DNA Sequence Number=SeqID_104227
  Subcellular localization annotation: CTP_CleavageSite=60; ConfidenceScore=5.19e-01
MAKIQGPKEGKHILIFTKKSGPNLGPWAQKSTLRFMRTLGPSLAGRLSVVKCNTEIERLSATESGDDFGGKTLIKVNDVIGKTLVQGRQCLWKDACPRLTTLSLLHFVRFSCRVPFFL

SEQ ID NO: 221006 - protein, 479 aa, Glycine max
  Coding DNA Sequence Number=SeqID_104228
  Gene Ontology: Mol. function=protein binding; Cellular component =nucleus; Biological process=response to DNA damage stimulus
  Homolog annotation: Hit_ID=Q6YS10; Match level="QueryCoverage=98%, HitCoverage=97%, E-value=2e-92, Identity=41%"; Hit description =Transducin / WD-40 repeat protein-like
  Pfam annotation: Domain name=WD40; Domain location=153-193; Score =3.0; E_value=16; Accession=PF00400.22; Description=WD domain, G-beta repeat
  Pfam annotation: Domain name=WD40; Domain location=196-254; Score =4.1; E_value=12; Accession=PF00400.22; Description=WD domain, G-beta repeat
  Pfam annotation: Domain name=WD40; Domain location=300-339; Score =28.9; E_value=1.8e-05; Accession=PF00400.22; Description=WD domain, G-beta repeat
  Pfam annotation: Domain name=WD40; Domain location=347-385; Score =22.2; E_value=0.0019; Accession=PF00400.22; Description=WD domain, G- beta repeat
  Pfam module annotation: Pfam domain module=WD40::WD40::WD40::WD40; Domain location=153-193::196-254::300-339::347-385
MAPQKLNDYERKRLENIRRNDEMMAALKLHSKATQLSNFKRSQRVGTKSYNMKSEKKPKTETPIVIRRSLRTRGIPPDSKGLVGDSVGPTTPTKTKPSVVNLGPISMADARESAHSDSSFVESLMGMAQLEAQDVRVEKEKVEASLGLESLYLDPKNIARVVPGRITSLRFFPSSSVKMVAVGNKFGNVGFWNVGGSEVHLYRPHRAPISGILIQPHCFSKMHSVISSGFQVKVEAKEESIYTSCYDGILRLMDVEKEIFDLVFECDESIYALSLPTNETNCLYLAEGYGGLTIWDNRIGKRSSHWVLHESRINTIDFNCENPHIVATSSTDGTACTWDLRYTDGDKLRALRTFTHKRSVQSAYFSPSGCSLATTSLDNTIGIYSGVNLEDAAVINHNNLTGRWLSTFRAKWGWDDSYLFVGNMKRGVDVVSSVERKIVMTLESQHMSAIPCRFDTHSYEVGMLAGATSGGQVYIWTSR

SEQ ID NO: 221007 - protein, 939 aa, Glycine max
  Coding DNA Sequence Number=SeqID_104229
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q9M2A0; Match level="QueryCoverage=99%, HitCoverage=100%, E-value=0.0, Identity=76%"; Hit description=ATPase 8, plasma membrane-type
  Pfam annotation: Domain name=Cation_ATPase_N; Domain location=8-88; Score=118.8; E_value=1.5e-32; Accession=PF00690.16; Description =Cation transporterATPase, N-terminus
  Pfam annotation: Domain name=E1-E2_ATPase; Domain location=101-322; Score=301.9; E_value=1.2e-87; Accession=PF00122.10; Description=E1 -E2 ATPase
  Pfam annotation: Domain name=Hydrolase; Domain location=326-604; Score=72.2; E_value=1.7e-18; Accession=PF00702.16; Description =haloacid dehalogenase-like hydrolase
  Pfam module annotation: Pfam domain module=Cation_ATPase_N::E1-E2 _ATPase::Hydrolase; Domain location=8-88::101-322::326-604
MASDISFEDLKNENVDLEHIPVEEVFKQLKCTREGLTSAEGEKRLQIFGPNKLEEKKDSKLLKFLGFMWNPLSWVMEVAAIMAIVMANGGGKPPDWQDFVGIVVLLIINSTISFIEENNAGNAAAALMAGLAPKTKVLRDGKWSEEEAALLVPGDLISIKLGDIVPADARLLEGDPLKIDQSALTGESLPVTKNPGSEVFSGSTCKQGEIEAIVIATGVHTFFGKAAHLVDSTNNVGHFQKVLTSIGNFCICSIAVGMLIEIIVMFPIQQRAYRDGIDNLLVLLIGGIPIAMPTVLSVTMAIGSHRLSEQGAITKRMTAIEEMAGMDVLCSDKTGTLTLNKLTVDKSLIEVFPTGMDRDTLVLYAARASRIENQDAIDASIVGMLGDPKEARAGITEVHFLPFNPVDKRTAITYIDGQGNWHRSSKGAPEQGEVLKKAHKVIDEYANRGLRSLGVSRQTVSEKNKESAGESWEFLGLLPLFDPPRHDSAETIRRALDLGVNVKMITGDQLAIGKETGRRLGMGTNMYPSSSLLGDSKDPAIASIPVDELIEKADGFAGVFPEHKYEIVKRLQEMKHICGMTGDGVNDAPALKKADIGIAVADATDAARSASDIVLTEPGLSVIVSAVLTSRAIFQRMKNYTIYAVSITIRIVLGFMLVALIWRFDFSPFMVLIIAILNDGTIMTISKDRVKPSPLPDSWKLKEIFATGVVLGAYMAIITVVFFFLVHDTDFFTRVFGVEPIVDSEEQLNSALYLQVSIISQALIFVTRSRSWSYVERPGILLITAFFAAQLVATVIAVYAHWDFARINGVGWGWAGAIWVFSIVTYIPLDILKFLIRMGLSGKAWDNMLDNKTAFTTKKDYGRGEREAEWAVAQRTLHGLQVGESNKAKQHEQSEIAEQAKRRAEAARLRELHTLKGHVESVVKLKGIDIDTIQQHYTL

SEQ ID NO: 221008 - protein, 1017 aa, Glycine max
  Coding DNA Sequence Number=SeqID_104230
  Gene Ontology: Mol. function=ATP-dependent helicase activity; Cellular component=intracellular; Biological process=RNA processing
  Homolog annotation: Hit_ID=Q3SA53; Match level="QueryCoverage=95%, HitCoverage=60%, E-value=0.0, Identity=52%"; Hit description=Dicer -like 4
  Pfam annotation: Domain name=DUF283; Domain location=202-292; Score =36.0; E_value=1.3e-07; Accession=PF03368.5; Description=Domain of unknown function
  Pfam annotation: Domain name=Helicase_C; Domain location=57-138; Score=67.4; E_value=4.7e-17; Accession=PF00271.21; Description =Helicase conserved C-terminal domain
  Pfam annotation: Domain name=Ribonuclease_3; Domain location=599-730; Score=123.9; E_value=4.7e-34; Accession=PF00636.16; Description =RNase3 domain
  Pfam annotation: Domain name=Ribonuclease_3; Domain location=808-917; Score=134.1; E_value=3.9e-37; Accession=PF00636.16; Description =RNase3 domain
  Pfam annotation: Domain name=dsrm; Domain location=202-272; Score =3.2; E_value=0.92; Accession=PF00035.15; Description=Double-stranded RNA binding motif
  Pfam annotation: Domain name=dsrm; Domain location=945-1010; Score =30.2; E_value=7e-06; Accession=PF00035.15; Description=Double -stranded RNA binding motif
  Pfam module annotation: Pfam domain module=DUF283::Helicase _C::Ribonuclease_3::Ribonuclease_3::dsrm::dsrm; Domain location=202 -292::57-138::599-730::808-917::202-272::945-1010
ASHILLSGDRSERHELVEAEGNSSDDSLCDKYLAQAAELFTSQCMIARSLSYILQKLKLLRQWRSDFLVGVHAGLKSMSRKTMNIIVDKFRSGELNLLVATKVGEEGLDIQTCCLVIRFDLPETVASFIQSRGRARMPQSEYAFLVDSGNKKELDIIDGFEKDEYRMNMEITFRTSKETYIIPEERIFRVDSSGASVSSGYSISLLHQYCSKLPHDEYFDPKPCFYYLDDSGGISCHITLPSNAPINQILGTPQLSMEASKRDACLKAIEELYNLGTLSDCLLPKQDDAEPEAQVSGSSDEDECEDAISRGELHEMLVPSAFGQSWINEDNIVRLNSYYIKFCPYPEDRVYKEFGLFIMVRLPMEAEKLELDLHLAHGRSVMTKFVPFGVVEFDKDEIKMAENFQEMFLKIILDRLEFVSEFVDLGMGAESHTGTSTFYLLLPVVLQEYGNAMKVDWKTVKRCLCSPIFRHPADTMDKKVFPLDIHLQLANGYRSVRDVENSLVYAPHKKNFYFVTNVNYQKNGYSPHNDSGTSSYVDYFIENSISLLPSIMHRLGNLLVAIELKHRLSSSFPEAAEISALRVLEALTTEKCQERFSLERLEVLGDAFLKFAVARHFFLMHDSLHEGDLTKRRSNAVNNSNLFKLAIKRNLQVYICDQTFDPTQFYALGRPCPRLCSNETKESIHFCLNSVKEQGKVTETQCNKNHHWLHRKTIADVVEALVGAFLVDSGFKAAIAFLSWIGIQVDFEASQVVDICIASASYLPLSSEVDIPSLEGKLGHHFFHKGLLLQAFVHPSYNKLGGGCYQASRLEFLGDAVLDYLITSYVFSAYPKLKPGQLTDLRSLSVNNKAFACLAVDRSFDKFLLCDSSGLSEAIKKYVDYIRRPVSDNSIKEGPKCPKALGDLVESCVGAILLDSGFNLNKVWKIMTSFLDSIMKFSSSLQLSPVRDLRELCQSHNMELEFLPVPSKLTKRFSVEAKVSGNGVCETASATGQNKKEACRIASLLLFSKFKVSILLL

SEQ ID NO: 221009 - protein, 732 aa, Glycine max
  Coding DNA Sequence Number=SeqID_104231
  Gene Ontology: Mol. function=DNA-dependent ATPase activity; Cellular component=nucleus; Biological process=DNA replication initiation
  Homolog annotation: Hit_ID=Q6KAJ4; Match level="QueryCoverage=99%, HitCoverage=100%, E-value=0.0, Identity=74%"; Hit description =Putative minichromosome maintenance deficient protein 5
  Pfam annotation: Domain name=AAA_3; Domain location=375-506; Score= -8.7; E_value=0.0029; Accession=PF07726.2; Description=ATPase family associated with various
  Pfam annotation: Domain name=AAA_5; Domain location=375-522; Score= -6.8; E_value=0.0059; Accession=PF07728.4; Description=ATPase family associated with various
  Pfam annotation: Domain name=MCM; Domain location=317-649; Score =686.1; E_value=2.6e-203; Accession=PF00493.13; Description=MCM235 family
  Pfam annotation: Domain name=Mg_chelatase; Domain location=375-528; Score=-136.4; E_value=0.0019; Accession=PF01078.11; Description =Magnesium chelatase, subunit ChlI
  Pfam module annotation: Pfam domain module=AAA_3::AAA_5::MCM::Mg _chelatase; Domain location=375-506::375-522::317-649::375-528
MSGWDEGAVYYSDQALAGDDGAGARGEAGTDSNHTLIQKFKEFIRNFETTNNVFPYRESLIHNPKFLLVDMGDLDTFDSELPAKLRSNPADVLPLFETAAAQVLVNLKTKVAGDTGDMEDQTPGDVQILLTSKEDPVSMRSLGAQYISKLVKIAGITIAASRTKAKATYVTLICKNCKKGKQVPCRPGLGGAIVPRSCDHVPQPGEEPCPIDPWLVVPDKSRYVDQQTLKMQENPEDVPTGELPRNLLLSLDRHLVQTVVPGSRLTIMGIFSIYQASNSNTSNKGAVAIRQPYIRVVGIEETNETNSRGPAAFTQDEIEEFKKFAAEPDAYKNICSMIAPSIFGHDDVKKAVACLLFGGSRKNLPDGVRLRGDINVLLLGDPSTAKSQFLKFVEKTAPIAVYTSGKGSSAAGLTASVIQDSGTREFYLEGGAMVLADGGVVCIDEFDKMRPEDRVAIHEAMEQQTISIAKAGITTVLNSRTSVLAAANPPSGRYDDLKTAQDNIDLQTTILSRFDLIFIVKDVRMYSQDKIIANHIIKVHKSAGGRMGESRTLKEENWLKRYLQYCRTQCHPRLSESATTLLQNHYVKIRQDMRQQANETGEAAAIPITVRQLEAIVRLSEALAKMKLSHLATEENVQEAVRLFTVSTMDAAKSGINQQINLTPDMANEIKQAETQIKRRIGIGNHISERRLIDDLSRMGMNESIVRRALIIMHQRDEIEYKRERRVVFRKA

SEQ ID NO: 221010 - protein, 90 aa, Glycine max
  Coding DNA Sequence Number=SeqID_104232
MDTNPNPRSGNPIFYSSESGTLLLYDNALGNPMLQTLTLTLVLLYASASETVLLYNNALETLLLFISALEILLLYVMEFNSSNPNPNPRS

SEQ ID NO: 221011 - protein, 223 aa, Glycine max
  Coding DNA Sequence Number=SeqID_104233
MARTKKSGQMKYEAAREIADRIDSLREQSAQGSFVAHGHQDILIVAIGQLKHPSCVCSAGIGVTIEQYFGPTSGVIPPAEPKVVPSTAHVSTKGSCVDPLGQDPNTATSDKHGLYVDNNLPCLVALGRVYEGSTTVHNIPLGNDLVKGLAKPVDRSELDDDPIYHMTLMIPQLFLKPMQVSWDATVFGLYNGNVPLYIKHEDLGEIAHDGQCLNIVVIQLWIL

SEQ ID NO: 221012 - protein, 124 aa, Glycine max
  Coding DNA Sequence Number=SeqID_104234
  Subcellular localization annotation: CTP_CleavageSite=72; ConfidenceScore=5.35e-01
MTKNRVLKDHNKTFLNWSKDTIFGDDNASKMLRKHMATPPSSLPLESTSSSSMSKRTRKTTRLISLDARPVRVERLVVHMDPTTRKSLWSPYKEIKNLFGGSSLETRWILHMLTRNKFLQLRRI

SEQ ID NO: 221013 - protein, 157 aa, Glycine max
  Coding DNA Sequence Number=SeqID_104235
  Gene Ontology: Mol. function=actin binding; Biological process =cytoskeleton organization and biogenesis
  Pfam annotation: Domain name=Transposase_21; Domain location=22-157; Score=97.5; E_value=3.9e-26; Accession=PF02992.5; Description =Transposase family tnp2
MAKAQRKAPKEGVMIANRDDKKNLTWHADGRNYDGMFFHLANSSQWKKINHLYPKIGKDSRNVRLGLAIDGMNHFGNLSTKHSPWPILLVIYNLPPLLFMKQKYMLSMIISGPRQPGNDINVYLNPLIEDLRKLWDEGVDMFDSYQNEKFKLCAMVF

SEQ ID NO: 221014 - protein, 66 aa, Glycine max
  Coding DNA Sequence Number=SeqID_104236
MTVEGGFTGGFKGQTKESEKRKRRIIITRERVLFKTLIMESAKKRVIKSYLSEHARSLRLTSRMIK

SEQ ID NO: 221015 - protein, 263 aa, Glycine max
  Coding DNA Sequence Number=SeqID_104237
  Gene Ontology: Mol. function=ATP-dependent helicase activity; Cellular component=intracellular; Biological process=RNA processing
  Homolog annotation: Hit_ID=Q3SA53; Match level="QueryCoverage=73%, HitCoverage=11%, E-value=3e-75, Identity=69%"; Hit description=Dicer- like 4
  Pfam annotation: Domain name=DEAD; Domain location=51-222; Score =69.5; E_value=1.1e-17; Accession=PF00270.19; Description=DEADDEAH box helicase
  Pfam annotation: Domain name=ResIII; Domain location=47-217; Score =33.4; E_value=7.3e-08; Accession=PF04851.6; Description=Type III restriction enzyme, res subunit
  Pfam module annotation: Pfam domain module=DEAD::ResIII; Domain location=51-222::47-217
MPDGESSVVVAGGQASMEPSLSVSNQLQSLSLSQDKNHDDSVKKDPRKIARKYQLELCKKAMEENIIVYLGTGCGKTHIAVLLMYGMGHLIRKPQKNICVFLAPTVALVHQQAKVIADSTNFKVGTYCGSSKRLKRHQDWEQEIGQYEVLVMTPQILLHNLSHCFITMEMIALLIFDECHHAQVKSNHAYAVIMKVFYKSNSSKVPRIFGMTASPVVGKGKIMLIFKKLSTNKSLDICLPQLPFDTVKYTQGQGMEGRGKKRI

SEQ ID NO: 221016 - protein, 318 aa, Glycine max
  Coding DNA Sequence Number=SeqID_104238
AEKSTIRGVTDGIRADISSGTDYIVKDDLKELIDTTYTIKMHLLFRSSSLKNSTVKLPKQIVKVSERATYGGGPTWGRTRRCFELVAHVDSVAGEKINVPLAKDASHVVCVNFTCQGHAKGRCGGVLSWLRMWMTRAVSKGTKLEKEIYMYEDPIALSLSNSKSLYKIPFENIMLFLICHTDHWKNSGDVHPGRGFPPKRATTTPEAWPNQSSDAPKTELVWLRKELACRQGVGFLMEARWVVLDRSTMGVPNRGFASQKGGQMAAADSCDRRSCQKFKNISSKKERSFVRALECRNKVARRRAKQRDPPGIVDLCQE

SEQ ID NO: 221017 - protein, 185 aa, Glycine max
  Coding DNA Sequence Number=SeqID_104239
  Gene Ontology: Mol. function=protein serine/threonine kinase activity
  Homolog annotation: Hit_ID=Q337P5; Match level="QueryCoverage=94%, HitCoverage=26%, E-value=1e-44, Identity=50%"; Hit description =Pleckstriny domain-containing protein, putative, expressed
  Pfam annotation: Domain name=DUF1336; Domain location=2-177; Score =241.6; E_value=1.7e-69; Accession=PF07059.3; Description=Protein of unknown function (DUF1336)
MGMKFVMQVVGGDPLLKLVAVDWFTVDKSADRIALHPKCLVQVPAKPNYSLVLYYAADRPINKNSLLAKFVDGSDAFRDSRFKLIPSIVEGYWMVKRAVGTKACLLGKAVTCKYFRQDNFLEIDVDIGSSSVARSVIGLVLGYVTSLVVDLAILIQANEEVELPEYILGTVRLNRLKLESAVPLE

SEQ ID NO: 221018 - protein, 82 aa, Glycine max
  Coding DNA Sequence Number=SeqID_104240
MLKFTIVQLVNDKDVRDSQTFDATEDQPQPYLRTPAVKPTSSAQPDKLELTAKSDLPNKELGPFNEDKDKVLHNQPQEDDEE

SEQ ID NO: 221019 - protein, 97 aa, Glycine max
  Coding DNA Sequence Number=SeqID_104241
MSSHTERKEKEGVGVERGKLRQREMDAAATGSELNKSGSGGSERSEDSGGGIFEYSGWVYHLGVNSIGHEYCHLRFLFIRGKYVSMYKRDPHDNPGL

SEQ ID NO: 221020 - protein, 778 aa, Glycine max
  Coding DNA Sequence Number=SeqID_104242
  Gene Ontology: Mol. function=nucleic acid binding; Cellular component= intracellular
  Homolog annotation: Hit_ID=Q9SHG6; Match level="QueryCoverage=28%, HitCoverage=27%, E-value=1e-11, Identity=32%"; Hit description =Similar to tuftelin-interacting protein
  Pfam annotation: Domain name=G-patch; Domain location=640-684; Score =72.9; E_value=9.9e-19; Accession=PF01585.13; Description=G-patch domain
  Pfam annotation: Domain name=G-patch; Domain location=733-777; Score =71.4; E_value=2.9e-18; Accession=PF01585.13; Description=G-patch domain
  Pfam module annotation: Pfam domain module=G-patch::G-patch; Domain location=640-684::733-777
MDGPKSKSFVNSGLGNVRGGQVTVTWPYTQFMLLGIIGMVLFGGSQYKEASSYGGSEIRLTAVGEYPIGSGQTRVHIGGWVGPAIPSFSFCFAASKHSTIRNLLLITRKQTIMGGGNRRSKGGGNRKSNNSSGCGNPKSRKRGSDVKSALFVEGGFLSDWHLPSPTQNPERSSGSNNKSGSQRRAAEGSASKSGFAKSLGATIRYSYPSLDVQNDLYLMAYYQEVACAGIGNNGEDSNLNQLQPLVLADSKQGQIIAHIDQTPPSKPSNVKYAYTYDADFILGDSSHRGLCLPAEQEKTPSGIGTLSEQMPQSTPVLDSPSFEKEAGSDEGMDCELSNQITEDLPSNVSAERNSGFLSIGGLKLYTQDISDDESDEYNDEDSSDEDSSASSEPEELLGSSESNDSEYSSDSDSDIDEEVAEDYLEGVGGSDNIMEAKWLLKPVLDESDDDSSSSSCYDEALEKLSGFVLQEASREYDTKKAQSWKKRSVGSGPLALEDLMLAKDPRSISARKKHVPRFPQSWPSHAQNIDDDEDADFSVADYVNKKSVSGDRRLGKKNAKRNDFRLQEPQSAQNKYSGSRKLKDKKGNGQKGSYANQPVSFVSSGLINSETLQVTVVDAEETNRKGVTSSANIGSFEEHTTGFGSKMMAKMGYTEGAGLGKNGQGMAQPIEVIQRPKSLGLGVEFYNNSAEPARNKSSRVGAKSLGLGVEFSNSPAEPARNKSSKVGSFEKHTKGFGSKMMAKMGFVEGNGLGRESQGITTPLSAVRLPKSRGLGAKS

SEQ ID NO: 221021 - protein, 219 aa, Glycine max
  Coding DNA Sequence Number=SeqID_104243
  Subcellular localization annotation: CTP_CleavageSite=72; ConfidenceScore=5.45e-01
MGTTILRSHDCLQGRFLHSEAFAIAASRVASRRNSNPNNNSFASSAKPNRCRKRSPVTNRNRRRSPAKATLPANLVMGHVKILKRGEKLSLQNNTNQRLAENVSMKNDMGLDLLLGSTDRLGPDPLTMQKHIRVSDANNNGVYAGSAFVSSPHPSSVPVPGFLGRNGAATSDLRRIAAGCGHVKKKRRKQCLKVFREWRFGVRFLKGGVSLLDSDAVSF

SEQ ID NO: 221022 - protein, 170 aa, Glycine max
  Coding DNA Sequence Number=SeqID_104244
  Subcellular localization annotation: CTP_CleavageSite=45; ConfidenceScore=5.34e-01
MLQQLNKEGPKAGPLRKPQPRVRDPTTGKNTQKTTNRKVQKTFMSNNSKWKDKAQESLIKGMNNKEVGNNRMTGNSNDEENKKKDDSMKTTIPTNYDPKGSTDEALLAVMRNMEALISMFATRFHYDKMDIVFNANKPANLVDKESLCNNTFNTPREEAMSGVIQEVVSP

SEQ ID NO: 221023 - protein, 372 aa, Glycine max
  Coding DNA Sequence Number=SeqID_104245
  Homolog annotation: Hit_ID=Q7F1Y6; Match level="QueryCoverage=69%, HitCoverage=81%, E-value=5e-70, Identity=52%"; Hit description =Putative ATP synthase mitochondrial F1 complex assembly factor2
  Pfam annotation: Domain name=ATP12; Domain location=81-216; Score =229.6; E_value=6.9e-66; Accession=PF07542.2; Description=ATP12 chaperone protein
MAHSLIRKCIKPATLNFLTPLAVPEIRRRLASVAAAADEDPPQSPSSFTFSSEGEKVYVKPPAGKWKPSPSSTVTMPMSFMTGSIVGKRFYKEVKTREADDGNGWTVMLDYRTLKTPSKRPLKLPSLPLAKAIAAEWEYQQTDGIRPFTMPLMRLACTALERVPLTRSKVIENLMKKFNQDLVFCRAPDDDELTSYVHARQVENIDPLLRWVESEFGFKPVLYTSFFGGKQEDGLVMAIENLLKKTDDCELAAIDAIAASAHSLIIAIGMVQGKLQIEEAIELIRLEEDSQVDRWGLVEGGHDVDIADLRVQSWYCSKRIKVTGDPLNTLDEIHENNYFDGCSPFDYVNISRHIPVAFKDLPDSIEHKVEAV

SEQ ID NO: 221024 - protein, 183 aa, Glycine max
  Coding DNA Sequence Number=SeqID_104246
  Gene Ontology: Mol. function=RNA-directed DNA polymerase activity; Cellular component=membrane; Biological process=RNA-dependent DNA replication
MYCMSIYILPDTLIDEIHGMLNSIWWGSKKESRMGVNWLRWDKLTLRKDQGGMVFQDLKGFNLALLGNQAWSFCEFWSSRHLLKEWMKWRVGKGYSINVWKDSWLRGRNIALHDHAGARVALDLIVHDLIDQEKGVWNARGPFCLENLENSWHALVGCEHEGSKYMGTIGELDLKHFPEKIRP

SEQ ID NO: 221025 - protein, 64 aa, Glycine max
  Coding DNA Sequence Number=SeqID_104247
  Homolog annotation: Hit_ID=Q6Z341; Match level="QueryCoverage=96%, HitCoverage=13%, E-value=2e-16, Identity=58%"; Hit description =Putative auxin-independent growth promoter
MGVKRTLGYDANEYNNGVLNWDEFSSAVKEAHANRMGSQTKRFVIPDKPKEENYFYANPQECLG

SEQ ID NO: 221026 - protein, 87 aa, Glycine max
  Coding DNA Sequence Number=SeqID_104248
MATGACQMMFQCVFEGSISLHDMEIERRPYHKNCGCALHNLNDGASMALASEPYSSLRMLNVVTRKSLESEKLFCLLLFFKAIDTLR

SEQ ID NO: 221027 - protein, 46 aa, Glycine max
  Coding DNA Sequence Number=SeqID_104249
  Gene Ontology: Mol. function=succinate dehydrogenase (ubiquinone) activity; Cellular component=mitochondrion; Biological process =tricarboxylic acid cycle
  Homolog annotation: Hit_ID=Q8LB02; Match level="QueryCoverage=73%, HitCoverage=12%, E-value=5e-13, Identity=94%"; Hit description =Succinate dehydrogenase [ubiquinone] iron-sulfur protein 2, mitochondrial precursor
TSTVQYGVAAIELEFIINGIQSLLSVLITAVAYPPANTITNNISKL

SEQ ID NO: 221028 - protein, 110 aa, Glycine max
  Coding DNA Sequence Number=SeqID_104250
MEIYNRPSGYVQCYFTPSMTFQPMKAFNGSQEFQTAPKPLAGHQVFDRVKDIITIFGKTQKKDAFEKNIWKKRYMTTVASDIRRSTNVFSLSMSDNVGKRKKVFVIVYGV

SEQ ID NO: 221029 - protein, 296 aa, Glycine max
  Coding DNA Sequence Number=SeqID_104251
  Gene Ontology: Mol. function=site-specific DNA-methyltransferase (adenine-specific) activity; Biological process=DNA methylation
  Homolog annotation: Hit_ID=Q2ZPI6; Match level="QueryCoverage=39%, HitCoverage=23%, E-value=2e-62, Identity=96%"; Hit description=N-6 DNA methylase:Type I restriction-modification system, M subunit
  Pfam annotation: Domain name=Methylase_S; Domain location=108-268; Score=-14.3; E_value=0.03; Accession=PF01420.9; Description=Type I restriction modification DNA specificity domain
  Pfam annotation: Domain name=N6_Mtase; Domain location=1-208; Score= -94.8; E_value=8.8e-09; Accession=PF02384.7; Description=N-6 DNA Methylase
  Pfam module annotation: Pfam domain module=Methylase_S::N6_Mtase; Domain location=108-268::1-208
MFLHDIEEFDVLRGDTLAEPKFIENDRLKQFDVIFANPPYSIKKWNRDKFAADPYGRNLYGVPPQGCADYAFYNHIIKSLKPDTGRAAMLWPHGVLFRDSEQAIRKQVIESDIIEAVIAFEVKRKLPTFMESHIQWCIRGEDFDSESLRFIRKGSLMDAGPTFFRHFLPGDFLYMTRNPRLKKGAIADFEGVAANTTLILNQKISKEFYDGLLPHIMQSELFHAYAESVAVGSTNLFTKWIDLKRFEFSLPSVREQERLIKILEKVVECIHLTEDLVEHYSNLKAALINSVITEDQ

SEQ ID NO: 221030 - protein, 1240 aa, Glycine max
  Coding DNA Sequence Number=SeqID_104252
  Gene Ontology: Mol. function=protein-tyrosine kinase activity; Biological process=protein amino acid phosphorylation
  Homolog annotation: Hit_ID=Q1SP36; Match level="QueryCoverage=99%, HitCoverage=90%, E-value=0.0, Identity=58%"; Hit description =Octicosapeptide/Phox/Bem1p; Protein kinase
  Pfam annotation: Domain name=PB1; Domain location=162-251; Score =93.8; E_value=5.1e-25; Accession=PF00564.15; Description=PB1 domain
  Pfam annotation: Domain name=Pkinase; Domain location=1091-1240; Score=-55.4; E_value=2.9e-05; Accession=PF00069.15; Description =Protein kinase domain
  Pfam annotation: Domain name=Pkinase_Tyr; Domain location=1091-1240; Score=-28.3; E_value=9.8e-11; Accession=PF07714.7; Description =Protein tyrosine kinase
  Pfam module annotation: Pfam domain module=PB1::Pkinase::Pkinase_Tyr; Domain location=162-251::1091-1240::1091-1240
MAFDQNSIPLNAASAVAEEPLISPATVTPPTPNSVGELFYPPSDSATWCVHPIAHHADVSPAAAPFGSNYGGSSFGNHRVVAAGNALNLGKLSACNGLDNKACNDVNGFGGVRGSRVVANVGDHGGGSHHEGGGSNGGDDSASSGRKVKFLCSFGGKILPRPSDGMLRYVGGQTRIISVRRDVSFNDLVQKMVESYGQAVVIKYQLPEEDLDTLVSVSCHDDVDNMMEEYEKLVERSHDGSAKLRVFLFSASESSECSSSSGGVHFGDLQDTGQKYFDAVNGIGNSTEGINRKESVTSAASTQNSDFSGAETLDSSIVSGGVPLSSPKENVSAASSSDTTATNLVVLEVPGAPVYSGGASAVSLAMPVAKTKTSPTATHNLYFQNEVESEKSVTVTLSQNPFGLQPFVDATSQEVMNHAADYVQLPSQMGFTNPQLLGKTGGHVFAQQQFHDSTHRLALHHQVIPAGVQMTVAQQPSSHVGVRPNVVQPQQQHLLDQYHDENTSGGVRIIQLPAERSYNTFQVPMNQVQPVIVGGNYGWVQVPPQERVVISDGLLPQQQVMIPEKIRRAEDCSMCQKKLPHAHSDPVVQDQHDSRGAGSTPDSTPSHNSFPIEDNVKAQATNRIMPMVTSPLKEGIAEQGARTRPRVLGKLEPPDGVHHTETSGFPHNIEPHTEGGRNFIQKLEELDHPRNSFFQEKIGMKGREQSPNDEPLGTTPLSYLDDVGNHHMVSVENWVKQDVLNHIPLGEGKSIKTSEGMLQGSQKEYTNELSRVVSKSDAIDNWIRQDHLKPVDARMDTLKIPNSEVYVSNDYSFLPVDKPSGNDNLDYSTHHSVEEEVILDNNFGRSKLRVDVNQNKMTGVLPCSSMEISYRNNSRPGECNEAAQPPFWGIPGSSPQSNIGNPHKGDASPSSPSLSVRFGDVQDTRNSLFSNQDPWNIQHGTFFPPSIPSKTAYSKETYSCNDSFDGNSGNFGEQSLEAQLDGSLYQSFKQNLTIEHVRSAKGSAEDQQLQAVAENVAASVLHSRTPSNSDLHSGDVSCCETIKYDSVQNNLIDVKCGHKAQDVKSKQLEKANFGFPASGVGKLQVIKNCDLEELIELGSGTFGTVYHGKWRGTDVAIKRITDRCFAGKPSEQERMRSDFWNEAIKLADLHHPNVVAFYGVVLDGPGGSVATVTEYMVNGSLRNALQKTERNLDKRKCLLIAMDVAFGMEYLHGKNIVHFDLKSDNLLVNIRDPHRPICKV

SEQ ID NO: 221031 - protein, 191 aa, Glycine max
  Coding DNA Sequence Number=SeqID_104253
  Gene Ontology: Mol. function=sequence-specific DNA binding; Cellular component=nucleus; Biological process=regulation of transcription, DNA-dependent
  Homolog annotation: Hit_ID=P48001; Match level="QueryCoverage=82%, HitCoverage=39%, E-value=2e-71, Identity=82%"; Hit description =Homeobox protein knotted-1-like 4
  Pfam annotation: Domain name=ELK; Domain location=93-114; Score=33.7; E_value=6.2e-07; Accession=PF03789.4; Description=ELK domain
  Pfam annotation: Domain name=Homeobox; Domain location=115-172; Score= -9.9; E_value=0.054; Accession=PF00046.19; Description=Homeobox domain
  Pfam module annotation: Pfam domain module=ELK::Homeobox; Domain location=93-114::115-172
MSLLSLELHPSLGRLLFALVQLWELRQCTECWVFISVSPGEGTGATMSDDEDDQAESNANLYEGSLDGGETLGFGPLVPTESERSLMERVRHELKHELKQGYKEKIVDIREEILRKRRAGKLPGDTTSLLKAWWQSHSKWPYPTEEDKARLVQETGLQLKQINNWFINQRKRNWHTNNPSSSSNSKSKRKR

SEQ ID NO: 221032 - protein, 280 aa, Glycine max
  Coding DNA Sequence Number=SeqID_104254
  Homolog annotation: Hit_ID=Q1SP36; Match level="QueryCoverage=33%, HitCoverage=6%, E-value=2e-45, Identity=91%"; Hit description =Octicosapeptide/Phox/Bem1p; Protein kinase
  Pfam annotation: Domain name=Pkinase_Tyr; Domain location=1-90; Score= -150.6; E_value=0.0031; Accession=PF07714.7; Description=Protein tyrosine kinase
MAPELLNGSSSLVSEKVDVFSFGIVMWELLTGEEPYADLHYGAIIGGIVSNTLRPPVPSSCDPEWRLLMERCWSSEPSERPTFTEIANELRSLATKVYLLLQIIEHCMTPRGCWVGVCTCITALTQIIKAATNLIHTIENMASYEGRPLVMEMEGEEGFEEAGSSGCGCFRCFSLKKWWQGYEEEGKGLLDQKGEGESWVVNKLRKAKEVSEVIAGPKWKTFIRKISGYGKKVKYQRNRFQYDEHSYALNFNSEAQREDEGMPHSFSSRFAAPGRRQNES

SEQ ID NO: 221033 - protein, 67 aa, Glycine max
  Coding DNA Sequence Number=SeqID_104255
MASLNAGEEGTRCAALFSNPVAMEERSLGSVVRSAFYLFYMRGGWVGEFGGGVGVDWEVLVDYGKYL

SEQ ID NO: 221034 - protein, 490 aa, Glycine max
  Coding DNA Sequence Number=SeqID_104256
MVYSYYTPTYYSTLHDSLTSLCKTILPFSFKKRPLPAAEHKLSKLQSDNLKWQQDSFHQVLNLMGLHKEGIVAESEVSAFRTHLLDTLIASPPEQEHPVILRDKLLFLQELLYAKCISEEEYHSSKRPLLQRLAAQGAQIEARDVIVARPKDSKENSEEEWSVIDLKDEKCWVNKENLGSKSKSNQGSAMKQIKGAALVFGFGKGGKNGEEKSMFDSPSLSANNESRENPFWDAQTKEKQSEGKSILMEESVPPEPVKESGGLDKLKRKPFRTLFHKEQSGGPEQDQRSGKSGKKQWGFEGFKKWRRNESEEETAPLPLNESEEAYSGSLAKTLGEGPDTKLIKKKLHSDGSPSDFFIDKVLGDKIKKELSRIQTELSSTNPNLKFSNDQIEAISTRIPVDKAELKNYFPKSWCDRYGDVVLDVVKKEFKDHVAEMENRRNIAREKQSNSRRWTTTTFDGDENIHPNLFGHRDNNSVRSSNINPFSHGYA

SEQ ID NO: 221035 - protein, 166 aa, Glycine max
  Coding DNA Sequence Number=SeqID_104257
MQLARQVSRLESGQFNQCNIHRNDLPLFLILIRYTPEKAQGAPDGDTRIVIHKLHMHYISNGGVGGVEALEGEVPVAQEAEELDEHTVARVGHGVDESLVRVGRDGGVEAQEAEELDKHAVGRVGRGGGVEAQEAEEMDEHVVAEPVGRGGGEGLDRLAGEDCACC

SEQ ID NO: 221036 - protein, 632 aa, Glycine max
  Coding DNA Sequence Number=SeqID_104258
  Gene Ontology: Mol. function=electron carrier activity; Cellular component=mitochondrion; Biological process=electron transport
  Homolog annotation: Hit_ID=O64624; Match level="QueryCoverage=65%, HitCoverage=71%, E-value=5e-21, Identity=22%"; Hit description =Putative salt-inducible protein
  Pfam annotation: Domain name=PPR; Domain location=170-204; Score =22.7; E_value=0.0013; Accession=PF01535.11; Description=PPR repeat
  Pfam annotation: Domain name=PPR; Domain location=211-245; Score =15.5; E_value=0.11; Accession=PF01535.11; Description=PPR repeat
  Pfam annotation: Domain name=PPR; Domain location=246-280; Score =39.5; E_value=1.1e-08; Accession=PF01535.11; Description=PPR repeat
  Pfam annotation: Domain name=PPR; Domain location=409-443; Score =19.8; E_value=0.01; Accession=PF01535.11; Description=PPR repeat
  Pfam annotation: Domain name=PPR; Domain location=451-485; Score =16.6; E_value=0.08; Accession=PF01535.11; Description=PPR repeat
  Pfam annotation: Domain name=PPR; Domain location=486-520; Score =19.9; E_value=0.0089; Accession=PF01535.11; Description=PPR repeat
  Pfam annotation: Domain name=PPR; Domain location=521-555; Score =32.2; E_value=1.8e-06; Accession=PF01535.11; Description=PPR repeat
  Pfam annotation: Domain name=PPR; Domain location=556-590; Score =15.9; E_value=0.098; Accession=PF01535.11; Description=PPR repeat
  Pfam module annotation: Pfam domain module=PPR::PPR::PPR::PPR::PPR::PP R::PPR::PPR; Domain location=170-204::211-245::246-280::409-443::451 -485::486-520::521-555::556-590
PKLGIILKPHKSHVGDLAPPLGWALEEDGVGSELVDEQIDSNDASVNRESEGVKSLNLDQVQDSDFEGQIRGYDDDSKESGGNELVEEQTDSNDALVNGDLEGVKSLNLDQVKDSDCEGKMCGDDNSKEGGEEESDGKVDVRALALSLQTVKTVEDVGGILKDKGDLPLQVFSTIISGFGKEKRMDSALILFNWMKKRKIETNGSFGPNLFIYNGLLGVVKQSGQFAEMEVILNEMAEDGIAYNVVTYNTLMAIYIEKGECDKALNMLEEIRRNGLTPSPVSYSQALLAYRRMEDGYGALNFFVEFREKYRQGEIGKDDDGEDWEKECLKLEKFTIRVCYQVMRCWLVSRDNLSKNVLKFLVDMDNVGIPLPRADLERLAWACTREDHYIVVKELYNRIRERYDKISLSVCNHAIWLMGKAKKWWAALEIYEDLLDKGPKPNNLSYELIVSHFNFLLSAAKRKGIWRWGVKLLNKMEDKGLKPGCREWNAVLVACSKASETTAAVQIFKRMVENGEKPTIISYGALLSALEKGKLYDDALRVWNHMIKVGVEPNAYAYTIMASIHTAQGNFNRVDAIIQEMVTLGIEPLQMMESQGWHISYIRELKTKALPSLRKLTTQLSNPLRLIMQPLN

SEQ ID NO: 221037 - protein, 529 aa, Glycine max
  Coding DNA Sequence Number=SeqID_104259
  Gene Ontology: Mol. function=zinc ion binding
  Homolog annotation: Hit_ID=Q1SP42; Match level="QueryCoverage=95%, HitCoverage=95%, E-value=1e-153, Identity=58%"; Hit description=Zinc finger, RING-type; RINGv
  Subcellular localization annotation: CTP_CleavageSite=31; ConfidenceScore=5.44e-01
MGSSSSRLGSRPSSSSSHSHRVNRFRLSSLLCGTSTSRSVHQLFIGDQAIELDLWLVILSKYRLLGKMEELSAELRVDSARDFDGEIQKDTEESSLSYTEARISSSRPAETATLSDMRTEFHGNTSVEGSSRNVATNSQRNCLSEHEELVPPYQVSAGHTGHESYSDSSNTASTSFVEQQSSDPVSVNVSANKDLVNDVNNPVVSDVSQVSHETMRPRSSTPQEHGNFGSGEISVENHTSAFISIQNSSSPVAQVSNLAATSQLPEDEPRRETIPSGLGILVSNRERGPGNDSVLQVDVVTISSNILSGSSADANDNDARRNGRRLFWDAFSRRSSRRLGDSPTIVFSAGGADDSGSQDRWLVDFGGDLSNDGVGGASGYTGSRIHRLNERRMQHSRSEIWERLRGGFDEIGRWNSCPLGLHADGMCSCESSPMAEESSTQASISRIIMLAEALFEVLDEIHRQPGSLSLSMVSLPAPESVVDSLPLKSHKKVDVAHGGNDAEHVCPLCRGNVCGGFTESSANSEVQSH

SEQ ID NO: 221038 - protein, 751 aa, Glycine max
  Coding DNA Sequence Number=SeqID_104260
  Gene Ontology: Mol. function=translation elongation factor activity; Cellular component=ribonucleoprotein complex; Biological process =translation
  Homolog annotation: Hit_ID=Q1SP45; Match level="QueryCoverage=99%, HitCoverage=75%, E-value=0.0, Identity=93%"; Hit description =Translation factor; Elongation factor G, III and V
  Pfam annotation: Domain name=EFG_C; Domain location=594-693; Score =102.9; E_value=9.7e-28; Accession=PF00679.14; Description=Elongation factor G C-terminus
  Pfam annotation: Domain name=EFG_IV; Domain location=471-592; Score =95.0; E_value=2.3e-25; Accession=PF03764.8; Description=Elongation factor G, domain IV
  Pfam annotation: Domain name=GTP_EFTU; Domain location=1-210; Score= -58.2; E_value=0.005; Accession=PF00009.17; Description=Elongation factor Tu GTP binding domain
  Pfam annotation: Domain name=GTP_EFTU_D2; Domain location=260-334; Score=40.3; E_value=6.6e-09; Accession=PF03144.15; Description =Elongation factor Tu domain 2
  Pfam module annotation: Pfam domain module=EFG_C::EFG_IV::GTP _EFTU::GTP_EFTU_D2; Domain location=594-693::471-592::1-210::260-334
MVNTERAIRHAIQERLPIVVVINKVDRLITELKLPPKDAYHKLRHTLEVINTHISAASSIAGGVQVVDPVAGNVCFASATAGWSFTLQSFAKLYGKLHGIPLEANKFASRLWGDYYFHPDTRTFKKKPPASGGERSFVEFVLEPLYKIYSQVIGEHKKSVETTLAELGVTLSNAAYRLNVRPLLRLACSSVFGPASGFTDMLVQHIPSPRDAAIKKVDHIYTGPKDSSIYKAMAQCDSYGPLMVNVTKLYPKSDCSVFDAFGRVYSGKIQTGQAVRVLGEGYSPDDEEDMTVKEVTKLWVYQARDRMPVAEAPPGSWVLIEGVDASIMKTSTLCNVDYDEDVYIFRPLQFNTLSVVKTATEPLNPSELPKMVEGLRKISKSYPLAVTKVEESGEHTILGTGELYLDSIMKDLRELYSEVEVKVADPVVSFCETVVESSSMKCFAETPNKKNKITMIAEPLERGLAEDIENGVVSTDWSKKKLGEFFQTKYDWDLLAARSIWAFGPDKQGPNILLDDTLPTEVNKDLMNAVKDSIVQGFQWGAREGPLCDEPIRNVKFKIVDAKIANESLHRGSGQIIPTARRVAYSAFLMATPRLMEPVYYVEVYALPTIMMAIQTPIDCVSAIYTVLSRRRGHVTADVPQPGTPAYIVKAFLPVIESFGFETDLRYHTQGQAFCMSVFDHWAIVPGDPLDKSIVLRPLEPAPIQHLAREFMVKTRRRKGMSEDVSINKFFDEAMMVELAQQAADLHQQMM

SEQ ID NO: 221039 - protein, 355 aa, Glycine max
  Coding DNA Sequence Number=SeqID_104261
  Gene Ontology: Mol. function=steroid hormone receptor activity; Cellular component=nucleus; Biological process=regulation of transcription, DNA-dependent
  Homolog annotation: Hit_ID=Q2HU72; Match level="QueryCoverage=79%, HitCoverage=36%, E-value=4e-33, Identity=60%"; Hit description =Steroid nuclear receptor, ligand-binding
MLYCTREELRVGFYVRSMILNLTYHCSNCEMPINSVISLTDRAKQFGPILKLVIGLCVLPVLLVVYPIVGILGSIVGGAAYGFLSPIFATLEAVEEGKDDKFYHCFIDGTWSTVEKSCMVVRDVNDVCFHSYFSVMDDLRQKGPPNAKYYEISAGKHWCKTCDLGGHWFKTWKQSLQTTLSGGQAAYTYPPLTLLSWSLVLDTLMSLKHFSDYFCIYIQIQSFMLCRLLYIPGALIAAVIGIIVDLPIISFVALCKGPYMLFKGWHRLFHDLVGREGPFLETICVPFAGLAILLWPLAVAGAILASMLTSFFLGAYAGIVAYQAFYYLTAQCFSRLVAINKKANAKLWKQHWGFG

SEQ ID NO: 221040 - protein, 588 aa, Glycine max
  Coding DNA Sequence Number=SeqID_104262
  Homolog annotation: Hit_ID=Q1RW57; Match level="QueryCoverage=13%, HitCoverage=31%, E-value=7e-22, Identity=69%"; Hit description =Ubiquitin
MKEHDSQGSGRTLGSSGILDSSHPRPEQAGLRILSDRLRNTFGTPAPVSLGSLQPPVIPDSLTTLSQYLRHISLEFDAIVREGRDNAEAAEAQRNEETRSVSSHLGSTPEGLSSPASLAEVLRSTRQMIDQQAGECLLQLSGQLENQANVTDPLLRSSIQSRALRTGVLFYNLGAFLLELGRTTMTLRLGQTSSEAVVNGGPAVFISPNGPNHIMVQPLPFQPGASFGAVPVGAAQSNSSLGSGLGSSFFPRRIDIQIRRGTSTTSSNTNQEERNETQSASVQRNSGESSVNQATSRRPDASIAGEPGVRLVPIRTMVAAAVPGTLGRLPSESSGNSIGLYYPILGRFQHVSSGHSNSEQGSQQSSQHHTVLPSTPESILQRQNTEDSARNGSLSTPSTRQEPSSSRVVNINILAASGPQNNQESERQIPSSVLQFLRTFFPGGEIHVEDSSVQGTTAGSALDHAATSRGAAPVPEAQPNVSEEGIFLSNILREIMPVISQQVGSEGNPSEDHMAQDSSTQVETDVGTSRRQSDSDPSPPNAKRQKREFHSPCSQTPMGTRGEYLQRCPDPRVSELQHGSLYNGNVSA

SEQ ID NO: 221041 - protein, 241 aa, Glycine max
  Coding DNA Sequence Number=SeqID_104263
  Gene Ontology: Biological process=protein modification process
  Homolog annotation: Hit_ID=Q1RW57; Match level="QueryCoverage=97%, HitCoverage=65%, E-value=7e-42, Identity=83%"; Hit description =Ubiquitin
  Pfam annotation: Domain name=ubiquitin; Domain location=23-92; Score =72.7; E_value=1.1e-18; Accession=PF00240.13; Description=Ubiquitin family
MGSTEKIPISAESSETTIEIKIKTLDSQTYTLRVDKQMPVPALKEQIASVTGVLSERQRLICQGKVLKDDQLLSAYLDVEDGHTLHLVVRQPDLPPPGSVSNHSASLGLTCKEDILSLKLFSVFPFSYKSMPGVKMDFLVGLVLLWFTSMPHPNENFPLVQRDKVFTDLHAYLHFAVTELNSSTGLGHASQVAPGVFIETFNVPVQGDGVAPEINRIVSAILGSIGLPNFASGSEGGIDVR

SEQ ID NO: 221042 - protein, 109 aa, Glycine max
  Coding DNA Sequence Number=SeqID_104264
MKVKDKGDSTLILMHHGNGYVGFCRVVALRREGKEQSTWKSTSRDEVAQQSPRGHRNFTHVVAPLGCKKHIGGDVCLNLSCGTMDLPSFYSIHSTSSFKYSSNPSLGVD

SEQ ID NO: 221043 - protein, 145 aa, Glycine max
  Coding DNA Sequence Number=SeqID_104265
  Gene Ontology: Mol. function=chlorophyll binding; Cellular component =integral to membrane; Biological process=photosynthetic electron transport
  Homolog annotation: Hit_ID=P56777; Match level="QueryCoverage=100%, HitCoverage=38%, E-value=3e-60, Identity=60%"; Hit description =Photosystem II P680 chlorophyll A apoprotein
  Pfam annotation: Domain name=PSII; Domain location=1-145; Score= -92.4; E_value=1.7e-06; Accession=PF00421.9; Description=Photosystem II protein
MGLPWYRVHTVVLNDPGRLLSVHIMHTALVAGWAGSMALYELAVFDPSDPVLDPMWRQGMFVIPFMTRLGITNSWGGWNITGGTITNPGIWSYEGVACFGFGAFHVTGLYGPGIWVSDPYGLTGRIQSVDPAWGVEGFDPFVPGG

SEQ ID NO: 221044 - protein, 249 aa, Glycine max
  Coding DNA Sequence Number=SeqID_104266
  Gene Ontology: Mol. function=binding
  Homolog annotation: Hit_ID=O22161; Match level="QueryCoverage=58%, HitCoverage=15%, E-value=7e-08, Identity=32%"; Hit description=F-box protein family, AtFBX5
  Pfam annotation: Domain name=Arm; Domain location=126-172; Score =12.0; E_value=0.39; Accession=PF00514.13; Description=Armadillobeta -catenin-like repeat
  Pfam annotation: Domain name=Arm; Domain location=173-213; Score =13.9; E_value=0.22; Accession=PF00514.13; Description=Armadillobeta -catenin-like repeat
  Pfam annotation: Domain name=Arm; Domain location=84-125; Score=22.3; E_value=0.0017; Accession=PF00514.13; Description=Armadillobeta -catenin-like repeat
  Pfam annotation: Domain name=HEAT; Domain location=179-215; Score =17.1; E_value=0.066; Accession=PF02985.12; Description=HEAT repeat
  Pfam annotation: Domain name=HEAT; Domain location=95-127; Score=3.5; E_value=16; Accession=PF02985.12; Description=HEAT repeat
  Pfam module annotation: Pfam domain module=Arm::Arm::Arm::HEAT::HEAT; Domain location=126-172::173-213::84-125::179-215::95-127
MVMPVTAPSTPPLPCGTQNLDSHSDRFSDNLFRPWLCGIDAVTSTSSGLSDGYVALFVRMLGIDRDPLDREQAIVALWKYSLGGKKCIDTLMQFPGCINLVVNLLRSESNSACEAAAGLLRSLSSVNLYRNSVADSGAIEELNRLLRQSSLASEVWELVKEQSLSTLWNLSVDEKLCIKISKTEILPLAIRYLDDEDIKVKEASGGILANLASSRVNHNIMVEAGVIPKLVRLPLSIVIGRWFYFFNRK

SEQ ID NO: 221045 - protein, 597 aa, Glycine max
  Coding DNA Sequence Number=SeqID_104267
  Gene Ontology: Mol. function=binding
  Pfam annotation: Domain name=Arm; Domain location=114-154; Score =37.6; E_value=4.3e-08; Accession=PF00514.13; Description =Armadillobeta-catenin-like repeat
  Pfam annotation: Domain name=Arm; Domain location=239-279; Score=7.3; E_value=1.5; Accession=PF00514.13; Description=Armadillobeta-catenin -like repeat
  Pfam annotation: Domain name=Arm; Domain location=517-557; Score =14.5; E_value=0.19; Accession=PF00514.13; Description=Armadillobeta -catenin-like repeat
  Pfam module annotation: Pfam domain module=Arm::Arm::Arm; Domain location=114-154::239-279::517-557
MLPDGTEIERTSRQPSRYGASELLLGLNIDDKNANLEEAKVNAIVGRTQQQFLARVGALEMEQKTMPHSECSNDQRFTLLPWMDGVARLVLILELEDRFAIIKAAESIATACINEHMRIAFREAGAIKHLVRLLNCDDNSVQLAATQALERLSVSNIVCRVIEAEGVLGPLVSILKCSEIAGTILEKSLNILARILDPSKVMQLKFYDGPVNGSEKAFGGTKGDCVSTGFSSTEQAVSKTYTRNDILDSVFIAHLVEIMKSSPPSLQEKAATVLEFVALTDPTLAPIIFLDIESGLNSAFQQKILKISGPTVPGGPFCSAALLRAKQFWFLYHCSISSFSREQYHELLQAFIGGCRALLSPKRPHPLSLHLPAKQLVSYSDMVNQADMESDVEDQFSEAYAIEFEEAGLAIAAASRLLTRLLDHEQFRHKINSSQFIDLLRGILRSCIPLHNKKWVATCLVKLSSLSGSITSLYPINVEVTLYETIPRLLEQIKTSFSPEAQETAVVELNRIISEGVVDYTEAIISDEAIYSLVNLIEEGSDRAVEASLAILYNLSMDSENHSALVAAGAVQVLKRSVLANRPHWERALLLLRILQP

SEQ ID NO: 221046 - protein, 95 aa, Glycine max
  Coding DNA Sequence Number=SeqID_104268
MVTALTSTVDGDEAPSTVDDGVALHGNLLNAPHNLFTASSSSRQQWWLKKKNLFTGEVSKNNTKMAKVRKKKKETGYYGLFTSSAGCTNKNARCT

SEQ ID NO: 221047 - protein, 127 aa, Glycine max
  Coding DNA Sequence Number=SeqID_104269
MDEIEKVQEQMKADPEALKEKMATMVEAMMSIKEIVEVSAAYQTRARAKIMGEVEKVQEQIRANGRQRFGKYGRPPIMRKLKTSMPSHHMAGLPTIHHPTWHAFPMRISITPLPYSLKCLSTHGGDT

SEQ ID NO: 221048 - protein, 227 aa, Glycine max
  Coding DNA Sequence Number=SeqID_104270
  Gene Ontology: Mol. function=zinc ion binding; Cellular component =intracellular
  Homolog annotation: Hit_ID=Q6H889; Match level="QueryCoverage=55%, HitCoverage=54%, E-value=2e-63, Identity=84%"; Hit description =Putative zinc-binding protein
  Pfam annotation: Domain name=PLATZ; Domain location=118-227; Score =256.3; E_value=6.1e-74; Accession=PF04640.4; Description=PLATZ transcription factor
MAKSYHRSYIELKFQDKLNQESTCFTSLLGEIVFPKATPRTVRYHAKAKDHVKWELGKPHSKGKGLGVVAAISGMPYAQHIAPGTNFCTEWLNNSVWKGYQKPAWLEALYTQKFFVGCSYHENAKKNEKNVCCLDCCTSICPHCLPSHRFHRLLQVRRYVYHDVVRLEDLQKLIDCSNVQAYTINSAKVVFIKKRPQNRQFKGSGNYCTSCDRSLQEPFIHCSLGCK

SEQ ID NO: 221049 - protein, 333 aa, Glycine max
  Coding DNA Sequence Number=SeqID_104271
  Gene Ontology: Mol. function=serine-type endopeptidase activity
  Homolog annotation: Hit_ID=Q1RW49; Match level="QueryCoverage=92%, HitCoverage=80%, E-value=9e-36, Identity=47%"; Hit description=IMP dehydrogenase/GMP reductase
MAEGARAKNTTTTLVLAKERTRRKDLLNGFQRYTDGWNISNVYYLTSVMSTAVPFLSVAVACDDGYSKALHHLSLTLLIFCTIAAIGGCAVLYSGQGKFRESTSNTLDYVVNQAQLVAENLRNVTSYFDSAKQLVNGIPLPLDLGSNIDDAAKVRVITATDSLSKKAKENSRMIHKVIDGVRLALVIVAAVMIFVALLGLRPLVPLLCNPYNADFTSRQCAPGEVTFKNAIEVWKNYTCQASSSEQCTNEGRLTPKIYNKLASAVNVTDGLFHYGPFFVDLVDCTFARKAFSEISNNYCPSLRRYTERVYLGTVVRAVAASSQLRCLARQRPS

SEQ ID NO: 221050 - protein, 118 aa, Glycine max
  Coding DNA Sequence Number=SeqID_104272
MEEIGERKKGRKWWKRREFPKEDFSGFGGHRPLCAHLALVPVFALRARLALVLVCALSACCVLSDSAFLHARRMQRAERAFGLGLMLSSLFLRHSYSFLLLVPPVFISTAKIWKNINS

SEQ ID NO: 221051 - protein, 110 aa, Glycine max
  Coding DNA Sequence Number=SeqID_104273
MLKERCLESVDFPGTKTVKNMPAFGATEEDLSGKQSSTSSYDNEEKISNTTSNSLNEPVEIIRSSHEEAPTNEIVNDVPEDLLSSVNTENPDIKSESLGALLKSRNTGLS

SEQ ID NO: 221052 - protein, 318 aa, Glycine max
  Coding DNA Sequence Number=SeqID_104274
  Homolog annotation: Hit_ID=Q1SH12; Match level="QueryCoverage=92%, HitCoverage=100%, E-value=1e-71, Identity=54%"; Hit description=C2; Sterile alpha motif homology
MTTSNLSISYHIGTTPSSSSSSMDWFSWLSRTTLEPSLIYDYGLTFARNELQLEDACYFNHEFLQSMGISIAKHRLEILKLVKKQEGGGAARPNKKLSGVIKKCLRKCMNKFVVSHDHHAVKHMPCSMVNVSVPPPLPPPPHEISWYHQGKLKGSLVRKQQQGSEELKEEKKEKPFPVPPIYRSRTIALSGPLEYGGRMHHEKMVHSRALKLSGPLDGRMHERMMMMNSTNSRTPLMPGPLDARFVATTKSPRVSGPLDPRVLVENRSPRLPRPSDAARAETESPMGYSPYNKPKADFDFDDDDHTLWPSLFQDLKPT

SEQ ID NO: 221053 - protein, 123 aa, Glycine max
  Coding DNA Sequence Number=SeqID_104275
MDDDEVMSRETNKVEFMGLGASATIDLEENTKGKRQGSTSFDTQSHKRRMGEKEGITASLDKMTNSFDRMIEKMDGKVDDEDIQEVLRETALIPDLNRQQWDKAIKWSGDNPKQLAIVKALPI

SEQ ID NO: 221054 - protein, 571 aa, Glycine max
  Coding DNA Sequence Number=SeqID_104276
  Homolog annotation: Hit_ID=Q1SH13; Match level="QueryCoverage=99%, HitCoverage=99%, E-value=0.0, Identity=67%"; Hit description=Nodulin- like
  Pfam annotation: Domain name=MFS_1; Domain location=79-496; Score =8.1; E_value=0.00013; Accession=PF07690.6; Description=Major Facilitator Superfamily
  Pfam annotation: Domain name=Nodulin-like; Domain location=11-258; Score=420.5; E_value=2.3e-123; Accession=PF06813.4; Description =Nodulin-like
  Pfam module annotation: Pfam domain module=MFS_1::Nodulin-like; Domain location=79-496::11-258
MLRVKGGKRPPWVGLGAAVWVQIASGNGYCFPLYSHSLKSVLGFNQSQITLLGVANDIGENVGILPGLACNKFPPWLILFIGALFSFLGFGVLWLAITKTLDSLPFILLWFALAVATNSCAWLSTAILVTNMRNFPVSRGTVAGILKGYSGLSAAVFTQIYSVVFHNSSSKFLLFLAIGIPALCFSTMFLVRPCTPASGDDSAEKGHFLFIQGASVAMGLYILATTLLDNFIHIRDSVSYALLAVMILLLLAPLVIPIKMTLCPRKASSTEIPEEHVGSTDYLVQDGKDNVEPLLSSSSASGLGSFNDVVDGSAEVAMLLAEGEGAVRKKRRPKRGEDFKFTEALVKADYWLLFFVYFVGVGTGVTVLNNLAQIGIAQGMEDTTILLSLFSFFNFVGRLGGGVVSEYFVRTKTIPRTIWMTCTQIIMIFLYLVFAYAIKGTLYPAIAVLGICYGVQFSIVIPTVSELFGLKDFGLLSNFMALGNPLGAFLFSALLAGHIYDNEAAKQHGVGLIASSVACMGPNCFKLTFFTLAGVCIAGTISSIILTIRIKPVYQMLYAGGSFKLPQTSGH

SEQ ID NO: 221055 - protein, 214 aa, Glycine max
  Coding DNA Sequence Number=SeqID_104277
  Homolog annotation: Hit_ID=Q8H6R2; Match level="QueryCoverage=64%, HitCoverage=76%, E-value=1e-38, Identity=59%"; Hit description=CTV.15
  Subcellular localization annotation: CTP_CleavageSite=72; ConfidenceScore=5.89e-01
MAAASRKPRSAVIGSLSSTPRFCNSHSTSSSSSSSAFASSTSSFTSRSSSFFHRSCSPTRVNLYGSTAPSVRFSLDRSVSPNRSISVAPRTGASRQSSSPHHQQKRTCMCSPTTHPGSFRCSLHKKSHAPAPYSPHRLNARRSAMTNSLVRIRGVEGDLVKRALAALIRPSSHQQRRRGDFYPRPSRLSVMSMAERGNISLVATGKWGGQHGTR

SEQ ID NO: 221056 - protein, 82 aa, Glycine max
  Coding DNA Sequence Number=SeqID_104278
MVEPQQQKVLKILHKENEIQTRKGGEYQERAVLGLIKEARSMLFSEKHLLGCQYPFHSTLVGFSGDCVVVWGFVKLQTKFGR

SEQ ID NO: 221057 - protein, 53 aa, Glycine max
  Coding DNA Sequence Number=SeqID_104279
MWSQNQWRPIISEAKEHGKLPAEYAVYILWFGSNQCCAAHATVLNKNEKDFRS

SEQ ID NO: 221058 - protein, 399 aa, Glycine max
  Coding DNA Sequence Number=SeqID_104280
  Gene Ontology: Cellular component=mitochondrion
  Homolog annotation: Hit_ID=Q2QZ53; Match level="QueryCoverage=53%, HitCoverage=55%, E-value=5e-21, Identity=30%"; Hit description =Expressed protein
  Subcellular localization annotation: CTP_CleavageSite=17; ConfidenceScore=5.02e-01
MAKKRKPKKKPQNHNVNQSQNVAALIWRVTHSAESFLSQNDLVLLPSQSLRLESLISSIISHSPSPPLSPPHRDSWFSRFRSVSDSQWLHAFRMLKPTFSHLLHLLSPSLAPSFPHIAPDCVLAAALFRLAHAAPYPAVSRRFAISPADACRAFFAVCKALADNLGHLFELRTDSQRVVVGFGFSSLPNCFGVLGFARFKIDDSLLGENGALMVQALVDSEGRFLDVSAGWPSTMKPETILRETKLYREVEESKELLNGPSYNLSEGCLIPQYILGDSCFPLLPWLLTPYNRVNEEDSFGSAERAFNTAHDNAMGLLGDAFARLRASWRLLAASRKWKRDCVEHLPFVLVAGCLLHNFVLKFNEAMPDEGVEKEEGLPSFDGVEDESAVRVRDALALHL

SEQ ID NO: 221059 - protein, 541 aa, Glycine max
  Coding DNA Sequence Number=SeqID_104281
  Gene Ontology: Mol. function=molecular_function; Cellular component =nucleus; Biological process=protein modification process
  Homolog annotation: Hit_ID=UPI0000D55C95; Match level="QueryCoverage =58%, HitCoverage=68%, E-value=4e-23, Identity=23%"; Hit description =PREDICTED: similar to CG15445-PA, isoform A
  Pfam annotation: Domain name=UBA; Domain location=288-327; Score =36.4; E_value=9.6e-08; Accession=PF00627.21; Description=UBATS-N domain
  Pfam annotation: Domain name=UBA; Domain location=348-383; Score=1.2; E_value=3.1; Accession=PF00627.21; Description=UBATS-N domain
  Pfam annotation: Domain name=ubiquitin; Domain location=3-77; Score =3.9; E_value=0.1; Accession=PF00240.13; Description=Ubiquitin family
  Pfam module annotation: Pfam domain module=UBA::UBA::ubiquitin; Domain location=288-327::348-383::3-77
MVKLKIGGMWIGILEVELETWSIRMLREEVAKRSNCNPNSVNLICAGKILKDGDGQHNLTQLGIKNNAKILATRICVEQGKAIKQEIMAEEEHSHKLARVKAAAIAVAKRHVDDLLPIENFTTEVEGQMGKKIKLASETDHQRAIMTGLVLEANGKRLIRQGKYKDALEVLSMAEETFSLCDDSDTLELIDIIPIMQINMVWCYFMMQDISSLSEAGKLLAKAREGLEDAYGKHALRARLLKSGCFLELAWHLRLELLEGVVAYYSGQLDTAREALLSAQAKFEKLQVSDEDLSLVMSMGFTKCDAKRALKMNLQNIQAAVNFLIEENAEKDQKQKERESEIRKQKPVDLQRLNELESVGDIAAEALRRNGNVFQKALNDLTHPETFSALQAYIESEKGKIVEEIRTSAALAATEADPNIIQFETMGGRMTTARVSRVTDANMQREVNPSGGASSSSSSLPPQINAFVCDLQDPSNKSEAQKRDVEMEDELSADIAESSDALADYDIEVDIEGAAITEYLSLVETAAGGRRKEEEENYSVE

SEQ ID NO: 221060 - protein, 259 aa, Glycine max
  Coding DNA Sequence Number=SeqID_104282
  Gene Ontology: Mol. function=calcium ion binding; Cellular component =intracellular; Biological process=defense response
  Homolog annotation: Hit_ID=Q1SH11; Match level="QueryCoverage=89%, HitCoverage=48%, E-value=4e-91, Identity=72%"; Hit description =Calcium-binding EF-hand
  Pfam annotation: Domain name=efhand; Domain location=199-227; Score =25.9; E_value=0.00015; Accession=PF00036.22; Description=EF hand
  Pfam annotation: Domain name=efhand; Domain location=91-119; Score =12.5; E_value=0.56; Accession=PF00036.22; Description=EF hand
  Pfam module annotation: Pfam domain module=efhand::efhand; Domain location=199-227::91-119
MKTDKCFWTSEYFKKEFVNREIVKQEFKKMMALMRSQNRQGANHRDGRRLGVTASIENGGNKCLQHERFVQFLRQLHDEKCFNGVLSVGVILRLEFSHYDYNKKGTISAKDFALSLVASADINHINKLLDRVEELNSVQNLRDKRITFKEFQDFAELRKKLHSFSLAIFSYGKVNGVLTKSDFQRAASQVCGVCISDEVVDIIFHVFDANRDGSLSASEFVRVVQRRENNNSSRHGGFGGLISCWWNCVKNCSSAKLQF

SEQ ID NO: 221061 - protein, 495 aa, Glycine max
  Coding DNA Sequence Number=SeqID_104283
  Gene Ontology: Mol. function=catalytic activity; Cellular component =endoplasmic reticulum; Biological process=protein transport
  Homolog annotation: Hit_ID=Q9LTZ8; Match level="QueryCoverage=90%, HitCoverage=38%, E-value=1e-152, Identity=62%"; Hit description =Similarity to negative regulator of vesicle formation
  Pfam annotation: Domain name=PGAP1; Domain location=79-378; Score =395.3; E_value=9.3e-116; Accession=PF07819.3; Description=PGAP1-like protein
MPGFRGKIRIGILIIVVVGICLAALYGLLKPISNGCIMTYMYPTYIPISSSESISPVKYGLYLYHEGWKKIDFKEHLKKLSGVPVLFIPGNGGSFKQARHKSAYLACFFQSLRYAHFLAKVRSLAAESDRAYQNGPLERTFYQEASLRPEEGGVDINLSGFQLPSQYTSRLDWFAVDLEGEHSAMDGAILEEHTEYVVYAIHKILDQYKVSYDARTREGAAVSGSLPKSVILVGHSMGGFVARAAVIHPHLRKSAVETVLTLSSPHQSPPVALQPSLGRYFARVNSEWIEGYKVQTTNTGHYVSDPVLSHVVVVSISGAYNDYQVRSKLTSLDNIVPPTHGFMIGSTAMKNVWLSMEHQAILWCNQLVVQVSHTLLSLIDSRTGQPFPDTQKRLAVFARMLRSGISHNFDWMMQLPSYKRSLNIPAQNTKDVTGSLVHRPVACPANIHWNDGGLDRDLYIQINELTVLAMDAVTYVSNGQQSHEEVLKVYMRRKG

SEQ ID NO: 221062 - protein, 433 aa, Glycine max
  Coding DNA Sequence Number=SeqID_104284
  Gene Ontology: Mol. function=catalytic activity
  Homolog annotation: Hit_ID=Q67TV0; Match level="QueryCoverage=94%, HitCoverage=36%, E-value=1e-83, Identity=41%"; Hit description=GPI inositol-deacylase PGAP1-like protein
MPYYQISDYLAFCYWQWQVDPHCSYKSSISISVSAAASRFLLLYSPKIVGFSIAVVFFALMRQACSWDLDLRIPSMLTAVESNLTLISHFFPLAILPIFFSLFLLLLMSQPLPPFASFISISLICYIFANGFIAILILISHLVFFVAAVTHIFIKTRWQMWERNVSFFFLRWFVNHSSSFFSLKVVRVLRANPVIVMAVTAMVLASLVHPSFGLLILLFSHFLCCHNALCSSFLTASCRNHEQNNENFDCNSEDYMGSERLKFKFDGSFKRTFPSEDNYSNSPDSSKSFGDTQLDLFHHRHGLLILHLVATMMFAPSVAAWFQRLALGESLPWLLDSVLCIGVILHGICNSKPEFNSFFLSYTGIPICNVRLYFIYLIAGYWSYFSGLTLAPYSAFYVMGAVGGISFALRMSRRRNGEEKEVTYSSRKHSHRH

SEQ ID NO: 221063 - protein, 85 aa, Glycine max
  Coding DNA Sequence Number=SeqID_104285
MAGEPPETANMDQMEEEVEDEAQQEPVHQWSHFEPFTIHKMDAMLHLHQEHSIDVHSTLENITTRLENIETKLTLSNLLNPDEDE

SEQ ID NO: 221064 - protein, 158 aa, Glycine max
  Coding DNA Sequence Number=SeqID_104286
  Subcellular localization annotation: CTP_CleavageSite=43; ConfidenceScore=5.04e-01
MPYFYVFSPTMLDRLASGSPGPSNNFMVKKLACLGELVASGLRGSKVQKWRELREERKKKKKKEEGTKPRCYRIAIVGVEVDLLSCWISDSLDNSEVSSRVFLSWGVATYPSKGGRCETHGCVFQGRKMRGVATNIYLKKTEGISTLRVRHKGRQPLI

SEQ ID NO: 221065 - protein, 78 aa, Glycine max
  Coding DNA Sequence Number=SeqID_104287
MGGGPPAMVEREKFDHIEERMRVIEGGRNYAFADMAELCLVPDMVIPPKFKVSDFDKESLIGAAITWYTCLEPSRVRS

SEQ ID NO: 221066 - protein, 191 aa, Glycine max
  Coding DNA Sequence Number=SeqID_104288
MKSGYYQALKKDNHEEAFSSVILENFWKKLWQIKSIPKCTHFAWRACMDILPEENTGQALLYCEEVRRTWFASSLGGNQWVFHNKKFQQVQETLSKASSIQLPSESVLHRPGFKPKSWIHLPKGFIKANFDASTGLGVLFRDQSGEILAAASLLLPHCHDPLTVETIAFSSGNYLDDILKDCSRLGGSHLT

SEQ ID NO: 221067 - protein, 100 aa, Glycine max
  Coding DNA Sequence Number=SeqID_104289
VFPTCVDEILLKTWPVRFKFRSQLRQSSVLDVSEELHHIQSLIAILGLKPPLPQSSDYDPGNSTCLTPTKRISCQQSSSDFDSDEHAQYQLSTNKHIKAE

SEQ ID NO: 221068 - protein, 385 aa, Glycine max
  Coding DNA Sequence Number=SeqID_104290
  Gene Ontology: Mol. function=metal ion binding; Cellular component =integral to membrane
  Homolog annotation: Hit_ID=Q9LTZ6; Match level="QueryCoverage=97%, HitCoverage=98%, E-value=1e-68, Identity=41%"; Hit description =Arabidopsis thaliana genomic DNA, chromosome 3, TAC clone:K1G2
  Pfam annotation: Domain name=zf-C3HC4; Domain location=175-213; Score= 37.4; E_value=5e-08; Accession=PF00097.15; Description=Zinc finger, C3HC4 type (RING finger)
MENKRMVTNEEQRRSPRNQKILPLADYNGQNLATLFSPRFKSAAAMAGWDEEALLLASLFVEDTPDRDPKHKKRYVWHSKTPPNSSRKRRALRSPQAPIPVVLDLDAEETPRKDSGRKNKEMKVCVDNEGKKACVENEGSRVGGDGNESKEKNSADASSSSVLPCIDKLRDELSCAICLEICFEPSTTPCGHSFCRKCLRSAADKCGKKCPKCRQLISNGRPCTVNTVLWNTIQLLFPQEVEARKEASALNSLQQAQNLSPESAFFANLRNDRRQPFRGASTTTSSTQQDEDAALARMLQRQIDEQRSPGTTRTRFARLRARRGGVSTSQHEDAALALRMRREEFMQTYRGSSQSSRLPSSLLAREKLRAMVSRAMNRREDLRQG

SEQ ID NO: 221069 - protein, 91 aa, Glycine max
  Coding DNA Sequence Number=SeqID_104291
MAPPKEIVTIIYHNGHIVDNPVQGSMYTSANPIFFLPQLFENDDIRGAMETILQNPQLNSVEFYAVTDLILQSQPLSPQPSCQQLQLPPPQ

SEQ ID NO: 221070 - protein, 444 aa, Glycine max
  Coding DNA Sequence Number=SeqID_104292
  Gene Ontology: Mol. function=calpain activity; Cellular component =intracellular; Biological process=proteolysis
  Homolog annotation: Hit_ID=Q6JE33; Match level="QueryCoverage=84%, HitCoverage=93%, E-value=1e-22, Identity=27%"; Hit description=S3 -locus linked F-box protein
  Pfam annotation: Domain name=F-box; Domain location=3-47; Score=33.9; E_value=5.5e-07; Accession=PF00646.23; Description=F-box domain
MEPHLPQELVSNILSRLPAIDLVKCKSVCKSWFDLITDSHFVSNYYVAYNNLKHYQSQEEKLLVIGRPFVSALKTHISLLSCNTNNPKKNHVSSSLSNLPCEYNNSEHKYWSEISGPCNGIYFLEGNPNVLMNPSLGQFKALPKSHLSASQGTYSLTEYSGFGFDLKNNDYKVVVIRDIWLKETDERKQGHWTAELYSLNSNSWRKLDDASLPHPIEIWGSSRVYTYANNCYHWWGHDVDESGVKEDAVLAFDMVNDSFRKIKVPIIRGSSKEEFATLAPLKESATIGVVVYPLRGQEKSFDVWIMKNYWDEGSWVKQYTVEPIEAIYKFVGFYGSNQFPWSSCNEGLGWYDYEPATEKIKDLQVWGNNGSLRAARYMEMPPPLLWHPPHCRLQLPPQGHHEDCRCPHRHGRPIELSNLNSLVKSASTSLNNKVITIRKYTFNI

SEQ ID NO: 221071 - protein, 74 aa, Glycine max
  Coding DNA Sequence Number=SeqID_104293
  Homolog annotation: Hit_ID=Q1SDX8; Match level="QueryCoverage=68%, HitCoverage=11%, E-value=2e-07, Identity=54%"; Hit description =RabGAP/TBC
MVLSSLSSCHHHLATVNLSKKVVDMSELWSLVCQGVPDATGICSTLWKLLLGYLLPNCGLWSTELAKKLAITVQ

SEQ ID NO: 221072 - protein, 255 aa, Glycine max
  Coding DNA Sequence Number=SeqID_104294
  Gene Ontology: Mol. function=protein serine/threonine kinase activity; Cellular component=cytoplasm; Biological process=protein amino acid phosphorylation
  Homolog annotation: Hit_ID=Q9LSH3; Match level="QueryCoverage=54%, HitCoverage=13%, E-value=6e-31, Identity=45%"; Hit description=Ser -Thr protein kinase-like protein
MRQPIEDEARFLDHKKDYPSDNEKGTGHGNLPDPQESSLAKHEEEDQCFAEEDSYLSGKEHIQQKNVEPVTASYDHIGQTMEPVRKSSTTHKNDAIRLGDGKVMDHSGRSRIKDMEDDQHGSVRSIRVGINNDVADIGNEVHGSLVGGSRVVESMNHKGHSHSHGKEWRVVEPWRAMERDENDKPFGYPSAPAKWNAKKPRGTQRSQPQSWKRMESCGECEPWRGMERDENDKPFGYPSAPGWKTVHVCHMSPIQ

SEQ ID NO: 221073 - protein, 144 aa, Glycine max
  Coding DNA Sequence Number=SeqID_104295
MWLKGVKTPVFLLEIAMNALSAPAAHSLFITTVKFLDLQMIALTWPVRLSATMLLLVNPLNKARRAQCAKPECHSSEAELSTPCCAKPRPSSVLKNCRLRLSPTCCAKPNLQKNIFCVFRLSASLLRLAHEQNFIRHTKPSLLR

SEQ ID NO: 221074 - protein, 341 aa, Glycine max
  Coding DNA Sequence Number=SeqID_104296
  Gene Ontology: Mol. function=acyltransferase activity; Cellular component=integral to membrane; Biological process=positive regulation of I-kappaB kinase/NF-kappaB cascade
  Homolog annotation: Hit_ID=Q52T38; Match level="QueryCoverage=88%, HitCoverage=45%, E-value=1e-106, Identity=62%"; Hit description =Palmitoyltransferase TIP1
  Pfam annotation: Domain name=zf-DHHC; Domain location=65-127; Score =82.9; E_value=9.9e-22; Accession=PF01529.11; Description=DHHC zinc finger domain
MDGRKGYADLQRGRGTCRSTGLAVMATKVMAEHKDPGYIRMNMHDNQDTKDDEPLLKIEINNPALLAGNWSQLCATCKIVRPLRAKHCSTCDRCVEQFDHHCPWVSNCIGKKNKWDFFVFLVLEVLAMLVTGGVCLTRVLTDPLAPHSFGAWIQYVANNHIGAISFLIADFFLFFGVFTLTVVQASQISRNITTNEMANAMRYSYLRGPGGRFRNPYDHGIKKNCSDFLINGYNEDVECIEELGNSEEGIGMMHMARSSNLANGDSHTHTEYARGNGNGHHAINVDSNSNSTNSKIHHGHINGHVHSSHCSHNNHGKTRNDNVPLGLGLGLGRNRSVTASS

SEQ ID NO: 221075 - protein, 96 aa, Glycine max
  Coding DNA Sequence Number=SeqID_104297
MKPREGHRKWTTQLGFKGENKTPEFGKRNKLIWVTNYGKKLQTLQGKRKHDEAARKFGMEENQVVLFFCNVEECFFISLTLTPQKAFEKNHITRVS

SEQ ID NO: 221076 - protein, 382 aa, Glycine max
  Coding DNA Sequence Number=SeqID_104298
  Gene Ontology: Mol. function=protein binding; Cellular component=SCF ubiquitin ligase complex; Biological process=ubiquitin cycle
  Homolog annotation: Hit_ID=Q1SH09; Match level="QueryCoverage=93%, HitCoverage=77%, E-value=1e-152, Identity=55%"; Hit description =Leucine-rich repeat; Leucine-rich repeat, ribonuclease inhibitor subtype; Leucine-rich ...
  Homolog annotation: Hit description=repeat, cysteine-containing subtype
  Pfam annotation: Domain name=LRR_1; Domain location=101-123; Score =3.8; E_value=55; Accession=PF00560.23; Description=Leucine Rich Repeat
  Pfam annotation: Domain name=LRR_1; Domain location=132-154; Score =10.1; E_value=3.7; Accession=PF00560.23; Description=Leucine Rich Repeat
  Pfam annotation: Domain name=LRR_1; Domain location=156-178; Score =13.5; E_value=0.78; Accession=PF00560.23; Description=Leucine Rich Repeat
  Pfam annotation: Domain name=LRR_1; Domain location=180-202; Score =2.9; E_value=81; Accession=PF00560.23; Description=Leucine Rich Repeat
  Pfam annotation: Domain name=LRR_1; Domain location=204-226; Score =6.3; E_value=19; Accession=PF00560.23; Description=Leucine Rich Repeat
  Pfam annotation: Domain name=LRR_1; Domain location=228-250; Score =4.5; E_value=41; Accession=PF00560.23; Description=Leucine Rich Repeat
  Pfam annotation: Domain name=LRR_1; Domain location=28-51; Score=1.5; E_value=1.5e+02; Accession=PF00560.23; Description=Leucine Rich Repeat
  Pfam annotation: Domain name=LRR_1; Domain location=300-323; Score =9.2; E_value=5.4; Accession=PF00560.23; Description=Leucine Rich Repeat
  Pfam annotation: Domain name=LRR_1; Domain location=325-347; Score =5.4; E_value=28; Accession=PF00560.23; Description=Leucine Rich Repeat
  Pfam annotation: Domain name=LRR_1; Domain location=349-376; Score =7.6; E_value=11; Accession=PF00560.23; Description=Leucine Rich Repeat
  Pfam annotation: Domain name=LRR_1; Domain location=53-75; Score =13.1; E_value=1; Accession=PF00560.23; Description=Leucine Rich Repeat
  Pfam annotation: Domain name=LRR_1; Domain location=77-99; Score=5.1; E_value=31; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=101-123::132-154::156-178::180-202::204-226::228-250::28 -51::300-323::...
  Pfam module annotation: Domain location=325-347::349-376::53-75::77-99
MEDENDLPMKGYQQELIPGPLSQGCLKKLEYLNIGCCKCVMDSDMKSISELINLKELQISNSSITDIGITYLRGLKMLTTLNVEGCNITAACLEFIHALASLACLNLNRCGLSDDGFEKISACTPFPAGLKNLKRLSLAFNRITDACLVHLKGLTNLEYLNLDYCRIGDDGLANLTGLTLLKSLVLSDTDIGNSGLRHISGLKKLEDLNLSFTTVTDHGLKRLSGLTQLKSLNLDARQITDAGLANLTSLSGLIALDLFGARISDNGTTFLRSFKILQSLEICGGGLTDAGVKNIREIVSLTQLNLSQNCNLTDKTLELISGMTALRSLNVSNSRITNEGLRYLKPLKNLRTLTLESCKVTASEIKKLQSTDLPNLISFRPE

SEQ ID NO: 221077 - protein, 725 aa, Glycine max
  Coding DNA Sequence Number=SeqID_104299
  Gene Ontology: Mol. function=binding; Cellular component=thylakoid; Biological process=photosynthesis
  Homolog annotation: Hit_ID=Q6K378; Match level="QueryCoverage=99%, HitCoverage=96%, E-value=1e-112, Identity=47%"; Hit description =Tetratricopeptide repeat protein-like
  Pfam annotation: Domain name=PB1; Domain location=271-348; Score =49.5; E_value=1.1e-11; Accession=PF00564.15; Description=PB1 domain
  Pfam annotation: Domain name=TPR_1; Domain location=110-143; Score =23.5; E_value=0.00073; Accession=PF00515.18; Description =Tetratricopeptide repeat
  Pfam annotation: Domain name=TPR_1; Domain location=36-69; Score =21.0; E_value=0.0042; Accession=PF00515.18; Description =Tetratricopeptide repeat
  Pfam annotation: Domain name=TPR_1; Domain location=74-109; Score =6.6; E_value=0.87; Accession=PF00515.18; Description=Tetratricopeptid e repeat
  Pfam annotation: Domain name=TPR_2; Domain location=110-143; Score =21.6; E_value=0.0028; Accession=PF07719.7; Description =Tetratricopeptide repeat
  Pfam annotation: Domain name=TPR_2; Domain location=36-69; Score =24.2; E_value=0.00047; Accession=PF07719.7; Description =Tetratricopeptide repeat
  Pfam annotation: Domain name=TPR_2; Domain location=74-109; Score =5.8; E_value=6.9; Accession=PF07719.7; Description=Tetratricopeptide repeat
  Pfam module annotation: Pfam domain module=PB1::TPR_1::TPR_1::TPR _1::TPR_2::TPR_2::TPR_2; Domain location=271-348::110-143::36-69::74 -109::110-143::36-69::74-109
MGKKKKQVGEIEEDGKVGDSSPRAYDNDTMVFISMSQELKNEGNKLFQKRDLEGAILKYENALKLLPKNHIDVSYLRSNMAACYMQMGLSEFPRAIHECDLALQVTPKYSKALLKRARCYEALNRPDLALRDASTVVKMEPNNVMALEISEKVKSALEEKGLRVNDTIIELPPDYVEPPDALPPEKVSKEKRRKKKKSNKEEEKAPDDKILEKQTEEKFEEKKAEGSIVVVEKKINTSKKKKAKGKTNEKKTDIKEVIEERSNGRRNHVPKKSAKFIFGDDIRCAELPINCSLFQLREVIQDRFPSLGAVLVKYRDQEGDLVTITSDDELRWAEAGSNGSIRLYIVEATPEQDPLFEKFKVKEVEVVGVNIAPENGCVGKAKEIISSSCIEDWIIQFSKLFKNHVGFESDRYLDFHELGMKLYSEALEETVTSEEAQGLFDIAGDKFQEMTALALFNWGNVHMSRVRKKVYVTEDSSKEHLCEQIKSSYECALEEYAKAGEKYAAAIKIKSDFHEGFLALGLQQFEQAKLSWYHALSSNADLLTWPSTEVLHLYNNAEENMEKGMQIWKESEKQNLSKTSNSNDVRLHLQNMGLDGLFKNISLDELAAQEAHMGSQINLLWGTMLYERSFVEFKLGLPIWHESLEVAVEKFELAGASQTDIAVILKNHCSNNTAVDGLAFKIDEIVQAWNEMYKAKKWQSAVPSFRLEPLFRRRVSKTYHAFELA

SEQ ID NO: 221078 - protein, 525 aa, Glycine max
  Coding DNA Sequence Number=SeqID_104300
  Gene Ontology: Mol. function=hydrolase activity; Cellular component =membrane; Biological process=proteoglycan metabolic process
  Homolog annotation: Hit_ID=Q1RX76; Match level="QueryCoverage=99%, HitCoverage=100%, E-value=0.0, Identity=72%"; Hit description =Glycoside hydrolase family 79, N-terminal
  Pfam annotation: Domain name=Glyco_hydro_79n; Domain location=34-352; Score=563.8; E_value=1.8e-166; Accession=PF03662.4; Description =Glycosyl hydrolase family 79, N-terminal domain
MGSQIRLLGLCLWMYLACLSFIGVGAVYGREGEVLEGIVLVHGKTAIGRIDDDSICATLDWWPSQKCDYGKCSWGHASLLNLDLNNKILLNAVKAFSPLKIRLGGTLQDKVIYGTEDCRQPCTPFVLNANEMFGFTQGCLPMYRWDELNSFFQKAGVKVVFGLNALAGKSIKSGSAVGPWNYTNAESLIRYTVRKKYTIHGWELGNELCGNGIGASVAADQYAFDVGALRNIVENAYRGFEHNKPLVIAPGGFFDSDWFKEFISKSGKSVDVVTHHIYNLGPGVDDHITEKILDPSYLDGEANTFSSLKSIVQSSATSVKSWVGEAGGAYNSGHHLVSDAFVYSFWYLDQLGMSAVYDTRTYCRQSLIGGNYGLLNTSTFMPNPDYYSALLWHRLMGGRVLSTTFYGTKKIRTYAHCAKQSKGITILVLNLDNSTTVEVNVALKFNKLPYRRVGEPARREYHLTAPDRNLHSQTMLLNGKILSVNSAGEIPPLDPLYVNSRKPIIVGPLSIVFAHIPNVLLSACS

SEQ ID NO: 221079 - protein, 94 aa, Glycine max
  Coding DNA Sequence Number=SeqID_104301
METQTTSREKIAYLNNVNALKKKKKNKATGQGAKEKTTLQNGAGWKKKTKKRWIARCTGHRVAEEGRRSRNKKMKRGRRKTVWVVLNSLSSDGI

SEQ ID NO: 221080 - protein, 235 aa, Glycine max
  Coding DNA Sequence Number=SeqID_104302
  Gene Ontology: Mol. function=transporter activity; Cellular component= integral to membrane; Biological process=transport
  Homolog annotation: Hit_ID=Q1RX82; Match level="QueryCoverage=99%, HitCoverage=42%, E-value=8e-93, Identity=73%"; Hit description=Major facilitator superfamily MFS_1
MTQSWKTSLRELNGSLKEVPWKAFFQNRAVWAMIYAHFCENLVLVFLTVLTNGESNSPICMLCSEELNLNLTEAAWVSILPPLASIFVTGLAAQLADNLISRGVEATVVRKICQSIAFLSPAICMTLSSLDLGLPPWEIVGILTSGLALSSFALSGLYCTHQDMSPEYASILLGITNTVGAVPGIVGVALTGYLLDSTHSWSISLFAPSIFFYVTGTIVWLAFASSKPQSFSELN

SEQ ID NO: 221081 - protein, 339 aa, Glycine max
  Coding DNA Sequence Number=SeqID_104303
  Gene Ontology: Mol. function=O-sialoglycoprotein endopeptidase activity; Cellular component=chromosome, telomeric region; Biological process=proteolysis
  Homolog annotation: Hit_ID=O49653; Match level="QueryCoverage=95%, HitCoverage=95%, E-value=1e-168, Identity=86%"; Hit description =Glycoprotein endopeptidase - like protein
  Pfam annotation: Domain name=Peptidase_M22; Domain location=26-291; Score=195.4; E_value=1.3e-55; Accession=PF00814.15; Description =Glycoprotease family
MKRMIALGFEGSANKIGVGVVTLDGTILSNPRHTYITPPGQGFLPRETAQHHLQHVLPLVKSALEVAQIAPQDIDCLCYTKGPGMGAPLQVSAIVVRVLSQLWKKPIVAVNHCVAHIEMGRIVTGADDPVVFEGRYRIFGETIDIAVGNCLDRFARVLTLSNDPSPGYNIEQLAKKGEKFIDLPYTVKGMDVSFSGILSYIEATAAEKLKNNECTPADLCYSLQETLFAMLVEITERAMAHCDTKDVLIVGGVGCNERLQEMMRIMCSERGGRLFATDDRYCIDNGAMIAYTGLLEFAHGASTPLEDSTFTQRFRTDEVKAIWREANLENLNGLAEKSI

SEQ ID NO: 221082 - protein, 207 aa, Glycine max
  Coding DNA Sequence Number=SeqID_104304
  Gene Ontology: Mol. function=transporter activity; Cellular component= integral to membrane; Biological process=transport
  Homolog annotation: Hit_ID=Q1RX82; Match level="QueryCoverage=80%, HitCoverage=33%, E-value=3e-54, Identity=65%"; Hit description=Major facilitator superfamily MFS_1
  Subcellular localization annotation: CTP_CleavageSite=66; ConfidenceScore=5.63e-01
MARLTLRPDNSCFFSHIQRAYSHTPFTRTTSFQRFHFHLSPSNHTLRLRIVSSSQQNAKETQRVSMAKAKAKVLTDLQVEEMEKQHETLSWNWPPWKNLPQRYKLIGTTSLAFVICNMDKVNLSIAIIPMSHQFGWNSTTAGLVQSSFFWGYALSQLPGGWLAKIFGGGKQEYNYGLMGSGPEGSNDLLSCKQGAGGDADIAKFAWD

SEQ ID NO: 221083 - protein, 98 aa, Glycine max
  Coding DNA Sequence Number=SeqID_104305
MNRILFSDGNKSGSQLKRGIPPLAEKILRGNIEDLLNDYIIEFDSSKISSHFGRKRAKFRIISIDKNNSKPGHKLMQQLPFCSSVDEDERKSDNSTET

SEQ ID NO: 221084 - protein, 69 aa, Glycine max
  Coding DNA Sequence Number=SeqID_104306
MGGGGTKAQVAIEAPICLLAMVGSICNWFGWRRFPWDWDRIKTCYCLQTASFACAVVRIYFQGLGSEHY

SEQ ID NO: 221085 - protein, 340 aa, Glycine max
  Coding DNA Sequence Number=SeqID_104307
PDCEGLPVCAPVLGLTWLFKCHVTYHIIFVDPRQYISPQALSSTCWRKRLSGVKGLYDVEGGSLDGKESVLYKMFYDDFALSDRYGVHLKRDISSPFLRNSMIDNLLGFDFNMVEGLADQSGISLPRAYLGFLKKCLPRADLGFPGTNLGFFEPLEKRDSPRADLEFDEPLEKQDSPRADLGFDKPLEKIDQGIVHPEFFRDSLKADLGFHKPLEKRDSPRTDLRFEELVERQPGIVHPGFWRESLRKHSSCQWFPNFDGDYDICVVCEPGFKDNPVSYLCLTIGLGMFDKSHKDVHPPHGKGSWGAQGVNSKCHPIVADMYNHGCQGTPPCLEATDSFM

SEQ ID NO: 221086 - protein, 117 aa, Glycine max
  Coding DNA Sequence Number=SeqID_104308
  Homolog annotation: Hit_ID=Q1T192; Match level="QueryCoverage=92%, HitCoverage=17%, E-value=2e-08, Identity=49%"; Hit description =Polynucleotidyl transferase, Ribonuclease H fold
  Subcellular localization annotation: CTP_CleavageSite=51; ConfidenceScore=5.24e-01
MVHPMSKEAGHASLSKALTTLLWSKPSSSTSKLLTIRPSTKHYLKLAKEVRAKKLRCYTDSQLMYHIRGENITRADLLSKLASTKKAGHLKTIIQETLQAPTIDTKEVMAREEAEPD

SEQ ID NO: 221087 - protein, 44 aa, Glycine max
  Coding DNA Sequence Number=SeqID_104309
MELRLMMVEINESNEVSTSRSTTIYMPLLHNILLEKQNIKVLDG

SEQ ID NO: 221088 - protein, 156 aa, Glycine max
  Coding DNA Sequence Number=SeqID_104310
  Subcellular localization annotation: CTP_CleavageSite=81; ConfidenceScore=5.04e-01
MLKQFLRKLPRKASKLNSDESCRADSSRSDDSPRVAGKNSHHPGDGGPSSTKKTSSSTVFPTKCNGSETVRMAQSLIVTCHAGTGWAVEDAEDKIMKRGQEAERRKEKETGAGGGERNRCGDVDMRQSTSELNGQRLIEVSGTNIAGFYKTGRSNS

SEQ ID NO: 221089 - protein, 126 aa, Glycine max
  Coding DNA Sequence Number=SeqID_104311
MYFYATSDHTFSFMVLFPFSQFFFTHYVDPITEEVESDTNTTFGSLVVQVEALAQALKDRTHAKKEARRWSLISDFFYKKAIGWKRPHSPMAPGSPVTLSFDSEDFGDEFLMKLDEEAARKRGEKM

SEQ ID NO: 221090 - protein, 82 aa, Glycine max
  Coding DNA Sequence Number=SeqID_104312
  Homolog annotation: Hit_ID=Q9AUH6; Match level="QueryCoverage=83%, HitCoverage=12%, E-value=1e-11, Identity=47%"; Hit description=F-box containing protein TIR1
KGGGAKAFTTRENKVMEGGVEEGEEGEVVVGEGHALECGGSRGEVSPLIQGHEVKVGEAGLTLDGQGSNTGKRVVARQGNTT

SEQ ID NO: 221091 - protein, 403 aa, Glycine max
  Coding DNA Sequence Number=SeqID_104313
  Gene Ontology: Mol. function=isomerase activity; Cellular component =intracellular; Biological process=proteolysis
  Homolog annotation: Hit_ID=Q6JE33; Match level="QueryCoverage=94%, HitCoverage=97%, E-value=2e-34, Identity=27%"; Hit description=S3 -locus linked F-box protein
  Pfam annotation: Domain name=F-box; Domain location=1-46; Score=27.1; E_value=6.1e-05; Accession=PF00646.23; Description=F-box domain
MEHLPRELVSNVLSRLPAKVLLLCKCVCNSWFDLITDPHFVSNYYVVYNSLQSQEEHLLVIRRPFFSGLKTYISVLSWNTNDPKKHVSSDVLNPPYEYNSDHKYWTEILGPCNGIYFLEGNPNVLMNPSLREFKVLPESHFTSPHGTYTFTDYAGFGFDPKTNDYKVVVLKDLWFKETDERQLGYWSAELYSLNSNSWRKLDPSLLPLPIEIWGSSRVFTYANNCCHWWGFVEESDATQDVVLAFDMVKESFRKIRVPKIRDSSDEKFGTLVPFEESASIGFLVYPVRGTEKRFDVWVMKDYWDEGSWVKQYSVGPVQVIYKLVGFYGTNRFFWKDSNERLVLYDSENTRDLQVYGKHDSIRAAKYTESLVSLHRGNEFSHKCFSCSLVPDPLLHDTEYLVSF

SEQ ID NO: 221092 - protein, 103 aa, Glycine max
  Coding DNA Sequence Number=SeqID_104314
IFRKKIDLLQHQELAAQNRTRLYNHGGCTSSVPSPGLKSYFCSQAVLNKLDTRFMDDSKKNDFRIIYVVKNVRIPKYLDLEWFSQQGFNFPNLLEAQALSKLV

SEQ ID NO: 221093 - protein, 88 aa, Glycine max
  Coding DNA Sequence Number=SeqID_104315
  Gene Ontology: Mol. function=DNA binding; Biological process=DNA integration
  Homolog annotation: Hit_ID=Q1SXA8; Match level="QueryCoverage=97%, HitCoverage=8%, E-value=6e-19, Identity=41%"; Hit description=Zinc finger, CCHC-type; Polynucleotidyl transferase, Ribonuclease H fold
MHQELDQFHKNHIWKLAEFPKDKKVLGAKWVSHNKLDKNGKVVRNKASNMELYQMDVKSTFLNGLIQEEVYVEHSPGFESDCHHVFQT

SEQ ID NO: 221094 - protein, 64 aa, Glycine max
  Coding DNA Sequence Number=SeqID_104316
  Gene Ontology: Mol. function=drug transporter activity; Cellular component=membrane; Biological process=multidrug transport
  Homolog annotation: Hit_ID=Q1T635; Match level="QueryCoverage=80%, HitCoverage=10%, E-value=3e-10, Identity=57%"; Hit description=Multi antimicrobial extrusion protein MatE
MAFRDLWSFAKLSLASSVISCLEQWYGTCIILLAGLLDNPVIDVDSYSICFNLFRVGTRCCSLE

SEQ ID NO: 221095 - protein, 153 aa, Glycine max
  Coding DNA Sequence Number=SeqID_104317
  Gene Ontology: Mol. function=RNA-directed DNA polymerase activity; Biological process=RNA-dependent DNA replication
MAPDRTQLQNISKREHESFKEYAQWWRDLAAQVAPPMVEREMITMIVDTLPVFYYEKLVGYMASSFTDLIFAGKRIEVGLNKGKFDYVAPASMSNKRFEESGAKKKEGDANTVTSASTWPKPQQTPHNTYQYAQHQPSFLACIRNPSNLVPVQ

SEQ ID NO: 221096 - protein, 58 aa, Glycine max
  Coding DNA Sequence Number=SeqID_104318
MAKFDPDIVLEFYANAWPVEEGVRDMRSWVRGMPLTRHPVYPDKSNRALGFPALIMGL

SEQ ID NO: 221097 - protein, 250 aa, Glycine max
  Coding DNA Sequence Number=SeqID_104319
  Gene Ontology: Mol. function=protein disulfide oxidoreductase activity; Cellular component=membrane; Biological process=glycerol ether metabolic process
  Homolog annotation: Hit_ID=Q8X3J0; Match level="QueryCoverage=100%, HitCoverage=83%, E-value=1e-103, Identity=76%"; Hit description =Efflux pump for cysteine biosynthetic pathway intermediates
  Pfam annotation: Domain name=DUF6; Domain location=14-132; Score =43.1; E_value=9.2e-10; Accession=PF00892.11; Description=Integral membrane protein DUF6
MTRKDGLLALLVVVVWGLNFVVIKLGLHNMPPLMLAGLRFMLVAFPAIFFVARPKIPFKLLLGYGLTISFGQFAYLFCAIKCGMPAGHASLVLQAQAFLTIIQGAFVFGERLQGKQLAGITLAVFGVLVLIESSLNGQHVALLGFMLTLAAGLSWACGNIFNKLIMQHEARPQVMSLVVWSALIPVVPFMVASLIFDGPAVMLTSLVEIDLTTILSLVYLAFVATIIGYGIWGSLLGRYETWRVAPLSLL

SEQ ID NO: 221098 - protein, 67 aa, Glycine max
  Coding DNA Sequence Number=SeqID_104320
MSGVWVFDKKGVARLITNPTRESFEQKEPRQPGTATAPGARPRVLVYLPSNQVIRSYTELEQRLTEL

SEQ ID NO: 221099 - protein, 90 aa, Glycine max
  Coding DNA Sequence Number=SeqID_104321
  Subcellular localization annotation: CTP_CleavageSite=52; ConfidenceScore=5.01e-01
MTPALPSYDDSVLILHTVPPSSPSYDGSDLVLHYTSPSSRHRITTFPLLLLRARFLVQGGTSIVEQQFHNAHSRTTIPKVIFLTYGKVIP

SEQ ID NO: 221100 - protein, 625 aa, Glycine max
  Coding DNA Sequence Number=SeqID_104322
  Gene Ontology: Mol. function=transmembrane receptor activity; Cellular component=membrane; Biological process=defense response
  Homolog annotation: Hit_ID=Q1SGR7; Match level="QueryCoverage=90%, HitCoverage=47%, E-value=1e-148, Identity=52%"; Hit description=TIR; Disease resistance protein; AAA ATPase
  Pfam annotation: Domain name=NACHT; Domain location=252-411; Score= -9.5; E_value=0.00031; Accession=PF05729.3; Description=NACHT domain
  Pfam annotation: Domain name=NB-ARC; Domain location=212-517; Score =75.4; E_value=1.8e-19; Accession=PF00931.13; Description=NB-ARC domain
  Pfam annotation: Domain name=TIR; Domain location=51-188; Score =149.6; E_value=8.5e-42; Accession=PF01582.10; Description=TIR domain
  Pfam module annotation: Pfam domain module=NACHT::NB-ARC::TIR; Domain location=252-411::212-517::51-188
  Subcellular localization annotation: CTP_CleavageSite=38; ConfidenceScore=5.49e-01
MHLTTSVAVLVGCVVVFIWRRSSSPKAKKVTSNSASAIAMASNATIPTYDVFVSFRGEDTRNSFTAFLFDALSQNGIHAFKDDTHLQKGESIAPELLLAIQGSGLFVVVFSKNYASSTWCLRELAHICNCTIQASPSRVLPIFYDVDPSELRKQSGYYGIAFAEHERRFRGDKEKMEELQRWREALKQVANISGWNIQNESQPAVIEKIVLEIKCRLGSKFQNLPKGNLVGMESCVEELEKCLELELVSDVRVVGICGMGGIGKTTLARALYEKISYQYDFHCFVDDVKEIYKKIGSLGVQKQLLSQCVNDKNIEICNASKGTYLIGTRLRNKRGLIVLDNVSRVEQLHMFTGSRETLLRECVGGGSRIIVISRDEHILRTHGVNHVYQVKPLNQDNAVQLFCKNAFKCDYILSGYKMLTHDVLSHAQGHPLAIQVIGNFLQGRNVSQWKSTLVRLNEIKSEDIMKVLRISYDDLEEKDKEIFLDIACFFSRDYSYKYSERYVKEILDFRGFNPEIGLPILVDKSLITISHGKIYMHRLLRDLGKCIVREKSPKEPRNWSRLWDWKDLYEVLSNNMKAKNLEAIVVEDKTWMFFETTMRVDALSKMKNLKLLMFPEYTAVEGYHK

SEQ ID NO: 221101 - protein, 153 aa, Glycine max
  Coding DNA Sequence Number=SeqID_104323
  Gene Ontology: Mol. function=transcription factor activity; Cellular component=nucleus; Biological process=regulation of transcription, DNA-dependent
  Homolog annotation: Hit_ID=Q00LP6; Match level="QueryCoverage=99%, HitCoverage=28%, E-value=4e-52, Identity=62%"; Hit description=GRAS2
MKIHHEMRDSFPITQPNRLATRQSESQRIPTPFFNRFIETLDYYLAMLESIDLSLPRKSKQRVNVEQHCLARNIVNIIACEGKERVERHELLGKWKSRLTIAGFRQYPLGSYVNFVIKSLLRWYPEHYNLVEKDGAMLVGWKDRNLISASAWH

SEQ ID NO: 221102 - protein, 60 aa, Glycine max
  Coding DNA Sequence Number=SeqID_104324
MVYGYKESIDSENEEFFLADSSHSFLIIALNDHKFRFMTSALLPVRSSRSGSLFLFGSMM

SEQ ID NO: 221103 - protein, 102 aa, Glycine max
  Coding DNA Sequence Number=SeqID_104325
MSKISSTGQSCTLFYSGRVSNEGSVSQSQYIQYSQRNSVEKFLHNAQMVRLGEISRLRQDCYYLIVGTVDEVIIDTPWSYDNYPYCTMTFDPLKIGVNFCSC

SEQ ID NO: 221104 - protein, 83 aa, Glycine max
  Coding DNA Sequence Number=SeqID_104326
MSPRVDCSMFSELESSIVAMRSRFSLPILMNYWERLGLSDFSTMHDAQKGLQCVAEPWYQYLRDNAFSVGDEICFYFRPYKKV

SEQ ID NO: 221105 - protein, 1512 aa, Glycine max
  Coding DNA Sequence Number=SeqID_104327
  Gene Ontology: Mol. function=RNA-directed DNA polymerase activity; Cellular component=chromatin; Biological process=chromatin assembly or disassembly
  Pfam annotation: Domain name=Chromo; Domain location=1412-1466; Score= 27.4; E_value=5.2e-05; Accession=PF00385.14; Description='chromo' (CHRromatin Organisation MOdifier
  Pfam annotation: Domain name=RVP_2; Domain location=412-535; Score= -26.8; E_value=0.00012; Accession=PF08284.2; Description=Retroviral aspartyl protease
  Pfam annotation: Domain name=RnaseH; Domain location=916-1035; Score=- 28.3; E_value=0.025; Accession=PF00075.14; Description=RNase H
  Pfam annotation: Domain name=rve; Domain location=1169-1339; Score =56.4; E_value=9.6e-14; Accession=PF00665.16; Description=Integrase core domain
  Pfam module annotation: Pfam domain module=Chromo::RVP_2::RVT _1::Retrotrans_gag::RnaseH::rve; Domain location=1412-1466::412 -535::656-825::124-214::916-1035::1169-1339
MGEIIHFAFALVVRQLESLFSAEELGSAPKMADRVTAVEDRLERVEASIVSLREFIGAEIQRAMASRPSPPPGGDSVTSPLDEFRLSAKKVELPSFNGDDPVAWITQAETYFEVQRISEEVSIQLTKLSMEGPTIHWFNLWRDSTEELTWENLTEAMMIRFGGGRLENPFEELKELKQNGSVEEYVAEFELYSSQCGRLPEQQFLGYFIGGLRHDIRSRVRTFKPRNRYLAMQLARDVEREFADVSGQGVGSRHKPGQASWARPQKQVWTQREGDGNGSSNPAQSGGGLGKSNSISRSVSGSTLSTGSTRSSAPSSGSRLNAGEGGRRNPRGVRHLPAAEMNERRSKGLCFRCNERWDPLHQCATKQLRVIILGDDEAINDEGEIVVLETAAEEDTESDEMECKGLGVFGVSSTSSQVRTMKLEGVLQGANILVLIDSGATHNFISPKVVEALGLQLVPSKPLGVKLGDDHRVLTMGKCAAISLVLGEMETTIDAYILELGGVDLILGVVWLENLGKVTMDWKEMSMVFNYNGNLVKLIGQPLEEKMATFQSAVTTSSVFANEGSPTLMEVKGKAEAGLSEVQNRALQALLTKFSSVFCEVMGLPPARNNSHSIVLLPGAGPVSVRPYRYPHHHKDEIEKHIQILLQQGVIRNSTSAFSSPVILVKKKDHSWRMCVDYRALNKVTIQDKYPIPVVDELLDELHGSAYFSKLDLKSGYHQIRMKEEDIHKTAFRTHEGHYEFMVMPFGLTNAPATFQSVMNEIFKPYLRRFVLVFFDDILVYSGDWNTHLQHLAVVLQVLQQHQFVANKNKCAFGQEKIEYLGHVISKAGVMVDPAKVQSVLQWPVPTSVKGVRGFLGLTGYYRKFIANYGKIAKPLIELTKKEGFKWNEEAEKAFQTLKTAVTSSPVLTLPNFELPFEIECDASGKGVGAVLMQMKHPIAYFSKAFTASKLSKSAYDKELMTLVLAIQHWRHYLLGRRFVVYSDQKSLKHLLQQRITTANQQEWMAKLLGFDFEVVYKVGVENKVADALSMQHEEATIQTMLSFPIWTQGKQLQQEVMQDPVLKGIIKAIQSDPTSKPGFVLKGGVLFYKNRLVIPAKSPIIDDLLRDFHSSPSGGHSGYLRTYRRMAGTLYWQGMMKRVQEFVKACDTCQRQKYAATTPSGLLQPLPIPVLVWSEISMDFITNLPKSNDYEAILVVVDRLSKYSHFIPLKHPFTARSIASIFVKEAVRLHGVPESILSDRDPLFVSIFWKELFKLIGTVLKMSSAYHPQTDGQTEVVNRCLEAYLRCFISDQPKKPPVLVHFLEGETRVEAVAQELRDRDEALRQLKFNLQKAQEQMKMQADKRRKEVQFDVGDWVFLKLWPHRQQSVVQRIHQKLAPRFFGPYQIIQKAVGNYTVSNDLPASLELEKKDVVPAKLLSWRDKFDAGKHTREWLVQWEGMDIGDATWEEELLLKSQFPDFSLEDKAVVAGGGDDRSGSVSSEGEVLVNKKNVEPKVWRVYERRIKKGVTKKV

SEQ ID NO: 221106 - protein, 113 aa, Glycine max
  Coding DNA Sequence Number=SeqID_104328
  Gene Ontology: Mol. function=DNA binding; Biological process =regulation of transcription, DNA-dependent
  Homolog annotation: Hit_ID=Q94CM2; Match level="QueryCoverage=53%, HitCoverage=12%, E-value=2e-10, Identity=59%"; Hit description=CDC6 protein
MALHLSTALTLVVCRARSRIWFWNCKGCVEHKKAESLYICGCPGKSLSMEKVKDKLLNWAKEIVDSVIALFRVDFSRWRACKSPASPGAAVKLCLGDLLVMGSNPETASLHMQ

SEQ ID NO: 221107 - protein, 351 aa, Glycine max
  Coding DNA Sequence Number=SeqID_104329
  Gene Ontology: Mol. function=transmembrane receptor activity; Cellular component=membrane; Biological process=defense response
  Homolog annotation: Hit_ID=Q1SGR7; Match level="QueryCoverage=55%, HitCoverage=12%, E-value=4e-31, Identity=56%"; Hit description=TIR; Disease resistance protein; AAA ATPase
  Pfam annotation: Domain name=TIR; Domain location=184-341; Score =101.6; E_value=2.3e-27; Accession=PF01582.10; Description=TIR domain
MVKRNGIRILKKKRGNILGILNMKVTLSLLSSALMVMMSSLPTHGDVAVTAIVLKALKSKEEPDEGDMTGVHGLEGEPGGGAVKANWLRGPGPPRKKKKNRGKCFCFIVLPIFYDVDPSEVRKQIGCFGKAFGKARWREALTRVANRSGWVIGNESKHLSLLPSTSGIALASSTIMHAIRTYDVFVSFHGLDTRNNFAALLLQALHRNGIDAFNDNVHVMKGEFIESELYMAIDGSRNFIVVFTKNYASSTWCLHELARICMNIETSTRRILPIFYVVDPLKVQKQSGCYEKAFMDYEERFRGAKEREQPEYGLDPMLHFALVGSERQVRIQGRASNWQDKLVVTSTRSVE

SEQ ID NO: 221108 - protein, 96 aa, Glycine max
  Coding DNA Sequence Number=SeqID_104330
  Gene Ontology: Mol. function=protein kinase activity; Biological process=protein amino acid phosphorylation
  Homolog annotation: Hit_ID=Q5VR06; Match level="QueryCoverage=97%, HitCoverage=7%, E-value=3e-15, Identity=39%"; Hit description =Helicase-like protein
  Pfam annotation: Domain name=DUF889; Domain location=1-96; Score= -115.0; E_value=0.0011; Accession=PF05970.5; Description=Eukaryotic protein of unknown function (DUF889)
MKKLKQFSDWLLDIGDGKIGQHNDGFSEITILDEFLIKDYDDYIHAIVEVTYPSLIDNYSDTDYLQKRVVLASKKEIVDKINDYVLSLIPNNEKEY

SEQ ID NO: 221109 - protein, 103 aa, Glycine max
  Coding DNA Sequence Number=SeqID_104331
MGTRKHIPNLPWKLSSNLLVDEIPFGLGQKSLIHLCEKYDISKEKWVQFCQNRKDPSWELMAEKTKKRLEEATQSGSTEGIIDPPSPIRRYMKWKMARIKKTG

SEQ ID NO: 221110 - protein, 75 aa, Glycine max
  Coding DNA Sequence Number=SeqID_104332
  Gene Ontology: Mol. function=DNA binding; Cellular component=nucleus; Biological process=regulation of transcription
  Homolog annotation: Hit_ID=Q0PJD4; Match level="QueryCoverage=51%, HitCoverage=21%, E-value=1e-13, Identity=89%"; Hit description=MYB transcription factor MYB64
MGRVLQTETYTGRVFGQQKKMKNFLGILLSTVMDVGAEFLSKKVCKGVENLQADVDHLIKVLQLKSKVVPVKLDY

SEQ ID NO: 221111 - protein, 158 aa, Glycine max
  Coding DNA Sequence Number=SeqID_104333
MFLVFNNALKGLDDTPQPKSKAGARWIIVKCNRQKRSTECGYYVMHWMSTIILGTFNNNWETYFNDVRSLEAKRFKAFRIQWAQYYLKKAKNPEAIVVDDKSWMFFETTMRVDALSKMRNLKLLMFPRYEEELSTDEEKEEKFSGNLNYLSNELGYLI

SEQ ID NO: 221112 - protein, 72 aa, Glycine max
  Coding DNA Sequence Number=SeqID_104334
MHPFEKQPTKGRDAIPYIDKFKHETDMDIVGSRKGVPLLVSKQNTIEYVCQWLIVATRECDEEVVPQIERMG

SEQ ID NO: 221113 - protein, 213 aa, Glycine max
  Coding DNA Sequence Number=SeqID_104335
  Gene Ontology: Mol. function=binding; Cellular component =intracellular; Biological process=metabolic process
  Homolog annotation: Hit_ID=Q7XHS8; Match level="QueryCoverage=96%, HitCoverage=72%, E-value=6e-48, Identity=34%"; Hit description =Putative pentatricopeptide (PPR) repeat-containing protein
  Pfam annotation: Domain name=PPR; Domain location=100-134; Score =25.2; E_value=0.00023; Accession=PF01535.11; Description=PPR repeat
  Pfam annotation: Domain name=PPR; Domain location=135-169; Score =21.2; E_value=0.0038; Accession=PF01535.11; Description=PPR repeat
  Pfam annotation: Domain name=PPR; Domain location=170-204; Score =38.9; E_value=1.7e-08; Accession=PF01535.11; Description=PPR repeat
  Pfam annotation: Domain name=PPR; Domain location=66-99; Score=22.7; E_value=0.0013; Accession=PF01535.11; Description=PPR repeat
  Pfam module annotation: Pfam domain module=PPR::PPR::PPR::PPR; Domain location=100-134::135-169::170-204::66-99
MTLDVQHGYSTSGTKADTSRQRYRASNPDYKLASSSCQKPWALTMGNEAYNLLERQKRKGCIPNVIAYNCILTCLRRKGKVEEALRILEAMKMDAAPNLTSYNILIDRLCKAGELEVALKVRDSTKEAGLFSNIITVNIMIDRLCKAKRLDEACSIYFGLDHKVCTPESITFCSLIDGLARHGKVNDAYMLYEKMLDYGQTPNAVLYTSLISW

SEQ ID NO: 221114 - protein, 75 aa, Glycine max
  Coding DNA Sequence Number=SeqID_104336
  Gene Ontology: Mol. function=DNA binding; Cellular component=nucleus; Biological process=regulation of transcription, DNA-dependent
  Homolog annotation: Hit_ID=Q9ZTX9; Match level="QueryCoverage=98%, HitCoverage=8%, E-value=1e-27, Identity=81%"; Hit description=Auxin response factor 4
MFCKTLTASDTSTHGWFSVPRRAAKTVFLVWCDTSHDYKQQRPSQELVAKDLHGVEWKFRHIYRGQPRWHLLTTG

SEQ ID NO: 221115 - protein, 64 aa, Glycine max
  Coding DNA Sequence Number=SeqID_104337
MVLIRCLHQHVLEGQHSKTVLTSTPSLKGRSLKTATSKMVIVAPSLKVSTFHDVEIYDGHPPSL

SEQ ID NO: 221116 - protein, 107 aa, Glycine max
  Coding DNA Sequence Number=SeqID_104338
MVGYTPSSFTDLVFASKKIEVDLKRGKFNHPAWTNEKTGANEEDENEGETHAVAAIPIWPSFPPTQQCHYSANNKPSPYPPHQLSIKAIPKSTTKSVYRTSNDEHHL

SEQ ID NO: 221117 - protein, 112 aa, Glycine max
  Coding DNA Sequence Number=SeqID_104339
  Gene Ontology: Mol. function=binding
  Homolog annotation: Hit_ID=Q10PS3; Match level="QueryCoverage=66%, HitCoverage=10%, E-value=5e-29, Identity=84%"; Hit description=HEAT repeat family protein, expressed
MKNVFFFSCPQIIIISYTFNKLTVRELLIKWSLPLSNNEFVKLGGDQLVPYYADILGAILPCIADKEEKIRVVARETNEELRALKADPAEAFDVGAILSIARRQLSSELEAT

SEQ ID NO: 221118 - protein, 907 aa, Glycine max
  Coding DNA Sequence Number=SeqID_104340
  Gene Ontology: Mol. function=transferase activity; Cellular component= intracellular; Biological process=DNA integration
  Homolog annotation: Hit_ID=Q1RU49; Match level="QueryCoverage=66%, HitCoverage=81%, E-value=0.0, Identity=50%"; Hit description =Polynucleotidyl transferase, Ribonuclease H fold
MVSKLLILFEALEVDYVLFEDPPADVNASESSTPETPATPVVTPLLAETKKADEEAKKKYEKDNKTARGHLLTHMADNLFDLFINQKSAKTIWYTLLKHYGDDDAGRKKYVVGNWLRFQMMDDKPIMEQIHEYENLVGDILNEGMKMCEILQANVLLEKFPPSWSDYRNQLKHKKRDLSLQELINHMKTEEASRLKDKHGQQSNNSKPAAPHAPQAHLAENEEVIAVVVVEANMVDNKVDWILDTGASKHLCANKELFHQIEDADDGECVFMGNSATAGVLGKGKILFKLTSGKTLSLSDVLYVPSLRRNLISVWGCLAKVALPDFKRTNVGTKTFDCVFIGYAQNSAAYRFLRLNDNSICESRNAEFFEQEFPLTKHVNELISSCNTTLVPLHLRTSSSVTNEQVNEPRRSKRKRIESSFGPDFVTAFVVENNDVDKINDVFVSTFLIEEDPKTYNEAVTSIDANFWKEAINSELDSIMYNHTWDLVDLPKGSKPIRCKWIFRKKLRTDGTIDKFKARLVVVGYTQKKEIDYFDTYSPVTKISTIRSLVALAAIHGLIVHQMDVKTAFLNGDLREEIYVEQPEGYVIQGQENKVCKLRKSLYSLKQAPKQWYEKFDQTLVSDGYIVNSSDTCVYSKLFGQECVIICLYVDDMLIFGTNVTVVEKTKLFLSSHFDMKDLGEANVILGVKMRKSDNELPMILAYILRKNNGSSVSQTEYAKIIGSVMFLMHCTRPDIAYAVSRLSRYTHNPEGFCDANWVTDNDEVSSTSGYVFTLGGGAISWKSSKQTCIARSTMESKFIALDLAGQEAEWLRNLLADVPLWGKRSIPVSLHCDSEAAIGIAKNSVYNGKRRHIRIRHSSVRELFKNGVISLQFVRSENNLADPFTKGLTKKVVLESSRGMGLKPLC

SEQ ID NO: 221119 - protein, 181 aa, Glycine max
  Coding DNA Sequence Number=SeqID_104341
  Gene Ontology: Mol. function=drug transporter activity; Cellular component=membrane; Biological process=multidrug transport
  Homolog annotation: Hit_ID=Q1SD92; Match level="QueryCoverage=76%, HitCoverage=56%, E-value=5e-26, Identity=50%"; Hit description=Multi antimicrobial extrusion protein MatE
VIAILDKLKNHKSQNKELLDSSPNEDDDDWDGEDPEEGIIYSVEKEESLRKRAWEESKKMWVVAGPAIFTRFSTFRIMVVSQSFIGHIGSTELVAYAIVMTVLVRFVNGALFKFGLNGAMTSTLLAYWIPNIGQLLFIMTKCPDINYGSFYNLEIWYNTVLILVTGNMKNAEVSINALAIW

SEQ ID NO: 221120 - protein, 60 aa, Glycine max
  Coding DNA Sequence Number=SeqID_104342
MENYTPSEFILKDAIPKPLPSAPLPDAEFMDAATYTPFLPYQVTQKCRKLPPNPEKESLT

SEQ ID NO: 221121 - protein, 122 aa, Glycine max
  Coding DNA Sequence Number=SeqID_104343
  Pfam annotation: Domain name=AP2; Domain location=99-122; Score= -18.7; E_value=0.072; Accession=PF00847.10; Description=AP2 domain
MSETQVHGRKRRNFNAIIETCDSCFVASTSATGHSLSLSSHTQTLLHSSHNFKIPNPSFALHSSQMCVFGVLHLAVLRHLVSSNASCEMRKKIIDPFSEKKFRGVRQRLWGKWVAEVRNLAR

SEQ ID NO: 221122 - protein, 568 aa, Glycine max
  Coding DNA Sequence Number=SeqID_104344
  Gene Ontology: Mol. function=transcription factor activity; Cellular component=nucleus; Biological process=regulation of transcription, DNA-dependent
  Homolog annotation: Hit_ID=Q00LP6; Match level="QueryCoverage=97%, HitCoverage=98%, E-value=0.0, Identity=67%"; Hit description=GRAS2
  Pfam annotation: Domain name=GRAS; Domain location=173-478; Score =416.9; E_value=2.9e-122; Accession=PF03514.5; Description=GRAS family transcription factor
  Subcellular localization annotation: CTP_CleavageSite=58; ConfidenceScore=5.50e-01
MDLNQFSSFNVISSAGFPCASSCTPISPISNRLLGSLKLDIGNSPNSALSTHFDSDTVSSALSDSQEQHNCGEIHSGVNSCNSLQESNHYLHRPVSSVDHLEDGLHLSTRSFFPQDASYDHETRHALLELETSLMAPDDEDQVTTSSTSLGDSSRPTASDQRNRSWSHEGQSSDVAYVEKRHKSMEEALLQGFPSSNLKQLLIVCAKALSENNMKGFDQLIEKARSAVSITGEPIQRLGAYLVEGLVARKEASGNNIYHALRCREPEGKDLLSYMQLLYEICPYLKFGYMAANGAIAEACRNEDLIHIIDFQIGQGTQWMTLLQALAARPGGAPHVRITGIDDQLSKYVRGDGLEAVGKRLAAISQTFNIPVEFHGVPVLAPDVTKDMLDVRPGEALAVNFPLQLHHTADESVDMSNPRDGLLRLVKSLSPKVTTLVEQESNTNTTPFFNRFIETLDYYLAIFESIDVSLPRKSKERVNVEQHCLARDIVNIIACEGKERVERHELLGKWKSRLTMAGFRQYPLSSYVNSVIRSLLRCYSEHYNLVEKDGAMLLGWKDRNLISASAWH

SEQ ID NO: 221123 - protein, 76 aa, Glycine max
  Coding DNA Sequence Number=SeqID_104345
MENWRTALRNYFAGLQTRRWRTHEQCGEWRIGEQRYATTSWDSRLVGGGCMNKARQKIHGAPKKVENGEMANSATQ

SEQ ID NO: 221124 - protein, 232 aa, Glycine max
  Coding DNA Sequence Number=SeqID_104346
  Homolog annotation: Hit_ID=Q1SRP2; Match level="QueryCoverage=42%, HitCoverage=23%, E-value=1e-36, Identity=78%"; Hit description=Beta 1,3 glucan synthase-related
  Subcellular localization annotation: CTP_CleavageSite=66; ConfidenceScore=5.02e-01
MPTNIACFSIAVNFYQTFLLPQGSRLLRISHRVVGGGHFPPIPPPHLARQQGRFHPRPPQHPTNTNSVSVSSFHTIQRILVRVLVGIKSHFAPTFYDDHKGALTTTKVYAVLACYFECKICVCLLSLDKALVDPTRAIIKEDNINYSWHDFVSKNNQNALTIVNVWAPVVAIYLLDIYVFYTLVLAVYGFLQGARDRLGEIRSFEALHRLLSSFLELLWTHFMFLYPIGAAC

SEQ ID NO: 221125 - protein, 91 aa, Glycine max
  Coding DNA Sequence Number=SeqID_104347
  Gene Ontology: Mol. function=receptor activity
  Homolog annotation: Hit_ID=Q9FQ21; Match level="QueryCoverage=94%, HitCoverage=38%, E-value=2e-14, Identity=71%"; Hit description =Putative Hs1pro-1-like receptor
MKKSSLLYDLVCKLNEIHMLKTTPYDERMGNHENHALHGSVLLQRYEALGVGDIGGGGGSEGRTDDSRDNNEALYFKERVREGSLVGGNAF

SEQ ID NO: 221126 - protein, 172 aa, Glycine max
  Coding DNA Sequence Number=SeqID_104348
  Gene Ontology: Mol. function=protein serine/threonine kinase activity; Cellular component=membrane; Biological process=protein amino acid phosphorylation
  Homolog annotation: Hit_ID=Q9FIU5; Match level="QueryCoverage=79%, HitCoverage=30%, E-value=1e-51, Identity=73%"; Hit description =Serine/threonine-specific protein kinase-like protein
MREESLGLIIGVSIGVVIGLVLAIFAFFCHRYHRKRSQIGNSSSRRAATIPIRTNGADSCTILSDSTLGPESPIKSDRHGMPFWLDGFKKSSSSMIPASGLPEYAYKDLQKATHNFTTVIGEGAFGPVYKAQMSTGETVAVKVLATNSKQGEKEFNTEVGCQCHFPLLWPLH

SEQ ID NO: 221127 - protein, 363 aa, Glycine max
  Coding DNA Sequence Number=SeqID_104349
  Gene Ontology: Mol. function=catalytic activity; Cellular component =cytosol; Biological process=cellular metabolic process
  Homolog annotation: Hit_ID=Q653W0; Match level="QueryCoverage=81%, HitCoverage=82%, E-value=9e-78, Identity=47%"; Hit description =Putative dihydroflavonol-4-reductase DFR1
  Pfam annotation: Domain name=3Beta_HSD; Domain location=40-296; Score= -134.9; E_value=0.005; Accession=PF01073.9; Description=3-beta hydroxysteroid dehydrogenaseisomerase family
  Pfam annotation: Domain name=Epimerase; Domain location=53-290; Score= 4.1; E_value=1.8e-06; Accession=PF01370.11; Description=NAD dependent epimerasedehydratase family
  Pfam annotation: Domain name=NAD_binding_4; Domain location=43-274; Score=-104.2; E_value=0.07; Accession=PF07993.2; Description=Male sterility protein
  Pfam module annotation: Pfam domain module=3Beta_HSD::Epimerase::NAD _binding_4; Domain location=40-296::53-290::43-274
MRAENGFGMRDEVCEPHRVKRYFWNNYSEKLHISAMVIPQDFVSFVADFKLNVKLIGYLWCLGVVVVAVIMEGGDQLRFFQADLHEEGSFDEAVKGCIGVFHVAASMEFNVRDKENNEAFVQANITDPAIKGTINLLKSCLKSNSVKRVVFTSSISTITAKDINGKWKSIVDESCQIHPDTVWNTQASGWVYALSKLLTEEAAFQFAKENGIDLVSVISSTVAGPFFTANVPTSVKVLVSPLTGETEYFRILSAVNARMGSIALVHIEDICSAHIFLMEHAKAEGRYICSSQSCALSDLATLISKVYSNSNIYQKTEKIYDKVPSEISSKKLQDLGFSYKHDLEDIIYQTLMCCLDYGYLPPV

SEQ ID NO: 221128 - protein, 436 aa, Glycine max
  Coding DNA Sequence Number=SeqID_104350
  Gene Ontology: Mol. function=nucleic acid binding; Cellular component= intracellular; Biological process=regulation of transcription
  Homolog annotation: Hit_ID=Q1SGQ8; Match level="QueryCoverage=97%, HitCoverage=97%, E-value=0.0, Identity=81%"; Hit description=Zinc finger, C2H2-type
  Pfam annotation: Domain name=zf-C2H2; Domain location=207-230; Score =16.8; E_value=0.077; Accession=PF00096.16; Description=Zinc finger, C2H2 type
MEKEEKKKIKGNVKDNMPTVWFSLKKSLHCKSEPSDVHDPKTRKQLSTILTKRAGRSGCSRSIANLKDVIHGSKRHLDKPPSCSPRSIGSSEFLNPITHEVILSNSRCELKITGYGGFQEGGVGSGGGGSNAGGGSTFVGTLRPGTPGPGGHPTMHYFNPSFRTSSTPPRKSPFLSSDKEGSGPHGAGLHSSNRLSLETDSNGSSTVTCHKCGEQFNKWDAAEAHHLSKHAVTELVEGDSSRKIVEIICRTSWLKSENQCGRIERVLKVHNMQKTLARFEEYREMVKIKASKLQKKHPRCLADGNELLRFYGTTVSCSLGLNGSSSLCLSEKCCVCRIIRNGFSAKKELKGGIGVFTTSTSGRAFESIDITCEEPSLRKALIVCRVIAGRVHRPLENIQEMAAQTGFDSLAGKVGLYSNIEELYLLNPRALLPCFV

SEQ ID NO: 221129 - protein, 35 aa, Glycine max
  Coding DNA Sequence Number=SeqID_104351
MPKWLLVARKLQMSLERTKAKPWSETWGSVIQSVH

SEQ ID NO: 221130 - protein, 116 aa, Glycine max
  Coding DNA Sequence Number=SeqID_104352
MEKSDKMNFKEKKEKKGYITWEDNVLNYSSDSEKKIISLGIMMKDYENGEEQSRYIDSNFSKHMACIKVYSYFSPRKLEVGSSYWKLKVKNGSWKLEVEVTGSWKLEMKLLKLKLK

SEQ ID NO: 221131 - protein, 85 aa, Glycine max
  Coding DNA Sequence Number=SeqID_104353
MRIKRSFKVVMGPRTRLVVSFKTRKGKQGSKGLSKELSQGKSIWLEAYKYKIASIISKYACELGSINKNQAKAIVQAINGAKHTK

SEQ ID NO: 221132 - protein, 50 aa, Glycine max
  Coding DNA Sequence Number=SeqID_104354
MCTYAIFGSQNALSMHEMAPRKLASKRSRKDKAAEGPVPLPSMTATALEC

SEQ ID NO: 221133 - protein, 88 aa, Glycine max
  Coding DNA Sequence Number=SeqID_104355
MSEIEEVREQMKADMEAMKDQMTTMMEAMISMRKMMEVNAATLTHLVQSKHLFPPYDLPLNYTPPNAIHVPDENNDHSSPIPLESQQP

SEQ ID NO: 221134 - protein, 91 aa, Glycine max
  Coding DNA Sequence Number=SeqID_104356
MLSGMEASSTLQTFSQRSQRSDRVHVTCKAADQISIYISGCYIPRQRRPKLVRTSSIKWYLNYLGKKKENHAREILCKNKLRKALVFLTGS

SEQ ID NO: 221135 - protein, 131 aa, Glycine max
  Coding DNA Sequence Number=SeqID_104357
MMGYAPSSFADLVFAGERIEVGLKRGKFDHPSLMNAKNRANEEDENEGETLVVTVIPTRPNFPSSQQCHYSANNNPSHYPPPNHPQRPSPNQPQDLLAARPMPNTTFSTNQNPNQEMNFTMKKLVEFTPIL

SEQ ID NO: 221136 - protein, 80 aa, Glycine max
  Coding DNA Sequence Number=SeqID_104358
MAAKLNSLRQYFGNFVSAFSLSKNLHILHLCFLFALSTSKQQPYTIQVFSEELAKHAYRAKRGHPLRMNTHPLAELPVAK

SEQ ID NO: 221137 - protein, 170 aa, Glycine max
  Coding DNA Sequence Number=SeqID_104359
  Gene Ontology: Mol. function=RNA-directed DNA polymerase activity; Cellular component=signal recognition particle, endoplasmic reticulum targeting; Biological process=RNA-dependent DNA replication
MSLHSSSSVKDPLYKILDELRSLKLWKEKQERKEKVEYWNDLKSALRKRQILSYYERELMDKLQRLRQGSMSVEEYRQQMELLLLSAGLREEERTSIARFLSGLNMEVRDKVELLPYREIDELVQLCIRVEQQIKRKSSSKSYGFHSYPRKDQAQGILGAAPSKPKEDKG

SEQ ID NO: 221138 - protein, 84 aa, Glycine max
  Coding DNA Sequence Number=SeqID_104360
MRKSDRARDWKKQGKALETEAVRTPKDRRRNPSVCREQRSTPLVAKPLGSTQRRKEPRLPETSAPDDFDSYCQQKFMIASYIMT

SEQ ID NO: 221139 - protein, 104 aa, Glycine max
  Coding DNA Sequence Number=SeqID_104361
MEYAPVSLASLARKRVGCDRRHTREPRVSLPPKDCTSCFMLGVATYPSAGGRRVTRGMRVPPKEYARSRHQRLFEENVGKTGKDVIYKLLSERFGSCIYARGRY

SEQ ID NO: 221140 - protein, 223 aa, Glycine max
  Coding DNA Sequence Number=SeqID_104362
  Gene Ontology: Mol. function=nucleic acid binding; Biological process= DNA integration
VIQWQEMTHKELPWRTTQASQLHCTSQLIQGNLFQGFSNEDPYVHLATYIEIYNTIKIVGVLEGAIRLNLFAFSLVSEAKRWLHSFKGNILRTWEKVVEKFLNKYFPESKTAQGKVDISSFHQFLDESLCEALDRFHGLLCRTPTHGFSKPIQLNIFIDGLRPHSKQLLDASAGVNDHAILRDRAYITTKKSLLELTSQDELMAQNKLHDQASIMRLAGDHFI

SEQ ID NO: 221141 - protein, 76 aa, Glycine max
  Coding DNA Sequence Number=SeqID_104363
MRSSTVTPKLLQIENTIFSIGKSGTIACRSSHCSLLLDSESESPDSDDRGDVTNCIRANLFLSTVWFKDELDGVGM

SEQ ID NO: 221142 - protein, 73 aa, Glycine max
  Coding DNA Sequence Number=SeqID_104364
MEKVYKSRSLGRSLKLTKFTSYPELRNKLGHMFGHEEVCKHKRMSRNDCLEYGGWNTTSFQSCFDNFGHKGNC

SEQ ID NO: 221143 - protein, 288 aa, Glycine max
  Coding DNA Sequence Number=SeqID_104365
  Homolog annotation: Hit_ID=Q1SVN4; Match level="QueryCoverage=31%, HitCoverage=31%, E-value=7e-16, Identity=58%"; Hit description=IMP dehydrogenase/GMP reductase
  Subcellular localization annotation: CTP_CleavageSite=60; ConfidenceScore=5.36e-01
MVVVPFVPLAFLDDGSSPPPSPSSPPQKSFAKVLSNACDIPLRQLLVPCLKGDALSVKIPEDEYKARLEGCKNNLHGRLSLSKGDTLLNYQYLHIKLEKGFGHGFLAFKPWITQTILSWLFHPLCLQPFLMTAMPYPLRYQRMNTKHDWRDVKTIFMEGKKVFVEKQKEPIIQDDGVIPPGLSFAQKNDLGGSLKYNQGDDAHISNLDDNCKSSVEGGTQSYDESLHLDLPLVDRFGAETPELKDNPIVHQYFGIITSRRLISRWFHNGSFKIPTQEASWQQKEDGSG

SEQ ID NO: 221144 - protein, 157 aa, Glycine max
  Coding DNA Sequence Number=SeqID_104366
  Gene Ontology: Mol. function=sugar porter activity
  Homolog annotation: Hit_ID=Q84L08; Match level="QueryCoverage=63%, HitCoverage=29%, E-value=2e-25, Identity=58%"; Hit description =GONST4 Golgi Nucleotide sugar transporter
  Subcellular localization annotation: CTP_CleavageSite=38; ConfidenceScore=5.42e-01
MVKSKQTNPMGLKNLFTTPDLTAVRTSTLSTMTKMTLLAMNLKKLMSKPKKQDREAVEAYDHVLDVDHLGGDGDEVGEVPGVGSDGEGEVDCDVAEGVNEDDKEGEGGEVVKAGLAVKGGVGEGNKKSGEGSEDDEGVDVGVAEEIGVGEDGEVEDE

SEQ ID NO: 221145 - protein, 252 aa, Glycine max
  Coding DNA Sequence Number=SeqID_104367
  Gene Ontology: Mol. function=protein dimerization activity; Cellular component=nucleus; Biological process=regulation of transcription, DNA-dependent
  Homolog annotation: Hit_ID=Q1SYN6; Match level="QueryCoverage=75%, HitCoverage=27%, E-value=2e-34, Identity=39%"; Hit description=Zinc finger, BED-type predicted
MREIIAIVVMVHELSFSIVEDEVWMWAFQYANSKFQKISRKNSWNLKKKVLSFVKVSAPRRGIDVADAILKCLKAWGIEDKVFSVSVNNISYNDSCLKNLKENLSLSRKMVLNGDLFHVRCCTHILNLLVQDGLGKIKDTIQNVHESVKYINHNDSRLKAFCDVAEQKHLKERKLIIDCPIRWNSTFQMLSTTLKFKTAFSTYSERDPHYTYAPSHEDWGKNAKGLYTFEVFNVATHIISGNEYLTTNLYLA

SEQ ID NO: 221146 - protein, 373 aa, Glycine max
  Coding DNA Sequence Number=SeqID_104368
  Gene Ontology: Mol. function=nucleic acid binding; Cellular component= beta-galactosidase complex; Biological process=DNA integration
MEEETHIKTISHGDESQNILSPYYLHPGESPGMVLASPPLNANNYHTWSKGMFSALWSKNKLKFIDGTLPMPKKEDANYKAWQRCNIMVVTWITQSLSPQIAQSTIYIDNAKKLWDELKERFTKGNYFIISDLLQEIHFIKQRERSVTDFFTELKILWDELDMVSPTQDCSCTVKYTSDLIKSIQKKQEIEPVICFLKGLGEVYGTVKSNILMMDPFPSINKAYALVLQQEGQLQGNGTSDSKVFFLPLQINRIIKGIGGHKEEGVTTLVEEKVMESWAEEMEMLEEEEDTTIQANSAYIAINLATQLTNATQSMVFLRVSNQEKTLPLTILWHPRENKVSLKLIILFKVHKVEPSPLRECSSNLINYSSCSL

SEQ ID NO: 221147 - protein, 789 aa, Glycine max
  Coding DNA Sequence Number=SeqID_104369
  Gene Ontology: Mol. function=sequence-specific DNA binding; Cellular component=nucleus; Biological process=regulation of transcription, DNA-dependent
  Homolog annotation: Hit_ID=Q2PF41; Match level="QueryCoverage=99%, HitCoverage=100%, E-value=1e-118, Identity=39%"; Hit description =BEL1-like homeodomain transcription factor
  Pfam annotation: Domain name=Homeobox; Domain location=451-509; Score= 5.5; E_value=0.0013; Accession=PF00046.19; Description=Homeobox domain
  Pfam annotation: Domain name=POX; Domain location=230-402; Score =209.7; E_value=6.9e-60; Accession=PF07526.2; Description=Associated with HOX
  Pfam module annotation: Pfam domain module=Homeobox::POX; Domain location=451-509::230-402
  Subcellular localization annotation: CTP_CleavageSite=62; ConfidenceScore=5.02e-01
MATYFHGSTSETPSSAEGLQTLYLMNPNYVVPYSDAAQHPTQNMLLVNPNNNTSNTSSTSTNALNLGNFSHAPPPPSPNNNREHHHHHLTGVTIPSSNFLLSNAAADPARSSFLGQHEFSGFHSSAAATTSTAAASRGNNYNLWGSIFDQSASNIMTSTTHTPSSNMGCVIGHSTQIGFHRPNHLSLSLSSQQTPYSSLSGETHAISLANRGGGGDDMRGMHNGVSSMHSVSLGSKYLKATQELLDEVVNVGKGIFKGEESMEGDKKEKMKGNIESSSWVGDGSSCGGGENNNNNDGGKQGVELSTAQRQELQMKKSKLVTMLDELYKCIGFDLVESTRVLEYVMAFFLAVEQRYRQYHHQMQVVITSFEQAAGVGAAKSYTALALKTISKQFRCLKDAISSQIKTTSKTLGEDDCLGVKVEGSRLRYVDHQLRQQRALQQLGMIQHNAWRPQRGLPERAVSVLRAWLFEHFLHPYPKDSDKVMLAKQTGLTRSQVSNWFINARVRLWKPMVEEMYLEEVKQEPNNSSQDNTTKRSKESSKELWSEANATAQESGAMRLDHINILQSKAESFNNNNNNQTTSPTEISNNSHNSLQSAGFHLADMQSPNKPIRSTSEMQNSPGSILSVDMEMKPRHHGETNNNTIITREGNNNTTKFGIESHGGGGGGFGAFPNMEDIGRFHHHHHHVTDQQSLAPRFHGNGVSLTLGLPHSTENNNNLSLSGTTHQHGFLSQNMHLGMRSTTNNANNEFCGAINTTPPSNSHSGTSYESIDIIQNRKRFAAQLLRDFVA

SEQ ID NO: 221148 - protein, 187 aa, Glycine max
  Coding DNA Sequence Number=SeqID_104370
  Gene Ontology: Mol. function=DNA binding; Cellular component=oxygen evolving complex; Biological process=DNA integration
  Homolog annotation: Hit_ID=Q1S1G2; Match level="QueryCoverage=98%, HitCoverage=17%, E-value=4e-36, Identity=36%"; Hit description =Integrase, catalytic region; Zinc finger, CCHC-type; Peptidase aspartic, catalytic
MLASKPCSTPMIKRNKLLYDDTAPPYDQTAYRRRLIGHLLYLTTTRLDISFTVQHLSQFMQSPRQPHFDVAARVLRYIKGCPAQGLFFLADSDLQLKAFSDLDWATCPTTRRQSARHIASNPNFHERTKHINIDCHIVRKKLQAKLFHLLPMPSSHQIVDFFTKPLETTTFLNLMSKLGVLSIHSPA

SEQ ID NO: 221149 - protein, 44 aa, Glycine max
  Coding DNA Sequence Number=SeqID_104371
MGNAMVAHARIPLEVYMEQGALSQKDLVVKVEFLGIVRVLLPKN

SEQ ID NO: 221150 - protein, 75 aa, Glycine max
  Coding DNA Sequence Number=SeqID_104372
MSMKQSHFKDSPNRPGTIEIMMDIHAHVRCTCTLYIVGLPCLKLFIGCGTAHRRVKVGYVFVVPMKQPFIYQGVN

SEQ ID NO: 221151 - protein, 169 aa, Glycine max
  Coding DNA Sequence Number=SeqID_104373
MVVCAGDKVGVRSRGADLVAAYGATTVVVADLIYEKIVREDHSSGASEGIVRWWGDWILNGRKLDAYANRVHGKVHIVRLDEGVKQREERACDMLEQTRDVLQIHQNHIHRCWLPNNFLVLDPSLLLAFVDASEISRKKIALIVDVEYETQKENTNVVSSFEEQKSCRC

SEQ ID NO: 221152 - protein, 417 aa, Glycine max
  Coding DNA Sequence Number=SeqID_104374
  Gene Ontology: Mol. function=ubiquitin-protein ligase activity; Cellular component=ubiquitin ligase complex; Biological process =protein ubiquitination
  Homolog annotation: Hit_ID=Q3HLY8; Match level="QueryCoverage=99%, HitCoverage=99%, E-value=1e-81, Identity=41%"; Hit description=U-box protein
  Pfam annotation: Domain name=U-box; Domain location=5-82; Score=83.4; E_value=6.9e-22; Accession=PF04564.6; Description=U-box domain
MAEVEIPQYFVCPISFQIMEDPVTTVTGITYDRESIEKWLLKAKDCVCPVSKQPLPRSSQYLTPNHTLRRLIQAWCSANTSNGVDRIPTPKTPLSMVQVQKLLKGLEVPCSYQKSLEKLHGLATTERNRICMAEAGVAKAMIKLINKSFKEGNTNLNNTTCIEKVLRIVHVLWSNDQSSMKSTLVGENNLDFINSLTWILKVHLDDNNIKMVNEAMPLLKLTIEVAADSTLLGSLGLEFFKEIVRVLRKRALLSQQAIKSALCVLTETSTSGRNRTRIVEAGAVTELIELELEKPEKNMTELIFNLLALLCSCADGREQFLRHAAAIAVVSKRVLRVSAATDDRAIHVFSVIAKFSASNEVVLEMLRVGAVSKLCMLMQADCASYLKEKARDILRLHSKVWNNSPCIQLYLFTRHQR

SEQ ID NO: 221153 - protein, 179 aa, Glycine max
  Coding DNA Sequence Number=SeqID_104375
  Gene Ontology: Mol. function=RNA-directed DNA polymerase activity; Cellular component=membrane; Biological process=RNA-dependent DNA replication
MVVKSQSIPQHVVDQEEFFGELRKYDMRLNPEKCTFKVQGGKFLSFMITHRGIEANPYKCTTILKMRSPTNIQEVEKLNGKLASLSRLLLKLIEKVKPFYKLLKKIEPFLWDKTLADEAVSLVSQRALRGRARARLTGALPKGGKMRGVATNIYLWKTSGKPKETGQKENSKFGSCIYA

SEQ ID NO: 221154 - protein, 139 aa, Glycine max
  Coding DNA Sequence Number=SeqID_104376
MVRTRGLGHALARVIGRGRQDEHDAVDVTKDVPHMAEDVPQVTEDFPHMANDVAQRSEDVPQMTTDVDANVAKDLGRDGAEGSHADEGFPGGPRDPSVLTSFAEHVAHAIWTGHERPELKLVSHGRKVALIGRPVPAIE

SEQ ID NO: 221155 - protein, 119 aa, Glycine max
  Coding DNA Sequence Number=SeqID_104377
  Homolog annotation: Hit_ID=O04892; Match level="QueryCoverage=45%, HitCoverage=14%, E-value=6e-10, Identity=66%"; Hit description =Cytochrome P450 like_TBP
MKIRRTECLPRPVVLITASGLQGLDLRAGHGSPSPEPVGCQWIARAASAARAGRRVPVGGRIGNGPFGASSPGVEQSTQNWSRESDLELWPDCPKRSYQLLAPPNWQVLAPLAVDQKIL

SEQ ID NO: 221156 - protein, 71 aa, Glycine max
  Coding DNA Sequence Number=SeqID_104378
MGNQIQVLITKIQQVAISFDSQTDSQQAEYQNEIEYQSAEKQNYAANPNYAENRPKRKSSAPTYLKDYNLG

SEQ ID NO: 221157 - protein, 71 aa, Glycine max
  Coding DNA Sequence Number=SeqID_104379
  Gene Ontology: Mol. function=5-formyltetrahydrofolate cyclo-ligase activity; Biological process=folic acid and derivative biosynthetic process
  Homolog annotation: Hit_ID=Q2QX67; Match level="QueryCoverage=50%, HitCoverage=12%, E-value=3e-07, Identity=69%"; Hit description=5 -formyltetrahydrofolate cyclo-ligase family protein, putative, expressed
MAAMPEDNSPDLREIARILNDIFEGMIANWWMIFQLKSCKSMMYPWIMSFLQIHLSKSLKVAYVWNFKGSL

SEQ ID NO: 221158 - protein, 70 aa, Glycine max
  Coding DNA Sequence Number=SeqID_104380
MGLISGKLLNELWISWYKVAHNLVFADFYSLRKDVEIMSQRVEEIKESSGLQLMEQELANLEEQAADSSF

SEQ ID NO: 221159 - protein, 1260 aa, Glycine max
  Coding DNA Sequence Number=SeqID_104381
  Gene Ontology: Mol. function=RNA-directed DNA polymerase activity; Cellular component=chromatin; Biological process=chromatin assembly or disassembly
  Pfam annotation: Domain name=RVP; Domain location=298-404; Score= -6.6; E_value=0.017; Accession=PF00077.10; Description=Retroviral aspartyl protease
  Pfam annotation: Domain name=RVP_2; Domain location=289-409; Score= -45.6; E_value=0.0036; Accession=PF08284.2; Description=Retroviral aspartyl protease
  Pfam annotation: Domain name=rve; Domain location=932-1088; Score =115.5; E_value=1.6e-31; Accession=PF00665.16; Description=Integrase core domain
  Pfam annotation: Domain name=zf-H2C2; Domain location=873-914; Score =17.6; E_value=0.0017; Accession=PF09337.1; Description=His(2)-Cys(2) zinc finger
  Pfam module annotation: Pfam domain module=RVP::RVP_2::RVT _1::Retrotrans_gag::rve::zf-H2C2; Domain location=298-404::289 -409::446-615::106-196::932-1088::873-914
MAESTRSKANSDRLEEAISKLTLSLNDTLHHLTHKIDELIVNLQKPETPSNSPSSSSTTSPPVTSSSPHRMKLEVPRFDGADPLGWIFKINPFFEYHATPEHERLTIASFFMDGRALAWFQWMTSNGQFTSWPVFLQALQSRFAPSPYEDPTGALFKLTQKGTVSAYLSEFEDLANRVVGLPSHFLLSCFVSGLSSEIRREVQAHQPLTMAQAAGLARLQEEKLFVARRQGRNRDKGLCFTCDEKYHRGHRCPSRAFLLIGDDDDPSYEDTLPPDLILDPPEDPSPTPAQISIHSLSGHPDPETLRLLGYINAHPVVILVDGGSTHNFIQAPLAKLLGLSSRTTNPLSVMVGNDQHLSCDQLCEDVPVWIQNKQFTVDLHLLPLSGVNLVLGVQWLKALGPILTDYNTLSMKFFHDGNLVELKGDDASTLSLLSHPQRDLIRPSISPFSSPVLLVRKHDGSWRLCVDYRALNAITIKDRYPIPTIDELLDELGGANWFSKLDLLQGYYQIRMHESDVAKTAFRTHHDHYEFEVMPFGLCNAPSSFQATMNGIFRPYLRRFIIVFFDDILIYSRTLPEHLIHLEQAFETLLHNQFVLKFSKCSFAQPQVEYLGHVVLGHGVAPVASKIQAIDQWPIPTTTKALRSFLGLAGFYRRFIRGYASIAAPLIKVTTKDPFEWTTEADEAFKALKTALISAPVLVLPNFTLPFTLETDASGVGMGAVLSQKGHPIAFFSKPFTPRMLQASTYVRELCAITTAVIQIPEQQMYLARLMGYDYCIQYRSGNTNLVADALSRRMEATESTLLLLSVPCLTFLEELKKQLNQELSFVDFIDNIKTNPTKFPDYSVSNDLVLQGNRIWLPQGIPFLQVLLTEYHSTPTGGHMGVAKTLARLTENFYWPGVRHDVKQFVAACVDCQQTKYETKRAAGLLCPLPVPCRPWEDLSLDFITGLPSFHGHTTILVVVDRFSKGVHLGMLPTQHSAYAVATLFMNTIGKLHGMPRSLVSDRDPLFISQFWKELFRLSGTQLRMSSAYHPQTNGQTEVLNRVLEQYLRAFVHKKPSSWGKFLPWAEWSYNTSRHSGTGVSPFEVTFGRRPPDWPSYVTSTSKVEAVDEFLTDRESIFQDLKKKLQKAQVLDRIGPVAYKLELPDSSRIHPVFHVSMLKQFHQVNTTPTHTTLALPPVAGLLPEDATWEDWEALQAEYHLEDKVTFEGPGNDSQQAEYQNEIEYQSAEKQNYAANPNYAENRPKRKSSTPAYLKDYNLG

SEQ ID NO: 221160 - protein, 137 aa, Glycine max
  Coding DNA Sequence Number=SeqID_104382
MGCTLTYQFVVAFHTDRNLIEIPSIYQKQWVPHYPSKVLFAYNGSSYIIKVIKIDDKYFFADGLKEFRKALNIQEGIIIIYAASERDWIFNLHFMPPLDNQTCGRPPATRITHVWTIELTEAMISAPRPLVGLHSYN

SEQ ID NO: 221161 - protein, 227 aa, Glycine max
  Coding DNA Sequence Number=SeqID_104383
  Gene Ontology: Mol. function=protein serine/threonine kinase activity
MWGCLPGHDHVIFVLLEDPLMSQRTIQRRILSCFGSLVALSDASSRMEGWLYLIRFNRIGLQFSRKRYFVLDGNLLRSFKSVPVSNNQFGASRPEEAARWIQSFHEASLRGASDGGDDVVGCSKRGWQSFRLSGSSSGIKSPKFCRPGLFLLLMSLPFHHGQSLAAKMVYDYSRKQKTGILMGRSHLLDSYVAWSFKIRVSSSIARHLSAVALLHTYFSMTYLNNVE

SEQ ID NO: 221162 - protein, 106 aa, Glycine max
  Coding DNA Sequence Number=SeqID_104384
MADGRVAGEKKRCVIRYGRYTIILWTEIRYGRYTIILWNDKVLSIVIVIIIPITCTMLASSITEIQKYDLFPSPVTLSHRALRQPQAAPSSHVPLRHRLGLTTEVN

SEQ ID NO: 221163 - protein, 112 aa, Glycine max
  Coding DNA Sequence Number=SeqID_104385
  Subcellular localization annotation: CTP_CleavageSite=75; ConfidenceScore=5.02e-01
GGFKEVKSLLGLLLCALQLSLQPPSETAFASPAPPKLASQSCDFSSSGEVASCTGEMPFHMKSPAPLTVWPSTCRMVAKSPLQVAVCLEIACSSRKKEHHAGNCSKRTPFEE

SEQ ID NO: 221164 - protein, 57 aa, Glycine max
  Coding DNA Sequence Number=SeqID_104386
MAWAIQQQRESSAHLHCHSHKRYTGLRIGLGSDKRNVTCVYTYKKGNTKKPPKVSSS

SEQ ID NO: 221165 - protein, 227 aa, Glycine max
  Coding DNA Sequence Number=SeqID_104387
  Homolog annotation: Hit_ID=UPI00005FA3FD; Match level="QueryCoverage =99%, HitCoverage=71%, E-value=2e-82, Identity=64%"; Hit description =COG3272: Uncharacterized conserved protein
  Pfam annotation: Domain name=DUF1722; Domain location=146-227; Score =85.9; E_value=1.3e-22; Accession=PF08349.2; Description=Protein of unknown function (DUF1722)
  Pfam annotation: Domain name=DUF523; Domain location=1-97; Score =35.8; E_value=2.1e-09; Accession=PF04463.3; Description=Protein of unknown function (DUF523)
  Pfam module annotation: Pfam domain module=DUF1722::DUF523; Domain location=146-227::1-97
MAIGLPTPRPALRLVKQSDDQIHLCFSKDGGEELTDEMARWSAERVKSLHHLCGYILCAKSPSCGLERVRVYEPDTNNNRKAGTGVFTSFLQKELPWLPLEEDGRLHDDAIRENFMGRVYALHEFNEMWRSGLTRHKLIAFHSRYKLLLLSHAQDEYREMGRFVAAMEQWESLDAYAFEYRNRLMHLMSHQASRRNHTNVLMHVQGYFRPKLSSPQRQELAQLIDRY

SEQ ID NO: 221166 - protein, 170 aa, Glycine max
  Coding DNA Sequence Number=SeqID_104388
  Gene Ontology: Cellular component=integral to membrane
  Homolog annotation: Hit_ID=Q7MZI5; Match level="QueryCoverage=91%, HitCoverage=64%, E-value=1e-59, Identity=73%"; Hit description =Similar to putative membrane protein
  Pfam annotation: Domain name=DUF969; Domain location=1-151; Score =244.6; E_value=2e-70; Accession=PF06149.2; Description=Protein of unknown function (DUF969)
RHGLKERAQTWIARIKTATAGRLLIVYLFVRELTAALGLTSLGGHPQMVRPLLAPMAEGATENRYGSVSPEIRQRLRAMSAATDNVGLFFGEDIFVAFGAIIFMHNFMQESAGISTEPLHIALWGIPTALCAFLIHAARLVRLDRQLSPTVSDVAGRGDPADCRAAVMAR

SEQ ID NO: 221167 - protein, 107 aa, Glycine max
  Coding DNA Sequence Number=SeqID_104389
MPPHKWSHNHYMQLKRSILRLFISDYQRPQSTYYTKFTAGQPPQASLLCGLVFLLSVDCQELACLGTSQVLTDRLCPGWVGIGQAWFWAIAPHLTSPRSPDPRDISP

SEQ ID NO: 221168 - protein, 62 aa, Glycine max
  Coding DNA Sequence Number=SeqID_104390
MTKPGLCLSSGPPPLDDKRVRITIRMTKLGLCLSSGPPPLDDKRGANNHKVSPRIIGPAASG

SEQ ID NO: 221169 - protein, 156 aa, Glycine max
  Coding DNA Sequence Number=SeqID_104391
MTSRDQVWSFCTLVSSRGGGPDDTRRYLMVIRTLLSSRGGGPDDKQRSSLGHSAPLYHPEAAGPMIRGDTLWLFAPFCHPEAAGPMISERPYVSFCTLVSSRGGGPDDTRRYLMVIRTLVSSRGGGPDDTRKYPSGYPYKNSFAICKTERLIACRG

SEQ ID NO: 221170 - protein, 130 aa, Glycine max
  Coding DNA Sequence Number=SeqID_104392
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-15, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=72; ConfidenceScore=5.75e-01
MKASAFSPLKVRTCSPLKVRACNPLKVRTCSPLNARTYSPLKVRTCSSLKVRASSPLMARTCSPLKVRACIPLMARTCNPLKVRACSPLMARTCSPLKARASSPLKTRTCSPLKVRTCSPLKARTCSPLM

SEQ ID NO: 221171 - protein, 62 aa, Glycine max
  Coding DNA Sequence Number=SeqID_104393
  Subcellular localization annotation: CTP_CleavageSite=47; ConfidenceScore=5.09e-01
MASFTRSRADLKLMRLKQSVFMTVVASGKGNIGKVSDMSRRWQRLCVGGGGSGSEGVSVFLD

SEQ ID NO: 221172 - protein, 932 aa, Glycine max
  Coding DNA Sequence Number=SeqID_104394
  Gene Ontology: Mol. function=actin binding; Cellular component =phragmoplast; Biological process=actin cytoskeleton organization and biogenesis
  Homolog annotation: Hit_ID=Q1SGQ9; Match level="QueryCoverage=91%, HitCoverage=84%, E-value=0.0, Identity=68%"; Hit description =Pyridoxal-dependent decarboxylase; Actin-binding FH2
  Pfam annotation: Domain name=Extensin_2; Domain location=262-539; Score=-139.4; E_value=0.074; Accession=PF04554.4; Description =Extensin-like region
  Pfam annotation: Domain name=FH2; Domain location=468-873; Score =475.6; E_value=5.9e-140; Accession=PF02181.13; Description=Formin Homology 2 Domain
  Pfam module annotation: Pfam domain module=Extensin_2::FH2; Domain location=262-539::468-873
MVNIKVTFGVLSVLLLVAAVSSIEKKEAENDFVRELLDPASGLLDEHTVGVDAVFHCFLDVWIVLACHFFHLTIPVPIMLDPERKFGRILLQHISEPPSPGPAVGSPTHSLAPSPESSLAPSSEPSLAPSSEPSLAPSPFAPAPLVHKPSHPLPPTSFFPKLTPPEEASEISSPSSDINKLEERHSNKKTVVLAVVITALVTFIAAALLFLCCTRHRKTGHFRLNDDRPLLSLSMSDYSVGPSSYSFGNSIKGEKVEFQSSSNGLVDNKKYSVQESQSIGALNAAAGSPFELKPPPGRVGATILSGLPPLKPPPGRLNPLPPEPPSFRPSGDAAPAAVAAVATAPPPAPQQPGLSSTLPPRPPAGARPGPPLPLPPALAGARPGPPPPPPASVGVKPGPPPPPPTAPAGAKPGPPPPPPPAGAKPGPRPPPPPMSGVAPPRPPPSFGSKVPRPLASGSKDTVVAGVEGEADAPKAKLKPFFWDKVQANPDQSMVWNQIKSGSFQFNEEMIETLFGYNAVDKNNGKKQKQSSSQDPSPLFIQIIDKKKAQNLLILLRALNVTMEEVCDALYEGHELPPEFLQTLLKMAPTSDEELKLRLFSGDLSQLGPADRFLKAMVDIPFAFKRMEVLLFMGSLKEDLATTMESFAILEVACKELRNNRLFLKLLEAVLKTGNRMNDGTFRGGAQAFKLDTLLKLSDVKGTDGKTTLLHFVVLEIIRSEGIKAIRKAKESQKSSSIKLDDLHDSTRETEDRYHEIGLQVVSRLSSELENVKKAAIIDADSLTGTTAKLGHGLIKTRDLVNKSMKNVEEDRGFCETVKSFVQNAEADVMKLLEEEKKIVALVKSTGDYFHGNSGKDEGTRLFIVVRDFLIMVDKVCNEVRDTKKKSVKTQKQETPREASSSEPRPPPDFRQRLFPAIAERRMDDISSDDESP

SEQ ID NO: 221173 - protein, 282 aa, Glycine max
  Coding DNA Sequence Number=SeqID_104395
  Gene Ontology: Mol. function=protein dimerization activity
  Homolog annotation: Hit_ID=Q1SYN6; Match level="QueryCoverage=42%, HitCoverage=17%, E-value=9e-23, Identity=39%"; Hit description=Zinc finger, BED-type predicted
  Subcellular localization annotation: CTP_CleavageSite=58; ConfidenceScore=5.51e-01
MRYCKSKFATGGTGSSTTHLHSKSCIQKKAKTTAESRQPTIPFQPSNSNNPFMIRGVRYSNKKMREIIATTIMVHEYPFSVVEDSIWMWAFQYANPDFHKVTHKTARNDCLALIEMEKKILKKLLESVSKISLTIDIWKSCHQVVEYMTAFASYNEREPHYNYAPSLEEWNQVEKVCKLLEVFNLAPHVISGSEYPTANLYLAEVWKVKQILDKEIKDEDLFMREMVGPMKKKFDKYWGECNMLMAIASVLDPRCKFHMVYVYKSLRLVLLIWMIIFHHPPN

SEQ ID NO: 221174 - protein, 97 aa, Glycine max
  Coding DNA Sequence Number=SeqID_104396
  Gene Ontology: Mol. function=serine-type endopeptidase activity; Biological process=negative regulation of enzyme activity
  Homolog annotation: Hit_ID=Q9LLL8; Match level="QueryCoverage=74%, HitCoverage=11%, E-value=3e-19, Identity=51%"; Hit description=Xylem serine proteinase 1 precursor
MCMYFDVKAKPMSHRVNKEAEFAYGAGQVNLTRTVNPGLVYDMDDFAYIQFICHEGYDVDPLYQWLGHDAINYPTMQLSVKQHRHNSSRVFRRRFRI

SEQ ID NO: 221175 - protein, 103 aa, Glycine max
  Coding DNA Sequence Number=SeqID_104397
MTSVKITLAALVLALIACNGLGFMGIPRMLGNGECHLDVECISILPYCKEKTICNNGICICDQTKASLKSGCKTNADCAIFICDPPYVIPYCDIKHGVCKCSR

SEQ ID NO: 221176 - protein, 85 aa, Glycine max
  Coding DNA Sequence Number=SeqID_104398
  Pfam annotation: Domain name=BmKK2_toxic; Domain location=9-42; Score= 16.6; E_value=0.051; Accession=PF09146.1; Description=BmKK2 toxic
VGFTSTPKTSGPNQCHDNADCSIKLPYCKGIAFCRNGVCACYEEKASITQQCQNDKDCIHLICAPPCEVSYCDTKTSKCKCKCKN

SEQ ID NO: 221177 - protein, 237 aa, Glycine max
  Coding DNA Sequence Number=SeqID_104399
  Gene Ontology: Mol. function=transmembrane receptor activity; Cellular component=membrane; Biological process=defense response
  Homolog annotation: Hit_ID=Q1T4Q1; Match level="QueryCoverage=63%, HitCoverage=14%, E-value=2e-47, Identity=63%"; Hit description=TIR
  Pfam annotation: Domain name=TIR; Domain location=88-224; Score =166.4; E_value=7.3e-47; Accession=PF01582.10; Description=TIR domain
MKTHSAIIFSYINISTQSVFVRLLMIWHSGTSLIKFSGINAQRLKILYERHVVYCVSNFQVIQMMNYFGSLKCSVSSSSSDAIKKYDVFVSFRGEDTGNNFTAFLLQALRRKGINAFKDDENLKKGEFIEPELREAIEGSRIFIVVFSKNYASSNWCLGELAHICYCIETSRRPVLPIFYDVDPLEVRKQSGCYEKAFVEHEERFVEDSKKMKEVHRWREALKQVANFKSGWDIRNK

SEQ ID NO: 221178 - protein, 98 aa, Glycine max
  Coding DNA Sequence Number=SeqID_104400
  Gene Ontology: Mol. function=transmembrane receptor activity; Cellular component=membrane; Biological process=defense response
  Homolog annotation: Hit_ID=Q1T4Q1; Match level="QueryCoverage=95%, HitCoverage=9%, E-value=9e-25, Identity=57%"; Hit description=TIR
  Pfam annotation: Domain name=TIR; Domain location=6-98; Score=29.0; E_ value=9.9e-08; Accession=PF01582.10; Description=TIR domain
MVIYDVFVSFCSEDTGNNFTGFLFQALHLHGIQTNNDDADLRKAESIPIEESRLFIVVFSKNYASSTLCLQELAKICNCIEASSRRVLPIFYDVDPSH

SEQ ID NO: 221179 - protein, 80 aa, Glycine max
  Coding DNA Sequence Number=SeqID_104401
MNYLTGKVLEDPMTLTASKLTNGSKLMLVASQCLYQGVATLKDDGCPKVWVVTSDHCHQQAAHGACKSFMSLYLELQGIG

SEQ ID NO: 221180 - protein, 147 aa, Glycine max
  Coding DNA Sequence Number=SeqID_104402
  Gene Ontology: Mol. function=carbonate dehydratase activity; Cellular component=extracellular region; Biological process=one-carbon compound metabolic process
  Homolog annotation: Hit_ID=Q9SL34; Match level="QueryCoverage=70%, HitCoverage=41%, E-value=2e-26, Identity=56%"; Hit description =Putative carbonic anhydrase
MVHETPSGQTAVIGILYKAGRRPDPFLSLLTNHLMVISNSTGAEREVDVMDPRLVKIGTSTTLYYRYIGSLTTPPCTEDIAWTMLKEVKSVSKEQIRLLRDAVHDYQEEVASKSKKKSNNLACIQAKDRTTGRTEIASCVKVAEVWN

SEQ ID NO: 221181 - protein, 678 aa, Glycine max
  Coding DNA Sequence Number=SeqID_104403
  Pfam annotation: Domain name=Extensin_2; Domain location=79-417; Score=-139.8; E_value=0.078; Accession=PF04554.4; Description =Extensin-like region
MPPSPALRYSPGREPRADGHKRGRSLESGLLFREKDDDLALFNEMQIREKDSFLLQSSDDLEDSFTTKLRHISDVNLGISIPGRGESSELLNDGDKNDYDWLLTPPDTPLFPSLDDEPPLSSFGSRGRPQSKPISISRSSTMDKSYQSRRGSASPNRLSPSPRSGTNTLQSRGRPSSLPNSSPTPSVRYATPSRRPSPPPSKSMAPASKSTYTPRRMSTGSSGSVVSSGVRGSSPVKTNRGNSASPKIRAWQTNIPGFSSEAPPNLRTSLADRPASYVRGSSPASRNSRESTSKFSRQSMSPTASRSSSHDRDQFSSRSKGSIASSGDDDLESLQSITVGSLDRLSSRRGGSFSTNRTPAISKKPARIASPSSAPKRSFDSAIRQMDRKIPQNMFRPLLSSVPSTTFYAGKANSAHRSLVSRNSSVTTSSNASSDQGTTFALDTEGSDHNQDDMANEVDKILYPDIHEEMFAFDKIDALNANIKQEMNRESVDILQSETRNPKTVFGPIESEDSISHIRIDTRVNESSEISHAKGDISETGSFENTALCSHCGCCYEVTNQPEKNIGLCPECKITLLRVIIPETTLAVSENSSLITTNMPKEEKSLPETNQLMVASELPQETNMGNLRFPHGEQNAEENQTSCRELNQDHSQNSPLPNSLTDGGRQTSGNQLEMNQSG

SEQ ID NO: 221182 - protein, 107 aa, Glycine max
  Coding DNA Sequence Number=SeqID_104404
MLGVIGAGTWLRYSKALLQPWKVGFSSLSAVDGRKHHLLDLQEIETVLTDVKADNVKVIPVPKHCDWADFMAKQKQRGVERMMLPSVEGQAGGKWIVIDSGCYLMLF

SEQ ID NO: 221183 - protein, 414 aa, Glycine max
  Coding DNA Sequence Number=SeqID_104405
QTEFRVQRQLSGRKLDVDCGYDSRIKPPSTASSFSGASIHSRQELGLATRETSGSTECGSVEEVPRVLQEMQASENTVADVIDASSTDLVVEEDKFEHDDSSRVNNACNSELLSQADDNLVTSFQNHEDCISPENVDDNPNNARDVSDTETSAKAPELSSHDKQDVQNSNVNELDALVTTNCSTITESEIEGENNCENNIGMANDDLSKSILDDFREPSNDCHAVSVSEVNVSESHRIEGSTVTVECQGAGNTRSLTLEEATDTILFCSSIVHDLAYKAATIATEKECSNPFEGSEPTVTLLGKANSDRKDSRNRPTSKRTLKSQKTKTKQRRVETDVKIPSGKTENDENIDESFTHNVGLPNKHFCTSLWPYMGAKSSACAFMVLGHKLRGILEDCDVPPPLAAFLFVIFHLN

SEQ ID NO: 221184 - protein, 171 aa, Glycine max
  Coding DNA Sequence Number=SeqID_104406
  Gene Ontology: Mol. function=peroxidase activity
  Homolog annotation: Hit_ID=Q2HT09; Match level="QueryCoverage=82%, HitCoverage=74%, E-value=2e-44, Identity=64%"; Hit description=Acid phosphatase/vanadium-dependent haloperoxidase related
  Pfam annotation: Domain name=DUF212; Domain location=11-168; Score =89.6; E_value=9.3e-24; Accession=PF02681.5; Description=Divergent PAP2 family
MSEAAATTTSSSMMRNYPLISAIVAFAIAQFIKFFTAWFKEKRWDPKQLVGSGGMPSSHSATVTALAAAIGFHEGFGGPLFATALVLACILMGYMVGRVSDMGHCWQVMYDATGVRLQAGRQAELLNQIVYELPAEHPLAESRPLRELLGHTPPQVLHFVFDCFLVLLDAS

SEQ ID NO: 221185 - protein, 1166 aa, Glycine max
  Coding DNA Sequence Number=SeqID_104407
  Gene Ontology: Mol. function=hydrolase activity; Cellular component =cytosol; Biological process=nitrogen compound metabolic process
  Homolog annotation: Hit_ID=Q7XAC5; Match level="QueryCoverage=68%, HitCoverage=97%, E-value=0.0, Identity=75%"; Hit description=Embryo -specific urease
  Pfam annotation: Domain name=Amidohydro_1; Domain location=355-657; Score=307.2; E_value=3e-89; Accession=PF01979.10; Description =Amidohydrolase family
  Pfam annotation: Domain name=Urease_alpha; Domain location=229-349; Score=297.1; E_value=3.3e-86; Accession=PF00449.10; Description =Urease alpha-subunit, N-terminal domain
  Pfam annotation: Domain name=Urease_beta; Domain location=144-193; Score=-42.5; E_value=0.0046; Accession=PF00699.10; Description =Urease beta subunit
  Pfam annotation: Domain name=Urease_gamma; Domain location=1-100; Score=218.5; E_value=1.5e-62; Accession=PF00547.9; Description =Urease, gamma subunit
  Pfam module annotation: Pfam domain module=Amidohydro_1::Urease _alpha::Urease_beta::Urease_gamma; Domain location=355-657::229 -349::144-193::1-100
MKLSPREIEKLDLHNAGYLAQKRLARGLRLNYVETVALIATQILEFVRDGEKTVAQLMCIGRELLGRKQVLPAVPHLVESVQVEATFRDGTKLVTIHDLFACENGNLELALFGSFLPVDLQKHKLQIEAPTHIISISLLWVETGSTVPSLDKFTENEEDHRTPGECKSVVLVSIGGNKVIRGGNNIADGPVNDSNCRAAMKAVVTRGFGHVEEENAREGVTGEDYSLTTVISREEYAHKYGPTTGDKIRLGDTDLFAEIEKDFAVYGDECVFGGGKVIRDGMGQSSGHPPEGSLDTVITNAVIIDYTGIIKADIGIKDGLIISTGKAGNPDIMNDVFPNMIIGANTEVIAGEGLIVTAGAIDCHVHFICPQLVYDAVTSGITTLVGGGTGPADGTRATTCTPAPNQMKLMLQSTDDMPLNFGFTGKGNSAKPDELHEIIRAGAMGLKLHEDWGTTPAAIDSCLTVNIHTDTLNESGFVEHTIAAFKGRTIHTYHSEGAGGGHAPDIIKVCGEKNVLPSSTNPTRPYTHNTIDEHLDMLMVCHHLNKNIPEDVAFAESRIRAETIAAEDILHDKGAISIISSDSQAMGRIGEVISRTWQTADKMKSQRGPLQPGEDNDNFRIKRYVAKYTINPAIANGLSQYVGSVEAGKLADLVLWKPSFFGAKPEMVIKGGEVAYANMGDPNASIPTPEPVIMRPMFGAFGKAGSSHSIAFVSKAWLQSISFTDTHLNSPCAEIITWSKITMAALDEGVKASYGLNKRVEAVKNVRKLTKRDMKLNDTLPQITVDPETYTVTADGEVCEYPLAICTGQVYLSDFIKKIMSIQTEQPLPTHTPFLNSNSNQSHQHQPQENNNDYETQTPLDDVLASLEVLLTLLSFNQSSLLSFTVSWTTFAVVGVVAPLLALQVYDTDKNQIKGFEIGIVAFQTCLAAVSLICLSHNLQKYGLNRFLLVDHHAAHMPCFHHDFAREITHLAFVEHGSLWPSIAVLLALIVSWTYVSAISLSACVLFHLVCSLQLVHFDDYRKLLQREYDALFLVVTASQFVTLLPVSGFGGALTFISGGDFAVFTLVKVVGIIIVLHAATKISLRAQGIVSLASRWHALVTCTSDPSKLRYCASTGSLEAAKHLNSIFLDYSESDLDSSDYIVVPSNTQLASYMSSHHKRQAFGT

SEQ ID NO: 221186 - protein, 378 aa, Glycine max
  Coding DNA Sequence Number=SeqID_104408
  Gene Ontology: Mol. function=oxidoreductase activity; Cellular component=mitochondrial envelope; Biological process=aromatic compound metabolic process
  Homolog annotation: Hit_ID=Q018V9; Match level="QueryCoverage=87%, HitCoverage=48%, E-value=2e-65, Identity=42%"; Hit description=[HC] KOG3855 Monooxygenase involved in coenzyme Q
  Pfam annotation: Domain name=DAO; Domain location=47-353; Score= -44.6; E_value=0.0052; Accession=PF01266.14; Description=FAD dependent oxidoreductase
  Pfam annotation: Domain name=FAD_binding_3; Domain location=45-378; Score=96.7; E_value=6.9e-26; Accession=PF01494.9; Description=FAD binding domain
  Pfam module annotation: Pfam domain module=DAO::FAD_binding_3; Domain location=47-353::45-378
MGFLRFIRRYSFPFKDKTRNRAYALQHMQSRGFSKDGVLNGNDVVHPVLIIGAGPVGLVLSILLTKLGINCTVLERNKAFSKHPQAHFINNRSMEIFRKIDGLVEEIQRSQPPVDLWRKFIYCTSLSGSILGSVDHIQPQDLEHFVSPVSVAHFSQYKLTMLLLKRLENLGFQICAPESLEGNEQSCEKKIMMGHECVSIDASNDFVTVTASSIIKGKRVEQNIHCNILIGTDGAGSTVRKLVGIEMRGEKDLQKLVSVHFFSKDLGQFLLKENPGMLFFIFNAEAIGVLVAHDLRQGEFVLQIPFYPPQQTIEDFNPKACEKLISKLVGREFGDVDVIDIKPWVMHAEVAERFICSGNRILLAGDAAHRFPPAGGFG

SEQ ID NO: 221187 - protein, 157 aa, Glycine max
  Coding DNA Sequence Number=SeqID_104409
  Gene Ontology: Mol. function=peptidase activity
  Homolog annotation: Hit_ID=Q6Z3T8; Match level="QueryCoverage=82%, HitCoverage=40%, E-value=1e-49, Identity=64%"; Hit description=Auxin- regulated protein-like
  Pfam annotation: Domain name=OTU; Domain location=22-148; Score=99.8; E_value=7.9e-27; Accession=PF02338.9; Description=OTU-like cysteine protease
MEEVPNKSKLQAQKTRAIYCIPGDGRCLFRSVVYGACLRSGEPSPSLSRQKELADELRAKVVDEFIKRRVDTEWFLEGDFDTYTVQMRKPHIWGGEPELLMSSHVLQMPITVLMQDKSSSNLKVIAEYGQEYGKDNPIRVIYHGYGHYDALLKSSFH

SEQ ID NO: 221188 - protein, 787 aa, Glycine max
  Coding DNA Sequence Number=SeqID_104410
  Gene Ontology: Mol. function=protein serine/threonine kinase activity; Biological process=protein amino acid phosphorylation
  Homolog annotation: Hit_ID=Q6K5F8; Match level="QueryCoverage=93%, HitCoverage=99%, E-value=1e-177, Identity=49%"; Hit description =Putative PITSLRE alpha 2-1
  Pfam annotation: Domain name=Pkinase; Domain location=396-687; Score =347.2; E_value=2.7e-101; Accession=PF00069.15; Description=Protein kinase domain
  Pfam annotation: Domain name=Pkinase_Tyr; Domain location=396-687; Score=53.2; E_value=9.8e-16; Accession=PF07714.7; Description =Protein tyrosine kinase
  Pfam module annotation: Pfam domain module=Pkinase::Pkinase_Tyr; Domain location=396-687::396-687
MAASRHGGYRDNEFRDRESNFDVSRRGFNNNSKQEYDKITNGGRDVVRVGSKDARDRLSLKQKDIRDREAPNGSYRSSSSKSDSGSSGGCSSGLGPRRCEFSVKTMDREPGELSSESGSDDDGIESGSQEKYCEVATGEGNRARSPLERKRKFSPIVWNQDDSEVNNLSKLRVVTAVTTLPPLPIVRLSPNVPDRGVETHPVKNTEAEILELPTVTNPPLLSESPVGLHSLLPEQRWGNEQEAKQPEGEDFIPTHNISSSRWASGDNSPGDEGEINDDKEILKRRKLSPELGMRVRNKMLRLEESNIEDFVEARAKSSESEERSSRGRSSSGDYHPGNLSGKDDYMEIDGQGSRSETSGYHSDTDLEDDCRETSEPPVPPQRVVNMLQGCRSVDEFERLNKIDEGTYGVVFRAKDKKTGEIVALKKVKMEKEKEGFPLTSLREINILLSFHHPSIVDVKEVVVGSNLDSIFMVMEYMEHDLKGLMEGMKQPFSQSEVKCLMLQLLEGVKYLHDNWVLHRDLKTSNLLLNNRGELKICDFGLARQYGSPLKPYTHLVVTLWYRAPELLLGTKQYSTAIDMWSLGCIMAELLSKEPLFNGKTEFEQLDKIFRILGTPNETIWPGFSELPQVKVNFVKNKCNLLRKKFPATSFTGSPVLSDSGFDLLNKLLTYDPEKRITAEEALNHEWFREVPLPKSKEFMPTFPAQHAQDRRMRRILKSPDPLAEQHWKEMQQGESGTGGASCWFVSRYVFFTSLEPDLFQVNLFMLYHYIEMHMGRSLRIKSGIFAF

SEQ ID NO: 221189 - protein, 775 aa, Glycine max
  Coding DNA Sequence Number=SeqID_104411
  Gene Ontology: Mol. function=ubiquitin-protein ligase activity; Cellular component=ubiquitin ligase complex; Biological process =protein ubiquitination
  Homolog annotation: Hit_ID=Q93XR9; Match level="QueryCoverage=97%, HitCoverage=96%, E-value=3e-82, Identity=29%"; Hit description=Bg55 protein
  Pfam annotation: Domain name=Arm; Domain location=465-509; Score =11.8; E_value=0.41; Accession=PF00514.13; Description=Armadillobeta -catenin-like repeat
  Pfam annotation: Domain name=Arm; Domain location=511-549; Score=3.1; E_value=5; Accession=PF00514.13; Description=Armadillobeta-catenin -like repeat
  Pfam annotation: Domain name=Arm; Domain location=550-591; Score=9.2; E_value=0.86; Accession=PF00514.13; Description=Armadillobeta-catenin- like repeat
  Pfam annotation: Domain name=Arm; Domain location=635-675; Score=2.0; E_value=6.9; Accession=PF00514.13; Description=Armadillobeta-catenin -like repeat
  Pfam annotation: Domain name=U-box; Domain location=291-363; Score =77.9; E_value=3.1e-20; Accession=PF04564.6; Description=U-box domain
  Pfam module annotation: Pfam domain module=Arm::Arm::Arm::Arm::U-box; Domain location=465-509::511-549::550-591::635-675::291-363
MDVVEAEESFFAASDAKLHGEMCKCLFAIYCKILSLFPSLEAARPRSKSGIQALCSLHVALEKAKNVLQHCSECSKLYLSILHITSLITQAITGDSVLLKFEKAKCALEDSLKRVEDIVPQSIGCQIEEIVKELASTVFALDPSEKQVGDDLIALLQQGRKFSDSNDSNELECFHLAATRLGITSSRTALTERRALKKLIERARAEEDKRKESIIAFLLHLMRKYSKLFRSEFSDDNDSQGSQPCSPTVQRSLEDGIPGGHCHAFDRQLSKLSSFNFKPNNRKSGQMLLPPEELRCPISLQLMSDPVIIASGQTYERICIEKWFRDGHNTCPKTQQKLSHLCLTPNYCVKGLVASWCEQNGVPIPEGPPESLDFNYWRLALSDTESTNSRSVNSVSSCKLKGVKVVPVEESGISEQTGGNATESFSAQEEDNERYLSFLKVLTEGNNWKRKCRVVEQLRLLLRDDEEARIFMGTNGFVEALMQFLQSAVLEANVMALENGAMALFNLAVNNNRNKEIMIATGILSLLEEMISKTSSYGCAVALYLNLSCLDEAKHVIGTSQAVQFLIQILQDKTEVQCKIDSLHALYNLSTVPSNIPNLLSSGIICSLQSLLVGQGDCMWTEKCIAVLINLAVSHVGREKLMLAPGLISALASTLDTGEPIEQEQAASCLLILCNRSEECCEMVLQEGVIPALVSISVNGTSRGREKAQKLLMVFREQRRQDQSPVKTDQRESESSDLSMPPPETKLLSKSRSRRKVGKAFSFLWKSKSYSVYQC

SEQ ID NO: 221190 - protein, 51 aa, Glycine max
  Coding DNA Sequence Number=SeqID_104412
MMVGKKICKVWLRETGIEVRTEERIAGRKRTRTEGTKGKKEQCQIAILSKF

SEQ ID NO: 221191 - protein, 240 aa, Glycine max
  Coding DNA Sequence Number=SeqID_104413
  Homolog annotation: Hit_ID=Q1SKB0; Match level="QueryCoverage=79%, HitCoverage=25%, E-value=3e-49, Identity=54%"; Hit description =Ankyrin
  Pfam annotation: Domain name=Ank; Domain location=14-47; Score=3.0; E_ value=11; Accession=PF00023.20; Description=Ankyrin repeat
  Pfam annotation: Domain name=Ank; Domain location=48-80; Score=37.0; E_value=6.5e-08; Accession=PF00023.20; Description=Ankyrin repeat
  Pfam annotation: Domain name=Ank; Domain location=81-122; Score=4.1; E_value=8.1; Accession=PF00023.20; Description=Ankyrin repeat
  Pfam module annotation: Pfam domain module=Ank::Ank::Ank; Domain location=14-47::48-80::81-122
MLEYALKKGGNVSIEVNPLHRAACCRDMIIAHKKLLKEGYDVNAFDGQGHTPLMLAARGCHGEMCELLISYGAKCDIQNERHETALLLARENGAGNDAERVILDEVARRLVLCGGRVKKHTKCGKGSPHGKLLEMVGAAGMLRWGKSSKRNVICKEAEVGPSAKFRWNRRRKFDVDEPGMFHVVTTKNKQIRDDKVNLELWGSAKIYSSETGKLLVILGMDTRHVYSHKFMRKWMWAPVL

SEQ ID NO: 221192 - protein, 37 aa, Glycine max
  Coding DNA Sequence Number=SeqID_104414
MVALELPPILSIRKLWLEDERALGALLGKGQTKCEIP

SEQ ID NO: 221193 - protein, 125 aa, Glycine max
  Coding DNA Sequence Number=SeqID_104415
MFLTNEIWASIRIECSETRSGSSVTDVNIIEEDGPTLNISVWFPQQRCLTLCKPTKQTLSTKTFVFYLNRLELLLVVVLAEANPTQLRAINCWCEKEGYVNNHRCGGTKVFITWKIRYYDSNSLS

SEQ ID NO: 221194 - protein, 705 aa, Glycine max
  Coding DNA Sequence Number=SeqID_104416
  Homolog annotation: Hit_ID=Q6K649; Match level="QueryCoverage=47%, HitCoverage=86%, E-value=1e-133, Identity=67%"; Hit description =Kelch repeat-containing F-box protein-like
  Pfam annotation: Domain name=F-box; Domain location=68-115; Score =27.0; E_value=6.7e-05; Accession=PF00646.23; Description=F-box domain
  Pfam annotation: Domain name=Kelch_1; Domain location=157-206; Score =36.3; E_value=1.1e-07; Accession=PF01344.15; Description=Kelch motif
  Pfam annotation: Domain name=Kelch_1; Domain location=208-254; Score =54.4; E_value=3.8e-13; Accession=PF01344.15; Description=Kelch motif
  Pfam annotation: Domain name=Kelch_1; Domain location=256-303; Score =37.9; E_value=3.5e-08; Accession=PF01344.15; Description=Kelch motif
  Pfam annotation: Domain name=Kelch_2; Domain location=157-206; Score =7.4; E_value=4; Accession=PF07646.5; Description=Kelch motif
  Pfam annotation: Domain name=Kelch_2; Domain location=208-254; Score =29.9; E_value=9e-06; Accession=PF07646.5; Description=Kelch motif
  Pfam annotation: Domain name=Kelch_2; Domain location=256-303; Score =25.4; E_value=0.00021; Accession=PF07646.5; Description=Kelch motif
  Pfam module annotation: Pfam domain module=F-box::Kelch_1::Kelch _1::Kelch_1::Kelch_2::Kelch_2::Kelch_2; Domain location=68-115::157 -206::208-254::256-303::157-206::208-254::256-303
  Subcellular localization annotation: CTP_CleavageSite=55; ConfidenceScore=5.08e-01
LQVAKSWQRLWPTLGGYNLGSLRNSLQKTSKKNHCGSRTTVMEFESDWTKHRKSSAHTAQALNKDYSPILPGLPDDVAEYCLALVPRSNFPAMGGVCKIWRSFIQSKEFATVRKLAGMLEEWLYFLTTDCEGKESYWEVMDCLGHKCRSLPPMPGPGKAGFQVVVLNGKLLVMAGYSVIEGTAFASAEVYQYDSCLNSWSRLSDMNVSRYDFACAEVNGLVYAVGGYGVNGDSLSSAEVYDPDTDKWALIESLRRPRWGCFACGFEGKLYVMGGRSSFTIGNSKFVDIYNPERHSWCEIKNGCVMVTAHAVLGKKLFCIEWKNQRKLAIFSPEDNSWKMVPVPLTGSSSIGFRFGILDGKLLLFPLEAETAFQTLLYDPNASLGSEWQTCDIRPSELVVEGAENPNAMFGSAQPSSSPFGTPAFGTPSSTPAFGSSLFSTPFSSQQPQPQQQQQQQTPLFQQQQQQQTSSAFGFQNSLAFAAPQSSPFPNAQLTTQMANVAPVPFSLADRDVQTIVDAYKDDPGNPKYAFKHLLFSVTEPQFRVKPAGVSDIMWAEAIGKLQGMESPDRERLWPQLVQGFKDLSQRLKVMRIVEALEEKGCRIPLTKGEAELAEKLATITRKLKGSGAELSRRVQNLLIVSRVKANSNGFGSSVYLPGSTKIHEQSLGDLQEVLQQQLEAIARLGNVLKRDIRDMEIMMTEDTKN

SEQ ID NO: 221195 - protein, 40 aa, Glycine max
  Coding DNA Sequence Number=SeqID_104417
MNHNARPNEKLDEHCKLMGKVEGDSLKIVGVGTAFEIKPS

SEQ ID NO: 221196 - protein, 206 aa, Glycine max
  Coding DNA Sequence Number=SeqID_104418
  Homolog annotation: Hit_ID=Q676U0; Match level="QueryCoverage=99%, HitCoverage=97%, E-value=6e-29, Identity=40%"; Hit description =Disease resistance gene
MEVHSPVGAKRLWNVLRVTFFMIRKGLISKRKMIMDMNLMMKKGKVVRKSLSNLMSSHHHHHNPKSVTRGGAALGVHYEFSCNSSPNPIFFNMPKRKHHFNFPCIHAPEVLEEEEETDFSLEVESDVPKAVVTVPKTQEYVYNFFVEKKSPLLSPFSVRVSNYSALDENEDIGNDHVDDQAEDFIRRFYEQLRTQSPVQFLRYQEM

SEQ ID NO: 221197 - protein, 116 aa, Glycine max
  Coding DNA Sequence Number=SeqID_104419
  Gene Ontology: Mol. function=signal peptidase activity; Cellular component=signal peptidase complex; Biological process=signal peptide processing
  Homolog annotation: Hit_ID=Q2QS62; Match level="QueryCoverage=69%, HitCoverage=53%, E-value=6e-21, Identity=54%"; Hit description =Microsomal signal peptidase 12 kDa subunit family protein
  Pfam annotation: Domain name=SPC12; Domain location=1-80; Score =137.3; E_value=4.3e-38; Accession=PF06645.4; Description=Microsomal signal peptidase 12 kDa subunit (
MDWQGQKITEQLMQLIIVAFAVIAFATGYLMASFQMMILIYAGGVVLTTLVTVPNWPFFNHHPLKWLDPSELEKHPKPQPSPNNFVYLTLLPSLSPSLDITMYFTSLDCKGYICSL

SEQ ID NO: 221198 - protein, 72 aa, Glycine max
  Coding DNA Sequence Number=SeqID_104420
MMIHQLIRHFENMKIAVKDIVLRVALCSPIALQCPEARIFSTTPFHFSHAKSKITRVYFRKCPAAGIHPHSN

SEQ ID NO: 221199 - protein, 475 aa, Glycine max
  Coding DNA Sequence Number=SeqID_104421
  Gene Ontology: Mol. function=GTPase activity; Cellular component =membrane; Biological process=cell cycle
  Homolog annotation: Hit_ID=Q010M4; Match level="QueryCoverage=77%, HitCoverage=84%, E-value=5e-74, Identity=39%"; Hit description =Homology to unknown gene
  Pfam annotation: Domain name=DUF258; Domain location=86-395; Score =428.5; E_value=8.9e-126; Accession=PF03193.7; Description=Protein of unknown function, DUF258
  Pfam annotation: Domain name=MMR_HSR1; Domain location=252-363; Score= 1.7; E_value=0.0007; Accession=PF01926.13; Description=GTPase of unknown function
  Pfam module annotation: Pfam domain module=DUF258::MMR_HSR1; Domain location=86-395::252-363
  Subcellular localization annotation: CTP_CleavageSite=15; ConfidenceScore=5.36e-01
MSFASSFSMLRHRAVAAYAPTLLLRRFRCLPTIAARHQQQQQNPNKQAAAPSRNLLKAKQTLKEYSCLAPVLSLEDSPPLTESQAIGVVAASQANFMRVIVPENDEPSGSFRGVEILCVVRALLKKIKRRVMVGDKVLVGSIDWVDRRGMIENVFQRTSEILDPPVANVDQLLVLFSLEHPKPEPFTLTRFLVEAESTGIPLMLALNKTELVDNEIISSWKARLRSWGYEPVFCSVESGHGLDLLGYKLRDQTTVIVGPSGVGKSSLINALRSNPSDAAEGDNWFEPILGSKWLEDQRVGEVSTRSGRGKHTTRHVSLLPLSEGGFLADTPGFNQPSLLKVTKQSLAQTFPEIRKMLSANETEKCSFNNCLHLGEPGCIVKGDWERYSYYFQLLDEIRIREEFQLRTFGTKREGDVRLKMGDMGVQQAEPRLEPKKHRRQSRKSINQSILDELDDDDDDNLLDEENDPILRALFR

SEQ ID NO: 221200 - protein, 360 aa, Glycine max
  Coding DNA Sequence Number=SeqID_104422
  Gene Ontology: Mol. function=DNA binding; Biological process=DNA integration
  Homolog annotation: Hit_ID=Q8FC53; Match level="QueryCoverage=54%, HitCoverage=73%, E-value=1e-108, Identity=93%"; Hit description =Transposase insF for insertion sequence IS3A/B/C/D/E/fA
  Pfam annotation: Domain name=Transposase_8; Domain location=3-80; Score=92.3; E_value=1.5e-24; Accession=PF01527.10; Description =Transposase
  Pfam annotation: Domain name=rve; Domain location=191-353; Score =84.2; E_value=4.1e-22; Accession=PF00665.16; Description=Integrase core domain
  Pfam module annotation: Pfam domain module=Transposase_8::rve; Domain location=3-80::191-353
MSGKRYPEEFKIEAVKQVIGRGHSVSSVATRLDITTHSLYAWIKKYGPDSSTNKEQSDAQAEIRRLQKELKRVTDERDILKKAAAYFAKLVLNVHPSGFYAWFKQPYSQRHQVDLRLTGQIKQFWLESGCVYGYRKIHLDLRDSGQQCGVNRVWRLMNRAGIKAQVGYRSPRAHKGEASIVSPNRLQRQFNPDAPDKRWVTDITYIRTHEGWLYLAVVVDLFSRKIIGWSMQSRMTKDIVLNALLMALWRRNPQKQVLVHSDQGSQYTSHEWQSFLKSHGLEGSMSRRVSVGMVRAIRCHRQNMKTSIINGSEVSRLSVAIQAADAGDLLPVAGTHALPLRLQFEVLPLQCRHRRKSNKI

SEQ ID NO: 221201 - protein, 310 aa, Glycine max
  Coding DNA Sequence Number=SeqID_104423
  Gene Ontology: Mol. function=DNA-directed DNA polymerase activity; Cellular component=extrachromosomal circular DNA; Biological process= DNA replication initiation
  Homolog annotation: Hit_ID=Q46775; Match level="QueryCoverage=58%, HitCoverage=60%, E-value=2e-74, Identity=78%"; Hit description=RepI
  Pfam annotation: Domain name=Rep_3; Domain location=2-177; Score =42.0; E_value=2e-09; Accession=PF01051.12; Description=Initiator Replication protein
DKVIGDKVQLSFVEFAKLCGIPSSRSSKQLRERISPSLKRIASTTISFSSKSGDDAKEYITHLVQSAFYDTKKDIVILQADPKLFELYEFDHKVLLQLKAINALKRRESAQALYTYIESLPKNPAPISLARLRERLNLRSPVFSQNQTVRRAMEQLKEIGYLDYSEVQKGRSVYFQLELIEPEDEIHTYITIDRVGAADDDHARITKAIVKLTAQDASDEDVIKHLFDSGYLDETRNVVAGRIALRSYYFSDDADIEVEAPQIAGVKVERGFQQQGAGHQHQLLAYEEMFQGTVSSIEVHPRVLVITPHF

SEQ ID NO: 221202 - protein, 700 aa, Glycine max
  Coding DNA Sequence Number=SeqID_104424
  Gene Ontology: Mol. function=cobyrinic acid a,c-diamide synthase activity; Cellular component=intracellular; Biological process =cobalamin biosynthetic process
  Homolog annotation: Hit_ID=Q2TTW1; Match level="QueryCoverage=50%, HitCoverage=99%, E-value=1e-154, Identity=74%"; Hit description=ParA
  Pfam annotation: Domain name=CbiA; Domain location=412-652; Score =45.1; E_value=2.4e-10; Accession=PF01656.13; Description=Cobyrinic acid a,c-diamide synthase
MTLIVKTQHYCRIKRMNVSAKGGIPVCRVFNHNVEPLFVIAMQKCRGLQQFAAQQHQLLLFICPFTFARGSRKPVQRIKQSPIFNNAFAQNGHMAVAAYIVLICQQFHDALGHVHADKINGLTPDFLHTCQVGANDVFIMKMFWEASITGTDAGAFHAIAAEPLCKLAGQSPAFSDEFGKRIANPITGAAIQSATSMPGRSSLQNSVSGPDQLSTSFRDSTSLGLNAVSVDGKSAPSYFSLPVMLAHRGLINAGVHPPDYQVKILFKPPRYARCMAGKGQGACGISRAASYQIPVERMMKSNYGGVDETARRANAMLRSMSDDIIDKRQEFGLDQFYQTFTRNAVANLPKLSRRAVEQAIEEMESKGHVFGKKDAGNSKHYALTVQDVVDIYAHRKVPKYRDIHKGEGPFVIFVVNLKGGVSKTVSTVTLAHGLRVHPDLLQYDLRNLVIDLDPQASSTMFLNQANSIGSIVETAAQAMLNDLDAQQLREQIIKPTIIPGVDIIPASIDDGFVASQWDRLVQEHLPGVLPSEVLRRNIIDRVGSDYDFIFVDTGPHLDAFMLNAIAASDLLLTPTPPAQVDFHSTLKYLTRLPDMLEQLEEEGITPRIKGNIGFMSKMTSKRDHEMTHGLARDVFTSYILDATLPRLDGFERCGETFDTIVSADPQSYPGSSEALKNAKREAERFTQAVFKRIEFVRGMQ

SEQ ID NO: 221203 - protein, 109 aa, Glycine max
  Coding DNA Sequence Number=SeqID_104425
MPQIVTSEPRNQVTDTDAAFRNNVLLPAEQRGLGSGEAFEQVKIRICKHDGALLRRVLDAFVFRKEVSKVFGIAVGFAGNCKQINDFVTAAGQGNQPLINMALQPGQVI

SEQ ID NO: 221204 - protein, 159 aa, Glycine max
  Coding DNA Sequence Number=SeqID_104426
  Gene Ontology: Mol. function=protein binding; Cellular component =fimbrium; Biological process=cell adhesion
  Homolog annotation: Hit_ID=P08191; Match level="QueryCoverage=84%, HitCoverage=43%, E-value=7e-16, Identity=37%"; Hit description =Protein fimH precursor
  Pfam annotation: Domain name=Fimbrial; Domain location=30-159; Score=- 36.3; E_value=0.013; Accession=PF00419.10; Description=Fimbrial protein
  Subcellular localization annotation: CTP_CleavageSite=65; ConfidenceScore=5.61e-01
MAYGSKVRLASTSDSSVNVVIPFVAANRSVIVNRNCDFSSQSASVTLPEYSVAGTSAFSVPLSLSCTAGGNIYGTMSLTGTTASGDNTVFTSDGSAQGVGVRFYYNSQPVAANQGLQFGPISGNNIPTPLGLSVAYARTGGRLTAGTVQSRVNLNFTYY

SEQ ID NO: 221205 - protein, 358 aa, Glycine max
  Coding DNA Sequence Number=SeqID_104427
  Gene Ontology: Mol. function=DNA-directed DNA polymerase activity; Biological process=DNA repair
  Homolog annotation: Hit_ID=Q8Z1G9; Match level="QueryCoverage=66%, HitCoverage=82%, E-value=4e-58, Identity=40%"; Hit description=UV protection protein
  Pfam annotation: Domain name=HTH_3; Domain location=25-79; Score =25.9; E_value=0.00014; Accession=PF01381.12; Description=Helix-turn -helix
MADLTPDELTQVHEKVAAMRLDSQLYKLREALSKTQKQQAEAMGIAQPSVAAIEGRGEDLKIATLKRYVEALGGQLTIGVNMPGEMRLTHFFDKCRPPEKKTGDITFTCPAIYTCNRNVRPACGPGRAEHLPLHVPFGIHSLSCKPHATHSGLINAGHHLHQLHSVFSWLPVIKEIKLTDSIRGKVIEHDARFHVSATFKPDAINAVSMEHPVDCMRRGANKYADKSLELPLASEIFGRSFPQQNIGFAVQFTDGSLQNYINVFPDEGRIFQKSSGALWIVWSKREHAPETAGGIHHMCSEAAEMFRIFAAVNTRQLQKHFINAVMLNAGRHLLQGCHYALAEIMVYVECKSTELVGV

SEQ ID NO: 221206 - protein, 269 aa, Glycine max
  Coding DNA Sequence Number=SeqID_104428
  Gene Ontology: Cellular component=nucleus; Biological process =response to DNA damage stimulus
  Homolog annotation: Hit_ID=Q2HRV5; Match level="QueryCoverage=54%, HitCoverage=18%, E-value=6e-18, Identity=43%"; Hit description=DNA repair metallo-beta-lactamase
  Pfam annotation: Domain name=DRMBL; Domain location=90-249; Score= -8.6; E_value=0.037; Accession=PF07522.4; Description=DNA repair metallo-beta-lactamase
MALSFAASTPLALEEEPLPHTDDDCDVNNDDDAFFGIVSLDDKDKGKKMKQVNLFQIWGFKRNDVVGSVESSSGHSGYCEEGGGSSERKIVKPENCGSILHHTGKEFENTKSSRKRKGSGDKGYLKTYKGQFTAILAFRPTGWTFSERISNDLELIKPVSKRNITIYGYSVHSNDLLSDAKMHPGCDIRIKKYSLSSRAVQYTSPFSSFFQGFPTVSTPASQNCEILFSELISILIQFLKPDKIIPTVNVWNAANREKMQSYSRDWLKG

SEQ ID NO: 221207 - protein, 83 aa, Glycine max
  Coding DNA Sequence Number=SeqID_104429
MMVKVVEEEGEGLVFHVDKEKEAHMDFGLCLVGRFLMSRTIYKVSSHEGEYGSSVATRAGGDNKGNEIRIILVLVQSSSVLQI

SEQ ID NO: 221208 - protein, 263 aa, Glycine max
  Coding DNA Sequence Number=SeqID_104430
  Gene Ontology: Mol. function=RNA-directed DNA polymerase activity; Cellular component=chromatin; Biological process=chromatin assembly or disassembly
MAIDRECLYKGQSSNGLANSGETSYNRIGNAGHKHDWKRFSLVWVCCYHSLHHRETPCPQGDRCLRVGTNLPKWSLLVAILSIVPELIGGVVFGCLTYGPEWSKGQSISNLPYSLRNLVRAIVALTKLLKFICDGCLAFPTKSVKHVLLGRKKEINGIYSKSTWGIIRNFWRWFAIGDLIRQQVCGGMALGVVEPLCEAEEFAPLGWFVMNEAEQILLQSAVEHLRLAVALRMVGSAHPQLGPTKPKEFTPELADEDGVPIGN

SEQ ID NO: 221209 - protein, 328 aa, Glycine max
  Coding DNA Sequence Number=SeqID_104431
  Homolog annotation: Hit_ID=Q2HRW5; Match level="QueryCoverage=47%, HitCoverage=87%, E-value=2e-26, Identity=58%"; Hit description=T -snare
  Pfam annotation: Domain name=SNARE; Domain location=103-165; Score =64.7; E_value=2.9e-16; Accession=PF05739.9; Description=SNARE domain
  Subcellular localization annotation: CTP_CleavageSite=59; ConfidenceScore=5.48e-01
MSFQDIQIGPNPSSRRNQSPSQAVATGIFQIKTAIAAFRRLVDGVGTVRHSRTPSEAVPTSSGSGEESVGIDVESQPFIREQKRQEILLLDNEISFNEAMIEEREQGIREVEEQIEQANEIFKDLAVLVHYQGVVIDDIHSNIDASAGATTQARVQLAKASKSVKSKTSWPLKANPLMSGGQFASFTPRIGDGASNIWFHNWSGSGCLSTKVLYVDIQDVDLTLSDVIQDGKYNLQRLATPLNEVRNTFNFLPPLIHHNVTDSFVWVGNTNGIYTTQSAYGWVTKVEASSPMQNLDFKWIWSCNIPLSIKIFLWQIWHNSLPVFLVLN

SEQ ID NO: 221210 - protein, 121 aa, Glycine max
  Coding DNA Sequence Number=SeqID_104432
MATAYKSRYYPLGWVPSLPGAQIPHFEASHVIVKACNQMIGEDHKANDSDPTHPTVWKCPGVSIIKINFDDSVMSQNNIGMDMVARDHNDLMLAGATWTVPTVFEPRIAKVLCYRWAIHLS

SEQ ID NO: 221211 - protein, 313 aa, Glycine max
  Coding DNA Sequence Number=SeqID_104433
  Gene Ontology: Mol. function=ATP-dependent helicase activity; Biological process=regulation of transcription, DNA-dependent
  Homolog annotation: Hit_ID=Q94JY9; Match level="QueryCoverage=85%, HitCoverage=36%, E-value=1e-113, Identity=69%"; Hit description =Putative helicase
  Pfam annotation: Domain name=TRCF; Domain location=120-228; Score= -27.5; E_value=0.022; Accession=PF03461.5; Description=TRCF domain
MEKFALGEIKILICTNIVESGLDIQNANTIIIQDVQQFGLAQLYQERLAAIEECRELGQGFQLAEKDMGIRGFGAIFGEQQSGDVGNVGIDLFFEMLFESLSKVEDHHVVSVPYHSVQVDININPHLPSDYINYLDNPMKIINDAERVAEKDIWSLMQFTENLRRQYGKEPRSMEILLKKLYLRRMAADLGITRIYSSGKMIYMKTNMSKKVFKMMTESMASDLHRNSLVLEGDQIKAELLLELPKEQLLNWIFQCLAELHASLPSFINTGRQNKLGLSVDTSEHVLPFKMYIIRATSMGLVTTYKHVGVGVI

SEQ ID NO: 221212 - protein, 645 aa, Glycine max
  Coding DNA Sequence Number=SeqID_104434
  Gene Ontology: Mol. function=RNA-directed DNA polymerase activity; Cellular component=chromatin; Biological process=chromatin assembly or disassembly
  Subcellular localization annotation: CTP_CleavageSite=55; ConfidenceScore=5.41e-01
MPELDTLVSTVKGMLKFGKASTGVVVMSSFRTSKSFWASEDQWNWSFFNNWVKERQSARVGFDAPDRDKVSKVFNSALTENTFKGFQAEIALLQCPQDTIKVIKGIHGRLKCGRSITESERHHHILVVALMSTESCLKYVMLDHVDLVEALCQVHFRKPRGMPQIIEKFINGSEGKSVFDGDGVQGPIVDATAWPDELTTKHIVHLSFNFLLLKVRIMVGTDVHRFGIGFEMNGMVRVFGEETTDGRWNSGVAGSNGFSRLKLEVEEAHYLMGRYQALNLSMGDLRWAGSGVTLDGDGLTLVNKAYGEVKDKCMALNQNGHVAANPIAHYVGTVTHHDGQTRNGFGCEVQEVSEAEVDKIMGAPSIDEDNNLVAIDGASDTQRGGYWVAGQLMKAQLCWWVGEGIRRQRLFILGGHKEEKLGTAAVVRAITLFTVVAKAAFAAKGHFRLGKAFIGSTWWCQQKRRQSGSKELVVGGGRWGRDRATAWTRDRGCMASTSRQMSGKSPDMKQLRRNGVGRPTIQFAKASNIARNELTDPERGPGRQLIVAVKPLKPTQGFTVKGHWYRRSEERRGSCEGEVVAGKGLVKGFPGLGGERRFRRAESEGSVKAPIDSAYTKDKALMVLPAQGRHAITELEMQGISTIGK

SEQ ID NO: 221213 - protein, 164 aa, Glycine max
  Coding DNA Sequence Number=SeqID_104435
  Gene Ontology: Mol. function=RNA-directed DNA polymerase activity; Cellular component=chromatin; Biological process=chromatin assembly or disassembly
MAATVSNQIPAWIFGFDQFLQAFRQELRADCRSLTQLLKKDQFHWSSEAQKDFEVLKLDMTTTPVLALPNFNIPFTVETNVSSSGMGVVLMQCGHPIAFFKMEAIPPGSCLRHLDGPQELAGTDDATIQGRPPQRGRRRSVTCTGCNSGSGSFLHPDRATLQIP

SEQ ID NO: 221214 - protein, 578 aa, Glycine max
  Coding DNA Sequence Number=SeqID_104436
  Gene Ontology: Mol. function=microtubule binding; Cellular component =phragmoplast; Biological process=positive regulation of microtubule polymerization
  Homolog annotation: Hit_ID=Q6ZJ66; Match level="QueryCoverage=76%, HitCoverage=88%, E-value=1e-117, Identity=54%"; Hit description =Putative microtubule-associated protein
  Pfam annotation: Domain name=MAP65_ASE1; Domain location=55-558; Score=-80.6; E_value=5.2e-06; Accession=PF03999.3; Description =Microtubule associated protein (MAP65ASE1 family)
GTFKSNGFIPDTHWNEKFNIARDFMWIPVAGTAGKRLIYFILYIIWDEVGEDKFEREKVLLDLEQECLEVYRRKVDRANISRAHLHQELAEAEAEFTHLLLSLGERSLPVRPEKRAGSLKEQLDSITPALREMRLRKEERLNQFRTVQGQIQKISAEIAGNSDNEPSSIVVNENDLSLKRLEEYQNELQRLHNEKNERLQQVEKYIDIIHSLSTILGKDSSAIIMEVHPSLNDLCGITKNISDTILDKLNITVESLFEEKQNRLEKLHHLGKALSNLWNLMDTPYSERQSFSHVINLLSLSSAEVTDPGSLTLEIVQQTEAEVKRLDQLKASKMKELFQKKQEELELICKKSHVEIPSREEMNNIINLINSGEIDHSDLLLSMDEQISRAKEEASSRKAIMEKVEKWMLACDEERWLEEYSRDENRYSVSRGAHKNLRRAERARIMPWEKKRIQSQVVERDNTYVSRPGTSSRRLPSRSMNGALDSSAVLNRRLSMGIQQLGSNSINSGNHGLSFIKDGRNALRKKIYGEPTFTSPTRDGASSAISKKTVVQLQKNKHGAFYVLMFLILSCPNGRAHT

SEQ ID NO: 221215 - protein, 168 aa, Glycine max
  Coding DNA Sequence Number=SeqID_104437
  Gene Ontology: Mol. function=sequence-specific DNA binding; Cellular component=intracellular
  Homolog annotation: Hit_ID=Q9FHS0; Match level="QueryCoverage=73%, HitCoverage=93%, E-value=3e-34, Identity=63%"; Hit description =Arabidopsis thaliana genomic DNA, chromosome 5, P1 clone:MNL12
  Pfam annotation: Domain name=CBFD_NFYB_HMF; Domain location=13-77; Score=87.3; E_value=4.7e-23; Accession=PF00808.13; Description =Histone-like transcription factor (CBFNF-Y) and archaeal histone
  Pfam annotation: Domain name=Histone; Domain location=10-80; Score =17.7; E_value=0.0025; Accession=PF00125.14; Description=Core histone H2AH2BH3H4
  Pfam module annotation: Pfam domain module=CBFD_NFYB_HMF::Histone; Domain location=13-77::10-80
MADEEENGVSIQLEFPKGRVKKIMALDKDVKRVSSEALFLVSRSTELFLQFLAEKSAQVAIEKKRKTVNLEHIRVAVKRHQPTRDFLLDELPPPSQAAKPDKPTQPAGRPKLDPAPRGTRCIDQFFRKPEPENTAQAPGQPPENPAQAQSPENPDQDQAQSPVPVDES

SEQ ID NO: 221216 - protein, 134 aa, Glycine max
  Coding DNA Sequence Number=SeqID_104438
  Homolog annotation: Hit_ID=Q19D24; Match level="QueryCoverage=35%, HitCoverage=23%, E-value=2e-09, Identity=66%"; Hit description=TOM20
MEFSQDDFDRLLLFEHTRKTAEANYAENPQDADVRIVLHYTLINLSSFYDLLCSHRTCFVSEFVRFLLEVILCHITTFKIGRTKLRYNAIIIELEFYRVLRITKNLTRWGGALIELSSFQAPRDAKAMIDGISR

SEQ ID NO: 221217 - protein, 149 aa, Glycine max
  Coding DNA Sequence Number=SeqID_104439
  Gene Ontology: Mol. function=protein binding; Cellular component =mitochondrial outer membrane translocase complex; Biological process= protein import into mitochondrial outer membrane
  Homolog annotation: Hit_ID=P92792; Match level="QueryCoverage=98%, HitCoverage=50%, E-value=1e-27, Identity=47%"; Hit description =Mitochondrial import receptor subunit TOM20
  Pfam annotation: Domain name=TOM20_plant; Domain location=1-148; Score=50.7; E_value=2e-16; Accession=PF06552.3; Description=Plant specific mitochondrial import recep
TEAKGYFDKALEYFQKAAEEDPENDLYRKSLQVAVKAPELHMEIHKNGLGLMSNAGSSATSKEKPCLGSSCLKFCGYKASHVSMSLEIASSTNFSWCLSKYCHTIVFHESKKQKSNDFKYDIFGWIILAVGIVAWVGMAKSNIPPPPPR

SEQ ID NO: 221218 - protein, 761 aa, Glycine max
  Coding DNA Sequence Number=SeqID_104440
  Gene Ontology: Mol. function=oxidoreductase activity; Cellular component=membrane; Biological process=electron transport
  Homolog annotation: Hit_ID=Q2R447; Match level="QueryCoverage=57%, HitCoverage=84%, E-value=1e-133, Identity=52%"; Hit description =Cytochrome P450 family protein, expressed
  Pfam annotation: Domain name=p450; Domain location=1-437; Score =210.3; E_value=4.6e-60; Accession=PF00067.12; Description=Cytochrome P450
  Subcellular localization annotation: CTP_CleavageSite=45; ConfidenceScore=5.28e-01
MGPLAHRKLAAMATSPKAKKLMTLSLGTNPVVISSHPETAREILCGSNFADRPVKESARMLMFERAIGFAPYGTYWRHLRKVAITHMFSPRRISDLESLRQHVVGEMVMRIWKEMGDKGVVEVRGILYEGSLSHMLECVFGINNSLGSQTKEALGDMVEEGYDLIAKFNWADYFPFGFLDFHGVKRRCHKLATKVNSVVGKIVEERKNSGKYVGQNDFLSALLLLPKEESIGDSDVVAILWEMIFRGTDTIAILLEWIMAMMVLHQDVQMKARQEIDSCIKQNGYMRDSDIPNLPYLQAIVKEVLRLHPPGPLLSWARLAIHDVHVDKVIVPAGTTAMVNMWAISHDSSIWEDPWAFKPERFMKEDVSIMGSDMRLAPFGAGRRVCPGKTLGLATVHLWLAQLLHHFIWIPVQPVDLSECLKLSLEMKKPLRCQVIRRVLCDFNVKVRFYPFLVLFDSQILDTDIAIDAGVSVSDWLGSLKSGSWMHCVRRNASQERGSPKVSRAQRKVSQNGQAAEKKVTDLITSSARKNKSLSTLENKTREPIPPTDLNNGYEFMDSGTSDACLENDAVDGVSLDFMGCNNQAVHLESGTIFSPGFHLSKNSGGVDRVDFIKIFQNEDHKRVSPCQEIESPQEDAVDGHVSRDSDTAMEVDINNSSLSTKNVNGCNSDYDGNGLSMEVSAIYLAMKNSKLECVDEHSQDPMSSEMCIEEDEFEDFDDFDPYLFIKTLPDLSTVVPTFRRLLLPKQTRSCPSTTLVLDLD

SEQ ID NO: 221219 - protein, 59 aa, Glycine max
  Coding DNA Sequence Number=SeqID_104441
MVKHFTCTLHGYRSKDYDFKYFNNNTSGIGNQDSWYMVDNEHKSYSLSAASASCFRGRE

SEQ ID NO: 221220 - protein, 210 aa, Glycine max
  Coding DNA Sequence Number=SeqID_104442
MEAIIQGTLEATSGRVIVVNEQVDDIHEHHKKNVTDIMMLGEEDTILCRDQLKPKKVTRCSKYSSSSLDVDETLVTSNGAICVEAIVVNSSNMAAFHLGILRALVRHEGSTGSELDEEINAWELRLGKGDVAVVVDLLVVHGASHGKQRQPKTRYLEEDYGHGEFLEGTKKIATYTPDLQSFLAEEPLPLSGSLPQNAREKFNRHRVSLT

SEQ ID NO: 221221 - protein, 345 aa, Glycine max
  Coding DNA Sequence Number=SeqID_104443
  Gene Ontology: Cellular component=nuclear chromosome; Biological process=microsporogenesis
  Homolog annotation: Hit_ID=Q9M6R5; Match level="QueryCoverage=89%, HitCoverage=49%, E-value=6e-73, Identity=50%"; Hit description =Meiotic asynaptic mutant 1
MANKPQEQEDYGIIEEDNTQDPVDDEQQLVRVKEWINCCHRDTIEFNDVLSNFPDISVVLSEEITDKLVEEGVLSKIGKETYAINKDKNLEYEFAIVKEEIDGQIPQVFDRALQVEDRIYMKALYHVLPMTHVSVTKLQSLLEGEVNQIAARKILDKMVRDGIIEPKGSKRLGKRVIHSDLTERKFIEVQKALSATTEAMDVDHCEPNSKSKKTGFRLNGSNYDVSTYGVLHSIGSDLTRMKVTSETNYSDSGNGQKASKAKEPGNTPISRPVISRESFAQGKENGRTNGIANQGDEADTIICSKSSQDKRPRKTSALIKVVPRPQLHSVVVTSFHFITMAHDLS

SEQ ID NO: 221222 - protein, 262 aa, Glycine max
  Coding DNA Sequence Number=SeqID_104444
  Gene Ontology: Cellular component=nuclear chromosome; Biological process=microsporogenesis
  Homolog annotation: Hit_ID=Q9M6R5; Match level="QueryCoverage=98%, HitCoverage=44%, E-value=2e-88, Identity=60%"; Hit description =Meiotic asynaptic mutant 1
  Pfam annotation: Domain name=HORMA; Domain location=13-214; Score =124.4; E_value=3.2e-34; Accession=PF02301.8; Description=HORMA domain
MVVAQKVKEAEITEQDSLLLTRILLRIAIFNISYIRGLFPEKYFNDKSVPALGVYDALQKKYLKTLLFCVCEAVDGPMLEEYAFSFSYSDSDNQEVSMNINRTGNKKNRGTFKCNSTTEVTPHQMRSSACKMIRTLVQLMRTLEKMPEEQISVPFILSMNFYIVETRSAYFARQLVPADYEPPFFKGCTDEETYHPWEKNPLKMEVGNVNSKHFVLALKVKSVLDPCEDDNEGVQDDFSAGDDSMQQNEYYDTDSEVNEDVA

SEQ ID NO: 221223 - protein, 144 aa, Glycine max
  Coding DNA Sequence Number=SeqID_104445
MGIDTSLDIEIMMLMFDFINLVVHHKGRFKRDDHGTLEYVDDILNMCRICIAHLAKDVHAYFEHTMDDFLNLVGGVLDEVVVNQIKDRAEEQPTIVSMVNTRGQLKLVTVQKGLLPQAEEEDNKGMDVGGEEDINLGWERRRRG

SEQ ID NO: 221224 - protein, 218 aa, Glycine max
  Coding DNA Sequence Number=SeqID_104446
  Homolog annotation: Hit_ID=Q1T493; Match level="QueryCoverage=81%, HitCoverage=33%, E-value=1e-10, Identity=28%"; Hit description =Nucleic acid-binding, OB-fold, subgroup
MDPSQITMIPCIQRGSQTFGSSLYFFGDRFLHNAHVKCFDKVSQVKKECMCVIVATITNLLVANGWIYEACLKCNKKVYEEALSFICVGCGNESASTIPKFRVEVRVAQSLEYAIFTLWDRECYALINETATDIKQIIIYEEGVFDPIDIPEALNRVLGKRLAFRFKDEDEPSISLVHENNDVIDSRCKSFQCTRWKHKNLLRLGLYVDMNKLPSSAA

SEQ ID NO: 221225 - protein, 174 aa, Glycine max
  Coding DNA Sequence Number=SeqID_104447
  Gene Ontology: Biological process=DNA dealkylation
  Homolog annotation: Hit_ID=Q9SA98; Match level="QueryCoverage=99%, HitCoverage=47%, E-value=2e-42, Identity=57%"; Hit description =Alkylated DNA repair protein alkB homolog
MEVTTEKDMSLRKCRTVSASVLLRKLRWSTLGLQFDWSKLVEILFALLQRCQTKPFCAKRNYDVSLPHNKIPEALCELSKQLAKPALPGGVEFRPDAAIVNYFGLGDTLGGHLDDMEADWSKPIVSLRCQQENPERILPWQCSFEAVMLYLWLEMQGNAFMGFLGSSQIKKMLK

SEQ ID NO: 221226 - protein, 48 aa, Glycine max
  Coding DNA Sequence Number=SeqID_104448
MGQNRLRQWSDAGMKLKAETNQEARVMTDRSSSLAQLWTNGKRRCKAA

SEQ ID NO: 221227 - protein, 68 aa, Glycine max
  Coding DNA Sequence Number=SeqID_104449
  Gene Ontology: Mol. function=transferase activity; Biological process= DNA integration
MNIAQNRQKSYQDNRRKDLEFKANKALRGNEILLVKVIWGGASGKDATWELESQMREVYPALFQSGEL

SEQ ID NO: 221228 - protein, 61 aa, Glycine max
  Coding DNA Sequence Number=SeqID_104450
  Pfam annotation: Domain name=DUF493; Domain location=4-61; Score =34.9; E_value=2.9e-07; Accession=PF04359.5; Description=Protein of unknown function (DUF493)
MHRSEKYLAPLSYMCGRVKQKLSARGKYVSVNIGPVQVVSSEQVQAVYNAMRRDDRMKYFL

SEQ ID NO: 221229 - protein, 147 aa, Glycine max
  Coding DNA Sequence Number=SeqID_104451
  Homolog annotation: Hit_ID=Q2QW42; Match level="QueryCoverage=28%, HitCoverage=22%, E-value=3e-08, Identity=64%"; Hit description =Expressed protein
MTFWHDIMISLIQEPKFRTSPTIFSRGHVILQQGDQTHNKITHHTAMQKPELDAQTFQMEQREILYGVMGFRFRIFLIKLLHINILRKSDGRNFPCRSRKLCRWCPDKQSKKQNITQFSKKKSKFHHHDQVNIQNKNSVNPENSQNH

SEQ ID NO: 221230 - protein, 217 aa, Glycine max
  Coding DNA Sequence Number=SeqID_104452
  Gene Ontology: Mol. function=ribonuclease H activity; Biological process=RNA-dependent DNA replication
  Homolog annotation: Hit_ID=Q1SZM6; Match level="QueryCoverage=80%, HitCoverage=64%, E-value=1e-27, Identity=36%"; Hit description =Ribonuclease H
MCCSEKYKKYTLLTYSFNLWRVFVGLYGTLNAFAFDGGTWTLQDTTNQITVLHGIITTDSPAATTTSSPREVSWFAPPDNAFKLNVAGAHLASNPGPSGFWGLLRNNSAEWITGFSGYCGHATNLYAELMTILQGLLLVWEKDHGDNRYHPYAAVINKTRDWVISFSHTLRQGNMCADSLPKMGSSTMDTLTIWDECPQQLSSLLLGDSLGVTYVRQ

SEQ ID NO: 221231 - protein, 515 aa, Glycine max
  Coding DNA Sequence Number=SeqID_104453
  Homolog annotation: Hit_ID=Q8GZ43; Match level="QueryCoverage=43%, HitCoverage=83%, E-value=4e-92, Identity=65%"; Hit description =RanBP2-type zinc-finger protein At1g67325
  Pfam annotation: Domain name=zf-RanBP; Domain location=311-342; Score= 27.9; E_value=3.6e-05; Accession=PF00641.9; Description=Zn-finger in Ran binding protein and others
  Pfam annotation: Domain name=zf-RanBP; Domain location=482-513; Score= 30.2; E_value=7.3e-06; Accession=PF00641.9; Description=Zn-finger in Ran binding protein and others
  Pfam module annotation: Pfam domain module=zf-RanBP::zf-RanBP; Domain location=311-342::482-513
MGHIKCNINVGFFHEIGASKRAPIMDNNEGKVWALITAMKFVISLGLQHVKFEVDCKIVVDKIIKRTSDAYEFVVKEPKWMVAAMTATLEKHNANLSVNLSSEGEDRVHVVVFEEHSWVFVGIYDGFSGTDALNYLLSNLYIPMHKELKGLLWDDRSTPENLMIKEDMLRDVTIIDEDDVCSQCQTNSSVVPSFQATMKGFVVTALANNKAPSAKFPRSAGKIPTITLPEDVYVKKFYKKYPESKSHDAIKYFPLFHLEYCISGKDTLADLDDEACWNWMEEKKWGAKKGRRVDNRNSSATKRARTDGSRREDDWTCPSCGNVNFSFRTTCNMRNCTQPRPADHNSKSAAKPLQAPQGYSSSAPYLGSNTPSSIYLGVPPYGSSLFNGSSVPPYDVPFSGGSAYHYNYGSRLSAGSPYRPLHLSGPTPYTGGPVIGNGGIYGMPQLLDRYGLGIPIGPGTMGARPGFFHDDKSQKKGTDATRDNDWTCPKCGNVNFSFRTVCNMRKCNTPKPGSQ

SEQ ID NO: 221232 - protein, 284 aa, Glycine max
  Coding DNA Sequence Number=SeqID_104454
  Gene Ontology: Mol. function=protein serine/threonine kinase activity; Biological process=protein amino acid phosphorylation
  Homolog annotation: Hit_ID=Q2R441; Match level="QueryCoverage=74%, HitCoverage=72%, E-value=3e-65, Identity=57%"; Hit description =Uncharacterized plant-specific domain TIGR01627 family protein, expressed
  Pfam annotation: Domain name=DUF579; Domain location=45-284; Score =466.3; E_value=3.7e-137; Accession=PF04669.4; Description=Protein of unknown function (DUF579)
MKNRYLVPERRWFVGLAVVGLIGAVLFLSNAIRTSETSYVCPGALGIRSKTRTEFSYDASPIQLRAIMHYATSRVVPQQSVSEIKISLDVIKSLGRPINFLVFGLGHDSLMWASFNPGGTTVFLEEDPKWVHSILKDAPGLRAHTVRYRTQLRDAKGLITSYRSEPSCSPTKAYLRGNEACKLALENLPDEVYETEWDMIMIDAPKGYFAEAPGRMAAVFSAAVMARNRKESGVTHVFLHDVDRKVEKVYAEEFLCKKNLVKGVGRLWHFEIPPSNDTRASRFC

SEQ ID NO: 221233 - protein, 137 aa, Glycine max
  Coding DNA Sequence Number=SeqID_104455
  Homolog annotation: Hit_ID=Q10MT0; Match level="QueryCoverage=59%, HitCoverage=56%, E-value=4e-17, Identity=49%"; Hit description=ECA1 protein, putative, expressed
  Pfam annotation: Domain name=DUF1278; Domain location=1-129; Score =155.7; E_value=1.2e-43; Accession=PF06915.2; Description=Protein of unknown function (DUF1278)
  Subcellular localization annotation: CTP_CleavageSite=42; ConfidenceScore=5.50e-01
MAFTLNLFILSSLIAITSLMSSASMVESRSLSSPSSSSLAVRLKAEGESSYCWDSLWQLQACTGEIVTFFLNGKTYLGHGCCQAIRVIGHDCWPNIVASLGFTNEETDVLEGYCDEDVVHSPPPPPQSIIDPKYIVP

SEQ ID NO: 221234 - protein, 97 aa, Glycine max
  Coding DNA Sequence Number=SeqID_104456
MTRMGFGDRGADVTREDATLENDECEEQRNRTWCSYDFQLIFTLLEAFEKVPSIQFLFSFRWWPYDGGGSTLQNSERASDVIPVLCLPFIFIQIKHY

SEQ ID NO: 221235 - protein, 459 aa, Glycine max
  Coding DNA Sequence Number=SeqID_104457
  Gene Ontology: Mol. function=DNA binding; Cellular component=nucleus; Biological process=regulation of transcription, DNA-dependent
  Homolog annotation: Hit_ID=Q6YXZ5; Match level="QueryCoverage=57%, HitCoverage=69%, E-value=3e-54, Identity=46%"; Hit description =Putative squamosa promoter binding protein 2
  Pfam annotation: Domain name=SBP; Domain location=171-249; Score =186.3; E_value=7.3e-53; Accession=PF03110.5; Description=SBP domain
MECNAKSLGQWDWEHLFFFNTKAAENPRLQPTDCSSEADREINVGMLHPSGGSACSGSELIHASSSRSSKSASNNSSSNGDSKASILTLEGSHDDSTGKKELCNGEPIETSPAAVPSPVSGEPLLTLKLGKRLYFEDVCTGSDSKKPSSFDIPISSGKKHKTSSQTLQHPSCQVEGCGLDLSSAKDYHRKHRVCEAHSKSPKVVITGLERRFCQQCSRFHALSEFDDKKRSCRRRLSDHNARRRKPQPDSIQLNPSALSSSPYGITGSFPSLGKSIAYFLLTDGRQIVSPFAFSRTATNLAWQDMHPQTKEFLPKPAKAFNKIPSIVSMLSDDSSGLLTSRGIATKSTVPGMEDPIRLSDPNGTQDVNRALSLLSTNSSSSWGAYETKSLSLEHSTRATHSITQHHLPLPSSAEYWHTDHQQHSSMCISFTDCDSSNRFQDFQLLSSPYESPFPCNQLD

SEQ ID NO: 221236 - protein, 223 aa, Glycine max
  Coding DNA Sequence Number=SeqID_104458
  Homolog annotation: Hit_ID=Q1SC30; Match level="QueryCoverage=40%, HitCoverage=13%, E-value=1e-26, Identity=64%"; Hit description =Helicase, C-terminal
  Subcellular localization annotation: CTP_CleavageSite=76; ConfidenceScore=5.35e-01
MDKVEATEALIPNAYVGAFWHSALKLCRQFQLSNATRKTSPTRSAARNGSSPTTTHPIPNPPLTATETIETGTVIVTETGTETENVRECERAHDRDREAKHHNRERECDMNSLYQIPHEAHLLFGFCTGMDRHEQKKLVAKNEKDMHDQIHKKDGIKEKPEEVDTQCRKEASAKLCDTFDICIKRHWSEKKLEEMMERDCPKGRAWVMATSRCAYRAFFLQRN

SEQ ID NO: 221237 - protein, 75 aa, Glycine max
  Coding DNA Sequence Number=SeqID_104459
MTNKNDGFVLAPNSFNWVDYDIARHNRRVHVIAGTVTGVSVAGAFGIGAAVWYLKKVRAKAPVTCGVQSNENRLF

SEQ ID NO: 221238 - protein, 120 aa, Glycine max
  Coding DNA Sequence Number=SeqID_104460
MERSYEKGRRTKNKSKEERRRRQRTKKTEEEDKGRRRHREKKVNLEKEGEAKCCKHNDSYGRVTVLILYEKGEGYFCPFTRITGAPNNCQSRTTYETQNENITRGNDLSHTMYMCNDIET

SEQ ID NO: 221239 - protein, 373 aa, Glycine max
  Coding DNA Sequence Number=SeqID_104461
  Gene Ontology: Mol. function=pectate lyase activity; Cellular component=anchored to membrane; Biological process=carbohydrate metabolic process
  Homolog annotation: Hit_ID=O65456; Match level="QueryCoverage=91%, HitCoverage=87%, E-value=1e-139, Identity=66%"; Hit description =Putative pectate lyase 16 precursor
  Pfam annotation: Domain name=Pec_lyase_C; Domain location=106-291; Score=325.8; E_value=7.4e-95; Accession=PF00544.9; Description =Pectate lyase
MATSPTLLLLSCFILHLAYSTESAVLNKIDSCWRAKSNWASNRQALANCGIGFGKDSIGGKYGSIYKVTDPSDDPISPKPGTLRYGVIQTQPLWIIFAKDMVIRLDNELIMNSYKTIDGRGAKVEIANGPCITIQGVSHVIIHGISIHDCKPSKAGLVRSTPSHLGHRRGSDGDGISIFASSNIWIDHCFLARCADGLIDVIHASTSITISNNYFTQHDKVMLLGHSDEYTADKKMKVTIAFNRFASGLIERMPRVRFGYAHVVNNKYDGWKMYAIGGSSNPTILSEGNYYVAPNNPATKQVTKREMKGKLKNWKWRSSKDAFLNGAYFVPSGYGSCDPNYSPTQYFTAVPASLVPAITLNAGPLTCVVGKAC

SEQ ID NO: 221240 - protein, 227 aa, Glycine max
  Coding DNA Sequence Number=SeqID_104462
  Homolog annotation: Hit_ID=Q9FGR6; Match level="QueryCoverage=90%, HitCoverage=71%, E-value=1e-09, Identity=28%"; Hit description =Arabidopsis thaliana genomic DNA, chromosome 5, TAC clone:K6A12
MSSGVSILTETNETLILCVKSTSPTSFQWILTLKAARGNRDIKINSDPIFGNLIIRHRSTNVLPINASITSTILKHQPQRLSGFGIVRATSTPRECKGATRQVPAEIASTVTRGITVFGEMLAEHRLWLNDDAVLAAVEEHVLVLRRELEVCGGVQAEWPRGAKLLAVLAAPHEWISDHDMWIGVAQYGLPHPSSMPNGYLMGMSPHDVLQRLDCDVVRVRNDERIS

SEQ ID NO: 221241 - protein, 743 aa, Glycine max
  Coding DNA Sequence Number=SeqID_104463
  Gene Ontology: Mol. function=calcium ion binding; Cellular component =nucleus; Biological process=regulation of transcription, DNA -dependent
  Homolog annotation: Hit_ID=Q9FYG2; Match level="QueryCoverage=76%, HitCoverage=55%, E-value=1e-133, Identity=48%"; Hit description =Calmodulin-binding transcription activator 4
  Pfam annotation: Domain name=Ank; Domain location=408-449; Score =29.1; E_value=1.5e-05; Accession=PF00023.20; Description=Ankyrin repeat
  Pfam annotation: Domain name=IQ; Domain location=536-556; Score=10.5; E_value=3.1; Accession=PF00612.17; Description=IQ calmodulin-binding motif
  Pfam annotation: Domain name=IQ; Domain location=595-615; Score=10.8; E_value=2.9; Accession=PF00612.17; Description=IQ calmodulin-binding motif
  Pfam annotation: Domain name=IQ; Domain location=618-638; Score=29.8; E_value=9.7e-06; Accession=PF00612.17; Description=IQ calmodulin -binding motif
  Pfam annotation: Domain name=TIG; Domain location=181-264; Score =19.6; E_value=0.011; Accession=PF01833.14; Description=IPTTIG domain
  Pfam module annotation: Pfam domain module=Ank::IQ::IQ::IQ::TIG; Domain location=408-449::536-556::595-615::618-638::181-264
  Subcellular localization annotation: CTP_CleavageSite=71; ConfidenceScore=5.17e-01
VEFDITVYSHILQGKSNSEHVTQLPSGSSPAFSQSHSSYTAHNPGTASMIGDSCEPNQNFSFPGSLEVTFEAQALRQLEEQLSLNDDGFNEIALDLVSGQDQRVVYKQDKSAALSGPNDLGQPCDGYNGRQDGGVKFPPYSLAETPGANSDYYETFFDQFQNQGPLGVDSSLTVVQKQKFTIRAVSPEYCYSTETTKVIIIGSFLCHDSDSTWACMFGDVEVPAEIIQDGIICCEAPSNHLGKVNLCITSGNRVPCSEMREFEFRNKTTSCTRCNSLETEGSKSPEDLLLLVRFAEMLLSSSTTKDDRIESGSHLSTEQKDDDDSWSHIIDTLLDSTRTPSDAVKWLLEELLKDKLQLWLSNRRDEGTGCSLSKKEQGIIHMVSGLGFEWALNPILSCGVNINFRDINGWTALHWAARFGRSLNILFHDREKMVASLIASGASAGAVTDPSSQDPTGKTAASIAASHDHKGLAGYLSEVDLTSHLSSLTLEESELSRESSELEAELTVSSVSEENLVASEDQVSLKASLDAVRNAAQAAARIQAAFRAHSFRKRKERDAAATVLDGYCIDAGSIDNNISVLSAMSKLSSQSWRDYKAALSIQKKYRNWKGRIEFLALRQKIVKIQACVRGYQVRKQYKLILWAVGILDKVVLRWRRKRIGIQSVRQEMESNEEESDDADFLNVFRKEKVNAAIEKALKRVLSMVHSTGARQQYRRLLSLYRQAKIDQIISDCYEYSFHSPFLY

SEQ ID NO: 221242 - protein, 834 aa, Glycine max
  Coding DNA Sequence Number=SeqID_104464
  Gene Ontology: Mol. function=binding; Cellular component =intracellular; Biological process=metabolic process
  Homolog annotation: Hit_ID=Q9C507; Match level="QueryCoverage=78%, HitCoverage=91%, E-value=1e-110, Identity=29%"; Hit description=PPR -repeat protein, putative
  Pfam annotation: Domain name=DUF1068; Domain location=700-830; Score =124.8; E_value=2.4e-34; Accession=PF06364.3; Description=Protein of unknown function (DUF1068)
  Pfam annotation: Domain name=PPR; Domain location=136-170; Score =46.6; E_value=8.1e-11; Accession=PF01535.11; Description=PPR repeat
  Pfam annotation: Domain name=PPR; Domain location=234-268; Score =34.6; E_value=3.5e-07; Accession=PF01535.11; Description=PPR repeat
  Pfam annotation: Domain name=PPR; Domain location=335-369; Score =39.9; E_value=8.5e-09; Accession=PF01535.11; Description=PPR repeat
  Pfam annotation: Domain name=PPR; Domain location=35-69; Score=2.9; E_ value=3.4; Accession=PF01535.11; Description=PPR repeat
  Pfam annotation: Domain name=PPR; Domain location=370-404; Score=7.4; E_value=0.99; Accession=PF01535.11; Description=PPR repeat
  Pfam annotation: Domain name=PPR; Domain location=436-470; Score =44.1; E_value=4.6e-10; Accession=PF01535.11; Description=PPR repeat
  Pfam annotation: Domain name=PPR; Domain location=471-505; Score=5.7; E_value=1.6; Accession=PF01535.11; Description=PPR repeat
  Pfam annotation: Domain name=PPR; Domain location=537-571; Score =33.3; E_value=8.2e-07; Accession=PF01535.11; Description=PPR repeat
  Pfam annotation: Domain name=PPR; Domain location=572-606; Score =10.3; E_value=0.45; Accession=PF01535.11; Description=PPR repeat
  Pfam annotation: Domain name=PPR; Domain location=608-641; Score=3.5; E_value=2.9; Accession=PF01535.11; Description=PPR repeat
  Pfam annotation: Domain name=PPR; Domain location=70-104; Score=10.6; E_value=0.41; Accession=PF01535.11; Description=PPR repeat
  Pfam module annotation: Pfam domain module=DUF1068::PPR::PPR::PPR::PPR ::PPR::PPR::PPR::PPR::PPR::PPR::PPR; Domain location=700-830::136 -170::234-268::335-369::35-69::370-404::436-470::471-505::537 -571::572-606::608-641::70-104
  Subcellular localization annotation: CTP_CleavageSite=14; ConfidenceScore=5.11e-01
MFSYKPKPNLLLSRSGLKRYVVSLPHPSSASATINSFNAIINHHSSQGAHRQVLATYASMLKTHVPSDAYTFPSLLKACSSLNLFSLGLSLHQRILVSGLSLDAYIASSLINFYAKFGFADVARKVFDFMPERNVVPWTSIIGCYSRTGRVPEAFSLFDEMRRQGIQPSSVTMLSLLFGVSELAHVQCLHGSAILYGFMSDINLSNSMLSMYGKCRNIEYSRKLFDYMDQRDLVSWNSLVSAYAQIGYICEVLLLLKTMRIQGFEPDPQTFGSVLSVAASRGELKLGRCLHGQILRTCFDLDAHVETSLIVMYLKGGNIDIAFRMFERSLDKDVVLWTAMISGLVQNGSADKALAVFRQMLKFGVKSSTATMASVITACAQLGSYNLGTSVHGYMFRHELPMDIATQNSLVTMHAKCGHLDQSSIVFDKMNKRNLVSWNAMITGYAQNGYVCKALFLFNEMRSDHQTPDSITIVSLLQGCASTGQLHLGKWIHSFVIRNGLRPCILVDTSLVDMYCKCGDLDIAQRCFNQMPSHDLVSWSAIIVGYGYHGKGETALRFYSKFLESGMKPNHVIFLSVLSSCSHNGLVEQGLNIYESMTRDFGIAPNLEHHACVVDLLSRAGRVEEAYNLYKKKFSDPVLDVLGIILDACRANGNNELGDTIANDILMLKPMDAGNFVQLAHCYASINKWEEDDPCIGISMRPSMPPLILVLLVTVIALFNPFLLSPKDPEVSEEVGKSFTDLLAEEVKQKEAEAEEKQRSVDTKLLEAKKLASQYQKEADKCNSGMETCEQARERAEAALENQMKETALWELRARQRGWNKDASKKARARFSVG

SEQ ID NO: 221243 - protein, 120 aa, Glycine max
  Coding DNA Sequence Number=SeqID_104465
  Homolog annotation: Hit_ID=Q9SZ28; Match level="QueryCoverage=97%, HitCoverage=88%, E-value=4e-17, Identity=33%"; Hit description=STIG1 like protein
  Pfam annotation: Domain name=Stig1; Domain location=5-119; Score =95.7; E_value=1.4e-25; Accession=PF04885.4; Description=Stigma -specific protein, Stig1
  Subcellular localization annotation: CTP_CleavageSite=20; ConfidenceScore=5.02e-01
MKSLKTLFLVALLIMALAITLSATSSQTEEPKSLRGTSRFLSQKRVALTCDKNPKICLVKGSAGPNCCSNKCVNFSTDRLNCGRCGKKCSFGKICCEGKCVNPKTNEKHCGKCGNKCNAK

SEQ ID NO: 221244 - protein, 162 aa, Glycine max
  Coding DNA Sequence Number=SeqID_104466
  Homolog annotation: Hit_ID=Q9LSP8; Match level="QueryCoverage=46%, HitCoverage=8%, E-value=4e-09, Identity=58%"; Hit description =Calmodulin-binding transcription activator 6
  Pfam annotation: Domain name=CG-1; Domain location=11-112; Score= -37.4; E_value=0.056; Accession=PF03859.7; Description=CG-1 domain
MAGLEYSIDDLFQEAKRRWLKPVEALYILRNHDQCKFTHQPPHQPAESCVPSVKMVITGGRKKMAKLWEKRMNGLRFHMRVRHGATACRSQVQILEVASSHAVIRLHASTLPKPLQVEALSTMLSFFFFLTSICLAAAHVSHYHLANFWHALFFMQMPQFAL

SEQ ID NO: 221245 - protein, 427 aa, Glycine max
  Coding DNA Sequence Number=SeqID_104467
  Homolog annotation: Hit_ID=Q6H6J8; Match level="QueryCoverage=81%, HitCoverage=80%, E-value=2e-65, Identity=41%"; Hit description=F-box- like
  Subcellular localization annotation: CTP_CleavageSite=24; ConfidenceScore=5.57e-01
MASLQISSICLSSFSLKRKHFPINASKSRRMPLLVPKISTKNSFHETNNSIDTNPLEVNVTPKILHDEDIHNLNILHTKTKIYTILELVTDRVEMHHNVGEQRDNWNTLLLNSINMITLTAATMSGLAATCPGSGAPLLALKLSSTLLFCAATGLLVVMNKIQPSQLAEEQRNATRLFKCLKTKIETTIALRNPTEEDVNDVIEKVLAVDRAYPLPLLGGAMLEKFPEKFEPVVWWPNKTSQPHEGKPKSEKIEEELVNGWSEELEMELREVVEVTKREDFEDYERLGNMVLRINKSLAILGSLLMGIATIGSVFVDNIRSCSWAYLVTLLAGSLAAVVNSFEHGGQVGMVFEMYRYCGGFLRLLEETVEATLEEKDVEKRENGEVFENKVAMQLGRSGLQLRKLASKSASCRREGIDMDEFASKLF

SEQ ID NO: 221246 - protein, 663 aa, Glycine max
  Coding DNA Sequence Number=SeqID_104468
  Gene Ontology: Mol. function=metal ion binding; Cellular component =nucleus; Biological process=regulation of transcription, DNA -dependent
  Homolog annotation: Hit_ID=UPI000034F5B3; Match level="QueryCoverage =89%, HitCoverage=70%, E-value=1e-179, Identity=52%"; Hit description= transcription factor
  Pfam annotation: Domain name=JmjC; Domain location=502-609; Score =41.9; E_value=2.2e-09; Accession=PF02373.13; Description=JmjC domain
MGEEDILVCSKRTTELPFRKGLEANKCLTALKKKRILEDAILINNLEDDKVYVPSKTYSRSKARKMDDVKTSNKCIRDDEKVQYLQYTINLLLPFIQRVCEEQSQELEIEAKIQAVTIVLLHLLTFIEAAPSVPLKSALTVAKKYAMEVYHPGHREIFTKWSANSDGSIRCAPKEMGGCGGSVLELKRLFPNGWISDLEAKARNMLKTYCKTEQATLQKEATSSGNSMIRAAFRDGTNDNNLYCPLSSDLINEGLFLFQKHWTKGEPIIVRDVLNQGTGLSWEPMVTWRALCENVVPGISSNMLEVTAIDCLASCEVEINTRTFFKGYTQGRTYRNLWPEMLKLKDWPPSHKFEDLLPRHYDEFIRCLPFQEYSDPRAGILNLAVKLPPHVLKPDLGPKTYIAYGIKEELGRGDSVTKLHCDMSDAVNILTHTAEVTLTDEQNCVISKLKKAHIAQDEKEHCARERVDECLNEGPWKDHREQEDNKCPVDINGKIFPNDMPTISRETTETGGALWDIFRREDTDMLEAYLRKHSKEFRHTYCSPVEQVVHPIHDQSFYLTLEHKKKLKEEFGVEPWTFEQKLGEAVFIPAGCPHQVRNLKSCTKVAADFVSPENVHMCLHLTEEFRRLPKNHKAREDKLEIKKMIVYAVDHAVKELEALVRCS

SEQ ID NO: 221247 - protein, 76 aa, Glycine max
  Coding DNA Sequence Number=SeqID_104469
MGMHNESYMNVAVAVGRDEERRNSEMNNLKSHTKSEIQTSWGPSTLHSHSVHHGHHPRKSKTKEREKLEKKKNKVD

SEQ ID NO: 221248 - protein, 410 aa, Glycine max
  Coding DNA Sequence Number=SeqID_104470
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=3e-41, Identity=29%"; Hit description= UPI00006A17C9 related cluster
VPITFRGLHAFTFRGLHVLAIRRLHTLAFVGLHALTFRGLHVLTFRGLHALAFIGLHALTFRGLHVLTFRRLYALTFRGLHVLAFRGLHVLAFRGQHVLAIRGLHALTFRGLHAIAFVGLHALTFRGLHVLTFRRLHALAFIGLHALTFRGLHVLTFRGLHILAIRGLHALTFRGLHALTFVWLHALTFRGLHVLTFRGLHALAFVGLHTLTLRGLHVLTFIWLHALTFRGLEFLALIGLDVLAFRGLHALAFRGLHVPLFRGRHALAFRRRHVLAFGGASSFLLSVPGPPPDIGGRPTVQAQPKEEAIVQLLCIPGQHFNRAAAKRQVQIMRTNMTTITQIWMTLLLSNILASDRNVDLPLQKNQDRTHKTPSEPREVQQGPGVSSFGYGPLSVLQGAHSPQQVHIVLT

SEQ ID NO: 221249 - protein, 253 aa, Glycine max
  Coding DNA Sequence Number=SeqID_104471
  Gene Ontology: Mol. function=protein serine/threonine kinase activity; Cellular component=membrane; Biological process=protein amino acid phosphorylation
  Homolog annotation: Hit_ID=Q6ZD33; Match level="QueryCoverage=68%, HitCoverage=34%, E-value=1e-68, Identity=66%"; Hit description =Receptor protein kinase PERK1-like protein
  Pfam annotation: Domain name=Pkinase; Domain location=118-253; Score=- 65.7; E_value=0.00012; Accession=PF00069.15; Description=Protein kinase domain
  Pfam annotation: Domain name=Pkinase_Tyr; Domain location=118-253; Score=-50.7; E_value=2.3e-09; Accession=PF07714.7; Description =Protein tyrosine kinase
  Pfam module annotation: Pfam domain module=Pkinase::Pkinase_Tyr; Domain location=118-253::118-253
MNDENGNFPPMQLRSGISSGAIAGIAVGGAVGVLILALLLYVGLRRRRKVAEVSLLPVPGASEDQCSPLQLHHGIGCGSSLDKASESSVVASPRLTGITVDKSVEFPYEELDKATDGFSAANIIGRGGFGSVYYAELRNEVRLIGYCVEGSLFLVYEYIENGNLSQHLRGSGRDPLTWAARVQIALDAARGLEYIHEHTVPVYIHRDIKSANILIDKNFRAKVADFGLTKLTEYGSSSLHTRLVGTFGYMPPE

SEQ ID NO: 221250 - protein, 101 aa, Glycine max
  Coding DNA Sequence Number=SeqID_104472
MWGKILQSIRKSLISLQQKSMNSRKSEEVDSSVTSVSVSLHDGVQWVNCNCCIEENKQCNFDHINASEGANNVHAQRDANANSSFTHAVINMVGMLVAHIT

SEQ ID NO: 221251 - protein, 105 aa, Glycine max
  Coding DNA Sequence Number=SeqID_104473
  Gene Ontology: Mol. function=enzyme inhibitor activity; Cellular component=cell wall; Biological process=cell wall modification
  Homolog annotation: Hit_ID=Q7XAF8; Match level="QueryCoverage=88%, HitCoverage=16%, E-value=4e-24, Identity=59%"; Hit description =Papillar cell-specific pectin methylesterase-like protein
  Pfam annotation: Domain name=Pectinesterase; Domain location=31-105; Score=-257.3; E_value=0.039; Accession=PF01095.10; Description =Pectinesterase
MVWEQKLYEIVRIRGRKLLQSALDNVAVSQMAVVNPGGSGNYTTFDDAVAAALNNTDTWGVNGYFLIHVVIGVYEEYVSIPQNKQYLMMIGDGINQTIISLMVES

SEQ ID NO: 221252 - protein, 363 aa, Glycine max
  Coding DNA Sequence Number=SeqID_104474
  Gene Ontology: Mol. function=L-isoleucine transporter activity; Cellular component=integral to membrane; Biological process=amino acid transport
  Homolog annotation: Hit_ID=Q53MQ4; Match level="QueryCoverage=94%, HitCoverage=71%, E-value=1e-109, Identity=59%"; Hit description =Transmembrane amino acid transporter protein
  Pfam annotation: Domain name=Aa_trans; Domain location=1-348; Score =89.5; E_value=9.9e-24; Accession=PF01490.8; Description =Transmembrane amino acid transporter protein
MGLGVMCAYSSHILGVCLRKNPKLTSFMDIGKHAFGSKGRNVAATIIYMEIFMSLVSYTISLHDNLITVFLGTNLKLHLPNFSSSQLLTAVAVFIAMPSLWIRDLSSISFLSSVGILMSLLIFLCVAATALLGHVQSNHSIPVLHLHNIPSVSGLYVFGYGGHIVFPELYTAMKDPSKFTKVSIVSFAVVTAIYTTLGFMGAKMFGKDVKSQITLSMPQEHIVTKIALWATVVAPMTKYALEFTPFAIQLEHALPTSMSVRTKMIIRGCVGSFSLLFILTLALSVPYFEHVLSLTGSLVSVAVCLILPSAFYVKICWGQISKPHLLLNLFLIIFGFVLAVMGTISSSQLLLKSLQSHNLRHKE

SEQ ID NO: 221253 - protein, 137 aa, Glycine max
  Coding DNA Sequence Number=SeqID_104475
  Subcellular localization annotation: CTP_CleavageSite=58; ConfidenceScore=5.37e-01
MESCATLPLSQLPYVYPSTLSSNKAYPFWPCKRRSSSQPTRLHCSKMFVPGFGEASPEAKAAQNLHNFFTFVAVKIVAAQLESYNHEAYEELMEFLSRHSLNDGDKFCASMFRESSRHKNLGNDYYQLPNTQSVSNY

SEQ ID NO: 221254 - protein, 253 aa, Glycine max
  Coding DNA Sequence Number=SeqID_104476
  Gene Ontology: Mol. function=protein-tyrosine kinase activity; Cellular component=membrane; Biological process=protein amino acid phosphorylation
  Homolog annotation: Hit_ID=Q1T420; Match level="QueryCoverage=73%, HitCoverage=33%, E-value=2e-50, Identity=50%"; Hit description =Protein kinase; Peptidoglycan-binding LysM
  Pfam annotation: Domain name=LysM; Domain location=44-88; Score=9.6; E_value=0.057; Accession=PF01476.10; Description=LysM domain
MTTHPTTKSKPPHVFFLLLIQLLISITRVKGSCVTGCNLALASYYLGNGTNLTYISNLFGRPTSEILKYNPSVKNPNVILSQTRINVPFSCDCLNGAFLGHTFSYAIQHGNTYKIVAEVDFSNLTTEDWVGRVNSYPPNQIPDNVNINVTVNCSCGNRHVSKDYGLFMTYPLRVGDSLQRVAAEAGVPAELLLRYNPTADFGAGNGLVFVPAKVEDQCTLHLWMTLGPALVVFWKSGGMICKGWGHSLHPYPI

SEQ ID NO: 221255 - protein, 261 aa, Glycine max
  Coding DNA Sequence Number=SeqID_104477
  Homolog annotation: Hit_ID=Q1SF98; Match level="QueryCoverage=86%, HitCoverage=63%, E-value=1e-112, Identity=83%"; Hit description=NnrU
  Pfam annotation: Domain name=NnrU; Domain location=39-257; Score= -79.0; E_value=0.00023; Accession=PF07298.2; Description=NnrU protein
MEYKLDRIAGLIMAKGKQHSAINLFILGACRTERWVVMLILILIFAGVHSGLASFRNTGEKLIGERPFRVLFAGISLPLAVSTVVYFINHRYDGLQLWQLQDAPGLHQLLWLSNFISFFFLYPSTFNLLEVAAVDKPKLHLWETGIIRITRHPQVIWCLAHTIWIGNSVAVAASIGLIAHHLFGVWNGDRRLAIRYGEDFELVKSRTSVVPFAAILDGRQELPKDFYKEFIRLPYLTVTAITLGAYFAHPLMQAASFNLHW

SEQ ID NO: 221256 - protein, 181 aa, Glycine max
  Coding DNA Sequence Number=SeqID_104478
  Gene Ontology: Mol. function=protein kinase activity; Cellular component=integral to membrane; Biological process=protein amino acid phosphorylation
  Homolog annotation: Hit_ID=Q6R2J8; Match level="QueryCoverage=98%, HitCoverage=28%, E-value=9e-49, Identity=51%"; Hit description =Strubbelig receptor family 8
  Pfam annotation: Domain name=LRRNT_2; Domain location=1-37; Score =12.1; E_value=0.047; Accession=PF08263.3; Description=Leucine rich repeat N-terminal domain
  Pfam annotation: Domain name=LRR_1; Domain location=110-132; Score =14.0; E_value=0.53; Accession=PF00560.23; Description=Leucine Rich Repeat
  Pfam annotation: Domain name=LRR_1; Domain location=134-155; Score =11.1; E_value=2.4; Accession=PF00560.23; Description=Leucine Rich Repeat
  Pfam annotation: Domain name=LRR_1; Domain location=156-178; Score =5.5; E_value=26; Accession=PF00560.23; Description=Leucine Rich Repeat
  Pfam annotation: Domain name=LRR_1; Domain location=64-83; Score =13.0; E_value=1; Accession=PF00560.23; Description=Leucine Rich Repeat
  Pfam annotation: Domain name=LRR_1; Domain location=86-108; Score =11.5; E_value=2; Accession=PF00560.23; Description=Leucine Rich Repeat
  Pfam module annotation: Pfam domain module=LRRNT_2::LRR_1::LRR_1::LRR_ 1::LRR_1::LRR_1; Domain location=1-37::110-132::134-155::156-178::64 -83::86-108
QALEVMYNALNSPTQLTGWKIGGGDPCGESWKGVTCEGSAVVSIKLSGLGLDGTLGYLLSDLMSLRELDLSDNKIHDTIPYQLPPNLTSLNLSNNALSMTVGDIFASLQDLGTLDLSFNNFSGDLPPSFVALANLSSLFLQKNQLTGSLGVLVGLPLDTLNVANNNFSGWIPHELSSIRNF

SEQ ID NO: 221257 - protein, 369 aa, Glycine max
  Coding DNA Sequence Number=SeqID_104479
  Homolog annotation: Hit_ID=Q1SF96; Match level="QueryCoverage=76%, HitCoverage=47%, E-value=1e-117, Identity=70%"; Hit description =Membrane attack complex component/perforin/complement C9
IPGSGYLSHAINLYLRYKPPPDDLQCFLEFQIPRQWAPMFYDLPLRHQRKKCSSPSLQFGFMFPKLRVSCAQVVSDQKPVVGLRMYLEGRKSDRLAIHVHHLSSLPNTMIHSSSGISLWRGSDDNESSDIFLEPIRWKGFANVCTAVVKHDPNWLHETSGVYIVSGAQLISKGSWPKNVLHLRLLYTHIPNCCIRKSEWDGAPEASRKSSFLTNLSTTFSFTQQSPPQKQAPTVLDSGVYPDGPPVPVRSCKMLKYVDTSEVVRGPHDAPGHWLVTAAKLVTEGVIHSFSKLLLFHVYVDTSEVVRGPHDAPGHWLVTAAKLVTEGDHMYIGICLISDDFVQYSIHNEWWLTSATRKLECGYNTALVWC

SEQ ID NO: 221258 - protein, 161 aa, Glycine max
  Coding DNA Sequence Number=SeqID_104480
  Gene Ontology: Mol. function=Rho GDP-dissociation inhibitor activity; Cellular component=cytoplasm; Biological process=actin cytoskeleton organization and biogenesis
  Homolog annotation: Hit_ID=Q1SF97; Match level="QueryCoverage=93%, HitCoverage=59%, E-value=2e-54, Identity=69%"; Hit description=RHO protein GDP dissociation inhibitor
  Pfam annotation: Domain name=Rho_GDI; Domain location=3-159; Score= -49.3; E_value=2.7e-05; Accession=PF02115.7; Description=RHO protein GDP dissociation inhibitor
MFVLESTNPESKDPEVKILSLIITSPDKPDLTLPIPFTTDAKKSLFILKEGSKCQMKFTFTVSNNIVSGLKYTNVVWKTGVRVDSRKKMLGTFSPKQEPYTFELEEETIPSGMFVRGTYAARTKEERANSNFLLQFVDDDRKCYLDVSYYFEIQKNRPTPQ

SEQ ID NO: 221259 - protein, 171 aa, Glycine max
  Coding DNA Sequence Number=SeqID_104481
  Pfam annotation: Domain name=DUF1218; Domain location=10-122; Score =71.9; E_value=2e-18; Accession=PF06749.3; Description=Protein of unknown function (DUF1218)
MEKKVLILCCVVAFLGLLSAATSFGAEATRIKVSQVHFVAPNQKNSQIPDSNWKVALVCFVLSWLTFVIGFLLLLTGAALNDQRGEESVYFGYYYCYVVKPGVFTGGAILSLASAAFGILYYISLTERKNGSQYPYPNQGVIAMAQPQIPSQTSQEPVFVHEDTYVRRQFT

SEQ ID NO: 221260 - protein, 351 aa, Glycine max
  Coding DNA Sequence Number=SeqID_104482
  Gene Ontology: Cellular component=mitochondrion
  Homolog annotation: Hit_ID=Q9SI32; Match level="QueryCoverage=86%, HitCoverage=76%, E-value=1e-103, Identity=59%"; Hit description =Expressed protein
  Pfam annotation: Domain name=Scramblase; Domain location=107-338; Score=233.4; E_value=5e-67; Accession=PF03803.6; Description =Scramblase
MKNWSKEGWRWLSKIDFHGNVASKVIVTRRFGSGVNGGKENEMDVHKLTREFLVKLWVDDRKMRNPRDRVKSFGGYGDPRWFSATSAVPRRPKRRAVLKQPPISQSVSDFFDPQSPEEAKVAPLLARSNLLITRDIEWANLVLGFEQENRYAIVDACYPQSVSDNYYLLFITKLYHIHPVGFIREQSNIIARQLLRLRRPFVAYITDALGNELFRVRRPFWWITSSIYAEIDGKEVGVVHRRWHLWRRIYDLYLGNKQFAVVENPGLWNWTFTLKDINGEILTDAGQYVIRFGSSDPSSKIGLASAIEDLEVSRKLTLAERAVTVALAISLDNDYFSRHGGWGLPFFVAEE

SEQ ID NO: 221261 - protein, 270 aa, Glycine max
  Coding DNA Sequence Number=SeqID_104483
  Gene Ontology: Mol. function=oxidoreductase activity; Cellular component=integral to membrane; Biological process=electron transport
  Homolog annotation: Hit_ID=O65048; Match level="QueryCoverage=43%, HitCoverage=91%, E-value=2e-38, Identity=62%"; Hit description =Hypothetical protein Sb08
  Pfam annotation: Domain name=UMP1; Domain location=101-218; Score =134.7; E_value=2.5e-37; Accession=PF05348.2; Description=Proteasome maturation factor UMP1
MLVAGSETSATAMECALSLLLNHPEAMHKTKVEIDTYVGQDQLLIEQDIAKLKYLQNVITETLRLYPVAPLMILHESSNDCNKEKKRVESKTKTKMEDASASKFIPHQIGGVQNDVLRFGLHGVKSDITRRMDEAMKKQCKVNLYGTAFPLKEELDRQILSRFQRPPGPIPSSMLGLETVTGSVDHFGFEDCLNDPRESETFRPLDMHHGMEVRLGLSKGPVYPMSKELAYFVIKASCFPNALDARNVIDPYKQSMSFKLKQNLCMRHLS

SEQ ID NO: 221262 - protein, 866 aa, Glycine max
  Coding DNA Sequence Number=SeqID_104484
  Homolog annotation: Hit_ID=P59278; Match level="QueryCoverage=12%, HitCoverage=17%, E-value=3e-28, Identity=56%"; Hit description =Uncharacterized protein At1g51745
MAAHSHIYLSVRAPFAGSPSLDPLMKDTRESDIGDCRAHSDEGLSLHQSAPDFGKYIFNEWKLEVRSITAAEISRVILALKYAWSLGEKKLRRPRFPDPALIGSPGKRMMDCGVGSIVWVRRRNGSWWPGQILGPDDLSASHLTSPRSGTPVKLLGREDASVDWYNLEKSKRVKAFRCGEFDDCIEKAETAQGGPLKKREKYARREDAILHALELEKQISKKPGKSSASSLNAVKKVAVAVASPPETLGNDNENHANLNVYCENETGGGSFPSEVAKDGNQLHVEVDYSETTPRMRDLQDFGLRIAPAKKNLSSSVDPYFSQKRIVDDGARALASGGGIRTGSALLMNGAGQIADSRAKRSRYVHFPTESSDSLEYRETLPCVEMSPSQLRREFPYHDSLVREAEYTFMDDAESDSSETASTDSDSDSSETEPDMDEEMTIFSAFFHIILHGFTQDVPITAETGHDAEEHESTSSEELDELPISNDMSHLYPRDLITCNDAVSKWQLKGKRNNRNLVKRSVGASEGKCILDGAGADVEGRNGHLRHNRKGPSLHRYKFDFGDTFDDDGQIFGLEDEYSLTSRSISKSGSKIHRGVAWNDLAWGDHLASKGYWDVKAYSPMHGDRYDFGGRVRSMLVDVDLKVQASYRKEHVPFISLMSKLDGRAIVGHPIQVEALKDGSSDILFPATDDFSNDGTAIEGTSVLPPAWRTARRTANFRVRRPHVPSSNGVEVAAELPSSDQEQNFEFRSLNSGSSSHQASLQKKSGLKSHRSSADRKSLKKVPKKLGLSSSQKTRTLSSLSTEHNLSRKPLHDSSSYQTDRLTKPEISRPTTVACIPVQLVFSRLLEKINRPPLKTASNAALLYTGV

SEQ ID NO: 221263 - protein, 94 aa, Glycine max
  Coding DNA Sequence Number=SeqID_104485
METESHEDLQHPSVSSNDTHSDDASNHRDAEQKQDVSREEVVQILQVIASTGRFWYDLLQYRLFVLRLLVFVIVRDGVCYRDNIVLNLEITQKL

SEQ ID NO: 221264 - protein, 649 aa, Glycine max
  Coding DNA Sequence Number=SeqID_104486
  Homolog annotation: Hit_ID=Q8EVB9; Match level="QueryCoverage=61%, HitCoverage=25%, E-value=9e-08, Identity=22%"; Hit description=DNA topoisomerase IV subunit A
MDFHTLSRKQLQTLCKKNKIPANIANVAMADALAALNKVEGLDDFLNPIEGDAGTPSVNHRTAVRTSTQRKTVREEAEGSKVEASTRRVRVAEEVVELENKDANVPPVTPAASRRRATAVSTRRKKEVEMAEEDGDKNGVQGNPKTPAPVAPVSRRRVTGRSVCTTKIETPGAGGTSAYNTRRSVRLLEKDLSKMSLIDTEDIGPAKIDDDVSQESSNVSHQVEYLYDTGKGDSLQMESTVVSEDIQELEVCSLEQHTEYECQSRDLDSDVKLVPVTEIDMVVESHGPNEAGSKKVNCLELEAEPNASDEAGSESLPVLEESSDSSEPETVNKECFSLVASEDAFPDVTDQDIAAVTVVAPDDVSVDATHQQVAAIPMQSECIMDDQVSNEGDHKEDKNNETREEDEPNDSNLNLEGSFGTCDKSDDAGFEVLTVLEESAVVMQDILPSDASQDAPMEIAPQHTATLTVVVADDAFDQDVAGSLPMSPVNDTPENIKEFVECNTDDDQGISKGDDNQDMNDETEDLNLADGNMDDEDCQHPLNVDESDSMTGSEEDSIQEQKSTDIPVQSDQLKGDVHESKMMKENVTSDDLSTKSIGELKRMLMQLTLNNKSKSKTNDVKDVENKRTALQVLPQNQMKASEAQILMAE

SEQ ID NO: 221265 - protein, 383 aa, Glycine max
  Coding DNA Sequence Number=SeqID_104487
  Gene Ontology: Mol. function=RNA binding; Cellular component =ribosome; Biological process=response to cold
  Homolog annotation: Hit_ID=Q9LK47; Match level="QueryCoverage=79%, HitCoverage=78%, E-value=1e-111, Identity=67%"; Hit description =Similarity to 30s ribosomal protein s1
  Pfam annotation: Domain name=S1; Domain location=183-261; Score=64.6; E_value=3.3e-16; Accession=PF00575.13; Description=S1 RNA binding domain
  Subcellular localization annotation: CTP_CleavageSite=54; ConfidenceScore=5.63e-01
MPIFSASLGSFTSISFLSTSQSQSQSHLSPFKLTVKTPWQWQHHHYLTSKVLVSASGNTQIPNTELLQRPTPPDPLDDVRQARRSSDWKAAKTYQDSKLIYNGRVEGFNSGGLLVRFYSIMGFLPFPQLSPVHASKEPEKSIQEIAQGLIGSIMSVKVILADEDNKKLIFSEKEAAWSKFSKQVNVGDIFEVRVGYVEDYGAFVHLRFPDGLYRLTGLIHVSEVSWDLIQDVRDILKVGDEVRVKVVGIDWGKSRINLSIRQLEEDPLLETLDKVIPQDGSADPDSMSGGDSGSIEPLPGLETILEELLQEDGIYDVRISRQGFEKRVVSQDLQLWLCNAPPTNQRFTLLARAGRQVQEIHLTTSLDQEGIKKALQRVLERVP

SEQ ID NO: 221266 - protein, 99 aa, Glycine max
  Coding DNA Sequence Number=SeqID_104488
MTRREVVFKGNTTNMMIIDKGENKEKGDLGQHNQMHTWREQKAMTRREVVAFKCNTTKCAVTLTKNRRTKGDDKRGAVFKGNTMKCIRGNIDKGENKRR

SEQ ID NO: 221267 - protein, 72 aa, Glycine max
  Coding DNA Sequence Number=SeqID_104489
MSEYKHFDVITLQHGDWPLDLAKEESKLEEIKNYSIYGHNHRHTTMSPHACVLMQVGSVSFSSAYGRKLIIR

SEQ ID NO: 221268 - protein, 399 aa, Glycine max
  Coding DNA Sequence Number=SeqID_104490
  Gene Ontology: Mol. function=oxidoreductase activity; Cellular component=chloroplast; Biological process=carotenoid biosynthetic process
  Homolog annotation: Hit_ID=P28553; Match level="QueryCoverage=96%, HitCoverage=63%, E-value=0.0, Identity=92%"; Hit description =Phytoene dehydrogenase, chloroplast precursor
  Pfam annotation: Domain name=Amino_oxidase; Domain location=1-379; Score=145.7; E_value=1.3e-40; Accession=PF01593.14; Description =Flavin containing amine oxidoreductase
MLTSIYELHAMNVNTGIWAILRNNEMLTWPEKVKFAIGLLPAMLGGQPYVEAQDGLSVQEWMKKQGVPERVTDEVFIAMSKALNFINPDELSMQCILIALNRFLQEKHGSKMAFLDGNPPERLCMPIVDHIQSLGGEVHLNSRIQKIELNDDGTVKSFLLNNGKVMEGDAYVFATPVDILKLLLPDNWKGIPYFQRLDKLVGVPVINVHIWFDRKLKNTYDHLLFSRSSTNFETPVMSGRDRNAVHLISPLLSVYADMSVTCKEYYSPNQSMLELVFAPAEEWISRSDEDIIQATMAELAKLFPNEISADQSKAKILKYHVVKTPRSVYKTVPNCEPCRPLQRSPLEGFYLAGDYTKQKYLASMEGAVLSGKLCAQAIVQDSELLATRGQKRMAKASVV

SEQ ID NO: 221269 - protein, 344 aa, Glycine max
  Coding DNA Sequence Number=SeqID_104491
  Gene Ontology: Mol. function=protein dimerization activity; Biological process=proteolysis
  Homolog annotation: Hit_ID=Q48G64; Match level="QueryCoverage=54%, HitCoverage=59%, E-value=3e-50, Identity=54%"; Hit description =Amidohydrolase
CPAFAYAAYAAAPFHPPSAVGVLLAELNKARGDVEGDFIGLEMAGAGEIFKRGELAGVKAAEPLVAGFAADAVAARMNSRRSMVTVSVQGIVSLLCYAVYNCYPCARSKVLPMWPVCTSMRTLRDVTPAGQCRNMGLLNLNTVRKGCTLTLLMEPYLMSLPAVLLENALTWRRQLHQHPELGYQEQQTSELLAQVLTDAGLQVFRGLAGTGVIGTLENGPGPVIGLRADMDALPITEKGEPQWKSSRPGVMHACGHDGHTAILLAAACQLAATRNFKALPDGCRVRDAQLAGIAGGIAGDYAARQKLPCGDAGKRCRPDGGRRRADSGAANHPVAPPVTAGVGG

SEQ ID NO: 221270 - protein, 247 aa, Glycine max
  Coding DNA Sequence Number=SeqID_104492
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=86%, HitCoverage=31%, E-value=1e-118, Identity=100%"; Hit description=DNA- directed RNA polymerase beta' chain
  Pfam annotation: Domain name=RNA_pol_Rpb1_2; Domain location=72-214; Score=245.1; E_value=1.4e-70; Accession=PF00623.11; Description=RNA polymerase Rpb1, domain 2
MDGFMSFTSSSSRIETDYSNRWGRNWYKKPWIHFLDNGIRGQPMRDGHNKVYKSFSDIIEGKEGRFRETLLGKRVDYSGRSVIVVGPSLSLHRCGLPREIAIELFQTFLIRGLIRKHFASNIGIAKSKIREKEPIVWEILQEVMQGHPVLLNRAPTLHRLGIQAFQPILVEGRAICLHPLVCKGFNADFDGDQMAVHVPLSLEAQAEARLLMFSHTNLLSPAIGDPISVPTQDMLIGLYILTSGNRR

SEQ ID NO: 221271 - protein, 35 aa, Glycine max
  Coding DNA Sequence Number=SeqID_104493
MVSSSQKVAPQYRKSQHGNEKILLNSPEKVVGIAG

SEQ ID NO: 221272 - protein, 1065 aa, Glycine max
  Coding DNA Sequence Number=SeqID_104494
  Gene Ontology: Mol. function=microtubule motor activity; Cellular component=microtubule associated complex; Biological process =microtubule-based movement
  Homolog annotation: Hit_ID=Q9LDN0; Match level="QueryCoverage=99%, HitCoverage=86%, E-value=1e-171, Identity=61%"; Hit description =Phragmoplast-associated kinesin-related protein 1
  Pfam annotation: Domain name=Kinesin; Domain location=3-250; Score =309.9; E_value=4.7e-90; Accession=PF00225.13; Description=Kinesin motor domain
  Pfam annotation: Domain name=Kinesin-related; Domain location=325 -1006; Score=906.6; E_value=1.1e-269; Accession=PF06548.2; Description=Kinesin-related
  Pfam module annotation: Pfam domain module=Kinesin::Kinesin-related; Domain location=3-250::325-1006
MWGPANCLSEENDQQGLAPRVFQRLFARISEEQTKHSGNQLNYQCHCSFLEIYNEQIMDLLDPNQKNLQIREDVKSGVYVENLTEEDVSSINDVTQLLIKGLSNRRTGATSINSESSRSHTVFICVVESRCKSAADGMSRFKTSRINLVDLAGSERQKSTGAAGERLKEAGNINRSLSQLGNLINILAEVSQTGKQRHIPYRDSRLTFLLQESLGGNAKLAMICAISPAQSCRSETFSTLRFAQRAKAIKNKAVVNEVMEDNVKHLRQVIRQLRDELHRIKANGYNPTESSGGHSAAWIRQSLNLLQSSLNRPPPLSRLDEDGDEEMEIDEEGVEDHDGVSCTANMPSNCNIVDNNDNEMNTDDQDLAQPGVEKNIPSCSGSKGLNEEPSRAMVQNSFSCPIGESDSPSAATNCVSPAGLSIVQCDLSPILKSPAPSVSPRISTSRKSLRTSTGLSPSENDLHVEKDLDMKTITKKSSTSALSSQTSPNFLSKTENLAASIRHGLEIMDSYKRNSALRQSPYRFSLQPRESRLIFPTNKVDVGLQTSLDDIVGEDSVLFTCSNCKNRAHLDANETDNDSNLQLIPVDCLEFADKPKKQVIKAVEKVLAGSIRREMALEEFCAKQTSEIMQLNRLVQQYKHERECNAIIAQTREDKILRLESLMDGVLPTEEFMEEELVALTHEHKILKDKYENHPEVLKMEIELKKVQEELEKYQNFYKLGEREVLMEEIQSLRSQLQFYVDSSSTSARKQYPLLQLTYSSEPSMAATLTVIPESTEEREETNETLASSRNDTEAQFEQERIKWTEAESRWISLSEELRAELESSRLLAEKRKQELDAERECTQELQEAMHMAIEGHARLLEQYADLEEKHIHLLARHRQIQDGIEDVKKAASRAGVRGAESKFINALAAEISALKAEREKERRILRDENKGLQSQLKDTAEAVQAAGELLLRLKEAEEAVTTAQKRAMDAEQEAAKAYKQIDKLKNKHEKEIITLNELLLEARLPKESVRPTYDDDVVMPSYDDSKEPKSVNDQFEPFTNNAEYGELAKVTESSWFSGYDRCNI

SEQ ID NO: 221273 - protein, 555 aa, Glycine max
  Coding DNA Sequence Number=SeqID_104495
  Gene Ontology: Mol. function=DNA topoisomerase type I activity; Cellular component=chromosome; Biological process=DNA unwinding during replication
  Homolog annotation: Hit_ID=Q56YZ6; Match level="QueryCoverage=98%, HitCoverage=68%, E-value=0.0, Identity=71%"; Hit description =Putative DNA topoisomerase III beta
  Pfam annotation: Domain name=Topoisom_bac; Domain location=160-525; Score=123.5; E_value=6.1e-34; Accession=PF01131.11; Description=DNA topoisomerase
  Pfam annotation: Domain name=Toprim; Domain location=7-146; Score =63.9; E_value=5e-16; Accession=PF01751.12; Description=Toprim domain
  Pfam module annotation: Pfam domain module=Topoisom_bac::Toprim; Domain location=160-525::7-146
MAPPIPKVLMVAEKPSIALSIASVLSHAQMFTRRGSTEVHEFDGKFLGSPAHFRVTSVIGHVFSVDFPGKYQDWAATDPLDLFQAQVIKNESNPKAHICRHLSQEARGCRYLVLWLDCDREGENICFEVIKSTGFHINDTYRARFSSVTEKDVVKALDNLVRPNRDEALAVDARQEIDLKVGVAFTRFQTSYFQGKYGNLDSRVISLKPTNKGHPFDTFMPLQVAMMFQKLVSEDGLLEVTEISEKQETKSRPVGLNTVNLLKVASSALGFGPQMAMQLAERLYTQGFISYPRTESTAYPPSFDFRGVLSAQTNNPTWGNYVQGLLTNGYQKPRLGTDVGDHPPITPMRSAAEDMLGNDAWKLYQYICQHFIGTVSPDCKYIRRKVEFSIGGESFHCTGQHVVTKGFTAIMPWLAINDKNIPSFIKGQKIEVSKLELYEGSTSPPDFLTESELISLMEKNGIGTDASIPVHINNICERNYVQVQAGRKLVPTTLGITLVRGYQTIDPDLCLPDIRSFIEQQITLIAKGQVDHRHVVQHVIQQFTQKFSYFVKKVG

SEQ ID NO: 221274 - protein, 232 aa, Glycine max
  Coding DNA Sequence Number=SeqID_104496
  Gene Ontology: Mol. function=oxidoreductase activity; Cellular component=chloroplast; Biological process=carotenoid biosynthetic process
  Homolog annotation: Hit_ID=P28553; Match level="QueryCoverage=88%, HitCoverage=36%, E-value=1e-114, Identity=96%"; Hit description =Phytoene dehydrogenase, chloroplast precursor
  Subcellular localization annotation: CTP_CleavageSite=81; ConfidenceScore=5.61e-01
MAACGYISAANFNHLVGARNLSKFSSSDATISLSFGGSDSMGLSLRPAPIRAPKRNHFSPLRVVCVDYPRPELENTVNFVEAAYLSSTFRASPRPLKPLNIVIAGAGLAGLSTAKYLADAGHKPILLEARDVLGGKVAAWKDKDGDWYETGLHIFFGAYPNVQNLFGELGINDRLQWKEHSMIFAMPNKPGEFSRFDFPDVLPAPLNVGCLYKKHIECLYLWKSYNAEFAVV

SEQ ID NO: 221275 - protein, 365 aa, Glycine max
  Coding DNA Sequence Number=SeqID_104497
  Gene Ontology: Mol. function=binding; Cellular component =intracellular; Biological process=RNA processing
  Homolog annotation: Hit_ID=Q9FND1; Match level="QueryCoverage=98%, HitCoverage=64%, E-value=1e-131, Identity=61%"; Hit description =Arabidopsis thaliana genomic DNA, chromosome 5, P1 clone:MRH10
  Pfam annotation: Domain name=DUF946; Domain location=1-365; Score =535.8; E_value=4.5e-158; Accession=PF06101.2; Description=Plant protein of unknown function (DUF946)
MEMSSVYFWLPEPPENYNALGYLVTKKPDKPLLDEMCRVRADLTDKCEPYHLILTAGSRILEFSFQVWSLRPCDRGMLGKGVSVGTFFCCSGWTMGEDIPVACLKNLNHELPAAMPNLQQIHALIKHYGPSIFFHPQEKYLASSVDWFFNNGAMLCKKGMSKGEGIDASGSNLPSGATNNGQYWIDLPSDHDRKNFVKRGDLKSARLYVHVKPALGGTFTDIAMWVFCPFNGPATLKIGIKNIPLSKVGEHVGDWEHFTIRICNFSGELYSIYFSQHSGGEWVDAYDLDYIEGNKAIVYSSKCGHASYPHPWTYMQGSSKLGIGIRNDTARSNLYVDSSIHYELVAAEYLENDVTEPQWLQIMRE

SEQ ID NO: 221276 - protein, 275 aa, Glycine max
  Coding DNA Sequence Number=SeqID_104498
  Pfam annotation: Domain name=PPP4R2; Domain location=70-256; Score= -47.2; E_value=0.0012; Accession=PF09184.1; Description=PPP4R2
MFCVILLVAGSAAQESFSHLSISTAPYSASWGWLCCMAFWDSLLWPNLMIVDLNMDLYIQRANVVKFLNDRHDWDKLKSMLSFQLKQVLSEYPEARMTSEQQYASFGESYIELVNKLDEVSTRPVHARTGLTSWCGLVLKTLAITTKLTCFIEGPPFTLQRLCEILLDAKGLYPNLSKLALALEKNLLVTSTLTICTDPYPQATAKELDDQEKPSEKQQQQQQSDSAENGVELLVSDKDEVMTEADVGDDMTIGMEAFEGVKSSETNSELNANSA

SEQ ID NO: 221277 - protein, 857 aa, Glycine max
  Coding DNA Sequence Number=SeqID_104499
  Gene Ontology: Mol. function=protein transporter activity; Cellular component=nuclear pore; Biological process=protein import into nucleus, docking
  Homolog annotation: Hit_ID=Q1SB44; Match level="QueryCoverage=88%, HitCoverage=71%, E-value=0.0, Identity=90%"; Hit description =Importin-beta, N-terminal
  Pfam annotation: Domain name=CRM1_C; Domain location=765-857; Score= -117.6; E_value=1.6e-09; Accession=PF08767.1; Description=CRM1 C terminal
  Pfam annotation: Domain name=IBN_N; Domain location=103-169; Score =73.5; E_value=6.7e-19; Accession=PF03810.9; Description=Importin -beta N-terminal domain
  Pfam annotation: Domain name=Xpo1; Domain location=180-324; Score =209.7; E_value=6.8e-60; Accession=PF08389.2; Description=Exportin 1 -like protein
  Pfam module annotation: Pfam domain module=CRM1_C::IBN_N::Xpo1; Domain location=765-857::103-169::180-324
MAAEKLRDLSQPIDVPLLDATVAAFYGTGSKDEVSLSLSSLPNTSHLHLGFNHSIEYNAFWFRYTNYPLADMCNVEIYQLFYSFRVSTTSRFVLLFSSLRNAADQILRDLQNNPDMWLQVMHILQNTQNLNTKFFALQVLEGVIKYRWNALPVEQRDGMKNFISDVIVQLSSNEASFRAERLYVNKLNIILVQILKHEWPARWRSFIPDLVSAAKTSETICENCMAILKLLSEEVFDFSRGEMTQQKIKELKQSLNSEFQLIHELCLYVLSASQRTELIRATLSTLHAFLSWIPLGYIFESPLLETLLKFFPVPAYRNLTLQCLTEVAALQFVNYYDVQYVKMYNIFMVQLQGILPPTTNIPEAYGQGSSEEQFHIRILESTQENIAALLVGLEYVINISYVDDTEVFKVCLDYWNSLVSELFEPHRSLDNPAAAATMMGLQVPAMLPGMVDGHGSQLLQRRQLYAGPMSKLRMLMICRMAKPEEVLIVEDENGNIVRETLKDNDVLVQYKIMRETLIYLSHLDHDDTEKQMLRKLSKQLSGEDWTWNNLNTLCWAIGSISGSMMEEQENRFLVMVIRDLLNLCEITKGKDNKAVIASNIMYVVGQYPRFLRAHWKFLKTVVNKLFEFMHETHPGVQDMACDTFLKIVQKCKRKFVITQVGENEPFVSELLTGLPITIADLEPHQIHSFYESVGHMIQAESDAQKRDEYLQRLMELPNQKWMEIIGQAHQNVDFLKDQDVIRTVLNIMQTNTSVATSLGTYFLPQISLIFLDMLNVYRMYSELISKSITEGGPFASRTSYVKLLRSVKRETLKLIETFLDKAEDQPQIGKQFVPPMMDPVLGDYSRNVPDARESEVL

SEQ ID NO: 221278 - protein, 866 aa, Glycine max
  Coding DNA Sequence Number=SeqID_104500
  Gene Ontology: Mol. function=methionine-tRNA ligase activity; Cellular component=soluble fraction; Biological process=methionyl -tRNA aminoacylation
  Homolog annotation: Hit_ID=Q1SE68; Match level="QueryCoverage=94%, HitCoverage=100%, E-value=0.0, Identity=84%"; Hit description =Aminoacyl-tRNA synthetase, class Ia; Nucleic acid-binding, OB-fold, subgroup
  Pfam annotation: Domain name=tRNA-synt_1g; Domain location=63-457; Score=711.7; E_value=5.2e-211; Accession=PF09334.1; Description=tRNA synthetases class I (M)
  Pfam annotation: Domain name=tRNA_bind; Domain location=710-805; Score=174.0; E_value=3.7e-49; Accession=PF01588.10; Description =Putative tRNA binding domain
  Pfam module annotation: Pfam domain module=tRNA-synt_1g::tRNA_bind; Domain location=63-457::710-805
  Subcellular localization annotation: CTP_CleavageSite=28; ConfidenceScore=5.06e-01
MENLLSEVRFITKSAGLTLPYPPFLNLAAGATASSLRRTQPNSFPMAENLIAPKLPVEGKRNILITSALPYVNNVPHLGNIIGCVLSADVFARYCRLRGYNAIYICGTDEYGTATETKAMEENCSPKEICDKYHAIHKEVYNWFNISFDEFGRTSSPEQTEVCQAIFRKIFENKWLSENTMQQLYCNTCERFLADRLVEGTCPTPGCEYDSARGDQCEKCGKLLNPTELKNPRCKVCQKTPHIRDTDHLFLELPLLKDRLEKYISEMSVVGGWSQNAIQTTNSWLREGLKPRCITRDLKWGVPVPHEKYSDKVFYVWFDAPIGYVSITSCYTHEWEKWWKNPENVELYQFMGKDNVPFHTVMFPSTLLGTSENWTLMKTISVTEYLNYEAGKFSKSKGIGVFGNDAKDTNIPVEVWRYYLLTNRPEVSDTLFTWPDLQAKLNSELLNNLGNFINRVLSFIAKPAGQGYDSIIPSVPDNVSGDSHGPTKKLADKVAAYIDQYIEAMEKVKLKQGLKTAMSISSEGNAYLQEAEFWRLYKENKSLCSLVMKTAAGIVYLLACLLEPFIPSFTLEVFKQLNLPADTHVSLSDDKGDVDRVKRPWDIISAGHKIGTPKPLFRELKDEEVEFYRKKFAGSQADRIVRAEAEAQNVAEQLKKTKVSDNRIVQDYLHLLGLLFTTDGNGKKKPGKSSNEAKNKAAAEPDITITRLDIRVGLIIKAQKHPDADALYVEEIDVGEEQTRTVVSGLVKFIPLDEMQNRKVCVLCNLKPVTMRGIKSQAMVLAASDGDHTKVELVEPPSSAQPGERITFPGYEGNPDELLNPKKKVWETLQVDLHTNEELVACYKNVPLTTSAGVCKVSSISCGSIR

SEQ ID NO: 221279 - protein, 281 aa, Glycine max
  Coding DNA Sequence Number=SeqID_104501
  Gene Ontology: Mol. function=nucleic acid binding; Cellular component= mitochondrion; Biological process=regulation of transcription
  Homolog annotation: Hit_ID=Q1RV65; Match level="QueryCoverage=82%, HitCoverage=64%, E-value=2e-48, Identity=44%"; Hit description=Zinc finger, C2H2-type
  Pfam annotation: Domain name=zf-C2H2; Domain location=137-160; Score =24.4; E_value=0.0004; Accession=PF00096.16; Description=Zinc finger, C2H2 type
MVSYTSYFIYRRAENPLQILKFRSIFFFSLEATCWQTYGTLRHCHSGSERGKNQKLTNRVGLFWDLDNKPPNSIPPYEVANKLRIAASSFGVVRYMVAYANSHTFSHVPQGVRESRKEKELLYRLENKGVIKPNQPYRCKVCGRKFYTNDKLVNHFKQLHESEHTKRMNQIESARGSRRVKLVAKYSMKMEKYKKAASDILTPKVGYGLADELKRAGFWVRTVSDKPQAADQALQSHIVDIMDHRRVECVVLVSDDSDFVDVINEAKMRCLKTVVIGDIDE

SEQ ID NO: 221280 - protein, 575 aa, Glycine max
  Coding DNA Sequence Number=SeqID_104502
  Gene Ontology: Mol. function=methionine-tRNA ligase activity; Cellular component=cytosol; Biological process=methionyl-tRNA aminoacylation
  Homolog annotation: Hit_ID=Q1SE68; Match level="QueryCoverage=100%, HitCoverage=71%, E-value=0.0, Identity=89%"; Hit description =Aminoacyl-tRNA synthetase, class Ia; Nucleic acid-binding, OB-fold, subgroup
  Pfam annotation: Domain name=tRNA-synt_1g; Domain location=18-412; Score=717.4; E_value=1e-212; Accession=PF09334.1; Description=tRNA synthetases class I (M)
MTENLKAPKLPVEGKRNILITSALPYVNNVPHLGNIIGCVLSADVFARYCRLRGYNAIYICGTDEYGTATETKAMEENCSPKEICDKYHAIHKEVYNWFNISFDEFGRTSSPEQTEVCQAIFRKIFENKWLSENTMQQLYCNTCERFLADRLVEGTCPTPGCEYDSARGDQCEKCGKLLNPTELKNPGCKVCQKTPRIRDTDHLFLELPLLKDRLEKYISEMSVVGGWSQNAIQTTNSWLREGLKPRCITRDLKWGVPVPHEKYSDKVFYVWFDAPIGYVSITSCYTRDWEKWWKNPENVELYQFMGKDNVPFHTVMFPSTLLGTSENWTLMKTISVTEYLNYEAGKFSKSKGIGVFGNDAKDTNIPVEVWRYYLLTNRPEVSDTLFTWSDLQAKLNSELLNNLGNFINRVLSFIAKPAGQGYDSIIPSVPDDVSGDSHGPTKKLADKVAAYIDQYIEAMEKVKLKQGLKVAMSISSEGNAYLQEAEFWRLYKENKSLCSLVMKTAAGIVYLLACLLEPFIPSFTLEVFKQLNLPVDTHVSLCDDKGDIDRVKRPWDIISASHKIGTPKPLFREL

SEQ ID NO: 221281 - protein, 85 aa, Glycine max
  Coding DNA Sequence Number=SeqID_104503
  Homolog annotation: Hit_ID=Q1RSK5; Match level="QueryCoverage=91%, HitCoverage=10%, E-value=3e-09, Identity=37%"; Hit description =Ovarian tumour, otubain
MAKPFVGHLYVGQLTKDEKIIVADMTKSMVKPRNVLLTLKDHNANSYTTVKKIYNVRHAYQYSLRGSNTEMQQLMMLLDRDQYIH

SEQ ID NO: 221282 - protein, 481 aa, Glycine max
  Coding DNA Sequence Number=SeqID_104504
  Gene Ontology: Mol. function=transcription factor activity; Cellular component=nucleus; Biological process=regulation of transcription
  Homolog annotation: Hit_ID=Q9FL03; Match level="QueryCoverage=75%, HitCoverage=63%, E-value=1e-133, Identity=66%"; Hit description =SCARECROW gene regulator
  Pfam annotation: Domain name=GRAS; Domain location=93-389; Score =335.0; E_value=1.2e-97; Accession=PF03514.5; Description=GRAS family transcription factor
MAYMCADSGNLMAIAQQVIKQKQQQEQQKQQQQQQTNPIPWNSTPPLPPTDFPDPFQSDPPFHFQPFRFSDFDSDDWMDSLIATPSSYTTDFPFPSSDLNRLIFPPQSPDSDSPQQPLLKALSECASLSETEPDQAAESLSRLRKSVSQHGNPTERVGFYFWQALSRKMWGDKEKMEPSSWEELTLSYKALNDACPYSKFAHLTANQAILEATENASNIHILDFGIVQGIQWAALLQAFATRASGKPNKITISGIPAVSLGPSPGPSLSATGNRLSDFARLLDLNFVFTPILTPIHQLDHNSFCIDPNEVLAVNFMLQLYNLLDEPPSAVDTALRLAKSLNPRIVTLGEYEASVTRVGFVNRFRTAFKYFSAVFESLEPNLAADSPERFQVESLLLGRRIAAVIGPGPVRESMEDKEQWRVLMERAGFESVSLSHYAISQAKILLWNYSYSSLFSLVESKPPGFLSLAWKDVPLLTVSSWR

SEQ ID NO: 221283 - protein, 463 aa, Glycine max
  Coding DNA Sequence Number=SeqID_104505
  Gene Ontology: Mol. function=sugar porter activity; Cellular component=integral to membrane; Biological process=carbohydrate transport
  Homolog annotation: Hit_ID=Q1SE63; Match level="QueryCoverage=95%, HitCoverage=84%, E-value=0.0, Identity=75%"; Hit description=Sugar transporter superfamily; Major facilitator superfamily MFS_1
  Pfam annotation: Domain name=MFS_1; Domain location=2-421; Score =65.7; E_value=1.5e-16; Accession=PF07690.6; Description=Major Facilitator Superfamily
  Pfam annotation: Domain name=Sugar_tr; Domain location=1-462; Score =244.9; E_value=1.7e-70; Accession=PF00083.14; Description=Sugar (and other) transporter
  Pfam module annotation: Pfam domain module=MFS_1::Sugar_tr; Domain location=2-421::1-462
MELLGSLLTGNNNSSPTLSGVSWYKLSSVEIGLLTSGSLYGALIGSVLAFNVADFLGRRKELIGSAVVYLVGALVTALAPNFPVLVLGRLVFGTGIGLGPEVEGGGTWAMHAAPMYIAETAPTPIRGQLISLKEFFIVLGMVAGYGIGSLFVETVAGWRYMYGVSSPMAIIMGLGMWWLPASPRWLLLRAIQGKGDVQNSKDIVIRSLCQLQGQAFNDSIPWQVDEILAELSYLGEEKEATFGELFQGKCLKALWIGAGLVLFQQITGQPSVLYYAGSIFQSAGFSGASDATRVSILLGVFKLIMTGVAVVVVDKLGRRPLLLGGVSGIGYANLLISAARMVISLFFLGSYYIFLDNTPVVAVVGLLLYVGSYQISFGPIGWLMIAEIFPLRLRGRGLSIAVLVNFGANALVTFAFSPLKALLGAGILFYTFGVIAVTSLVFIYLVIPETKGLTLEEIEAKCL

SEQ ID NO: 221284 - protein, 1285 aa, Glycine max
  Coding DNA Sequence Number=SeqID_104506
MYWRGDSQSEDDGGFSISCSQGHRSSLNLQTHDEGGSLCLVCFSNLVSNPLSPTVHVSYALSQLSRSLSIPHFLQSLLTFHPHFLLSPLLAALSSFHDQPIAAQLTHLILSLSSSADPSLCSQFIARISDRIASAALGWTSPQLHMIHCLGALLNCEKDDDLHAHIKDMYSFISVLVTGLQLPSEEIRGEVLFVLYKLYVLQSTSAGGDGSDMLIPFCPQILYLLVDVLMKTQNDDVRLNCIALLTMLARRHLLREECAYDTSNMSSNGGVNSKETEDGTKGTSLVNLFAEAIKGPLLSSDSQVQIGTLDLLFHYLSSVRNSDYQIRVLVEENIADYLFEILRLSEYKDPAVKMCLQVLGLLSTAEETFKLRLVVGISTLIPALRYVAEVPFHPVQCETLKLIYECISECPGSVSTSQLEELILVLIRMLRKHSDGEMGMIPETFIMVCSIFVALIRSPSCNGALDLSKSIEEATNHAILACLSVSERNINQILQCLYLLKEAYAYSHDGNSINSSKLELRSGILDICRTHLLPWLVVGINEMEEDIALGLLETFHSILLLHSSINSMEFAETLISIGDRMKNRIYLLLSSLMDSLLGNDSGQPIREAALHLPRDPIDLLFLLGQRSTNSLDLPSCQSAVLLIMYTSSLYDESFLTFIARLADEKLILASLEQYILLNRGNFHNRTTDNLTVTRLVNLYSSLRGLGSMNYQIHYSRDAEEIIFQLINNDEWDLLSARIHTVSLKWLFQQENIINSLSHQILKFCRSYNLEEADIIIGNNYQTVNVQTLSELVSTEDNYGARLFVCLLAQLLEEEGREYDIICVLNVMATMVLVCPAACEQLSLHGIATTIRTWCYLSNSLSTTTYMSILILVFNTLSSVHPETLSVDQSWVAITMKMMECSIPSKEVDILSDESLFVIGILSLILHLSTNKALEETSKAILFNTCIISMVNTVVCAASSKGPALVDHDEGTSTGETLIFVLLLHYFAVKSLHAILPGFVDWQSFFASTNPSEPLAFIGIRCHDLCRLLHFGSTVIKIAASYSLLELFKRISDQINSNHEELRCTIGYIMSIRSILEGLVFYNDLRVATNCSLCLSMILGWEKLTKETKVLEESSWCRLIIEEMTVSLAAPALASQSFMNNQRPAVLVAIALLKLHKIPQWMRSVFDNSSISGILGNLSASNLSSEILALFRELLKSNFLSTEQIATINQMLQECRKRMYSNNAQEDLPNEPIKKVLTTSYNMGDICEYLIDLMTSEAYLDTGSKKLLEEIELFFSTLSVDNGSCM

SEQ ID NO: 221285 - protein, 916 aa, Glycine max
  Coding DNA Sequence Number=SeqID_104507
  Gene Ontology: Mol. function=protein serine/threonine kinase activity; Cellular component=integral to membrane; Biological process=protein amino acid phosphorylation
  Homolog annotation: Hit_ID=Q8LKR3; Match level="QueryCoverage=96%, HitCoverage=100%, E-value=0.0, Identity=66%"; Hit description =Receptor-like kinase RHG4
  Pfam annotation: Domain name=APH; Domain location=572-751; Score= -13.8; E_value=0.055; Accession=PF01636.13; Description =Phosphotransferase enzyme family
  Pfam annotation: Domain name=LRRNT_2; Domain location=29-64; Score =21.2; E_value=0.0038; Accession=PF08263.3; Description=Leucine rich repeat N-terminal domain
  Pfam annotation: Domain name=LRRNT_2; Domain location=324-363; Score =16.6; E_value=0.016; Accession=PF08263.3; Description=Leucine rich repeat N-terminal domain
  Pfam annotation: Domain name=LRR_1; Domain location=114-136; Score =14.4; E_value=0.4; Accession=PF00560.23; Description=Leucine Rich Repeat
  Pfam annotation: Domain name=LRR_1; Domain location=138-162; Score =2.6; E_value=94; Accession=PF00560.23; Description=Leucine Rich Repeat
  Pfam annotation: Domain name=LRR_1; Domain location=164-186; Score =10.1; E_value=3.6; Accession=PF00560.23; Description=Leucine Rich Repeat
  Pfam annotation: Domain name=LRR_1; Domain location=188-210; Score =17.0; E_value=0.069; Accession=PF00560.23; Description=Leucine Rich Repeat
  Pfam annotation: Domain name=LRR_1; Domain location=237-258; Score =8.8; E_value=6.3; Accession=PF00560.23; Description=Leucine Rich Repeat
  Pfam annotation: Domain name=LRR_1; Domain location=260-282; Score =10.0; E_value=3.8; Accession=PF00560.23; Description=Leucine Rich Repeat
  Pfam annotation: Domain name=LRR_1; Domain location=284-305; Score =4.0; E_value=51; Accession=PF00560.23; Description=Leucine Rich Repeat
  Pfam annotation: Domain name=LRR_1; Domain location=366-388; Score =6.3; E_value=19; Accession=PF00560.23; Description=Leucine Rich Repeat
  Pfam annotation: Domain name=LRR_1; Domain location=390-412; Score =13.7; E_value=0.66; Accession=PF00560.23; Description=Leucine Rich Repeat
  Pfam annotation: Domain name=LRR_1; Domain location=414-435; Score =13.6; E_value=0.74; Accession=PF00560.23; Description=Leucine Rich Repeat
  Pfam annotation: Domain name=LRR_1; Domain location=67-89; Score=3.8; E_value=56; Accession=PF00560.23; Description=Leucine Rich Repeat
  Pfam annotation: Domain name=LRR_1; Domain location=91-112; Score =14.3; E_value=0.44; Accession=PF00560.23; Description=Leucine Rich Repeat
  Pfam annotation: Domain name=Pkinase; Domain location=569-845; Score =169.4; E_value=9e-48; Accession=PF00069.15; Description=Protein kinase domain
  Pfam annotation: Domain name=Pkinase_Tyr; Domain location=569-845; Score=136.3; E_value=8.3e-38; Accession=PF07714.7; Description =Protein tyrosine kinase
  Pfam module annotation: Pfam domain module=APH::LRRNT_2::LRRNT_2::LRR_ 1::LRR_1::LRR_1::LRR_1::LRR_1::LRR_1::LRR_1::LRR_1::LRR_1::LRR_1::LRR_ 1::LRR_1::Pkinase::Pkinase_Tyr; Domain location=572-751::29-64::324 -363::...
  Pfam module annotation: Domain location=114-136::138-162::164 -186::188-210::237-258::260-282::284-305::366-388::390-412::414 -435::67-89::91-112::569-845::569-845
MATSKLKPKTLLSPSKLFLLSLCLACTAIADDGEFMSKLAKALSPTPSGWSGSSFCAWNGVKCSAHRVTSINIASQSLGGMLPPDLNSLSQLTSLSLQNNALSGAFPSLANLSMLESVFLSSNNFTSIPVGCFQGLPSLQTLSMTDSINLAPWTIPAELTDSINLVKLELGNANLIGTLPDVFDKFVSLVELRLSYNNLTGVLPKSFAGSAIQNMWLNNQNGFGFSGTIEVLASMTHLSQVWLQKNQFTGPIPDLSNCTTLFDLQLRDNQLTGVVPPSLMSLSGLQNVTLANNALQGPVPSFGKGVKFTLDGINSFCLKDVGPCDSRVTTLLDIAAGFGYPFQLARSWTGNDPCDDWSFVVCAGGKIITVNLAKQNLTGTISPAFANLTDLRNLFLNDNNLGGSIPGSLTNLAQLEVLNVSNNKLSGDVPKFSSKVKFTTAGNDLLGRSDGGGGSGTTPSKGSGDAPSGSPSAGTSGSSLSPAWIAVVVFVFCKCHAKNRHGKFGRVNNPENGKGEVKIDMMSVTNSNGYGGVPSELQSQGSERSDLHVFEGGNATISIQVLRQVTDNFSEKNILGRGGFGVVYKGELHDGTQIAVKRMESVATGSKGLNEFQAEIAVLSKVRHRHLVALLGYCINGNERLLVYEYMPQGTLTQHLFDWGENGCAPLTWKQRVAIALDVARGVEYLHSLAQQSFIHRDLKPSNILLGDDMRAKVADFGLVKNAPDGKYSVETRLAGTFGYLAPEYAATGRVTTKVDVYAFGVVLMELITGRRALDDTVPDERSHLVSWFRRVLINKENIPKAIDQTLDPDEETMESIYKVAELAGHCTAREPYQRPDMGHAVNVLGPLVEQWKPTTHEEEEGYGIDLHMSLPQALRRWQANEGTSTMFDMSISQTQSSIPAKPSGFTDSFDSMDCR

SEQ ID NO: 221286 - protein, 652 aa, Glycine max
  Coding DNA Sequence Number=SeqID_104508
  Homolog annotation: Hit_ID=Q2Z1Z1; Match level="QueryCoverage=33%, HitCoverage=99%, E-value=2e-16, Identity=30%"; Hit description =Hypothetical salt-inducible protein
MDNNQDQGHEGHAFRCSETVEGYELSVSERQTHSNASESDDNPHSQGPNSLDTGNNEKLNVGTGEILLSSSGDELFLDANANFSDGAASPRSKEPLRDSSESATDEEIGNIKYQEFSSGSSSDFNDVNQFIVKGQMQDPSILQRERVKEGNMLELQGQLSGSHVDPPSSSSITDLRTIEDRFGLSSDSNPSKGEAAPDLLLENKIYAGENVRQEMGEENVNIFTSPVCDDSADVTHPQNECADFKDHKGVLPQNSLSLLSSEAGKPKQDDLKDSDDDDDYCHINLSHLSEKREVLPPDGTMTDQESWEIVSDEMHDEESIGVSSVKFITESDKTSDEIGASMNCMKFTMIEDYLSNFSDGVYKSDDVVEMDKFEKCDITDIECATNKSTPSGAQEDIEDNEINSSCRVNKECNRLISTSANSHQTQNAELSVKAAEEPGRNDSSLYSLGVEPSAQCVSVVRETQGEVSGITVVPVQDQSGNKNNNVQLPSSAIHTSIDYGIQCDSLEGNRDSVSGIPSNLNDPKAAYEIQKGLNQQHPSSTSSQAGWFTRLVTEVTNESQGREKNEEIIAEITNDSTSEQQTPPQSPLSEAAHSNNRPESPKLEESPIFGKNGESAVVKGEGDINRQNKKVKSKLYYCPLFWCCSSVDSPPR

SEQ ID NO: 221287 - protein, 93 aa, Glycine max
  Coding DNA Sequence Number=SeqID_104509
  Subcellular localization annotation: CTP_CleavageSite=39; ConfidenceScore=5.15e-01
MTMSRVVIALCHSQRPTVFGHSTPSLASIVPLTKTKDLVVMVIPGGGKLCGWQRLKVSPISSTSNCLRSLLPSPPHMLMTTTHQHIKDINPKP

SEQ ID NO: 221288 - protein, 506 aa, Glycine max
  Coding DNA Sequence Number=SeqID_104510
  Gene Ontology: Mol. function=binding; Cellular component=plastid chromosome; Biological process=positive regulation of transcription, DNA-dependent
  Homolog annotation: Hit_ID=O23278; Match level="QueryCoverage=80%, HitCoverage=75%, E-value=1e-113, Identity=49%"; Hit description=Salt- inducible protein homolog
  Pfam annotation: Domain name=PPR; Domain location=136-170; Score =29.4; E_value=1.2e-05; Accession=PF01535.11; Description=PPR repeat
  Pfam annotation: Domain name=PPR; Domain location=171-205; Score =43.3; E_value=8.1e-10; Accession=PF01535.11; Description=PPR repeat
  Pfam annotation: Domain name=PPR; Domain location=206-240; Score =26.9; E_value=7.1e-05; Accession=PF01535.11; Description=PPR repeat
  Pfam annotation: Domain name=PPR; Domain location=241-275; Score =24.8; E_value=0.0003; Accession=PF01535.11; Description=PPR repeat
  Pfam annotation: Domain name=PPR; Domain location=276-310; Score=8.2; E_value=0.8; Accession=PF01535.11; Description=PPR repeat
  Pfam annotation: Domain name=PPR; Domain location=380-414; Score=2.8; E_value=3.5; Accession=PF01535.11; Description=PPR repeat
  Pfam module annotation: Pfam domain module=PPR::PPR::PPR::PPR::PPR::PP R; Domain location=136-170::171-205::206-240::241-275::276-310::380 -414
  Subcellular localization annotation: CTP_CleavageSite=27; ConfidenceScore=5.61e-01
MVNALTHSQSQFVLVLLNSNCRGSKSSSNTVFRKPFAKFSSLTTKICHASYHRFADTKHTTLLVETYHLHHSLRALLAKLENEYSNPLHMLAEDADWSKDHFWAVVRFLKSSSNFTHILQVFDMWKNIEKSRISEFNYNKIIGLLCEGGKMKDALSALQDMKVQGIKPSLDTYNPIIHGLSREGKFSDALRFIDEMKESGLELDSETYDGLIGAYGKFQMYDEMGECVKKMELEGCSPDPITYNILIQEYAGGGLLQRMEKLYQRMLSKRMHVKSSTLVAMLEAYTTFGMVEKMEKFYRKILNSKTCIEDDLIRKVAEVYINNFMFSRLEDLALDLCPAFGESNLEWCFRLLSYACLLSKKGMDIVVQEMQDAKVSWNVTVANIIMLAYVKMKEFRHLRILLSQLPIYRVQPDIITIGILFDATRIGFDGSGALETWRRMGYLYRVVEMKTDSLVLTAFGKGHFLKSCEEVYSSLHPEDRKRKTCTYHDLIPLLSKHTGTIHCIKT

SEQ ID NO: 221289 - protein, 170 aa, Glycine max
  Coding DNA Sequence Number=SeqID_104511
  Gene Ontology: Mol. function=thiosulfate sulfurtransferase activity; Cellular component=chloroplast
  Homolog annotation: Hit_ID=Q1SL56; Match level="QueryCoverage=76%, HitCoverage=95%, E-value=2e-58, Identity=83%"; Hit description =Rhodanese-like
  Pfam annotation: Domain name=Rhodanese; Domain location=39-142; Score= 53.7; E_value=6.2e-13; Accession=PF00581.10; Description=Rhodanese -like domain
METMSILPFFYNTYLHRRWLARHMLLMAMSIHQNVVTIDVHAAKDLLNSSGYRYLDVRSVEEFNKSHVENAHNVPYVFITEAGRVKNPDFVDQVAAICKTEDHLIVACNSGGRSLRASVDLLDSGFKNIVNMGGGYSAWVDAGFAGNKPGEDLKTSCKFRPNIAKPTAQP

SEQ ID NO: 221290 - protein, 603 aa, Glycine max
  Coding DNA Sequence Number=SeqID_104512
  Gene Ontology: Mol. function=catalytic activity; Cellular component =plastid; Biological process=metabolic process
  Homolog annotation: Hit_ID=Q8LRT1; Match level="QueryCoverage=91%, HitCoverage=76%, E-value=0.0, Identity=70%"; Hit description=Acyl -CoA synthetase-like protein
  Pfam annotation: Domain name=AMP-binding; Domain location=109-602; Score=243.0; E_value=6.4e-70; Accession=PF00501.18; Description=AMP -binding enzyme
  Subcellular localization annotation: CTP_CleavageSite=46; ConfidenceScore=5.61e-01
MSAIPISSSYASTFSYSAAHALPFFFARNNYSTRINLHPPVFCQLQSETEKPLTRRCSPFLESSLLSGNGGVASNEWKAVPDIWRSSAEKYGDKIALVDPYHDPPSTMTYKQLEDAILDFAEGLRVIGVRPNEKLALFADNSCRWLVADQGMMACGAINVVRGSRSSIEELLQIYNHSESVALAVDNPEMLNRIAKLFYLKASMRFIILLWGEKSGLVSEGDKEVPVFTFTEVIHLGQESRRVLFDSLDTRKHYMYEAIKSDDIATLVYTSGTTGNPKGVMLTHQNLLHQIKNLGDIVPAEVGDRFLSMLPSWHAYERACEYFIFSCGVEQVYTTVRNLKEDLGHYQPHYLISVPLVYETLYSGIQKQISTSSLVRKLVALTFIRVSLRYMECKRIYEGKCLTKDQKPPSYLHSILDWLWARVVATILFPVHLLAKILVYHKIHSAIGISKAGVSGGGSLSSHVDRFFEAIGVNVQNGYGLTETSPVIAARRLSYNVIGSVGHPIKHTEFKVVDSETDEVLPPGSKGILKVRGPQLMKGYYKNPSATNQVLDRDGWLNTGDIGWIVPHHSTGRSRNSSGVIVVDGRAKDTIVLSTGRTEVCVC

SEQ ID NO: 221291 - protein, 92 aa, Glycine max
  Coding DNA Sequence Number=SeqID_104513
MRRQIMVILHTFSPFRHSRVKWHAKTNVVFCAFCHPEAAGPMTCGNHLVPHFFTFLSSRGGGPDDMREPFGPAIFHLLSSRGGEPDGMRGTI

SEQ ID NO: 221292 - protein, 87 aa, Glycine max
  Coding DNA Sequence Number=SeqID_104514
  Gene Ontology: Mol. function=catalytic activity; Biological process =metabolic process
  Homolog annotation: Hit_ID=Q1SB22; Match level="QueryCoverage=72%, HitCoverage=10%, E-value=2e-13, Identity=66%"; Hit description=AMP -dependent synthetase and ligase
MAFLVAICLLEGENVEPGELEEAAMRSSLIHQIVVIGQDKRRLGAVIVPNKEEVLKAARESSIIDSNSSDASQEKVTSLIYKELRTW

SEQ ID NO: 221293 - protein, 425 aa, Glycine max
  Coding DNA Sequence Number=SeqID_104515
  Gene Ontology: Mol. function=methyltransferase activity
  Homolog annotation: Hit_ID=UPI000069DC8F; Match level="QueryCoverage =32%, HitCoverage=39%, E-value=2e-16, Identity=37%"; Hit description =UPI000069DC8F related cluster
MAAANSEGNGQKPRLETFQLFSSSASAFGIFDDAAQQVPHIPPPPCVEVLASEVPSSIKHNVDSVNLDGVTLLKGRVNTQQVFGLSNSNLVPWKYEGGLKLWEGSLDLIKALRSDIRNGLISFSGKRVLELLDGVLIIIFHVERYTLHEADACTLHSTSETVSYQYFVITLHLTWTLTSPYDGVLNVGSGHGLPGIFALLEGAAAVHFQDFNAEVLRFLTIPNLNANLSRDTQLSSFNSTICDKAEVCFFAGDWSGIDKLLPHVSTDAKNNQGDGYDFILMAETVYSINSLQNLYDLIKKCLQHPDGVVYMAAKKYYFGVGGGTGDFCLCCIIKSSALDMQTTCSNNINILILLTYLFSTISFAHTVISVLPVSWNLNYGTMCSMPDGSHQKLAHVMQCVMTSSLVAEITDGSSNVHEVWKLAYK

SEQ ID NO: 221294 - protein, 608 aa, Glycine max
  Coding DNA Sequence Number=SeqID_104516
  Gene Ontology: Mol. function=binding; Cellular component =intracellular; Biological process=metabolic process
  Homolog annotation: Hit_ID=Q6ZIP5; Match level="QueryCoverage=99%, HitCoverage=93%, E-value=1e-122, Identity=32%"; Hit description =Pentatricopeptide (PPR) repeat-containing protein-like protein
  Pfam annotation: Domain name=PPR; Domain location=140-173; Score=4.6; E_value=2.1; Accession=PF01535.11; Description=PPR repeat
  Pfam annotation: Domain name=PPR; Domain location=202-236; Score =35.3; E_value=2.1e-07; Accession=PF01535.11; Description=PPR repeat
  Pfam annotation: Domain name=PPR; Domain location=304-338; Score =43.6; E_value=6.6e-10; Accession=PF01535.11; Description=PPR repeat
  Pfam annotation: Domain name=PPR; Domain location=339-373; Score =14.1; E_value=0.16; Accession=PF01535.11; Description=PPR repeat
  Pfam annotation: Domain name=PPR; Domain location=37-71; Score=14.1; E_value=0.16; Accession=PF01535.11; Description=PPR repeat
  Pfam annotation: Domain name=PPR; Domain location=375-409; Score =19.0; E_value=0.017; Accession=PF01535.11; Description=PPR repeat
  Pfam module annotation: Pfam domain module=PPR::PPR::PPR::PPR::PPR::PP R; Domain location=140-173::202-236::304-338::339-373::37-71::375-409
MGRSLQSQLCSAARQSPLLAKKLHAQIIKAGLNQHEPIPNTLLNAYGKCGLIQDALQLFDALPRRDPVAWASLLTACNLSNRPHRALSISRSLLSTGFHPDHFVFASLVKACANLGVLHVKQGKQVHARFFLSPFSDDDVVKSSLIDMYAKFGLPDYGRAVFDSISSLNSISWTTMISGYARSGRKFEAFRLFRQTPYRNLFAWTALISGLVQSGNGVDAFHLFVEMRHEGISVTDPLVLSSVVGACANLALWELGKQMHGVVITLGYESCLFISNALIDMYAKCSDLVAAKYIFCEMCRKDVVSWTSIIVGTAQHGQAEEALALYDEMVLAGVKPNEVTFVGLIHACSHAGLVSKGRTLFRTMVEDHGISPSLQHYTCLLDLFSRSGHLDEAENLIRTMPVNPDEPTWAALLSSCKRHGNTQMAVRIADHLLNLKPEDPSSYILLSNIYAGAGMWEDVSKVRKLMMTLEAKKAPGYSCIDLGKGSHVFYAGETSHPMRDEIIGLMRELDEEMRKRGYAPDTSSVLHDMDQQEKERQLFWHSERLAVAYGLLKAVPGTVIRIVKNLRVCGDCHTVLKLISAITNREIYVRDAKRYHHFKDGNCSCNDF

SEQ ID NO: 221295 - protein, 489 aa, Glycine max
  Coding DNA Sequence Number=SeqID_104517
  Gene Ontology: Mol. function=transition metal ion binding; Cellular component=chloroplast; Biological process=chlorophyll biosynthetic process
  Homolog annotation: Hit_ID=Q1SJU1; Match level="QueryCoverage=95%, HitCoverage=98%, E-value=1e-136, Identity=85%"; Hit description =Ferritin-related
  Pfam annotation: Domain name=Rubrerythrin; Domain location=149-282; Score=200.6; E_value=3.6e-57; Accession=PF02915.8; Description =Rubrerythrin
  Subcellular localization annotation: CTP_CleavageSite=68; ConfidenceScore=5.80e-01
MLLLSPPQPQLQPFFTSLHMAALVKPISNVTPKFVSSPRMGSSHSSKFSTIIRMSATATPPPSTSTKPASSKKGNIKETLLTPRFYTTDFDEMETLFNTEINKNLNQDEFEALLQEFKTDYNQTHFVRNKEFKEAADKLEGPLRQIFVEFLERSCTAEFSGFLLYKELGRRLKKTNPVVAEIFSLMSRDEARHAGFLNKGLSDFNLALDLGFLTKARKYTFFKPKFIFYATYLSEKIGYWRYITIYRHLKANPEFQCYPIFKYFENWCQDENRHGDFFSALMKAQPQFLNDWKAKLWSRFFCLSLKFVRKVGIQNPTDLNCANPMDKGKRKDLDLLAKLLLPQKHFSPENQTCTMSKMQNLIYLGITHHVYVTMYLNDCQRTAFYEGIGLNTKEFDMHVIIETNRTTARIFPAVLDVENPEFKRKLDRMVEINEKLVAVGESDDIAVVKNLKRIPLVAALVSELLATYLMPPIESGSVDLAEFEPQLVY

SEQ ID NO: 221296 - protein, 669 aa, Glycine max
  Coding DNA Sequence Number=SeqID_104518
  Gene Ontology: Mol. function=nucleic acid binding; Cellular component= mitochondrion; Biological process=DNA integration
  Homolog annotation: Hit_ID=Q1SRN1; Match level="QueryCoverage=98%, HitCoverage=55%, E-value=1e-148, Identity=51%"; Hit description =Integrase, catalytic region
  Pfam annotation: Domain name=rve; Domain location=1-103; Score=-1.9; E_value=0.0086; Accession=PF00665.16; Description=Integrase core domain
  Pfam module annotation: Pfam domain module=RVT_2::rve; Domain location=187-421::1-103
MAELQFNKKIKALQTDGAKEYLVLTKYLVDHGIRHRISCPHTHEQNGALERKHRHLTETDLTLLADSCFPSKFWAEAFNTITFIINRIPSPMIHYKSPFEPTLPPSIATINPPTSTPAAPITPIPDPIPPTSITPVTEHSTPPNPATNTHPMTTRAKSGIFKSKALLTEMTPRCTMDALQNPQWLAAMKAKYMALMQNNTWDLVPLPPHKKAIGSKWIYCLKYNADGSVTFSPVIKPATIRTILSITVTRKWDTRQVDINNAFLNGTIQEEVYMQQPEGFASANSHLVYKLKKSIYGLKQAPRAWFSKLASSLISFGFKPTRCDTSLFVHATPKFITYILVYVNDIIITGSSTSAVQYVISKLHSLYPLKDLDTLHFFLGIEAKYTTTGALLLSQSKYITDILTKANMHNAKPIKTHLALGSKLHMDGTNAFSDPTLYKYVVGAQQYATIIRPDIAYAVNKLCQFMHNPLESHWKATNRVLRYLNGTIDHGLAFYPSQHLFITGYSDSDWADSFDMRFTSGFCVYLGNNLVSWLAKKQQSVSRSSTEVEFRSLAALVAEIKWLQSLLTELHNVQTKPPLLWCDNQGAVMITANPVLHSKSKHFELDLWFVREKAANGEIIVKHIPSQFQVADLLTKAPSSNTFLSLRPKLNVHQLPTLSLQGDVKDRGK

SEQ ID NO: 221297 - protein, 488 aa, Glycine max
  Coding DNA Sequence Number=SeqID_104519
  Gene Ontology: Mol. function=delta3,5-delta2,4-dienoyl-CoA isomerase activity; Cellular component=peroxisome; Biological process=fatty acid catabolic process
  Homolog annotation: Hit_ID=Q9FHR8; Match level="QueryCoverage=55%, HitCoverage=98%, E-value=1e-88, Identity=61%"; Hit description=Enoyl CoA hydratase-like protein
  Pfam annotation: Domain name=ECH; Domain location=235-411; Score =132.6; E_value=1.1e-36; Accession=PF00378.10; Description=Enoyl-CoA hydrataseisomerase family
METYAYRAPDYAMTGQPTVKSDARPLFKDGRKFPELADARSLPSSNCGINVHSRTGKSSSSHWGCGGVSGSRWDLEGSEKDDSSRETARTSNNGVPRVNHDRLSVPTCLFLVSRTFSDGVSRWVSSLVSKKLKILKNGIKVVEESSIKGKDSLANSAKEAWNIMNKSYRELIEESKDLEKLRVEEQQNSLKAHEQRALERSGDWVEVCVAVRSGGMEEKYSSLEIVEESPNSGVFFLILNRPSRRNALSREFFSEFPKALHALDHNPEVKVIVLSGAGDHFCSGIDLSLLGSTAASSGSSGSGETLRREIMAMQDAVTALERCRKPVIASVHGACIGGGIDIVTACDIRMCSEEAFFSVKEVDLALAADLGTLQRLPLIVGFGNAMELALTGRTFSGKEAKELGLVSRVFLSKHDLHQAVRDVAQAIATKSPLAVVGTKTVLLKSRDLTVDQGLDYVATLNSARLLSPDLTEAVMAQKQKRKPVFSKL

SEQ ID NO: 221298 - protein, 125 aa, Glycine max
  Coding DNA Sequence Number=SeqID_104520
MGSRRVEREGWASGSACKGNGAKVARPWLVNGVEEVVVGWCTDLVSRETHDIIGIMVVLRMTMIGVVVMVARKGKEGGWGRKPGEDLHLGAVIRLQCPILYHYDCDSPCDYVYTATCIPCSCLSG

SEQ ID NO: 221299 - protein, 474 aa, Glycine max
  Coding DNA Sequence Number=SeqID_104521
  Gene Ontology: Mol. function=transferase activity, transferring glycosyl groups; Cellular component=membrane
  Homolog annotation: Hit_ID=Q8H038; Match level="QueryCoverage=89%, HitCoverage=72%, E-value=1e-141, Identity=54%"; Hit description =Xyloglucan galactosyltransferase KATAMARI1 homolog
  Pfam annotation: Domain name=Exostosin; Domain location=58-408; Score= 525.4; E_value=6.1e-155; Accession=PF03016.6; Description=Exostosin family
MDKSCVISPSCYDNHHLCFAFLFSFLFCSLLLSFHAPNLLRLTSKTKNVTDSCTGRYVYIHQLPSRFNDYLLQNCQSLTRGTDKPNMCPYMQNNGLGPHITYSQGLFSNNTCYATNQFLLEVIFHNRMTKYGCLTNDSSLASAIFVPFYAGLDVSRFLWLSNLTERDSSGRDLLQWVAKRPEWKQMWGRDHFLVSGRIAWDFRRQYDDASYWGSKFRFIPESMNMSMLAVEASSWNNDYAIPYPTSFHPSEDTHVYRWQRKIRHQKRPYLFTFTGAPRPELEGSIRGKIIDQCRASSVCKFVDCSYGVERCDDPINVIKVFESSVFCLQPPGDSYTRRSIFDSILAGCIPVFFHPGTAYSQYKWHLPKNRTKYSVYIPVKDVKQWNVNVEQVLLGIPEGEVFAMREEVIKLLPNIIYADPRSKLDCFEDAFDLAVKGMLERIEKVREAMRSGRDPSIGFADEDHYKYTFSQNYS

SEQ ID NO: 221300 - protein, 188 aa, Glycine max
  Coding DNA Sequence Number=SeqID_104522
  Gene Ontology: Mol. function=zinc ion binding
  Homolog annotation: Hit_ID=Q1SJU0; Match level="QueryCoverage=97%, HitCoverage=41%, E-value=2e-67, Identity=70%"; Hit description=Zinc finger, DHHC-type
MEKRTTYENFRNQYDKKGNPFNRGSCRNLKETLCSSIPHSKNNFRSFVVEDEQMMVGSLTPNTGDGILTPKEKIDLEMGSMRAEDGRRPVPELLRNFDFDNFDSDMKFADDDGQPSFDPFYSIEDDVKDSARTSIQTVLNFQSITEDVMEESVQSSHAGGKVRESTQRHFPADGTYTIKETDDRNHSH

SEQ ID NO: 221301 - protein, 147 aa, Glycine max
  Coding DNA Sequence Number=SeqID_104523
MDPSFNELEWSWIVNCQRLCAKRTKLLELGWHFYGLSGVASSPCLSCFGSSSIPLSGPCSSSAHLRHLGVAHAYDEQSLSGAILDHTKPSSTLHSVVGHDFRGLLGAKPSWESFVSSMGAKCALGSLARGHLRQLYFACVLSAHMQT

SEQ ID NO: 221302 - protein, 284 aa, Glycine max
  Coding DNA Sequence Number=SeqID_104524
  Gene Ontology: Mol. function=3'-5' exonuclease activity; Cellular component=intracellular; Biological process=DNA recombination
  Homolog annotation: Hit_ID=Q1S9Y1; Match level="QueryCoverage=90%, HitCoverage=64%, E-value=3e-54, Identity=51%"; Hit description=3-5 exonuclease
  Pfam annotation: Domain name=3_5_exonuc; Domain location=25-238; Score=41.2; E_value=3.5e-09; Accession=PF01612.11; Description=3'-5' exonuclease
MTMRPLLTLSYFPNYTSLRMESVHPTIRTFDAVEKAATKLLQILQEMMQIAIGFDIEWKPTFRKGNNNDVYLINWGGKERDKKKKRMFQVQNLILAQTYRTLVDCLDEEFQNSWEAEPLYFVLQIAMWMKLLLEDPTVLKVGAGIDGDAVKVFRDYNISVKGVTDLSFHANRKLGGDHKWGLASLTEKLLSKQLKKPNKIRLGNWETPVLSKEQLEYAATDAFASWYLYQPYLDFKLLTSVVFSSILLILDSRNWFILLHAIKDLPDAQKVTDRSGEVDGVPQE

SEQ ID NO: 221303 - protein, 66 aa, Glycine max
  Coding DNA Sequence Number=SeqID_104525
MAPTVPSTPIEGRLVMLPTVERYRYIEAKLLSGVQVGWINNMENDNSIDRFLRQWQLALSHIMLVT

SEQ ID NO: 221304 - protein, 59 aa, Glycine max
  Coding DNA Sequence Number=SeqID_104526
MAQVLAFRDIAPRAPTHILITPKVRDRLTARSKAYYVVSHVHLKIIYIHVLNVHNNTIY

SEQ ID NO: 221305 - protein, 152 aa, Glycine max
  Coding DNA Sequence Number=SeqID_104527
  Homolog annotation: Hit_ID=P42855; Match level="QueryCoverage=42%, HitCoverage=51%, E-value=5e-14, Identity=75%"; Hit description=14 kDa zinc-binding protein
MVKLLLRRAKGKQTTLTRTRVGHRTRQRAGVSVFHRSQLCIVYTFQVEERHCEILGSLLYTAKLITKQEGLDEGFRIVKLMMDQTGVRIGFGQTNQFTTFTCTSLGDDRWLEPPFKRSHSMPVPTCSNALPMQSINNGFKRLSSVFMLQNSL

SEQ ID NO: 221306 - protein, 86 aa, Glycine max
  Coding DNA Sequence Number=SeqID_104528
  Homolog annotation: Hit_ID=Q1S7A5; Match level="QueryCoverage=89%, HitCoverage=19%, E-value=2e-20, Identity=66%"; Hit description =Cystinosin/ERS1p repeat
  Pfam annotation: Domain name=PQ-loop; Domain location=31-80; Score =46.5; E_value=8.7e-11; Accession=PF04193.5; Description=PQ loop repeat
MGVFENSTLSLWCHSNQHCLQLAKEHMGSVRETASFLLGLISVIVWVVAEIPQILTNYRTKSAEGLSVTFLITWIIGNMDEGKIMF

SEQ ID NO: 221307 - protein, 102 aa, Glycine max
  Coding DNA Sequence Number=SeqID_104529
MEPLVIFIIVVVCMFTFVVVFTLCQVAAGRQAFGSGGGGGGGGFGHHNHHHHSHHGGMMGGIIGSGACGGGGGGGGGGGGGGGGGCGGGGGGGGGGGGELIQ

SEQ ID NO: 221308 - protein, 287 aa, Glycine max
  Coding DNA Sequence Number=SeqID_104530
  Homolog annotation: Hit_ID=Q2HUI3; Match level="QueryCoverage=80%, HitCoverage=76%, E-value=4e-71, Identity=63%"; Hit description =Cystinosin/ERS1p repeat
  Pfam annotation: Domain name=PQ-loop; Domain location=177-241; Score =66.1; E_value=1.1e-16; Accession=PF04193.5; Description=PQ loop repeat
MPRILQAFFLCLLGLYAIETFTKVGHVEKASDAEQSIQVDGSNRSTDLSSPIPLPARPQRISTGRELFYQSARYLSKSNTPTAGSILAQKPPTLDSIQESLLGSTIATQSAPALKMKNTLCLVSTLTFLGAINLLQPLDERINSMASNPRQQFVIYVGRKLFQVSDDQLPKTDVSGSIGTFFGWAMTFIYLGGRLPQICLNIRRGHVEGLNPLMFLFAVIGNATYVASILVISLDWSKIRPNLPWLVDAGGLYIFAVGPPKPCRAITSINCCLLRKKQGYSGLSLTL

SEQ ID NO: 221309 - protein, 225 aa, Glycine max
  Coding DNA Sequence Number=SeqID_104531
MKMKANKIRNELKVSDSKTYGLKTEECTKNRRRTAKNDGKFSRNCSRKQLGRVTEGSGALLLSIFALIYSQNGEEVVAKLEFPNAPPILLSSPPILPRLPQEVSCEPKLLRKRFQKCYRSITKVSNAIFQQNGGGGCRPARPGELGCFHLKQEKVQNLLDGPRFENCYLHPHFDKFIPVFVFFGCFLSETSRNFTDSTAMGFKHSEAIKNGPRTKLGYDNYQIKM

SEQ ID NO: 221310 - protein, 132 aa, Glycine max
  Coding DNA Sequence Number=SeqID_104532
  Gene Ontology: Mol. function=RNA-directed DNA polymerase activity; Biological process=DNA integration
MAYQRGISYKNETISNGYKHTFHNGLIQEEVYVEQPLGFESNTFPHHVLKLNKGLYRVTQALRAWDFSKLMQVEFEMSMMGELKFFLRQQIKHTSNEIYIRQTKYVKELLKKFKLEDAKEMKTRMHPTTCLG

SEQ ID NO: 221311 - protein, 110 aa, Glycine max
  Coding DNA Sequence Number=SeqID_104533
MVEQNPNKYMLRIRVRLGKSSNQILCEKRKTLPARISNLQVEMLKQGVSKPTIGRSEENRAHAHFMQTPRVRSNENLENPVTERSWVDSQGEKENPNSNLARKRNENLMG

SEQ ID NO: 221312 - protein, 508 aa, Glycine max
  Coding DNA Sequence Number=SeqID_104534
MSRPRGWNGHEKHREKKHKKGKRDKEKKEKRDKEGRDGKRKEKKDKKEKHREKKKDKDKNRDKEKSKTGAAIEKEFPGQAQGPNAGKLHQKEIKPIDKIVLLEDKLTKQFASNNGEKARENNHFFEENKDSKFLLDLERRIRDNDGGAENQLAQKFATAGHRKNEGAVRLVTKGSGTWPDGKERLQDKGIDTRMVDRREIWAESRPVGNITVQNNAGKFHHRVDEMPKSLENNFYKPLEAAVEGKERVKEKKDDKHRDKKKNKEKGKKGHGKDKDRSKEKKKEEKAKENAEHENREQQNKLKESTKAGPLGSNSFTQVSRHIYENSAVGENLKKRKDIESNGIMHANDNWPSKLPTPSPSPSHLTENGRILEPCQISLQNTSDNRLAAASNIKVDNKKRRTNGIIEVLPSAVSSKTPTPTATLPAPVSEASAKPPHPDTKYISQVYSVPKADEWSDFDDQEWLFGSSHSQERKPVVKSSEVGDTLQVWAEAVHIEPADIFALPYVIPY

SEQ ID NO: 221313 - protein, 245 aa, Glycine max
  Coding DNA Sequence Number=SeqID_104535
  Gene Ontology: Mol. function=hydrolase activity; Biological process =metabolic process
  Homolog annotation: Hit_ID=UPI00006DBC1C; Match level="QueryCoverage =99%, HitCoverage=58%, E-value=1e-104, Identity=76%"; Hit description= COG0402: Cytosine deaminase and related metal-dependent hydrolases
MTVRRTLFKGGTILTLDASVPDLVCGDVLIEDDRIAAVGENLSADDAQVIDACGHIVMPGLVDAHHHMWLGAMRRLMPNVDDLFAYIDVVAETLGAHYRPLDMYLSTRLTALACLDAGITTVIDACHSSRSPAHTDAALDALQENGIRALHMVGAAMDKQASSDHLPGDLARLASRWNHAGSRVQVGLFGQLNLAWWRVARELDMRILTDLPNPACWVRTTFSITVRAYRRTSGSSWRTRASTLP

SEQ ID NO: 221314 - protein, 248 aa, Glycine max
  Coding DNA Sequence Number=SeqID_104536
  Gene Ontology: Mol. function=transcription factor activity; Biological process=regulation of transcription, DNA-dependent
  Homolog annotation: Hit_ID=UPI00006DBC1D; Match level="QueryCoverage =94%, HitCoverage=77%, E-value=5e-96, Identity=76%"; Hit description =COG0583: Transcriptional regulator
  Pfam annotation: Domain name=HTH_1; Domain location=12-71; Score =72.1; E_value=1.8e-18; Accession=PF00126.17; Description=Bacterial regulatory helix-turn-helix protein, lysR family
  Pfam annotation: Domain name=LysR_substrate; Domain location=95-245; Score=29.8; E_value=8.5e-06; Accession=PF03466.10; Description=LysR substrate binding domain
  Pfam module annotation: Pfam domain module=HTH_1::LysR_substrate; Domain location=12-71::95-245
MENRMSFDGRLLSGMSVLAAVVEAGSFSRAGEVLGLSASGVSRAISRLEQRLGVRLLDRTTRTLHLTSEGASLYERAAPHLEGIEEAANYVSGAAVTVRGTLRVSLNPLFSRYVLAAKLPLLRARYPHLELTILQQPDVGDLVAEGIDVAVRFGPQPPSTMTSRLLLQTRVLTVAAPDYLARCGRPTQPQQLTEHNCLQYIDPRSNKPFSWEFHRGTQRLTVATHGHLTTTDPDLMVQACVGGAGVAQ

SEQ ID NO: 221315 - protein, 76 aa, Glycine max
  Coding DNA Sequence Number=SeqID_104537
  Gene Ontology: Mol. function=nucleic acid binding; Biological process= DNA integration
  Homolog annotation: Hit_ID=Q1RVB5; Match level="QueryCoverage=97%, HitCoverage=5%, E-value=2e-27, Identity=81%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
VQHLKGLKKNLLFVGQLDDLKCKIHTEGGILKVAKGNLVVMKAERITPNQYMLLGDTLKEVDASVVATSQEEATMM

SEQ ID NO: 221316 - protein, 86 aa, Glycine max
  Coding DNA Sequence Number=SeqID_104538
MQRKQNTVGLSEKIIICGKNGSTDRWKRRSLVVDIDHALHLKSKSSFTENKEYIGMEKEKDDWRCHFKEKMSLEEAHHHRKPWIRA

SEQ ID NO: 221317 - protein, 229 aa, Glycine max
  Coding DNA Sequence Number=SeqID_104539
MVVLHQKKELVNMDWQALKRYYRLGAHCSGLEPKEKPSFDGVHHTTGNYFQTINHNPFLVDSPSNRICVWKKELVTMSECNFSFTFHLPHSTCTFIHQVKPIIEEVDSNDETHVATEDMAMEVYVGPPPSREYVYFLEKALLRTREALVEALHDKAHAERKAKRWKLFGDFLFQKFPETLMGIFTNDDSGDEFFRKLEANEAEEVAKQKGKKNKATKAEDAKVEDYTSI

SEQ ID NO: 221318 - protein, 387 aa, Glycine max
  Coding DNA Sequence Number=SeqID_104540
  Gene Ontology: Mol. function=solute:hydrogen antiporter activity; Cellular component=integral to membrane; Biological process =regulation of pH
  Homolog annotation: Hit_ID=Q1SA42; Match level="QueryCoverage=99%, HitCoverage=80%, E-value=5e-37, Identity=45%"; Hit description =Na+/H+ antiporter-like protein, putative
DGKEGMDHCHIGIAITHILCLFNDLVVALVSHTVISFAVISSLLSELQIQNSELGKLALSSALISDILCTIATAIGTAVMITENSNVKDVIRNVLALICLAIFNPLVCRPTMLWIIKHTPEGRAVKDEGPPLGSALVKKLNFLGTTFLLPIFVTINHACLVPSLYCNMQPRDAVSLALILNCKGVVEVGLYCFLYDTNVIDGLASIWSNDFEHNGGSMHCAMHKSYSDEHDNPDAVSAYPCTAIAPPNLIEHDDEEALCIARRAIRNPGMNIVIYNLVFKAEDDEWGQEVDDDELEDVKHAREHNIRYQQIIETEGSQTAAFLSDIVKEHDFFIVGRRHGNGIESPQTDGLTDWSEFPELGAIGDFLASPDLESRASILVVQQQLSP

SEQ ID NO: 221319 - protein, 297 aa, Glycine max
  Coding DNA Sequence Number=SeqID_104541
  Gene Ontology: Mol. function=protein binding; Cellular component =integral to membrane
  Homolog annotation: Hit_ID=Q5N7I7; Match level="QueryCoverage=89%, HitCoverage=74%, E-value=2e-97, Identity=64%"; Hit description =Putative NTS2 protein
  Pfam annotation: Domain name=DUF803; Domain location=2-273; Score =519.3; E_value=4.4e-153; Accession=PF05653.4; Description=Protein of unknown function (DUF803)
MGLKKAADHGNRAATGGHSYLYEPWWWAGMISMIAGEIANFAAYAFAPAILVTPLGALSIIFSSVLAHFILKEKLHIFGVLGCALCVVGSTSIVLHAPKEKDIHSVKEVWELATGPGFIVYICAIVILVCVLHFRFVRSHGQTHMMVYLGICSPTGSITVMGVKAVGIALKLTFEGTNQFVYFETWIFTVVVIGCCLLQINYLNKALDAFSTAVVSPVYYVMFTSFTIVASIITFKEWAKQDSTQIATELCGFVTILSGTFLLHRTKDMGNKPSDASVHSSPEDNNSNTKTPLSNQI

SEQ ID NO: 221320 - protein, 348 aa, Glycine max
  Coding DNA Sequence Number=SeqID_104542
MVESGELRSRIAEIQKLCNANDDELDNDSALLHFKTALQQIDSDFSSMEIQDAYLHHLKEELNNLHLETAQYQKNTAEGIDSPMLADDCLNLTVANLDKNLEQFELDNKIDEMKSVLNSLQNLQFTVKWFEVVEQIEDAFTGLKVLAFDENCIRLSLKTYMPTFEGISYLPRIEATVDAAELNYELLIEVFEGTMRLKNVQVFPNDIYVNDIVDTAKLVSKSSLQWFIQKVQDRIILSTLRHLVVKDANKSRYSLEYLDKDKTIVAHMAGGIDAYIKLSHGWPIFGSPLKLICIKGSDDLKRTSLSFHCKVEVREFQSVLAITYKFSVIILPCGLSICTSVLNVVSGF

SEQ ID NO: 221321 - protein, 116 aa, Glycine max
  Coding DNA Sequence Number=SeqID_104543
MFYSLLVNNIRDFPFPYQWFTVYQTIYLRVSSYENSEDLKQDVRLLLSPVRLGAQAFSWAAGKLESNGLGLPTSPSSSDVQNRVLQAAAKHESQPSDSEGNQDPVPEPTVPLNQNV

SEQ ID NO: 221322 - protein, 179 aa, Glycine max
  Coding DNA Sequence Number=SeqID_104544
  Gene Ontology: Mol. function=Rab GTPase activator activity; Cellular component=intracellular; Biological process=regulation of Rab GTPase activity
  Homolog annotation: Hit_ID=Q1SA43; Match level="QueryCoverage=83%, HitCoverage=51%, E-value=2e-28, Identity=47%"; Hit description =RabGAP/TBC
  Subcellular localization annotation: CTP_CleavageSite=76; ConfidenceScore=5.33e-01
MKKKKQVPEWMNSALWSTPSDHGRFDPPSPPPPPPVSVKEDSRTIPTNQNSSPPPFSSSSVSSPTASADDISRQAQAQAQAQVQLLAELSRKVIDMRELRRVASQGIPDAALRPTLWKLLLGYLPPDRALWFSELTKKRSQYKNFKDDLLMNPVTYLLHTYLHTYLLIPQPHTFECFCA

SEQ ID NO: 221323 - protein, 240 aa, Glycine max
  Coding DNA Sequence Number=SeqID_104545
  Gene Ontology: Mol. function=binding
  Homolog annotation: Hit_ID=UPI0000E47D1A; Match level="QueryCoverage =31%, HitCoverage=7%, E-value=9e-07, Identity=45%"; Hit description =PREDICTED: hypothetical protein, partial
MGVEMQIANKSERAISLEANGQAFAVIVASPLRVDLSCILEHVVAELTAFLQKANRALRQATLGSLNSLIVAYGDKIVLSAYEVIIVELSGLISFDSLLESLLACAKPSPQSGGIAKQALHSMAQCVVVLCLAAGDQKCSSIVKMLIDILKDDSSSNSISFSLQYFCCVRLSLEVLKVVVALSSPFGFSAHPTLSAASMRLARQKNLAEHKYQGRALSMMVVFSQAQHMTDAKLKSTNSR

SEQ ID NO: 221324 - protein, 98 aa, Glycine max
  Coding DNA Sequence Number=SeqID_104546
MQSQVKINVDESFRNSYMGVGGVLLDHAGIWVEGFVNSIPNGDYVKVELLAIKEGLSATWNYGFWDVACETDDREACNDILCHETNRGGISSERSVLL

SEQ ID NO: 221325 - protein, 245 aa, Glycine max
  Coding DNA Sequence Number=SeqID_104547
  Gene Ontology: Mol. function=chromatin binding; Cellular component =chromatin; Biological process=chromatin assembly or disassembly
  Homolog annotation: Hit_ID=Q1SAV4; Match level="QueryCoverage=88%, HitCoverage=64%, E-value=1e-51, Identity=42%"; Hit description =Integrase, catalytic region
  Pfam annotation: Domain name=Chromo; Domain location=170-215; Score =36.2; E_value=1.2e-07; Accession=PF00385.14; Description='chromo' (CHRromatin Organisation MOdifier
DGQTEVLNRVIEQCLRSFVHRRPSSWGKFLLWVEWSHNTSWNAATGSTPYEVTFGRKPFNFPEYITGSSNVDAVEEMLTNREETFLSIRKKLLKAQAQMKHYADAKRRNVEYHPGDWQRVGQVAYKLQLPEGARIHPIFHCSVLKPFKGSPETMEPVTLPSRFDQNQPIIAPLTILDYRQRTDKKWEVLVQWEGLSPDETTWEELDQLRCDYHLEDKVFLQGPWNDMNSGREVQEVTQGLDSNEG

SEQ ID NO: 221326 - protein, 67 aa, Glycine max
  Coding DNA Sequence Number=SeqID_104548
MEMIFQVVFLEPAEARAAFRGLAYKRFKRVYNCTVMSSMFFGKWKALTKNGFVRTLSLLHTKGGVWE

SEQ ID NO: 221327 - protein, 93 aa, Glycine max
  Coding DNA Sequence Number=SeqID_104549
MKNNNTSYANRRWDTDRPPLDIWMGYQNLRDDLVNDIAQAYRLELLEASWLINFGDQNKDCMEKTILSKARLGKPPGVILIRSGSLGAGQGIR

SEQ ID NO: 221328 - protein, 101 aa, Glycine max
  Coding DNA Sequence Number=SeqID_104550
  Homolog annotation: Hit_ID=Q9LSM1; Match level="QueryCoverage=97%, HitCoverage=24%, E-value=5e-09, Identity=28%"; Hit description =Arabidopsis thaliana genomic DNA, chromosome 5, TAC clone:K21L13
MVNCVPDSALPLSDRVESSSDQKVKMLSVLDTLPPIAEIRSSVMMKRHGGAMKGSVEDFSEVLSKHICKIGTNLRVFADSYKKQCSAIELLKMLIKTIGFR

SEQ ID NO: 221329 - protein, 787 aa, Glycine max
  Coding DNA Sequence Number=SeqID_104551
  Gene Ontology: Mol. function=RNA binding; Cellular component =commitment complex; Biological process=U2-type catalytic spliceosome formation for first transesterification step
  Homolog annotation: Hit_ID=Q9LHC3; Match level="QueryCoverage=69%, HitCoverage=87%, E-value=7e-61, Identity=33%"; Hit description =Transcription or splicing factor-like protein
  Pfam annotation: Domain name=Extensin_2; Domain location=435-782; Score=-130.6; E_value=0.033; Accession=PF04554.4; Description =Extensin-like region
  Pfam annotation: Domain name=KH_1; Domain location=180-253; Score =21.2; E_value=0.0038; Accession=PF00013.19; Description=KH domain
  Pfam module annotation: Pfam domain module=Extensin_2::KH_1; Domain location=435-782::180-253
  Subcellular localization annotation: CTP_CleavageSite=59; ConfidenceScore=5.07e-01
MSAEIDSTYAPEPHKMSGATTSGQKLSIFSAKSGFVIPKNKLSGSLVPIFRGAKQHGVTAAAINEESSKQIERRSKWGPDLTQDAAVRRGKVLALQIRVDQITKQLESEKLEVGDTQNLNPDQSISGPQINSKKAEMLELEKREAIGEILKLDPSYKPPRGFKPLLKEASIPLPVQEYPGYNFVGLIYGPEGDNQKQLEKETGAKIKIHGIKADTGEKGEIKPGTDIQCNYKEMHVNLSADSFEKVDAAMLIIELLITSVTENLAAGSTPSISVSRDSTNVLSQRQEGHADSLSLENQAVLQPVAVTQMHGDNFQYSSPWFSVVPSHTPVFASSGTVAPPNPLGLARTPHFSSQTSNMASTFGAQPGPVAGFQSIIPNQHVSVQTPPPRQILQYSHMTQTSPLGHIGPLRNPVQNLSTPNSSFSFPVTLSQAMPIGQHQTSVSSMHLPISGISSPPIPNQPLTHLGVSSGLNEAPVTVKMSVGPSNMGPVVPPARPVSLHQQPDVAFKPPQSNMSMITRSATFLPHQVGISPGQPSSLRSMPVPIRAPTHLSANHLSGPVSFPSRGISPSLPLPQQAGIPNLASGVAPYHTHVKPPVLGTSKSGNFTFQSHLPNADYGQVFSGPNSQSGATQEPPSGPRPPPFGFAVPDQPRQIFPRTQFPGQVDQAVPFGVRLGSISNSIPPPRHAVFPYAGQPAPRSSVPQMGMKNFISAPQMPNLTNAGAQRGMPIRQSYPPQMARPDIPMPLNQKFVNNPPMASGKIAYAADQIYDPFSPTSAPPQQKGNPGK

SEQ ID NO: 221330 - protein, 515 aa, Glycine max
  Coding DNA Sequence Number=SeqID_104552
  Gene Ontology: Mol. function=hydrolase activity; Cellular component =extracellular space; Biological process=biological_process
  Homolog annotation: Hit_ID=Q1SA45; Match level="QueryCoverage=87%, HitCoverage=82%, E-value=0.0, Identity=87%"; Hit description =Metallophosphoesterase; Purple acid phosphatase, N-terminal
  Pfam annotation: Domain name=Metallophos; Domain location=232-445; Score=60.3; E_value=6.3e-15; Accession=PF00149.18; Description =Calcineurin-like phosphoesterase
MIDASWVRGPEPPKKKGTQRTEKEKITSITEMVLLPPEARQQSQQILYSLFQLSLVTHNLSAIVDGGGVPTTLDGPFKPVTVPLDQSFRAVDLPDTDPLVQRTVQGFQPEQISLSLSVSHDSVWISWITGEFQIGDNIEPLDPETVASIVQYGRLGRSMRHNATGYSIVYSQLYPFEGLQNYTSGIIHHVRLTGLRPNTLYQYQCGDPSLSAMSDVHYFRTMPVSGPKSYPSRIAVVGDLGLTYNTTSTVDHMTSNHPDLILLVGDVSYANLYLTNGTGADCSSCSFSNTPIHETYQPRWDYWGRYMQPLISSVPVMVIEGNHEIEEQAENQTFVAYSSQFAFPSEESGSSSTFYYSFNAGGIHFIMLGAYISYDKSGDQYRWLERDLASVDREVTPWLIATWHAPWYSTYGAHYREAECMRVEMEDLLYKYGIDIVFNGHKFLMGEQVHAYERSNRVYNYTLNPCGPVYITVGDGGNREKMAITHADEPGQCPEPSTTPDDYMGGLIRNPPIKR

SEQ ID NO: 221331 - protein, 84 aa, Glycine max
  Coding DNA Sequence Number=SeqID_104553
  Subcellular localization annotation: CTP_CleavageSite=55; ConfidenceScore=5.31e-01
MPWRRKQIADENSTAGVTNTNTTVTTPAAMPNVAAPTTTTPIHGGDGVGMNPLIPENSTSAPNSNTILTTTSFLVFLLIMSLIP

SEQ ID NO: 221332 - protein, 1149 aa, Glycine max
  Coding DNA Sequence Number=SeqID_104554
  Gene Ontology: Mol. function=RNA-directed DNA polymerase activity; Cellular component=chromatin; Biological process=chromatin assembly or disassembly
  Pfam annotation: Domain name=RVP_2; Domain location=321-454; Score= -28.6; E_value=0.00017; Accession=PF08284.2; Description=Retroviral aspartyl protease
  Pfam annotation: Domain name=RnaseH; Domain location=817-937; Score= -20.4; E_value=0.0046; Accession=PF00075.14; Description=RNase H
  Pfam annotation: Domain name=zf-H2C2; Domain location=1014-1055; Score=27.1; E_value=6.2e-05; Accession=PF09337.1; Description=His(2)- Cys(2) zinc finger
  Pfam module annotation: Pfam domain module=RVP_2::RVT_1::Retrotrans _gag::RnaseH::zf-H2C2; Domain location=321-454::575-744::107-197::817- 937::1014-1055
MSDSSHTPGSAVTLETAILKLTQHQMSLSESVDNMTQKFDELLLRLPLSPIQPQPTSAPTLTPPVPATQHRMKLDIPRFDGTDPCGWVFKINQYFQYHATPEHERLTIVAFYMEGRALAWFQWMTSNGQLTSWPSFLHALQTRFAATTYEDPTGSLFKLTQTGTVAQYLSDFEDLANRIVGLPAQFLLSCFISGLTPEIRREVQALQPMTLVQAAGLARLQEDKLLDTRSSFRHRAPPTLTIPVSRPAPTTALLPSPPSRMPTPRSPTLRPQPTLKRLSPEEIISHRCASRVFFLVAKEDPAAEVNIEELDPGPDPPATHDPLAAQISFNSLAGQLAPETLRLLGTLSGHQVIILVDGGSTHNFVQEELVVRLGLKTHETRPLRVMVGNDQHLACNQWCEAVAVAIQGISFTIDMYVLPIVGANLVLGVQWLKSLGPVLTNYNSMLMKFFHEGQLVELHGDTELSLNLLSPPQFRRLLRKSHTGVYFHITVLEDEPQTGKSPHPRIQSLIDRFPALFQPPSSLPPAREIDHHIHLLPQAAPVNVRPYRYPHYQKHEIESQVESMLQKGLIRPSNSPFSSPVLLVRKQDGSWRFCMDYRALNAITVRDRFPIPTIDELLDELGKACWFSKLDLLQGYHQIRMNSDDIAKTAFRTHHGHYEFKVMPFGLCNAPSSFQATMNMIFRPFLRRFVIVFFDDILIYSVTFDDHLVHLEQAFQVLAENQFVLKLTKCSFGQPQVEYLGHMVSSKGVEPVASKVSAIHHWPVPQSTRALRSFLGLAGFYRRFIRGYASIAAPLGAFSRLKQALSEAPVLALPDFQVPFTVETDASGVGMGAILSQRGHPIAYFSKPFPPKLHHASTYVRELFAVTTAVRKWRQYLLGHRFTIITDHRSLKELLTQVIQTPEQHMYLARLMGFDYQIQFRSGASNQAADALSRLPEHTISLFLTLSVPCLTFMDELRAQLTASSEFQDMVKAIQTSPSTYPDYTIVNDLVLRKGRIWLPSKLALIPTLLTEFHATPTGGHLGTAKTVARIMENFHWTGLRKDVADFVAQCMDCQSVKYETKRVAGLLCPLPVPHRPWDDLSLDFIVGLPPYHGHTVILVVVDRFSKGIHLGMLPTAHTAHSVACLFMDIVGKIHGMPRSLVSDRDPLF

SEQ ID NO: 221333 - protein, 506 aa, Glycine max
  Coding DNA Sequence Number=SeqID_104555
  Gene Ontology: Mol. function=ATP-dependent helicase activity; Cellular component=cytoplasm; Biological process=multicellular organismal development
  Homolog annotation: Hit_ID=Q1S8V6; Match level="QueryCoverage=71%, HitCoverage=65%, E-value=1e-164, Identity=77%"; Hit description =Helicase, C-terminal
  Pfam annotation: Domain name=DEAD; Domain location=125-308; Score =237.5; E_value=2.9e-68; Accession=PF00270.19; Description=DEADDEAH box helicase
  Pfam annotation: Domain name=ResIII; Domain location=121-303; Score= -37.6; E_value=0.065; Accession=PF04851.6; Description=Type III restriction enzyme, res subunit
  Pfam module annotation: Pfam domain module=DEAD::ResIII; Domain location=125-308::121-303
  Subcellular localization annotation: CTP_CleavageSite=63; ConfidenceScore=5.37e-01
MRTSWADLAANSAPENAGTSNSTAPSRPVYVPPHLRNPRNGWGNRSCGSWDRREVNPFGDQEEAAAAFGGEEQQENTGINFDAYEDIPVETSGENVPPAVNTFAEIDLGDALSQNIRRCKYVKPTPVQRHAIPISLAGRDLMACAQTGSGKTAAFCFPIINGIMRGQAQPLQRPPRGVRIVYPLALVLSPTRELSMQIHEEARKFSYQTGVRVVVAYGGAPINQQLRELERGVDILVATPGRLVDLLERARVSLQMIRYLALDEADRMLDMGFEPQIRKIVEQMDMPPAGARQTMLFSATFPKEIQRLASDFLSNYIFLAVGRVGSSTDLIVQRVEYVQESDKRSHLMDLLHAQKANGVQGKAFKVNLMISIVSSSVVKWRLWRRHGGMAWRIFEKTPPNSGGVAGFKWRHHGGHHKLNGGGGMAHAARELQNSSASTMRTPARAQAARSTQHAPAAMAPRTSVRSHPKSTTAPREHHAPRMRARDGGSSSTNYNEEDYVGIGEDD

SEQ ID NO: 221334 - protein, 667 aa, Glycine max
  Coding DNA Sequence Number=SeqID_104556
  Gene Ontology: Mol. function=binding; Cellular component=plastid chromosome; Biological process=positive regulation of transcription, DNA-dependent
  Homolog annotation: Hit_ID=Q1S8V7; Match level="QueryCoverage=88%, HitCoverage=86%, E-value=0.0, Identity=79%"; Hit description =Pentatricopeptide repeat
  Pfam annotation: Domain name=PPR; Domain location=145-179; Score =30.5; E_value=6e-06; Accession=PF01535.11; Description=PPR repeat
  Pfam annotation: Domain name=PPR; Domain location=180-214; Score =27.9; E_value=3.6e-05; Accession=PF01535.11; Description=PPR repeat
  Pfam annotation: Domain name=PPR; Domain location=215-249; Score =20.2; E_value=0.0072; Accession=PF01535.11; Description=PPR repeat
  Pfam annotation: Domain name=PPR; Domain location=250-284; Score =39.1; E_value=1.5e-08; Accession=PF01535.11; Description=PPR repeat
  Pfam annotation: Domain name=PPR; Domain location=285-319; Score =32.6; E_value=1.4e-06; Accession=PF01535.11; Description=PPR repeat
  Pfam annotation: Domain name=PPR; Domain location=320-354; Score =38.9; E_value=1.7e-08; Accession=PF01535.11; Description=PPR repeat
  Pfam annotation: Domain name=PPR; Domain location=355-389; Score =31.2; E_value=3.5e-06; Accession=PF01535.11; Description=PPR repeat
  Pfam annotation: Domain name=PPR; Domain location=390-424; Score =44.1; E_value=4.6e-10; Accession=PF01535.11; Description=PPR repeat
  Pfam annotation: Domain name=PPR; Domain location=425-459; Score =29.9; E_value=8.9e-06; Accession=PF01535.11; Description=PPR repeat
  Pfam annotation: Domain name=PPR; Domain location=460-494; Score =17.6; E_value=0.046; Accession=PF01535.11; Description=PPR repeat
  Pfam annotation: Domain name=PPR; Domain location=526-560; Score =32.1; E_value=2e-06; Accession=PF01535.11; Description=PPR repeat
  Pfam annotation: Domain name=PPR; Domain location=561-595; Score =16.1; E_value=0.092; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=145-179::180 -214::215-249::250-284::285-319::320-354::355-389::390-424::425 -459::460-494::526-560::561-595
  Subcellular localization annotation: CTP_CleavageSite=84; ConfidenceScore=5.70e-01
MCTVVSSSVLVGWLSSSCSKTKGSVGNGISHLSPATRAISVLATAMAKDVWTRTSSSNTSRQRSSSSSRRQQQYLDRSVDMEVLLAAIGQTQNEDELYAVMSPYNGRQLSMRFMVSLLSREPDWQRALALLDWINDKALYRPSLFAYNVLLRNVLRAKQWHLAHGLFDEMRQKGLSPDRYTYSTLITCFGKHGLFDSSLFWLQQMEQDNVSGDLVLYSNLIDLARKLSDYSKAISIFSRLKASTITPDLIAYNSMINVFGKAKLFREARLLLQEMRDNAVQPDTVSYSTLLAIYVDNQKFVEALSLFSEMNEAKCPLDLTTCNIMIDVYGQLHMPKEADRLFWSMRKMGIQPNVISYNTLLRVYGEADLFGEAIHLFRLMQSKDVQQNVVTYNTMINIYGKTLEHEKATNLIQEMNKRGIEPNAITYSTIISIWEKAGKLDRAAILFQKLRSSGVRIDEVLYQTMIVAYERTGLVAHAKRLLHELKRPDNIPRDTAIAILARAGRIEEATWVFRQAFDAREVKDISVFGCMINLFSKNKKYANVVEVFEKMREVGYFPDSDVIALVLNAFGKLREFDKADALYRQMHEEGCVFPDEVHFQMLSLYGARKDFVMVESLFEKLDSNPNINKKELHLVVASIYERADRLNDASRIMNRMNKKANRIHDHA

SEQ ID NO: 221335 - protein, 141 aa, Glycine max
  Coding DNA Sequence Number=SeqID_104557
  Homolog annotation: Hit_ID=Q1S8W1; Match level="QueryCoverage=38%, HitCoverage=14%, E-value=7e-20, Identity=83%"; Hit description =Ribosomal protein S2; Squalene/phytoene synthase
  Subcellular localization annotation: CTP_CleavageSite=40; ConfidenceScore=5.24e-01
MDWPRKGIWKDGGSKPCSMINTGSNRKPCCGRRRFGVIIRSEVNVAPKQRGILRLSKQGVPLAVQEVVHRRMDGLVDDPNAVYMSSAILDRWEDRLHDIFNGQPYDMLDAALTDIVSKFPLDIKVITYYHQNYLFIWIRIG

SEQ ID NO: 221336 - protein, 172 aa, Glycine max
  Coding DNA Sequence Number=SeqID_104558
MGLYIVGEECTRLVALGKVFDTTVAIHNVPYTDDVVRDSHPNVPKSVGSVERCNTGAVEDPLGELMKILYDMYQKPIQLPWDGTKFGLPNVQASFFITHVDVAEIISGLWMVAVEAEVMVQCMFCLSLSLYIMLRIDVNNVNITLKHGSRSHNDNCTKLKVIDENVIDQLPI

SEQ ID NO: 221337 - protein, 253 aa, Glycine max
  Coding DNA Sequence Number=SeqID_104559
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=4e-21, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
HAFRGLHALAIRGLDAFSFRGLFVLAIRGLYVLTFRGQHTLTFRELHILTFRGLHTLAFRGLHVLAFRGLHFLAFRGLHVLPFKGLHVLTFRGLHPVAFNGLHAFTFRGLHALALEGYTSSPLDSYTPSPSEDSTSLLSEDCIGLYVLLFRGLHAPAFSGLHIHPVTGQLVLEIRRLHVLRVKELHALTFRGVHILTFIGLHVLSFRGLHALPLKGLHALASEDYMSSPLEDYTSSPLEDYTTSPSEGCTPSP

SEQ ID NO: 221338 - protein, 120 aa, Glycine max
  Coding DNA Sequence Number=SeqID_104560
MECLEGVWETLEGNERCRFCGTIRLTATSLPVEWILPTPTPYRLVEPVQVIEVSSSEEDLEEDPEELPPEPAMDAPDFPKDDEDPLPDVDSPEDIMSASEADSTEESGPGGTTISDDSSS

SEQ ID NO: 221339 - protein, 481 aa, Glycine max
  Coding DNA Sequence Number=SeqID_104561
  Gene Ontology: Mol. function=exoribonuclease II activity; Cellular component=membrane; Biological process=mRNA catabolic process
  Homolog annotation: Hit_ID=Q8ZED8; Match level="QueryCoverage=93%, HitCoverage=69%, E-value=0.0, Identity=80%"; Hit description =Exoribonuclease 2
MLMISELFPQRIRALGFALVYSLGVAIFGGFAQAGDHAAGFHAHFGDGDLQGVALAVNHFTLDLHGAGFLAALHLVAHRVNKRCRDEGNGAVVQQAHAQAAAGHVDDLGVEAGIGTGLVLQEASVQPVADVALRHAVEAAALRQLYRHVILRFFRRLLVDDRLQQAMVDHIAVFTDRRCPGGVSLQPQTEVWPRRGADLREGLEAADAAVEELGRLRVQVAAQFAETVEGQQLVGFGFHAVGLQYGDRLLDQRRIETGVHVVHAEAQAIAQHDGGADVGGDHALFNDAVSAAALLGNDLQHVAFFTQHEAVVRAIFKHQRMLVAPGVARVANAFQQGYLLCDGVARRLPAGNAFQPVGHFVVHQLGFGFDPRGKEVGIVSQAAIRHYSDATHQRRTPDVRAQRADIIRQFARQHRDVKARQIVGEGASGGQLVEFAAGGNVSGRVGNGDGQGQLAFCQLFNIQRIVHIFGAGAVDGDKVQR

SEQ ID NO: 221340 - protein, 75 aa, Glycine max
  Coding DNA Sequence Number=SeqID_104562
  Gene Ontology: Mol. function=aspartic-type endopeptidase activity; Cellular component=lysosome; Biological process=sphingolipid metabolic process
  Homolog annotation: Hit_ID=Q94IA2; Match level="QueryCoverage=68%, HitCoverage=10%, E-value=3e-20, Identity=88%"; Hit description =Aspartic proteinase 1
  Pfam annotation: Domain name=SapB_1; Domain location=25-64; Score =34.6; E_value=3.5e-07; Accession=PF05184.5; Description=Saposin-like type B, region 1
MVMSGVGIKSVGDENERKSSGDHHGAACPTCEMAIVWIQNQLSRNQTQDQILSYINQHPAASLDLLPHDDIAALR

SEQ ID NO: 221341 - protein, 85 aa, Glycine max
  Coding DNA Sequence Number=SeqID_104563
MKENERHTSNRKEHQLGSSFGGSDGVGVVGEGWDWSTGVGGLGGGVTTRWWCRVWGMGPHVQIRETLVWHTLLWLVELPFFADPS

SEQ ID NO: 221342 - protein, 123 aa, Glycine max
  Coding DNA Sequence Number=SeqID_104564
MTKDKVDTSMPYSGEMRGTMHEPQANLGADQKYSPIDVFEQKKGDKPWDFNGLIKRQTAPLSSLQNGQVFKSNRTYTLREFPERFAKDTIRLHELSPLSKGQSICVFQKNQIKSKSQNRERMS

SEQ ID NO: 221343 - protein, 40 aa, Glycine max
  Coding DNA Sequence Number=SeqID_104565
MGVDQLSFHVTFTMSALVALSEYDGIRVVITMSALVALVT

SEQ ID NO: 221344 - protein, 69 aa, Glycine max
  Coding DNA Sequence Number=SeqID_104566
MSLIKLRSSRPQFSFNLMKGTSSLPKSNGDIHVSLSQKEIGLGFVGFEPLKFADGYITRSSRELQIFQN

SEQ ID NO: 221345 - protein, 94 aa, Glycine max
  Coding DNA Sequence Number=SeqID_104567
  Gene Ontology: Mol. function=nucleotide binding; Cellular component =nucleus; Biological process=small GTPase mediated signal transduction
  Homolog annotation: Hit_ID=P41916; Match level="QueryCoverage=100%, HitCoverage=51%, E-value=3e-44, Identity=75%"; Hit description=GTP -binding nuclear protein Ran-1
  Pfam annotation: Domain name=Ras; Domain location=15-94; Score=-43.1; E_value=4.8e-06; Accession=PF00071.12; Description=Ras family
MALPQQHTVDYPSFKLVIVGDGGTATIGVEVHPLDFHTNCGRIRFYCWDTAGQEKFGGLRDGYYIHGHCAIIMFDVTARMTYRNVATWHRDLCR

SEQ ID NO: 221346 - protein, 475 aa, Glycine max
  Coding DNA Sequence Number=SeqID_104568
  Gene Ontology: Mol. function=DNA binding; Cellular component=beta -galactosidase complex; Biological process=DNA integration
  Homolog annotation: Hit_ID=Q1SAZ0; Match level="QueryCoverage=97%, HitCoverage=42%, E-value=5e-52, Identity=43%"; Hit description =Integrase, catalytic region
  Pfam annotation: Domain name=rve; Domain location=159-321; Score =17.0; E_value=0.00023; Accession=PF00665.16; Description=Integrase core domain
MNREVEEGRIFQFLTGLNKELDEVRGRIIGRVTLPSLGEVFAEVRREETRRSVMIRKIKIVLPPPETNALVAETTALKSSTKQKNFSNLWCDHCNKPRHTRETCWKINRRQTHLKGTKSGPKVHRPFPTTHEAKKTSLRKEQVEELIRLLNSNFLSGTPSGSVAQKGKGDITLSKNIDLKNVLHVPKLTYNLLSVSKICIDSHCSVKFFDTYCVFQDQTSGKMIDNAKIMDGLYYFENTFENKEARGLSGIQHQSTCPNTPQQNGTAERKNKHLLEVACAIMFESNVPKYLWGDAVLTATYLIYRMPTRVLNYRIPLDTFKTIFPACRLHTEMPLKVFGCIVFMHTPSISRSKLDPRAEKYIFVGYSPNQKGYRVFNPITKKLCVSMDVTFVEHQPFFQKNSLQGENDYVSEDNFLHFHEPLPIPVVHTKNTDFIDQTNENKLHNKEDHVETSPEFSKGNPMPDLGGAQAGKEIP

SEQ ID NO: 221347 - protein, 82 aa, Glycine max
  Coding DNA Sequence Number=SeqID_104569
MVNGSSQRFMLLFMQTEKRMLKERKENCLACDSGCWRSIGKGERVAGRYAASRKYIEGTCKQTYAPQAERLFPGLQCMNSRS

SEQ ID NO: 221348 - protein, 33 aa, Glycine max
  Coding DNA Sequence Number=SeqID_104570
  Homolog annotation: Hit_ID=Q1S8X4; Match level="QueryCoverage=87%, HitCoverage=1%, E-value=2e-09, Identity=89%"; Hit description =Rhodopsin-like GPCR superfamily
MPNRYQDDWLKTSANSLQHWEKAPLEPYALQKP

SEQ ID NO: 221349 - protein, 460 aa, Glycine max
  Coding DNA Sequence Number=SeqID_104571
  Pfam annotation: Domain name=FRG; Domain location=189-295; Score =108.4; E_value=2.1e-29; Accession=PF08867.1; Description=FRG domain
MKVNDEDWNVRVGELAFSSMPLNRYLEYTSDHISVIFREINEKVLADLKLIPCVLMTEFENERHADGRSRQCSSIRVGMLEDVSVRGKNLEYAVRIYYDFGKVVVDNYRALADRFFFHLFETSRTHWAIKEVNLPEVMNTFGLQVAAPSAAVPALVPPPPPPAEELLRQQSVKSVEAFLQKINEFQAQDGHEMFYRGHSKHGYRLEPSLFREDEGVPLYKYKERNMINEILTAHPAEFYQDHFMIDKLVRMQHYGLPTRLLDVTANPLVALYFCCADMLDKDKNEEEKVGDVKIFSVRTDDIKFYNSDTVSCIANLSLLNMDEQNRLIPETNVPQGERGEETPEMKKLLHFIRAEKPYFENDIRPGDLSRILFVRGRIANQRISSQSGAFLLFGHEAVLPDTGHSDDLRVNRIYVSNKKAILQELSRLNIKPSTIYPGIEETAREIARRTKGEEILYRVK

SEQ ID NO: 221350 - protein, 84 aa, Glycine max
  Coding DNA Sequence Number=SeqID_104572
MAERGWYAEKTVENDNRKSQNHHNKKLAPGRNQTVLSSAGPVSHSSVQMNIPADEKTWLNRTWVGRLRNLTLFDRIEDGLMWTG

SEQ ID NO: 221351 - protein, 315 aa, Glycine max
  Coding DNA Sequence Number=SeqID_104573
MTEEVNEQHSALFYSLEKWTPQLRTGHRLVWLLCWGIPLHAWDMEHIKQIATAVREVVEVDDDMDELHRLDRRRILVKTPQPPLIQHKVSVWINRVEYTVHMDARPSATGGEKDQVVTVTQRTEGQYQPVNPQAQGTADESNRTPSSHLRKEDKTNGDKMEKELLKEVGKVVAVISEKELLMESENCKDGGPSMGLSKDYLRDKPGGAERNTHCEQIGPRHMGKENFSPGTRGSGSEEVAETTAPVEAQLKTQTPLQKDSHQTCAQIREASAQWKMAQNLGVTCEEGDATVVTKFMKMEVTDKEEANKLGNRRPG

SEQ ID NO: 221352 - protein, 145 aa, Glycine max
  Coding DNA Sequence Number=SeqID_104574
  Subcellular localization annotation: CTP_CleavageSite=79; ConfidenceScore=5.12e-01
MATEDRKAATVTEDGGPRLRTASEGFQSRTTVSSSFSTTRPQSRDSDQGAPMNPKRIKVIPEWHTPPTPLIELVRNHIPSSEDAQEMDFQILPYFNIPNTTNIYVFVLFTGVQEKSPKFQEPRDLRSNLFQGGGNDAILPRKGIG

SEQ ID NO: 221353 - protein, 54 aa, Glycine max
  Coding DNA Sequence Number=SeqID_104575
MKLMTYVDLRIDFLKLYILLVLTHEGHMAPLCLGSIRTRLGKGSFAWAPQCWVN

SEQ ID NO: 221354 - protein, 317 aa, Glycine max
  Coding DNA Sequence Number=SeqID_104576
  Gene Ontology: Mol. function=RNA-directed DNA polymerase activity; Cellular component=nucleus; Biological process=RNA-dependent DNA replication
  Subcellular localization annotation: CTP_CleavageSite=36; ConfidenceScore=5.24e-01
MARLDTVYPGKKFLGSLPRWFKNLGRTIRFANSKCRSSTLRGVVVNDVWVDEPGRVKEETYMFFKNRFQEVEWEVIKVDVLRFMDEFYAHRSFSKGCNTSFITLVPKIKDPQNLHEYRPISFIGCIYKTVAKVLARRLKGGRHLLHNTITANEVIHEAKTKNKSCLVFKVDYEKAYDSVSWEFLLYMLKRMGFCGKWVSWIKGCLKSASISILVNSSPTSKFIPQRGLRQGDPLAPFLFNIVVEGLNGLVKEAMDKNLFLGFSVDRNEVKVSILQYADDTLFLGKTSMEKVKATKVILRSFELALGLKINFSKSRFG

SEQ ID NO: 221355 - protein, 315 aa, Glycine max
  Coding DNA Sequence Number=SeqID_104577
  Gene Ontology: Mol. function=transferase activity; Biological process= lipopolysaccharide biosynthetic process
  Homolog annotation: Hit_ID=Q7N2Q7; Match level="QueryCoverage=58%, HitCoverage=74%, E-value=5e-39, Identity=43%"; Hit description =Similarities with glycosyltransferase
PDGRYDGFELDNAVFTQQGPAIGLKPDREQEFGQAYGRPVIDDVGVSEDGFSHLYHAVRLADHPGAAAVMLVCLAQKHDFRTSPRRGFIPRQNFRQRRGQFNVILEDKRAGDVFIRNFFIDVVMTERTADFSWRHTGSIKRVRQSRRFVRGQKPSVRCADNLRIQVQVAALLQDVLTANNVFIQSDEFPADPAGCSAVRAGLIGISPQLFNGENQGRIAVCIFVDTGFCERDQLLNQLLPMCFFSPVSKTKADHTGDPARLPGAVFASSAVSADYISLKVTPMMIAAKASLLKQAWPASSAQPAPECRVSGMEAP

SEQ ID NO: 221356 - protein, 450 aa, Glycine max
  Coding DNA Sequence Number=SeqID_104578
  Gene Ontology: Mol. function=monooxygenase activity; Cellular component=membrane; Biological process=electron transport
  Homolog annotation: Hit_ID=Q1RVL3; Match level="QueryCoverage=93%, HitCoverage=96%, E-value=0.0, Identity=80%"; Hit description=E-class P450, group I
  Pfam annotation: Domain name=p450; Domain location=1-446; Score =230.3; E_value=4.2e-66; Accession=PF00067.12; Description=Cytochrome P450
MAVMFPAPSLFCKLDTYYLRERDCATFLVWFGPTVRLTVSEPDLIREIFTSKSEFYEKNEAPPLVKQLEGDGLLSLKGEKWAHHRKIISPTFHMENLKLLVPVMATSVVEMLEKWSAMGEKGEVEIEVSEWFQSLTEDVITRTAFGSSYEDGKAIFRLQAQQMDLAADAFQKVFIPGYRFFPTRRNIRSWKLEKEIKKSLVKLISRRRENEKGCGVEEKEKGPKDLLGLMIQASNMNMNMSNVTVDDMVEECKSFFFAGKQTTSNLLTWTTILLAMHPHWQVRAREEVLKVCGSRDHPTKDHVAKLRTLSMIVNESLRLYPPTIATIRRAKADVDLGGYKIPGGTELLIPILAVHHDQAIWGKDANEFNPGRFREGVSRAGKHPLGFIPFGVGVRTCIGQNLALLQTKLALAIILQRFTFCLAPTYQHAPTVLMLLYPQYGAPIIFQLIH

SEQ ID NO: 221357 - protein, 477 aa, Glycine max
  Coding DNA Sequence Number=SeqID_104579
  Homolog annotation: Hit_ID=Q7BRX8; Match level="QueryCoverage=45%, HitCoverage=76%, E-value=5e-72, Identity=61%"; Hit description=RepA
  Pfam annotation: Domain name=IncFII_repA; Domain location=247-471; Score=-102.7; E_value=0.00027; Accession=PF02387.6; Description =IncFII RepA protein family
MKLTSAAIAVAMCLTFSAAASADAPAIDVGFSPEGSAQQLVLRTLDSARESIRLMGYSFTSPEVVRALVAARRRGVDVRVVVDDKGNRSKASQAALNVLANAGIPLRTNGQYKIMHDKVIVTDGQNVETGSFNYTRSAAESNSENALDAVMPHIQPATAQSKQKQTRNRKHPMSDSERQLSYVARKREALKEIKIFVEPELKKALMRMCEEEGATQADILQRLIKHEAELKGKLYRRLEGVAEQLTESTSFYRQVKNPNPEFIPEEGKKTLPFCEKIREKAAGFTRRMEFQTLVAMSIARGERKRRPPELRMRALEASLQALCHYFNPLANRVGASLTTMSIRCGLATEKKRLSITRFTGAVQFMAQLKLLTYNTEYDKEIGCNIPTDITFTPLMWQVLDVSEEAVTAARRSRIEWENRQREKKGLPRAGADELISAAWAFVRERFREYQKSRREHGMKRHRARKGCATYPERYRAA

SEQ ID NO: 221358 - protein, 194 aa, Glycine max
  Coding DNA Sequence Number=SeqID_104580
  Homolog annotation: Hit_ID=Q9C8A3; Match level="QueryCoverage=67%, HitCoverage=4%, E-value=3e-23, Identity=48%"; Hit description=Acetyl- CoA synthetase, putative; 45051-31547
MESNARIFKESLIKIPVLWDSVLNLHIFANVNTVIFGLLYNLRGLTGCSPSDLVKQSYFSSTKFRVSNGIIGLPYHVSQGVGCQLRGQNCYVEVSLGFPRSGTDNTLQPNKNSVRNLPKLHVAESPIVGRSDHKGSPDHLLDYDKTFLYPAEAVLVPVLQTSLARSSLRRYFFSMDICYAIFFLSLVKSFVYNC

SEQ ID NO: 221359 - protein, 223 aa, Glycine max
  Coding DNA Sequence Number=SeqID_104581
  Homolog annotation: Hit_ID=O04076; Match level="QueryCoverage=15%, HitCoverage=11%, E-value=4e-10, Identity=80%"; Hit description=ACC -oxidase
MENFPVINLENINGEERKTMLDQIQHACQNWGFFETTPSLEAVNEIPCYVNYLQYVFDEDITYIGLRRDLCSKERSGSCSGETIKRKRGFDLERPTERDIFYGGCDEHEAGLTSYTALERCKISSNNDDGYDEDVEVDLTLSIGGGSQVNINKNRSCNKPYLLPLGYLDSPNGKTKDLNSSVSFQSYRVGDFSDPTTPMSSSSVTFDQERKGPHWISQGLKLK

SEQ ID NO: 221360 - protein, 95 aa, Glycine max
  Coding DNA Sequence Number=SeqID_104582
MMFFKGEKRDSRTCRLHGIENLSNTWNCWEGVHDREEEVHGEDAGGDGREEGELGHNGGGIRDCLFDGGGMAWSTVVVVFVGEGEKGDDVARTRQ

SEQ ID NO: 221361 - protein, 118 aa, Glycine max
  Coding DNA Sequence Number=SeqID_104583
MAESTQRVLFKTFWCSKVLIGSSKPIDDKLSDEEQLLLLLASPARSFKALVQTLLIGRSTLNLDEVNVILREKERMMRTENVDDEHHVIIVVESERERNHSRRHDGPRGRSKSQSHPQ

SEQ ID NO: 221362 - protein, 67 aa, Glycine max
  Coding DNA Sequence Number=SeqID_104584
MAQTRNPILQLYHLATPSVSPYDEDTTKGKDHEALEEPMTRGILKRVQHSDEDTTKGKDHEALEGPK

SEQ ID NO: 221363 - protein, 124 aa, Glycine max
  Coding DNA Sequence Number=SeqID_104585
MGETHEVHRDHTLAYSKPCLGYATEGQVLHPAMVERENFDHIEERLRVIEGGGNYAFANMAELCLVPDVVIPLKFKVPDFDKYNGTTCPKNHLKMYCKKMGAYVKDEKLLMHFFQESLIGAAIT

SEQ ID NO: 221364 - protein, 78 aa, Glycine max
  Coding DNA Sequence Number=SeqID_104586
  Subcellular localization annotation: CTP_CleavageSite=24; ConfidenceScore=5.46e-01
MRKILKRGGKRVFSFFFLDPSSPRQASGSPGPPNSFMVKKPARLGELQLPQSDPLPINRCPRGVLKGFRGQKWRELIE

SEQ ID NO: 221365 - protein, 97 aa, Glycine max
  Coding DNA Sequence Number=SeqID_104587
MATGIGAYAGMEDEKCGVGLRVWLRQPQGDPRWQTKIQGGVVVVVGAAMGASYGEWQPWKLRMVSGMGCGSGGWYGSHGRQPWKLRMVSDMGCGSGG

SEQ ID NO: 221366 - protein, 142 aa, Glycine max
  Coding DNA Sequence Number=SeqID_104588
NPIELNRYLHDDEEDEPITIEDEVYMGLNQKFTPENAEHAGHETDSYSGGFEANNGQEPYIGMKFESKENAASMRSFNGDYPPWRCSGRQRRRGERRRHPLGNKPWKKELHHQDEPWIRSLERMLQWRKRKRERKREGGARN

SEQ ID NO: 221367 - protein, 266 aa, Glycine max
  Coding DNA Sequence Number=SeqID_104589
  Gene Ontology: Mol. function=nickel ion binding; Cellular component =extracellular space; Biological process=protein complex assembly
  Homolog annotation: Hit_ID=Q6ZHC0; Match level="QueryCoverage=72%, HitCoverage=54%, E-value=1e-91, Identity=81%"; Hit description =Putative GAMM1 protein
  Pfam annotation: Domain name=UPF0160; Domain location=6-264; Score =125.2; E_value=1.8e-34; Accession=PF03690.4; Description =Uncharacterised protein family (UPF0160)
MTYEWSMFGCLENVDKADAYQVAGVLVLEVLDAVLDVGGVYDPARDRYDHHQKGFEEVFGHGFSTKLSSAGLVYKHFGKEIIAKELEVDEEHRDVHHIYLAVYKSFMEAIDAIDNGINQYDTDQPPRYVNNTHLSSRVGRLNLDWTDPDQSPEKENEAFQRAMALAGSEFLDSVRFHVNSWLPARSIVMETLAARHTVDPSGEILVLTKFCPWKLHLFELEGELKNDPAVKYVPFYAFSPQRVSLKISDDCLPFTMTEFQQKVQNN

SEQ ID NO: 221368 - protein, 97 aa, Glycine max
  Coding DNA Sequence Number=SeqID_104590
MESVAKRINQQLAACFYGPLLSWGKLHISSNYQNSQVFIRFSIFPIGDFQVHSELPQKLEVQTALRTRLILWNWDHEEELDELVLIERPELLERGLE

SEQ ID NO: 221369 - protein, 121 aa, Glycine max
  Coding DNA Sequence Number=SeqID_104591
  Pfam annotation: Domain name=hATC; Domain location=49-113; Score= -4.0; E_value=0.085; Accession=PF05699.5; Description=hAT family dimerisation domain
MATRMRVEYDKYQGTPNVINILLLIVVVLDPRCKADELKLQLSSSLKSLYEQYQGVEEGFQINQEVVQLDEDDDDDIHASKSPFTAKGRILDPYQSSLTSRMVEVLVCTKDWSKGTFFNVY

SEQ ID NO: 221370 - protein, 127 aa, Glycine max
  Coding DNA Sequence Number=SeqID_104592
  Gene Ontology: Mol. function=phosphoribosylaminoimidazole carboxylase activity; Cellular component=phosphoribosylaminoimidazole carboxylase complex; Biological process=purine nucleotide biosynthetic process
  Homolog annotation: Hit_ID=P55195; Match level="QueryCoverage=85%, HitCoverage=17%, E-value=8e-29, Identity=63%"; Hit description =Phosphoribosylaminoimidazole carboxylase, chloroplast precursor
  Pfam annotation: Domain name=AIRC; Domain location=1-125; Score =106.2; E_value=9.8e-29; Accession=PF00731.10; Description=AIR carboxylase
MGSDSDLPVMKSAAEILEMFGVPHEVRIVSAHKTPELVFSYASSAHERGIQVIIAGVGGAAHLAGSAFLPLIKPQISGMVVALTPLLVIGIPVRASTLDGIDSLLSIVQALTSSDCINWVGPRKLRQ

SEQ ID NO: 221371 - protein, 122 aa, Glycine max
  Coding DNA Sequence Number=SeqID_104593
  Gene Ontology: Mol. function=nucleic acid binding
  Pfam annotation: Domain name=zf-CCHC; Domain location=96-113; Score =9.6; E_value=0.026; Accession=PF00098.13; Description=Zinc knuckle
MTQPQFFRHYRELQEDNLHGTTWLDQIPREQWTLAWDDGKCVYKIPLAGIRHHDYWPPYEGPQLCVNPAMRRNKKGRPKSIRIRTNMDERERGQPKQCSICRLVGHSKNKCPHYPGSSSQAN

SEQ ID NO: 221372 - protein, 70 aa, Glycine max
  Coding DNA Sequence Number=SeqID_104594
MGGNVKFVISDTRKVKDSFHITKTSRVTVWLQRAVSDNDSDVAAPRDCNASSDGVTVSREVANESVKAFE

SEQ ID NO: 221373 - protein, 108 aa, Glycine max
  Coding DNA Sequence Number=SeqID_104595
MTSMDSITEKVTQQVMFSFNQMQSQMQPKEHILPPKPEVGPSTACVSTKGSCFDPSGQNPNTDESDKCGVYEGSITIHNIPLDNDQGKVDVEEVQDVDAHVPIPIQEV

SEQ ID NO: 221374 - protein, 202 aa, Glycine max
  Coding DNA Sequence Number=SeqID_104596
  Gene Ontology: Mol. function=nucleic acid binding; Biological process= RNA-dependent DNA replication
  Homolog annotation: Hit_ID=Q2QNL3; Match level="QueryCoverage=90%, HitCoverage=22%, E-value=3e-12, Identity=26%"; Hit description=Zinc knuckle family protein
MKARAKTYLGDIARACWESFKKTFPEQIKTNLVDPGPNIYNFCSLIQRIFTTQSVNDGNNIRQKIYLGNLERLSISYFGKIKEFTQDYLMYASIAGGFTDKSLGEKLFLKLPSKLGQKIRDSWNHDQIDPVMNNLTVRIQHIMKVMEDTCTNIAINKEIKMAHSEMCKQIYTPQQYHKEIRRKRPQYRPHNKQPPKKKNPTG

SEQ ID NO: 221375 - protein, 58 aa, Glycine max
  Coding DNA Sequence Number=SeqID_104597
MVGAKCAHRNLELTDVRVYIGKMSSMISHVGLQVPFTRRTKGGTYKAKDSNAQIIPNL

SEQ ID NO: 221376 - protein, 71 aa, Glycine max
  Coding DNA Sequence Number=SeqID_104598
  Subcellular localization annotation: CTP_CleavageSite=45; ConfidenceScore=5.04e-01
MASTTKTYLVIVSTKTSKDCFRANGMPARKPTKLVQRQCDDGGLRVAMRDLALGVRDNGSDDGDLRVPLQE

SEQ ID NO: 221377 - protein, 170 aa, Glycine max
  Coding DNA Sequence Number=SeqID_104599
MGGGNGGVGGLGGGGGGLGGGSGGLGGPVVPGGVEALGGAGGLGCGVGGAGCMHQLGPSFLNPLSHLKPYLSKPSISLSCRYASRNLAGYFYHDITRCPPSCRQQLVYYIVRQLSMRLEVSIVVRSAKLKQGGLQEIDETRPKRKKKAPAYLEEYAPCKKRIAVARIRTL

SEQ ID NO: 221378 - protein, 117 aa, Glycine max
  Coding DNA Sequence Number=SeqID_104600
  Pfam annotation: Domain name=GRP; Domain location=1-111; Score=-17.8; E_value=0.0048; Accession=PF07172.2; Description=Glycine rich protein family
MGKWDTLLVLFVLVTVHATASARDVPKGGGGEEEILGVHASAPHAGVGDKKHFLFGGVGGFAGVGGFVGGAGGIGKFGGVGGIGKFGALGGGIGGGMGKVGGIGGGAGIGGFHGMGG

SEQ ID NO: 221379 - protein, 40 aa, Glycine max
  Coding DNA Sequence Number=SeqID_104601
MVVPHLRVKSSKHLRKSNDLHLSEQQPPLKFEPKLSGSSL

SEQ ID NO: 221380 - protein, 80 aa, Glycine max
  Coding DNA Sequence Number=SeqID_104602
  Pfam annotation: Domain name=TIL; Domain location=25-69; Score=-5.4; E_value=0.1; Accession=PF01826.8; Description=Trypsin Inhibitor like cysteine rich domain
MARSHVSMSFLKFMIFAAAMLVVLFSVGVSCKQWCPGTCQQYPKGKCEAFCKANGYQIGKCVPPENAFCCCAKIGDQIFN

SEQ ID NO: 221381 - protein, 256 aa, Glycine max
  Coding DNA Sequence Number=SeqID_104603
  Homolog annotation: Hit_ID=Q1RTL8; Match level="QueryCoverage=37%, HitCoverage=13%, E-value=1e-29, Identity=63%"; Hit description=IMP dehydrogenase/GMP reductase
MEVNLSDLMVPSRRIVPQWAIGIIDSSSPKSSDRQEGQGGCSNPIPVAVPDFWLSGKTRTCSRTRSTWVLPIKVGTDSDGYPRDFSKVVDDGLKLSKCIYFGKDRAVSLSKHPSPMARLTTTFLPSTPMVYAVISDPGIVDNPDIPSYQPHAYGRCDPPALIPLQMNVIEMEADCYHKTASDPTAPAVPCKGATGFDDDERGEKERGEGFAAALIDDPVWVMNTVPVAAKVNTLGAIYERGLIGTYMKWFVISSIF

SEQ ID NO: 221382 - protein, 52 aa, Glycine max
  Coding DNA Sequence Number=SeqID_104604
MAFSIPPPLLPILTTTVLWHRLMRKKVLAVSSDVHIKDFYLQLENLKMIDTY

SEQ ID NO: 221383 - protein, 210 aa, Glycine max
  Coding DNA Sequence Number=SeqID_104605
  Gene Ontology: Mol. function=nucleic acid binding; Biological process= DNA integration
  Homolog annotation: Hit_ID=Q1SDG1; Match level="QueryCoverage=52%, HitCoverage=9%, E-value=1e-21, Identity=44%"; Hit description =Integrase, catalytic region; Zinc finger, CCHC-type
MEEGYSTNKPPMFNGVNHDYWKVQIIDHFESIHINLWGIVENDNYIPYDDELNEIPRIQCMEEQKLRFLLNSKTRNIMLYALLEEEYTKVHSFKSAKQMWDTLAITYDGTSQDGGLKKAKSLALNVHKTKKASLSEEPSSKSSSKSSSRALKVENPSNKEYEDEFDEDELTFISQKICKMWKNKSISKWNKSSKKVFKERKDKDKSSIIY

SEQ ID NO: 221384 - protein, 70 aa, Glycine max
  Coding DNA Sequence Number=SeqID_104606
MSPNRTKVAKRKSKEKGATPTGPNLDLSSIESAVKEKNTKYNKLIKLKEAQKIHMEYEILMKDMSGMADQ

SEQ ID NO: 221385 - protein, 75 aa, Glycine max
  Coding DNA Sequence Number=SeqID_104607
MASSKHQKQSLCFYNLKVFASTLRSMDLEVEHGFDGPITRARAKKMVNEAQSEMENKMPKPKFINSLKSKENELT

SEQ ID NO: 221386 - protein, 195 aa, Glycine max
  Coding DNA Sequence Number=SeqID_104608
  Homolog annotation: Hit_ID=Q1RVR8; Match level="QueryCoverage=30%, HitCoverage=3%, E-value=7e-07, Identity=58%"; Hit description =Glycoside hydrolase, family 1; Integrase, catalytic region; Zinc finger, CCHC-type
MSKCRDQPRIGVSNAFKANTRGAKKIRIPKKKKIPVVDVFDSRKQTHIMVQGQWFLTSYDKKTNLKGKTQVEAAISFAETFRWICKKQGSTTLSTTKAEYMLATSCCIHHLIKNQLEDYNICLEINETLLFYGARLLNGPQTIYLELVRMFWRNVEFLNNKVIVSKVLGVRVTVSSDCIAKATSCLREKSIYHEG

SEQ ID NO: 221387 - protein, 288 aa, Glycine max
  Coding DNA Sequence Number=SeqID_104609
LLAVNPTNLDLTLADYSMLGGLYAQMYIHNQATAYPPGLQISKATDVTIVADKASSTGYDGSDNVDLHDLTQVQCLVRTYHFDDACACFTKDASNYTFIDCLKSFPTIFHETTYDLTKTEERYSTMLKRKEEHVWKNLFFTIVVKVQVAQVQAEAFAKTVDNNIVHEVSKHSATSNEATSTEKDAPDAIIVYFTSLGPTPLNYAPPTVVTRDQENEQLRLSMQNVNATQLSNLGVVLLQNLQQAQMSMLGVVSTPIAAIAAPESLTLIQQPPPVEPTPPPPPPTHPPP

SEQ ID NO: 221388 - protein, 136 aa, Glycine max
  Coding DNA Sequence Number=SeqID_104610
MRIKETIRKGATIPKEMISQGSRLPQRIRVLDKIKGGSMKNPRENNTIIGQKELEKGRAHRDDSKVRLEIPMSGKLKRLKDNLEPPVATYPSAGGRRVTRGMRVPRKEYARSRHQRLFEENVRKTGKDAIYELLSE

SEQ ID NO: 221389 - protein, 64 aa, Glycine max
  Coding DNA Sequence Number=SeqID_104611
  Subcellular localization annotation: CTP_CleavageSite=44; ConfidenceScore=5.34e-01
MSPSPLGSHNHSQTHLKLSEQLPLQALRVPFSLSGWTEAVRLVRSSGALSETIQLIFFQILPCA

SEQ ID NO: 221390 - protein, 125 aa, Glycine max
  Coding DNA Sequence Number=SeqID_104612
  Homolog annotation: Hit_ID=Q6T2Z9; Match level="QueryCoverage=47%, HitCoverage=18%, E-value=2e-23, Identity=88%"; Hit description=CDK -activating kinase
MELLQDKYFSEEPLPVPICELQVPLTRNGQEQDSPGGHNEMGSNSDLEEFGTLNTTTTGDKVFAKSDGHSDNHKSNGKNHKSTNMPSDLTSAGDHGLDMKKQEAAAAAGNGSDDFYDGLGCCHVR

SEQ ID NO: 221391 - protein, 457 aa, Glycine max
  Coding DNA Sequence Number=SeqID_104613
  Homolog annotation: Hit_ID=Q9FQZ2; Match level="QueryCoverage=81%, HitCoverage=93%, E-value=3e-84, Identity=43%"; Hit description =Avr9/Cf-9 rapidly elicited protein 137
  Pfam annotation: Domain name=DUF668; Domain location=317-405; Score =78.7; E_value=1.8e-20; Accession=PF05003.3; Description=Protein of unknown function (DUF668)
MAWRHKAVPRAEVLGILAFDAGKTMCHLISLYHSLSDKEITKLRKEVINSKGVTYLNSQHECFLLNLAAAERLEELDTAADTVSRFGRKCSDPSLSRFDLVYADLKLGLIDLRKLSYGARNTPKIISKMEKFVSSTRSLYFAMEYMAELEASDKKRQRLKTVGATNYNSNPKQNMEYLNEQIAYHRKQVQQYKEVSLWSQTLDKTVGIMAKLVCIVYARICSVFGGYISNCNCYEINDVDNNNNNCCCLLEHRELYKKNYCLYEESLQKRVTRSGPIPKASNNNKTGVIRFLNRDGEVDRPKSSVNNRVLRLAPPSTVGGAGLAVRYAEVILSAEQWLHAPATVGQDAREGLYEMLPDRLRQKVAAKLRGRWRREEEGEALSEGWRDAVEEMLEWLSPVAQDTMRWQVERSMETGRFEAKTTALLLQTLHYSDLEKAEAAIVEVLVGLSCIYWCERR

SEQ ID NO: 221392 - protein, 127 aa, Glycine max
  Coding DNA Sequence Number=SeqID_104614
MVTSRATPAPSSTQTKFYYLKLTTSLGRGIKRIKLDTITKNLHLPRLIGLFVGNVVFNHDMHQQRFNSTTTNLSQLRELHAQNSIYNTNFQLMDVERQTNLAEQEHLNKRVEDLIAKLDRVNKELAI

SEQ ID NO: 221393 - protein, 102 aa, Glycine max
  Coding DNA Sequence Number=SeqID_104615
MQWKMGKDCSTTCFCSTVVDEEANITKMPPLLGSKSHIACLSLCGAAYISVGQLHLVPIGFKMKSNMVSEPIARLSSLRHVGGSLRHIGGSPISASSVEGGC

SEQ ID NO: 221394 - protein, 413 aa, Glycine max
  Coding DNA Sequence Number=SeqID_104616
  Gene Ontology: Mol. function=GTPase activator activity; Cellular component=intracellular; Biological process=signal transduction
  Homolog annotation: Hit_ID=Q10L77; Match level="QueryCoverage=70%, HitCoverage=49%, E-value=4e-34, Identity=42%"; Hit description =Pleckstriny domain-containing protein, putative, expressed
MIATILFSTLRAPKKEENIQRCSMSADSQVENSGSEDSTDDDYIDVKENGYHDAENEVDKETDDDVDCIQSGKLSESSGYAGSDLYDYKAFGGDDSNVGSSSSNHAKTKNVNLNVVPDTPLSEDQNKQRKGSENPVDENDASNLFPSTESYRSMGEILSSMDPGNHLPMQVTESGFGKQTSKASSASFSSKRSTFWGRSNPRKTPSMESVDSSGEEERFLQQYFDSTLAFVNHERKQRTKESLLGTNWRNIKGQVLASSNGTRQPSRKKFLKSSPSNSKSIEASTSMSVDDLGALDSASVPSTSRATEVDPLSTSMLTLIDVSANHPLDHVLLKNVAEYVDTNGNWLLDNFKEYVPNNVVQDAVAMIFPQMPENRNVLAWSLSSDESFLIMWCIIVWCALTKCYSKSSINGKV

SEQ ID NO: 221395 - protein, 123 aa, Glycine max
  Coding DNA Sequence Number=SeqID_104617
MKNERRTAENLRENHHGNVTKTLRKRLGSDFLHGTNFFHSFQENGGDACHPARPGEQGGFFLKQPPSGGIFWRAQNLTNCATMLPFEFRHVTELHELLNDGCQVPQNGQMKVACHQAKVPGRD

SEQ ID NO: 221396 - protein, 150 aa, Glycine max
  Coding DNA Sequence Number=SeqID_104618
MPKKMKNRETQANPVIHDNSWTPPTQGSSSIDTSSRDISIAFLTQNAQYEDNSLQASKFIIPTPIQPHEVVFVVEWMRYDYEHSPSKAFETLPLDAIARMQPHWLVPGTQQCLHPSSEVDPPEERAKMKKNVWTNILSTNNPLAKFAKSD

SEQ ID NO: 221397 - protein, 89 aa, Glycine max
  Coding DNA Sequence Number=SeqID_104619
  Homolog annotation: Hit_ID=O24292; Match level="QueryCoverage=67%, HitCoverage=45%, E-value=5e-09, Identity=57%"; Hit description=CP12 precursor
MACPCAQLLHLVPCYHALIACQVADTHLLRILYALLHLLQYALWSCANGSIPHHLTQPITTMSHPLAEWKCKLYDIRVLWGVMMMRSKE

SEQ ID NO: 221398 - protein, 195 aa, Glycine max
  Coding DNA Sequence Number=SeqID_104620
MGCERDAGFDAQWNAGIVAEQLQLSKGDHNVIPLCQRLIAALISEEECGGGSEHFKFDAYDTEFEPDGEPELNGLDHHSGTNFQFPCHSAYNGFRIMDKPEHDETERDIFGIPPTGLNSSFGKSINGFLRDKAMSSFTCSELQYDSLDINDKLLLELKSIGLLLHLWPNLLGVFYPMPLEGRIASIFISHLLNSQ

SEQ ID NO: 221399 - protein, 186 aa, Glycine max
  Coding DNA Sequence Number=SeqID_104621
MANPIPICPWPCLPSLEATSTSSHEKTKENETKGKGILHTNPSGYDDANSIRVITIVGENRGAEMKITQSQKKQQPIQKSDKVVRTLYSTPIMKVVYSTNNNVQNLGDAYPYPIKDLKNVITTAAATKKFHSKKPAAAAASAAPKVLKSGLSRKEALEEVSYIGKIAYISGNQSSPSQKHPELSVG

SEQ ID NO: 221400 - protein, 324 aa, Glycine max
  Coding DNA Sequence Number=SeqID_104622
MAQTKKTGQMTSEAAKEITDKIASLTGKLCHPWTSGSGVTIKEYFGPAPRTSHMSLSMAPKDGLALPPEPEIGPSAAHASTKESCIDPSGHDLDMGVPEKYGLYVDKNPPCLVALGFRRLYEGRPPFTTSLWEMIKLRSVFRKFETLMLIFLYPLKSLPEPNIEKNHHHRHQQQQQHRNEAYVGHVGGVVARVCHEPPWLQGMCSCAPCHFSPSRAAGSRNLTISVTDSLTNATTMFHHRAIMVSPPPSPITSLGWTNCTNSMSSSFVARLLQLEVNRLEEEKTKEKDKKDDEKPDVAVSSELWPKMTERQSNTPEKDKERWKG

SEQ ID NO: 221401 - protein, 69 aa, Glycine max
  Coding DNA Sequence Number=SeqID_104623
MASYMLLMLNEYLRNIFEMDSYVEGNLKTARATKIDVAQCRACRPWIFFINGVFYFLKINGRGIENEER

SEQ ID NO: 221402 - protein, 69 aa, Glycine max
  Coding DNA Sequence Number=SeqID_104624
MGVLQPHQFHLPNFKYKSNLDHEDEVKDNALEHYDEERPVGGIALLHEIKGFWNLHLKPGSRNLDTAKK

SEQ ID NO: 221403 - protein, 85 aa, Glycine max
  Coding DNA Sequence Number=SeqID_104625
MSGFRIRMCIGHVMGKGLDNRRVVYLLEDATWEPTTKVREQFPSFYLEDKAMVTGSGIGSIQQATIGRHFHVYTRRPKTHKPNNA

SEQ ID NO: 221404 - protein, 142 aa, Glycine max
  Coding DNA Sequence Number=SeqID_104626
  Subcellular localization annotation: CTP_CleavageSite=53; ConfidenceScore=5.19e-01
MTMQNMQFQQETRASIQSLTNQMGQLATQLNQQQSQNSDKLPSQAVQNPKNVSAISLRSGKQCQGPQPIAPSSSANEPAKLHSTPEKGESSSTGNSDLQKQHIPPLPFPPRAVSNKKNGRGRERDLGNIQKSRGKHTSAGCN

SEQ ID NO: 221405 - protein, 150 aa, Glycine max
  Coding DNA Sequence Number=SeqID_104627
  Gene Ontology: Mol. function=transferase activity
  Homolog annotation: Hit_ID=Q9MAP9; Match level="QueryCoverage=85%, HitCoverage=24%, E-value=6e-21, Identity=42%"; Hit description =Highly similar to YUP8H12R.39
MGAENGGFSVNVTNEEVVAAVVPMQEHWLPLSNLDLLLPPIDVGVFFCYKNPMLTSTTLGDTCTNKITFESMLGSLKKALAQALISYYAFAGEVVPNNVGEPEVLCNNRGVDFVEAVADVELKCLNFYNPDDTIEGKFVPKKKNGVLTVQ

SEQ ID NO: 221406 - protein, 115 aa, Glycine max
  Coding DNA Sequence Number=SeqID_104628
MVGQGGKELGSTDDPHFVHVQNKHAFPPSGLPPNYNRPNVVHTPDENVNNSTSILIEGQQLQSDHAHVSQPMGETHAIPHHNLADFKPGLRYATKGQAVGGVPLQKTLEGPQFCP

SEQ ID NO: 221407 - protein, 258 aa, Glycine max
  Coding DNA Sequence Number=SeqID_104629
  Gene Ontology: Mol. function=ATP-dependent helicase activity; Cellular component=membrane
  Homolog annotation: Hit_ID=P37024; Match level="QueryCoverage=90%, HitCoverage=29%, E-value=6e-73, Identity=57%"; Hit description=ATP -dependent RNA helicase hrpB
MLCAAGDDVHAIASAALLVAILEDPPRSGSVDLRDALNQPQPQWLRRARHWQQRLNAGQGRVDADRFPALLAAGFADRLAQRRGHSARYQLANGIGAMLDEHDGLSRYEWLIAPSLLQGASSADARMLLALPVEMDALRQQCPQLVEQRTDVDWDEDKGTLRAWRREAIGALILRAQPQARPEPEILHPAMLRWIREKELAVLGWTPEAEQLRLRLQCAAQWLPEEAWPTLDDDTLLASLEHWLLPEMGAVRDLKGIL

SEQ ID NO: 221408 - protein, 34 aa, Glycine max
  Coding DNA Sequence Number=SeqID_104630
MSAENISRGNVRSASSDDAPVFNLDRLTFLAEVG

SEQ ID NO: 221409 - protein, 161 aa, Glycine max
  Coding DNA Sequence Number=SeqID_104631
MSLKVVPYSTTIAKTILEGGVFNASVSTTVLDMSSFYVGPLRMTDVECNTFYDGHVTRIILKCVAFYIGHGKTGIESIQVVKDDFDEDQSLIELAGEILEESFVADIKLERLEMSGSTLFLEAILEDKLLPEDVEVTDLVVVDTVGPKGHLDCSVGLCIER

SEQ ID NO: 221410 - protein, 471 aa, Glycine max
  Coding DNA Sequence Number=SeqID_104632
  Gene Ontology: Mol. function=zinc ion binding; Cellular component =cellulose and pectin-containing cell wall; Biological process =metabolic process
  Homolog annotation: Hit_ID=Q9FG39; Match level="QueryCoverage=99%, HitCoverage=65%, E-value=0.0, Identity=70%"; Hit description=Ankyrin- like protein
  Pfam annotation: Domain name=DUF248; Domain location=1-469; Score =874.6; E_value=4.7e-260; Accession=PF03141.7; Description=Putative methyltransferase
  Pfam annotation: Domain name=Methyltransf_11; Domain location=67-180; Score=12.3; E_value=0.0034; Accession=PF08241.2; Description =Methyltransferase domain
  Pfam annotation: Domain name=Methyltransf_12; Domain location=67-178; Score=8.7; E_value=0.072; Accession=PF08242.2; Description =Methyltransferase domain
  Pfam module annotation: Pfam domain module=DUF248::Methyltransf _11::Methyltransf_12; Domain location=1-469::67-180::67-178
MVVWYSNVPHTRLVEDKGGQNWILIKRDKFVFPGGGTQFIHGADKYLDQISEMVPEIAFGHNTRVALDVGCGVASFGAFLMQRNVTTLSVAPKDVHENQIQFALERGVPAMVAVFATHRLLFPSQAFDLIHCSRCRINWTRDGRQLKAIQAHGYTTVAMKDGILLLEANRLLRAGGYFVWAAQPVYKHEETLQEQWTEMENLTASICWELVRKEGYIAIWRKPLDNSCYLGRDIDAHPPLCESNDDPDNVWYVGLKACITPLPNNGYGANVTEWPLRLHQPPDRLHSIQLDAIISRDELLRADSKYWFEIIESYVRAFRWEDYNLRNVMDMRAGFGGVAAALHDLQIDCWVMNVVPVSGFNTLPVIYDRGLTGVMHDWCEPFDTYPRTYDLLHAAGLFSVEKKRQKCNISTIMLEMDRMLRPGGRVYIRDTTLVIGELQEIATALGWSTTINDVGEGPYSSWKILRSDKRF

SEQ ID NO: 221411 - protein, 205 aa, Glycine max
  Coding DNA Sequence Number=SeqID_104633
  Gene Ontology: Mol. function=zinc ion binding
MKLSCNLCAVLYVYINNGNTTFKVKEKMILIAVKKPFDLAVGNTSKDHSHDHWGNVVLKQLYHSLGNDNGGMEWCIREALMSHPKISCATTMTETLNIVKDGQECSPQLESLFYRLQSEANGHENVVNNGFSSESNGHGATGRCQRVFRDILASEKFSSLCKVLLENFRGMKPETVFDFSLINSRMKGQAYEQSPTLFLSDFQQM

SEQ ID NO: 221412 - protein, 341 aa, Glycine max
  Coding DNA Sequence Number=SeqID_104634
MEAEEGSSNGDNGEGVGLDWRLGSQDGDNGGRILGGNGVAEGEGDRGLKDGAVNNGVAIEAEEVWGLKKEAVDNGVAVVGGDGVVEGEEVRGLKNVTVNNGMAIEGGNGVAEGKVWALKNEVINSGVAIADGNGAAEDGEVSGSKNDVIGVAIADGNGFAEHGEVWGSKNEAVSNEVPFVDGNCVVYSGEVQGSKNGAVNNEVVIADEIGVTEGQEDHCLQNGTVDNVVANANEGNSGSVECFQTYKRRKHVKLSSEFEVQENSRKHMAAASQLSEQVFSTAFTTCVPVMVLYCYLSLCIRDFMCYVCLLVEFLEVQAARFLCLCRKEVNQLARCTCASNL

SEQ ID NO: 221413 - protein, 377 aa, Glycine max
  Coding DNA Sequence Number=SeqID_104635
  Gene Ontology: Mol. function=zinc ion binding; Cellular component =nucleus; Biological process=regulation of transcription, DNA -dependent
  Homolog annotation: Hit_ID=Q5N7H9; Match level="QueryCoverage=26%, HitCoverage=61%, E-value=1e-27, Identity=47%"; Hit description=PHD finger protein-like
  Pfam annotation: Domain name=C1_1; Domain location=89-132; Score= -4.0; E_value=0.078; Accession=PF00130.12; Description=Phorbol estersdiacylglycerol binding
  Pfam annotation: Domain name=PHD; Domain location=204-255; Score =12.9; E_value=0.0029; Accession=PF00628.19; Description=PHD-finger
  Pfam annotation: Domain name=PHD; Domain location=256-301; Score =50.4; E_value=5.9e-12; Accession=PF00628.19; Description=PHD-finger
  Pfam annotation: Domain name=PHD; Domain location=94-142; Score=37.1; E_value=6e-08; Accession=PF00628.19; Description=PHD-finger
  Pfam annotation: Domain name=zf-C3HC4; Domain location=205-252; Score= 3.7; E_value=0.065; Accession=PF00097.15; Description=Zinc finger, C3HC4 type (RING finger)
  Pfam annotation: Domain name=zf-C3HC4; Domain location=254-298; Score= 17.6; E_value=0.0024; Accession=PF00097.15; Description=Zinc finger, C3HC4 type (RING finger)
  Pfam module annotation: Pfam domain module=C1_1::PHD::PHD::PHD::zf -C3HC4::zf-C3HC4; Domain location=89-132::204-255::256-301::94 -142::205-252::254-298
  Subcellular localization annotation: CTP_CleavageSite=37; ConfidenceScore=5.12e-01
MGAATGTYSSIVIQCIQLYNTIQVVWRKLQNTGNQIVAMARSLSNMSKASFCEQVGISAQSSFEDEKQVLCNQESISHMKPEQTVECVAFKVGNCWHCGDKADGIDCLVCDSCEEMYHLSCIEPAVKEIPRKSWFCANCTANGIGCRHKNCVVCEQLNVLKTLDDFVGEENFPTNEETLNELEEYSNCTYDGIQVSTDGRNSSNCKICKMAVDGEKVKICGHSFCPSKYYHVRCLSSKQLKSYGNCWYCPSCICQVCLTDKDDDKIVLCDGCDHAYHIYCMKPPQNSIPKGKWFCIKCEAGIQAIRQARKAYESKKGKVGQNDSKPNEDIDKKWNKKRGRESDKVGGMMDMLINAANTLNSEEDMNAMLIDSKKTLT

SEQ ID NO: 221414 - protein, 260 aa, Glycine max
  Coding DNA Sequence Number=SeqID_104636
MAFDTSSLSNITSPWYHTTPYGIKVLGKGKGGYLTSTADPPSKSDPNPTRNLGIGPLSAAEDSALAVHVNQNQGSDGRPRKGRPSCDLFQSLGQIKECGYKSENSQQTADWKPNKSQSHRDRKYKVHITDGSDPLFPALTLKGSEDLTLESVLFVPNLVSASVKTLDDVMLWHFRLMIMYPAKLFPSFATSHQTHGPCKPNQTTVVKHHTKTSTTEAQLDAKSHHLQQAHLASEGLHCYSMSLVYSPQEEAEQGALEGNS

SEQ ID NO: 221415 - protein, 178 aa, Glycine max
  Coding DNA Sequence Number=SeqID_104637
  Gene Ontology: Mol. function=binding; Cellular component=thylakoid; Biological process=photosynthesis
  Homolog annotation: Hit_ID=Q69SU8; Match level="QueryCoverage=68%, HitCoverage=40%, E-value=3e-28, Identity=54%"; Hit description =Putative tetratricopeptide repeat (TPR)-containing protein
  Pfam annotation: Domain name=TPR_1; Domain location=141-174; Score =24.4; E_value=0.0004; Accession=PF00515.18; Description =Tetratricopeptide repeat
  Pfam annotation: Domain name=TPR_1; Domain location=50-83; Score=7.7; E_value=0.65; Accession=PF00515.18; Description=Tetratricopeptide repeat
  Pfam annotation: Domain name=TPR_2; Domain location=141-174; Score =18.0; E_value=0.034; Accession=PF07719.7; Description=Tetratricopepti de repeat
  Pfam annotation: Domain name=TPR_2; Domain location=50-83; Score =21.2; E_value=0.0038; Accession=PF07719.7; Description =Tetratricopeptide repeat
  Pfam module annotation: Pfam domain module=TPR_1::TPR_1::TPR_2::TPR _2; Domain location=141-174::50-83::141-174::50-83
MKVTWKNKKKKRCLPTLSHFTDLPFEHNHQQHSNTDAEDGAHVPDATQLANEFQAQGDKLAMDGKYREALGKWEAALALAPDVPVVHEQKAQVLLETGDAWNALKAATRASMRFILLNHCLKFDNGALYITGATELDPSWAEAWVTLGRAQLNFGEPDNAIESFDRALALKVSRCWST

SEQ ID NO: 221416 - protein, 407 aa, Glycine max
  Coding DNA Sequence Number=SeqID_104638
  Gene Ontology: Mol. function=oxidoreductase activity; Cellular component=cytoplasm; Biological process=gibberellin biosynthetic process
  Homolog annotation: Hit_ID=Q4JH25; Match level="QueryCoverage=99%, HitCoverage=100%, E-value=1e-174, Identity=74%"; Hit description=GA 20-oxidase
  Pfam annotation: Domain name=2OG-FeII_Oxy; Domain location=217-348; Score=111.3; E_value=2.8e-30; Accession=PF03171.10; Description=2OG -Fe(II) oxygenase superfamily
MDSGFYLVSSLNHQEVVQSRFFDPSWLQMQPHVPMSFVWPKECLVDANEEFHAPMVDLGGFLRGDDDEATSRAVRLVRKACSSHGCFQVINHGVDSRLIREAYDQMDAFFKLSIRRKVSARKTPGSVWGYSGAHADRFSSKLPWKETLSFPFHDNNELEPVVTRFFNNTLGEDFEQAGVVFQNYCEAMKQLGMKLLELLAISLGVDKLHYKDLFEEGCSVMRCNFYPSCQQPSLALGTGPHCDPTSLTILHQDQVGGLDVFADNTWQTVPPRPDALVVNIGDTFTVTIRRKRLRVETKEVAVPVLILGELSRLNSLRALSNGRYKSCLHRAVVNKYKERRSLAFFLCPKEDKVVRAPEDIVRRDGTKQYPDFTWSSLLEFTQKYYRADEATLQNFTKWLLSSKQQTL

SEQ ID NO: 221417 - protein, 68 aa, Glycine max
  Coding DNA Sequence Number=SeqID_104639
  Gene Ontology: Mol. function=DNA binding; Cellular component=nucleus; Biological process=regulation of transcription
  Homolog annotation: Hit_ID=Q0PJD2; Match level="QueryCoverage=60%, HitCoverage=25%, E-value=7e-12, Identity=80%"; Hit description=MYB transcription factor MYB67
  Subcellular localization annotation: CTP_CleavageSite=56; ConfidenceScore=5.14e-01
MGIDPETHKPRTDLNDLTSLSQFLRMSILSSAINTSWGNNPLEKLTSTPTTTMVARLATSGSENDTGA

SEQ ID NO: 221418 - protein, 236 aa, Glycine max
  Coding DNA Sequence Number=SeqID_104640
MDVMLHLYQEHSADALNTLENITTRLENIETRLTLNLDPPNALNGKFKFGIIKTKTEKIVRDGEKHEDLALNLQDQLEEVLSFTFSTLLSGICIDCYIECCILAFIISFVHHASSCVSKKKISSIDQTLYCHNLPFGGGVKRPKSWAKASISKGENERSRHQCLFEENIRKTKKDDGLQILKKRVQELFTHGEAKQGIWDKGSSPRRAVYFILKQPCSPRWAELTQASQGLEKVYK

SEQ ID NO: 221419 - protein, 72 aa, Glycine max
  Coding DNA Sequence Number=SeqID_104641
MASNPSRAQKKLKSSKRKQGEYSQTALNRLDIGFTIERFNFPKLLEAQGFNFPKPALNRLDIGFTIESKKNN

SEQ ID NO: 221420 - protein, 94 aa, Glycine max
  Coding DNA Sequence Number=SeqID_104642
MESPSVATYPSAGEGKGQNHGPKRLSPREKTSGVASNIYLRKKLEKPKKMMIDFNREQNSFKALDLETIFDFKKRKESLRRCWTFKRSLDFLMK

SEQ ID NO: 221421 - protein, 72 aa, Glycine max
  Coding DNA Sequence Number=SeqID_104643
MTLIFMITMIPPHPKNGKSGKVSNNVKEGQMDPGPIMVNNIPMRHQMENIQAVQGLPMMNGDGGKVEAKELG

SEQ ID NO: 221422 - protein, 104 aa, Glycine max
  Coding DNA Sequence Number=SeqID_104644
MGYTPSSLVDLVFAGEMIKVGLERGKFDHPALMNAKTRANEEDENEGETLAMTAIHTWSNFPLVKQCHYSANNSPSHPIINRSHPQISHKACLLTTRPMPKHHL

SEQ ID NO: 221423 - protein, 67 aa, Glycine max
  Coding DNA Sequence Number=SeqID_104645
MKDEEAVASSGLILLEPMQFKLGKRPNSKIAQRFSQECGLWCSVVVATSKGTKIKVAVRAHVYGIKR

SEQ ID NO: 221424 - protein, 136 aa, Glycine max
  Coding DNA Sequence Number=SeqID_104646
  Gene Ontology: Mol. function=oxidoreductase activity; Cellular component=cytosol; Biological process=flavonoid biosynthetic process
  Homolog annotation: Hit_ID=Q41399; Match level="QueryCoverage=96%, HitCoverage=40%, E-value=1e-43, Identity=62%"; Hit description =Chalcone reductase
  Pfam annotation: Domain name=Aldo_ket_red; Domain location=1-112; Score=-97.5; E_value=0.0013; Accession=PF00248.11; Description =Aldoketo reductase family
MRPLQVEMNAAWQQENLRKFCKEKGIHVSAWSPLGANGAVWGSLAVMDSPILKDIAIKTGKTVAQVALRWIIEQGATPIVKSFNSERMKENLKLFDWELSETDSEKIKQIPQHRGFSGERFVNEFGPYKTPQDFWD

SEQ ID NO: 221425 - protein, 114 aa, Glycine max
  Coding DNA Sequence Number=SeqID_104647
MKQNALITCLSQSMQLFKEKNKMSPVYGDIHSSSGFNFENVTQLTKGAKDTIIIQGPGHPESEPPPHLSDGKIGESERATTSPYKESERSAASPAGDSGGAATSPDGESEMIIK

SEQ ID NO: 221426 - protein, 245 aa, Glycine max
  Coding DNA Sequence Number=SeqID_104648
MESETESGLDYKRKGERKDIELVEEEEPRIGANCSSATSNKSEIYKEEAGNAAQKHKAKRVESVNANAEAFGDHWESSDCFMHYEAEALEHMKKRDRGHQSVSLENKTGDSTVVKMSEKNNNVDASDCMILDDHEGEEHCYGKGTNARSVSFLPRSQEKIGDSAKVVIKQDIKGGEHKYGFNNNKREKPEKVRVVDDETGDKHELFVVLRMPSRTKNRCLKFFTEGRRVIINIVFYIYQTPNPMH

SEQ ID NO: 221427 - protein, 373 aa, Glycine max
  Coding DNA Sequence Number=SeqID_104649
  Gene Ontology: Mol. function=nucleoside-triphosphatase activity; Cellular component=membrane; Biological process=cell division
  Homolog annotation: Hit_ID=P0A9R7; Match level="QueryCoverage=56%, HitCoverage=95%, E-value=1e-107, Identity=93%"; Hit description=Cell division ATP-binding protein ftsE
  Pfam annotation: Domain name=ABC_tran; Domain location=28-213; Score =246.9; E_value=4.3e-71; Accession=PF00005.17; Description=ABC transporter
MIRFEQVSKAYLGGRQALQGVTFHLQQGEMAFLTGHSGAGKSTLLKLICGIERPSAGKILFSGHDISRLKSREVPFLRRQIGMIFQDHHLLMDRTVFDNVAIPLIIAGASGDDIRRRVSAALDKVGLLDKAKNFPIQLSGGEQQRVGIARAVVNKPAVLLADEPTGNLDEALSEGILRLFEEFNRVGVTVLMATHDLGLISSRPYRVLTLSDVNQIRQFGSKFDRLRNATGGGNGGRNAPKRSKAAPNPASRKSNVFNEQVRYAWHGALQDLKSTPLATFLTIMVIAISLTLPSVCYMVYKNVNSAASQYYPSPQITVYLEKTLDDDAAARVVGQLQAEQGVEKVNYLSRDEALGEFRNWSGFGGALDMLEEN

SEQ ID NO: 221428 - protein, 309 aa, Glycine max
  Coding DNA Sequence Number=SeqID_104650
  Gene Ontology: Mol. function=transcription factor activity; Biological process=regulation of transcription, DNA-dependent
  Homolog annotation: Hit_ID=Q3KDH8; Match level="QueryCoverage=99%, HitCoverage=91%, E-value=1e-115, Identity=67%"; Hit description =Transcriptional Regulator, LysR family
MRRIDHRERPRPPPQLRQHFYQLPALQPLAHDELIALADADALFGQRHHAQHIVGGLDGRTRQPVHVASTVAEDPRGQPPGARHHKRQAQVLLQVVQRLRRTPALQIVRRGHQQQRRILKLPPHQPAVRQLAQADGQVEAFGHQVHVAVGDVQFHLHLRVLLRKARQHGRQPVVAIGGGHAQAHAAGQRTVLGQYVALGVVQQAEGGAHLFQIEPPGVGQAHAAGGPLQQLPAQPRFQAGDRAAQHRGRGGQRHRAGSERAVLDHRQEHLHIAQVVELAAHLALRGTDVLRWGQFIAAGAMNKVAAIPR

SEQ ID NO: 221429 - protein, 185 aa, Glycine max
  Coding DNA Sequence Number=SeqID_104651
  Gene Ontology: Mol. function=transition metal ion binding; Cellular component=nucleus; Biological process=lipid metabolic process
  Homolog annotation: Hit_ID=Q8LME4; Match level="QueryCoverage=90%, HitCoverage=32%, E-value=4e-36, Identity=40%"; Hit description =Putative transposable element
MLILFDLPYWSDLDVRHCIDVMHVEKNVCDSVIDTLLNIQGKTKDGLNTRQDLAEMGIRDQLHPIVIDPVKLDELENEAIIILCQLEMYFLPSFFDIMWMYPVERYMKILKGYTKNSHHPKASIVERYIAEEAIEFILEYIEKTKPVGLPESRYEKKVGGTGSRGLHVIPPKSRRIAISSFAYTK

SEQ ID NO: 221430 - protein, 171 aa, Glycine max
  Coding DNA Sequence Number=SeqID_104652
MREGTPLPATTPIRSKARNPIMNIALERLARQLDLDAPRNETLRLAFGHACARRVEHLLEDPQAMECLAILGRYLEGACGPQQLAQAAATASRLANHHPGSTSIDGCGHAAVSATYAVASALAGKALRAAEYAAYAAVYGQGGHGAVSDPASFDIEHAWQADCLERCALPA

SEQ ID NO: 221431 - protein, 250 aa, Glycine max
  Coding DNA Sequence Number=SeqID_104653
ATAQSSSSSSTEATEIDNEGMTEVKQTMIKFATGQGADMSQPVRPPNIGDNQINFPLWVHNSLNHYQFVGASTECGRLAQLALTSSTNHMGGIEAIMEHIVNFKQTPTEMLFDAWKRYKSLLRSCPFDGNNQFMQISMLMKGITNDYRRMINASFEGNYLNKTTTQVKTIIKDLPASEKTIKTNGSNPQKGEEEEVEERTMLEEEMKAQVNPLTQGDDEMMAKFEKYMEMLQGKKEEPPIEKLTWDVLNE

SEQ ID NO: 221432 - protein, 246 aa, Glycine max
  Coding DNA Sequence Number=SeqID_104654
MSHVKVDMAKVGFKISHVGLRLAFVKRTRTWKTKEFIAQYISPPSFEPACEQKRLSIVMEDCFVSRVVASTSRRVEKSDVPCEGSLVFENSALLLTIGECIEDKCFICHFALSEYNARMLLLHMCHSQSGHVLKMQYMGLIVAEEVISIKGSSSEETHRGASDSNSSSSKRLTILRRVVGGPSRLYKRAQHLASSLDEEPVPVTTILPSSIFWGVGKSGAGDVRASLRCGVVIMLGRHRHPCCCWP

SEQ ID NO: 221433 - protein, 111 aa, Glycine max
  Coding DNA Sequence Number=SeqID_104655
MNEKKKRYNWCASYTCSSMFSGLIDVPQSQTMFLEEDGNDRIKENRRSIEYSSEVIFDMDKEHMLLSSMPHRLASQCHTTVISRLNTNPVMDPLLKSIKHSHYPKARLGNM

SEQ ID NO: 221434 - protein, 892 aa, Glycine max
  Coding DNA Sequence Number=SeqID_104656
  Homolog annotation: Hit_ID=Q2QNC7; Match level="QueryCoverage=89%, HitCoverage=90%, E-value=3e-27, Identity=20%"; Hit description =Expressed protein
MGKQIREKECALPNRNSHHTHPGRVWGILHVIKYHHWRQVKRRLTRRRHGGERPDARAKIPGTSDDSGVHSIPEHYKPHTELSNVEEKPVYSSPPAKITIKSRLRSLLNEDIYRRKSGHKRSSTCPAKSQLTHANSVHNLEVDLLGELLLTVQSPDPVLETFQNHLAAGTLDELTPVLYEKPIANNDKCVDCGTMFSKDILEHSKIHKHLCSPSQGGPEEKLMNAQILTTDASPHLVKDFLDALDVINTNKDFLLEYIQDLGSHLPFHTHDQQSFNGKQRRAKSLSFPVSASSSGSQDSVSGQLINQMVDYWLDSEEEKLQNQSNMQNTSMDESSEDSHQQSLPSGFSNNYDQWGERGTNSPSVSSHVPNNVKTRHFRDLRKKMKHIIEDGRNEKHRITMDAILDKIPCGKRLTKKVKKFIHIKSKDPTVKWEDEDRATSGFGSHLSSNSFNKHQPSPMRTSFLKDSAGRYSQLYHQTCFNSDAKYPKAENLRLRTEERNSILKTPKSFKRFLSMPNLKSYFHHNEELPLPLSPQNSIKNFGDRTTSTNVTDQQQRSFDNNDDSKSQILPPTFVDNINQDSNLNVDQKQLLARSASKSRLDFSTEAEADKSIGIEGLGDLRDSEQDIGAKTESIVPVEASSVFSSDTSFLDFTFDLENLNIQEEESDIEINPGQGDDGLDDMAEHQEAKEDHPEKVENFQNLGTLSKRFNYEIPSIEVDPSNEAAFNYVRKVLELSGFTGHDSLGIWYSDNQPLDPSMYEELEGCLLLDPDCSRNSEGGECNHHLLLFDIINEGLLEIFGRSYNYYPRPLSYLSHVHPLPSGENVLCKVWTLISWYLMNSTTSELYLSLDYYVSKDLAKYDGWMNLQFDSECVGLELDDLIFEDLLEEIIST

SEQ ID NO: 221435 - protein, 117 aa, Glycine max
  Coding DNA Sequence Number=SeqID_104657
  Gene Ontology: Mol. function=catalytic activity; Cellular component =nucleus; Biological process=spermidine biosynthetic process
  Homolog annotation: Hit_ID=Q4ADY5; Match level="QueryCoverage=95%, HitCoverage=33%, E-value=1e-42, Identity=71%"; Hit description =Spermine synthase
  Pfam annotation: Domain name=Spermine_synth; Domain location=1-117; Score=-29.8; E_value=7.4e-06; Accession=PF01564.7; Description =Sperminespermidine synthase
MYGNVLVLNGIVQLTEKDECAHQEMIAHLPLCSIHLPKNVLVVGGRDGSVVREVAHHSSVEHIDICEIDKMVTGVSRKFFPQLVVGFVDSRVHLHVGDGKSDAIIVDSSDLVGMSFQ

SEQ ID NO: 221436 - protein, 179 aa, Glycine max
  Coding DNA Sequence Number=SeqID_104658
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=24%, E-value=7e-59, Identity=77%"; Hit description=DNA -directed RNA polymerase beta chain
  Pfam annotation: Domain name=RNA_pol_Rpb2_7; Domain location=90-167; Score=144.1; E_value=3.6e-40; Accession=PF04560.10; Description=RNA polymerase Rpb2, domain 7
KREIKVGDKVAGRHGNKGIVSKILSRQDMPYLQDGRPVDMVFNPLGPAIMGKPYILKLIHQVDDKIHGRSSGHYALVYTTTHLEERAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 221437 - protein, 61 aa, Glycine max
  Coding DNA Sequence Number=SeqID_104659
MESWGEYFGGCLERILVPVFWSVSESSSDSEAISAQVFLANFGTLVRPMSSKARRVCIDQA

SEQ ID NO: 221438 - protein, 107 aa, Glycine max
  Coding DNA Sequence Number=SeqID_104660
MENCTKQSLRIALNLKVDAWRTHERKRNSWGSEKIENGELHYAITTHGSKLEGGGLMNENAIHGAPKKGENGELHYAVTTHGSKLEGGGHMNENAIHGAPKRLRMEN

SEQ ID NO: 221439 - protein, 168 aa, Glycine max
  Coding DNA Sequence Number=SeqID_104661
  Gene Ontology: Mol. function=transition metal ion binding; Biological process=proteolysis
DGLDTCQDLVEMGIRNQLHPRFDVPQGYSLNIKSLVQLKDLKLIGLKSYDCHVLMQQLLAVVIQDILPKKVKRAITCLCFFFNAICSKVIDLLKLDELENEVAIILCQLEMYFPPSFFDIMVHLIVHLVYCEISYEFCFEYMEKRKPVGILESRHDERMRDKGSRRLH

SEQ ID NO: 221440 - protein, 86 aa, Glycine max
  Coding DNA Sequence Number=SeqID_104662
MDSGRFQVGVPGNNYPSVAGGDVEGLPKCFQGVYHQLLALQWHIRAKARSQLDCDGEFHVSPPRFRRYVYDQFGVVGSQWIWEWGY

SEQ ID NO: 221441 - protein, 334 aa, Glycine max
  Coding DNA Sequence Number=SeqID_104663
  Gene Ontology: Mol. function=transferase activity, transferring phosphorus-containing groups; Cellular component=integral to membrane; Biological process=two-component signal transduction system (phosphorelay)
  Homolog annotation: Hit_ID=UPI00005F7E30; Match level="QueryCoverage =100%, HitCoverage=61%, E-value=1e-124, Identity=65%"; Hit description=COG3290: Signal transduction histidine kinase regulating citrate/malate metabolism
MEAQADLVALNAVDGVDGVFDQVAEHADQHVGGFRIVGFRQQAGFFDGQFNAGFVGAADLADEEARHFRRVDLAQQRADLFLIVAGGIDDLVHKFVRLHPQRIGVVRHAAQPLQQAADLGLVAEGGDGAGHLAVDDHRHGIGQQFAAVEADLPIAQRLAAGQHLRQMQLRRPVLAGGFQQQVFHRAALAQQALGFVVDDGDAGFIIDRDHAFFNRLQHGVALFEQVGDFVRLETQHDAFERGDQEEGAQAADQGGEGDGPIDDPAALRYHPLHGVQRDAERHHADLLFLRVIHRHVHPQRRGQRAAVDGAVDVALQRGRQIVADKMLADQPGFG

SEQ ID NO: 221442 - protein, 138 aa, Glycine max
  Coding DNA Sequence Number=SeqID_104664
  Homolog annotation: Hit_ID=Q9AVH2; Match level="QueryCoverage=99%, HitCoverage=68%, E-value=5e-32, Identity=45%"; Hit description =Putative senescence-associated protein
MIGRADIEGSKSNVAMNAWLPQASYPCGNFSDTSSFNSEGLRIDRPRFHDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 221443 - protein, 88 aa, Glycine max; identical to SEQ ID NO: 220034
  Coding DNA Sequence Number=SeqID_104665
  Gene Ontology: Mol. function=unspecific monooxygenase activity
  Homolog annotation: Hit_ID=O04892; Match level="QueryCoverage=98%, HitCoverage=21%, E-value=6e-15, Identity=51%"; Hit description =Cytochrome P450 like_TBP
  Subcellular localization annotation: CTP_CleavageSite=21; ConfidenceScore=5.25e-01

SEQ ID NO: 221444 - protein, 199 aa, Glycine max
  Coding DNA Sequence Number=SeqID_104666
  Gene Ontology: Mol. function=tRNA (5-methylaminomethyl-2 -thiouridylate)-methyltransferase activity; Cellular component =cytoplasm; Biological process=tRNA processing
  Homolog annotation: Hit_ID=Q7U375; Match level="QueryCoverage=84%, HitCoverage=45%, E-value=1e-68, Identity=73%"; Hit description=TRNA (5-methylaminomethyl-2-thiouridylate)-methyltransferase
MSQAPRTRRPRGLAGTAIGVATARHRPACLDDDAAAQADIAIVKHRRLPGRDRPLRLGEIEREALGGRVAQAAGRIGLAVARLGAVFARGRRLPRHPADVLRPQRAGQQPGMVMPLHHVKHIALEVLARHVPGLGRAVIALAALHADHAQALALAQRVERQALVAPDLLSFRRQDRARFGRQVAVQELAERTFADEADA

SEQ ID NO: 221445 - protein, 123 aa, Glycine max
  Coding DNA Sequence Number=SeqID_104667
  Gene Ontology: Cellular component=integral to membrane
  Homolog annotation: Hit_ID=Q7WL00; Match level="QueryCoverage=99%, HitCoverage=45%, E-value=3e-49, Identity=82%"; Hit description =Putative integral membrane protein
MAHRLGHGARHHPGRQLSGGEVLAALSTMWRSLLLTLFVGYSGWNMLRNKKPKPSRQMPGVVGTSAAGAGIGFRSGLVGAGGGFLSVPFMVWCNVAMHNAGSTSAALGFPIAMANSIGYVVSG

SEQ ID NO: 221446 - protein, 113 aa, Glycine max
  Coding DNA Sequence Number=SeqID_104668
TTKALEQETKRARREEHGQNKFRGALWGSNSELKLRREERDQSRAHSMVLKEELAACSRSKRNLSQHLCETKTNMLAIVSKYQEELNLATAHEHKVAGEYARVYAEKEARGRG

SEQ ID NO: 221447 - protein, 120 aa, Glycine max
  Coding DNA Sequence Number=SeqID_104669
  Gene Ontology: Mol. function=oxidoreductase activity; Biological process=metabolic process
  Homolog annotation: Hit_ID=Q9AR59; Match level="QueryCoverage=57%, HitCoverage=26%, E-value=8e-11, Identity=50%"; Hit description =Tropinone reductase I
MLDGVRCGVGGMIEVVQNGVNFAGKFRMVVRPIDKSRDLAQVLGLCHVPLGPTCVGFVHITNIYPLLKESGYESIVFNSSIAAVKAFPVLSAYSASKGAMGQFTKNVALEWANDNIVQML

SEQ ID NO: 221448 - protein, 51 aa, Glycine max
  Coding DNA Sequence Number=SeqID_104670
ALGGLATRPGQPEASQGEPRSKKLLGMTLLPLPLGIFCILNQNVERSFVLH

SEQ ID NO: 221449 - protein, 117 aa, Glycine max
  Coding DNA Sequence Number=SeqID_104671
  Gene Ontology: Mol. function=oxidoreductase activity; Cellular component=membrane; Biological process=electron transport
  Homolog annotation: Hit_ID=Q2MJ20; Match level="QueryCoverage=51%, HitCoverage=12%, E-value=8e-24, Identity=80%"; Hit description =Cytochrome P450 monooxygenase CYP716A12
MAIAKSKAPGELLNWDDIQKMKYSWNVACEVIRLNPPAQGAFREAINDFIFDGFSIPKGWKKPIPQCYILSEHCVSTSFRIRFLKAIHLVICSPEHKAQNHHRIQTQTTHRSELSHS

SEQ ID NO: 221450 - protein, 67 aa, Glycine max
  Coding DNA Sequence Number=SeqID_104672
MDTLFGMLLLKCVIQTAPTMTMMETQMMKDMMMKMKVKADGSRNLGLVNHLHRHKEEVTQKMDHGQQ

SEQ ID NO: 221451 - protein, 74 aa, Glycine max
  Coding DNA Sequence Number=SeqID_104673
MFLGIWTIDGVSSWLLARIKRALSWLGSRMGFRYLFSSSDLDLNFHPLWERGIFQTDVVIWEDGENYASSMEGG

SEQ ID NO: 221452 - protein, 95 aa, Glycine max
  Coding DNA Sequence Number=SeqID_104674
MSHQNNDLRLIHRWIIMKFRSMIQLRTHLPLGLAIKYLWREIKELHEDSTNKGFSPFFVSLTFKNSIGVVGGKTGGILGNRWRCRYRCRKTHESA

SEQ ID NO: 221453 - protein, 170 aa, Glycine max
  Coding DNA Sequence Number=SeqID_104675
MPISPCRCIGWDRAHKTPSGPEEVQQGPGVSSSGHGPLESYKVPVPPARSCHRDIGKNHTHKDTQWTRRSPIGPCGFQLWLRASVVLQGAHSPRQGHIIIGIAPARHPVDSKKSNRVLELSCSNYGSLASGPLLIELSSRSTASPGRRREKHHSSLRMASSRQQTHRHNL

SEQ ID NO: 221454 - protein, 134 aa, Glycine max
  Coding DNA Sequence Number=SeqID_104676
MGEFHQQTLLPRGENTETFSSLTSYPELRRSEFLIGGYVGARASLLSTTPPFVAMTQELVARGDTLRLSAPRHSVIPSVIDEQRPIWSSAPFPEMSAFSDGDFSSLTSYPELRRSEFLIGGYVGARALLLSAAP

SEQ ID NO: 221455 - protein, 118 aa, Glycine max
  Coding DNA Sequence Number=SeqID_104677
MEREMITMIDTLPVFYYEKMVGYTSSSFSDLVFAGERIEVGLRGSKFDYPALMNGKPHANGESKNEGGTHVVTAIPTLPNSPPAQQYQYSANFSPSHYPPPYQSRKLNHPQRSPLNHP

SEQ ID NO: 221456 - protein, 179 aa, Glycine max
  Coding DNA Sequence Number=SeqID_104678
MPALLQMRNLIMSLYITLTITTFSGQDYIKIPAFYHEQWVPDYPNFAHFHYDRASYHIRLRQHRGKLFFADGLKHLRKYLDIYESVTINFMACKHRWIFNLHFTPPLEQQACGRPLLATRMHVWTLELTQALLGDHQPLKLPPLAAIHLPSCGFHMTVLRKFGPPLQWPILPVAPGFHG

SEQ ID NO: 221457 - protein, 116 aa, Glycine max
  Coding DNA Sequence Number=SeqID_104679
TKKKAAFSKSGTERKKKEEILKQAQSNRGAQRASGAKRATNWRRWAWRKPLRALSQPGAQRPIQQTHRRPAPDPTDAQAPSARSNRSTGPAYMARPARDLNALSARCGAERNYEGP

SEQ ID NO: 221458 - protein, 374 aa, Glycine max
  Coding DNA Sequence Number=SeqID_104680
  Gene Ontology: Mol. function=sequence-specific DNA binding; Cellular component=nucleus; Biological process=regulation of transcription, DNA-dependent
  Homolog annotation: Hit_ID=Q43458; Match level="QueryCoverage=99%, HitCoverage=100%, E-value=1e-174, Identity=83%"; Hit description =Heat shock transcription factor 5
  Pfam annotation: Domain name=HSF_DNA-bind; Domain location=22-248; Score=153.3; E_value=6.3e-43; Accession=PF00447.8; Description=HSF -type DNA-binding
MALLLDNCESILLSLDTHKSVPAPFLTKTYQLVEDPSTDHIVSWGEGDTTFVVWRPPEFARDLLPNYFKHNNFSSFVRQLNTYGFRKIVPDRWEFANEFFKKGAKNLLCEIHRRKTPHQHHQEVQAMNNHHHHYHHHQFGLNVPPFFPFHNSRLSISPPHDSDELIIPNWCDSPPRGVASVNNNNNNNNNYNTVTALSEDNERLRRSNNMLMSEIEHMKKLYNGIIYFVQNHVKPVAPSNNNTFPSFLLCSNNINSNSNNNTSSQPQASPMSNVSTVQRQVKQFLGCYSNNTKQARAVNSSPTNSSITIVEEEASSNSCKTKLFGVSLQSKKRVHPDEYGSNYILQSSETNNKARLVLENDELLGLNLMPPSTC

SEQ ID NO: 221459 - protein, 75 aa, Glycine max
  Coding DNA Sequence Number=SeqID_104681
  Homolog annotation: Hit_ID=Q1T1K3; Match level="QueryCoverage=73%, HitCoverage=4%, E-value=7e-09, Identity=57%"; Hit description =Thioredoxin domain 2
MDGIWMHGKQKYLASGIAKAFGWLQLSGKCERNKVDEGSRLAGPGEGVEKDEVRMETDLRREIMFGGDLALGLGG

SEQ ID NO: 221460 - protein, 71 aa, Glycine max
  Coding DNA Sequence Number=SeqID_104682
MPSTSQGPKKGRMSSSKGPRTKLGCFLQPIIKVDDDYVLQPSTWLIVEGNDFLYNFLCFTNNPPLITSKEF

SEQ ID NO: 221461 - protein, 97 aa, Glycine max
  Coding DNA Sequence Number=SeqID_104683
RDNSGLVHEDKPEESSSTPTHAQCICSSLSEAIVSSVLSTRLVLSQISLTRAKRAFEVSKPFLSLICTEKKRRGLNSRQSLKSEIHRGKEQSQGAKF

SEQ ID NO: 221462 - protein, 98 aa, Glycine max
  Coding DNA Sequence Number=SeqID_104684
MHMRIKRSLKVVMGPRTRLKQELGNIQIHQAWPKIISSNETYPPHLFPAYSKNNSKAPKFLKGKEASTRIKPRLLCKQSMGQNTPNDYDDRWLKFSQR

SEQ ID NO: 221463 - protein, 170 aa, Glycine max
  Coding DNA Sequence Number=SeqID_104685
  Gene Ontology: Mol. function=phosphoinositide phospholipase C activity; Biological process=intracellular signaling cascade
  Homolog annotation: Hit_ID=Q69L69; Match level="QueryCoverage=62%, HitCoverage=15%, E-value=9e-12, Identity=33%"; Hit description =Calcineurin-like phosphoesterase-like protein
MFVDKNSKRVPMRYLQFLRDLRECSTYAWGAALLGNLYIEMCIATDYNVKSTGGFTLLIQLWAWERCPTLAPLFIPPQQQNAPLAYRWLGGEFHHIGNDNLLDFRRKLDVMKRDEGEIAETLYFMVSPIGRRVCTFDDLLACIENITLLYDEEDRILEAHEDALPFSATI

SEQ ID NO: 221464 - protein, 65 aa, Glycine max
  Coding DNA Sequence Number=SeqID_104686
MVTSLLQLDSMNLFVKARAWFNPITQGMAILIANTSTTFHRDERLENTHAMHGKWENARVTHEQT

SEQ ID NO: 221465 - protein, 124 aa, Glycine max
  Coding DNA Sequence Number=SeqID_104687
  Gene Ontology: Mol. function=DNA binding; Biological process=DNA integration
  Homolog annotation: Hit_ID=Q1S3H4; Match level="QueryCoverage=78%, HitCoverage=20%, E-value=7e-09, Identity=39%"; Hit description =Integrase, catalytic region
MGKEILAVLYALKKVSIISFTKKEKEIEEELPDKTLMEVSFKDEDYPWFIDIANCKAIGQPSKVMKFNERKRFSREATRENKLAYFGIVRTYHMEATSTDKEHMQRSFMPNFIRLHSSHMISEF

SEQ ID NO: 221466 - protein, 94 aa, Glycine max
  Coding DNA Sequence Number=SeqID_104688
MLEPFLSPPSTPIYWKGSLWGLAARPGELRLTPEVVSLLRRAGFLTLKSFGGSGKLGSRKTKEKSLLPFFLDILCLPNRNTEWFLALHYNWHST

SEQ ID NO: 221467 - protein, 177 aa, Glycine max
  Coding DNA Sequence Number=SeqID_104689
EQATQGSFIPHGCQDVLVAAIGRPEHPGRVRAAGAGVTIKQYFGSAPWMSRSASSLPPDELQQLTQQIRDQLEESITEKVMRQVPSSFSQLQSQMQSQGLAVPPKPLVGPGPSGPRVSTKESCVDPSGNDPETGDSDKCGLYIEADPRSGFGDTKLRAPHPIYRVCPSQSSQLVIKT

SEQ ID NO: 221468 - protein, 71 aa, Glycine max
  Coding DNA Sequence Number=SeqID_104690
EARGASGNRLPGDVIDYQASKGNWKTVEASSNRLPVCVIDYTGEWVTGNRLPGMGNRLHSAFFRFSCPEAV

SEQ ID NO: 221469 - protein, 123 aa, Glycine max
  Coding DNA Sequence Number=SeqID_104691
MARTKKTWEMTTEAAKEIAEKIDSFEEQATQGSFVPHGHQDVLTAAIGRPEYPGRVRAARAGVTIKQYFGSVPRTSRSASSLSPDELQQLTQQIRDQLEESITEKVTRQVMASFSQLQSQMQS

SEQ ID NO: 221470 - protein, 100 aa, Glycine max
  Coding DNA Sequence Number=SeqID_104692
MAFCGGYWWLWVMEKELGMLEMVLEERRRRNGVFQSYLDYKAQNAQVTKALGNGSVTHTPDVFPKIPTGVTLPPPPLSLSFFSSIETSSLSFLSKGLSWW

SEQ ID NO: 221471 - protein, 118 aa, Glycine max
  Coding DNA Sequence Number=SeqID_104693
MNALSAPVRLACSSQLSIDIAIVEEFYANLYDPEDKSPKQVRMGGHLVKFDEDTLNTFLKTPVVLEEGASLCTYSRFALLRPDPQELDPMLCILGRGFKLNADGQPLKILRKNMTTLA

SEQ ID NO: 221472 - protein, 79 aa, Glycine max
  Coding DNA Sequence Number=SeqID_104694
MSRQVQGNAPQATDVPPPPHQADPAESLGMERAEVTWPGDWPEAQAGEAPAKAPGDAEEARMDEEMTDLLGFLGGSGAT

SEQ ID NO: 221473 - protein, 148 aa, Glycine max
  Coding DNA Sequence Number=SeqID_104695
MGKVEEAQEKMKADIEAMKEQMATVMEAMMSIKKIMEANAVTVAATSAIATVNPMPPSDLNQTNHPTSDMVGKDLGSTDGPMMCKFKMSAPSHHMACLPTIHHPMWHTLPMKMSITPLRYSLRANNLNLIRHMSLKPWGRHMKFPTKI

SEQ ID NO: 221474 - protein, 63 aa, Glycine max
  Coding DNA Sequence Number=SeqID_104696
FYGVPVAPNKFIRHPINRAFIKKYCTPRQAQGETPQQPGECWQRATDAPPPPLEFTSAQQQKG

SEQ ID NO: 221475 - protein, 53 aa, Glycine max
  Coding DNA Sequence Number=SeqID_104697
MVRAFSQNTVTLTGLPMILPSESDLPYYCVMNRWMTMKNLMLEDTGTPRFDWM

SEQ ID NO: 221476 - protein, 49 aa, Glycine max
  Coding DNA Sequence Number=SeqID_104698
SDDLQTPVILTGALQEALKFVNTSLKMLKVLQQLKDKALKRAGLAEDEC

SEQ ID NO: 221477 - protein, 259 aa, Glycine max
  Coding DNA Sequence Number=SeqID_104699
MYAQLLLLALPAPPMGGLGMPPMPPFWILSRAFFIRILVENVATYPSAGVRKGQNHGPKCLSLRERTSGVPTNVYLRKMLEKPKRRWSADFENEGLGVVSVGGRVLPFLLLSSVKTYFTKEKRLPMIEEGDEDAQNNREDPYGSINQTSGPWDPFLSPSSRLFIAKAATWDHDSSPRRAVNFILKQPCSPRRAGYFIMKLFGGPGEPEASLGELEQLASSRSIRLARIKTLAKEGPLMKLRYDRENDKVLFFFMSFSHL

SEQ ID NO: 221478 - protein, 269 aa, Glycine max
  Coding DNA Sequence Number=SeqID_104700
  Gene Ontology: Mol. function=pyruvate dehydrogenase (cytochrome) activity; Cellular component=membrane; Biological process=electron transport
  Homolog annotation: Hit_ID=Q66CL9; Match level="QueryCoverage=59%, HitCoverage=27%, E-value=2e-79, Identity=91%"; Hit description =Pyruvate dehydrogenase [cytochrome]
RHVARQDHHRDAAVEDRLAHGDLQHARQLFRVGNQLAIVAAFAKQLLRMRFLEVAAADFAGRNVCGDRQHRHMVAVAVEQAVDQVQVAGAAGTGAHRQLAGELGFGAGGEGGHLFMAGAQPFDGAHAVQAVAKAVERIAGHAPNAFYAGLIQRFGDQCGYDAVRKGKERRTGESVTGRGGGNLPINAPSQRWGQGRHGAGGDVVALEDAGFARAAHPGTAGGVDRQGIALQWHRPALSACGTALYGNARPARRAGGTAAPPVPYRAQGR

SEQ ID NO: 221479 - protein, 60 aa, Glycine max
  Coding DNA Sequence Number=SeqID_104701
MARNVSASCPYSRDLYGRELKGFLVIIPKVVKSLLMVSRAVGTTSNNMLSKRKTLDEGSL

SEQ ID NO: 221480 - protein, 222 aa, Glycine max
  Coding DNA Sequence Number=SeqID_104702
  Gene Ontology: Mol. function=acetylglucosaminyltransferase activity; Cellular component=membrane; Biological process=electron transport
  Homolog annotation: Hit_ID=Q9ARU3; Match level="QueryCoverage=87%, HitCoverage=57%, E-value=5e-66, Identity=59%"; Hit description =Putative xylosyltransferase I
  Pfam annotation: Domain name=Branch; Domain location=1-92; Score= -74.6; E_value=0.0098; Accession=PF02485.11; Description=Core-2I -Branching enzyme
MYHSLCLFGLSTDQGPNICPTLSLLFGGTSISLITPATLDGKSSPWVILSRSFLEYCIFGWDNLPRTLLMYFTNVKLSQEGYFHSVICNAPEFKNTTVNGDLRYMIWDNPPKMEPLFLNVSVYDQMAESGAAFARQFEVGDQVLDMIDKKILKRGRNQAVPGGWCSGWRSWWVDPCSQWGDDVNILKPGPQAKKLKESVSSLLDDWSSHTNQCLITSEETED

SEQ ID NO: 221481 - protein, 63 aa, Glycine max
  Coding DNA Sequence Number=SeqID_104703
METQLDYLDEKKLMIAKLLRRKRKRSDVQLQSTETLTKVRLAAKKAELPNLDGTDQVEIVGVC

SEQ ID NO: 221482 - protein, 186 aa, Glycine max
  Coding DNA Sequence Number=SeqID_104704
  Gene Ontology: Mol. function=acetylglucosaminyltransferase activity; Cellular component=membrane; Biological process=electron transport
  Homolog annotation: Hit_ID=Q9ARU3; Match level="QueryCoverage=74%, HitCoverage=35%, E-value=2e-37, Identity=56%"; Hit description =Putative xylosyltransferase I
  Pfam annotation: Domain name=Branch; Domain location=50-185; Score =25.5; E_value=9.7e-10; Accession=PF02485.11; Description=Core-2I -Branching enzyme
MGVERKWLFTLFTAAFLSFIILMFSSLSCFNSPVPFPSSVHYGPHYPPAFAYFISGGNRDGDRIFRLLLAVYHPRNRYLLHLGLDARDEERQKLAAAAMSVPVIRAFGNVDVVGKAGYMTYLGSSNVAVTLRAASVMMKLDAGWNWFVTLSARDYPLVTQDGNANTVISVLDHGFALFIVIVCGLA

SEQ ID NO: 221483 - protein, 117 aa, Glycine max
  Coding DNA Sequence Number=SeqID_104705
  Subcellular localization annotation: CTP_CleavageSite=70; ConfidenceScore=5.19e-01
MAAVRVENVKFVVLRHMGAFGLLPPAFRFFFLTFVLLPFSLGLSRKSLTHGRHQPQRICSPSSSSSSAFRCATVSSWVLTIPAKLTVVLLPPRVGMIVEVTDQVDQVVCSSPLYRSS

SEQ ID NO: 221484 - protein, 231 aa, Glycine max
  Coding DNA Sequence Number=SeqID_104706
RGNIASLVRGKARPRDFEEAIGQLLCVLGQDFAQSVTGRRVQIMRTSMTTLTQIWMTLLLNNILHSDHNSDLPLPKCQLVYAILTQVSVHVPQLISDAIYQFAGITPLRHPVDPEKSNKALGFPTLITGLFQFYGDQQQPAADAPLLPLLQPPSLESISAHMWRMELQMHAYMQHVIDQQATNQRGQFGAIVASPGDRPDFQVGAGPIGASEDEDGAQENDHMANVMKYFL

SEQ ID NO: 221485 - protein, 123 aa, Glycine max
  Coding DNA Sequence Number=SeqID_104707
MKETVKALDLKQTQVTLTDKKLDYVLIFSWFHLFTFNLIKRRLVRIKWDYGTIDRLKFALREEMRLLMASSVRLGKLVTSPLSYLEAQVFSVFFTGTLKNLSYCATTGVKQHNSASKNQNISK

SEQ ID NO: 221486 - protein, 120 aa, Glycine max
  Coding DNA Sequence Number=SeqID_104708
MGVGVTYARQGDFDTYCLVFLSESVMWTRLGYFLTNGMTLCRNVPFCGRARRGSRVRFPKEERCAELPPTFICGKRRKNRRKPVKMKILSSGVVFTFEEGRQKQGFCSYVPSIEEEIRPT

SEQ ID NO: 221487 - protein, 110 aa, Glycine max
  Coding DNA Sequence Number=SeqID_104709
  Gene Ontology: Mol. function=steroid hormone receptor activity; Cellular component=nucleus; Biological process=regulation of transcription, DNA-dependent
MTIPMFQGKNDPKLYLEWERKVEHMFDCHNYFEEKKKVKLVVVEFIDYASIWWDQLVTIRHKNDERPINRGEEMKTIMRRRFLPSHYYRDLDRKLHEYGGLLQSDRNSHD

SEQ ID NO: 221488 - protein, 90 aa, Glycine max
  Coding DNA Sequence Number=SeqID_104710
  Gene Ontology: Mol. function=RNA-directed DNA polymerase activity; Biological process=RNA-dependent DNA replication
MDPKDQEKTTFTCSFGVFAYRYMPFGLCYALATFQRCMMVDKAKIDVIEKIPPPINEKGDVAFVFNEECVEAFNDLKIRLVSAPVLTTPE

SEQ ID NO: 221489 - protein, 59 aa, Glycine max
  Coding DNA Sequence Number=SeqID_104711
MSVKNLVGHLGVDDKKDYTLDQHRLQGTFKLSVFTPKAYTPKSLSIPFPPDSGLTQKTF

SEQ ID NO: 221490 - protein, 85 aa, Glycine max
  Coding DNA Sequence Number=SeqID_104712
MRPSTVITTIGTLRNLNQNEQHYTTLCYPLFYFWKLCQNCSGHKYWNIALKVRSGRHGAIHITIDIKHSKVYKVSTTYLNQNETL

SEQ ID NO: 221491 - protein, 83 aa, Glycine max
  Coding DNA Sequence Number=SeqID_104713
MAAEWRRKRERRRHFKEKMSLEEAHHHRRPRIRAWRIASACFLLSLCNDPPHDYDITTPNRIKGVGHNISLALLMSDHIRELL

SEQ ID NO: 221492 - protein, 88 aa, Glycine max
  Coding DNA Sequence Number=SeqID_104714
MHEFEDDEGHVLIESSHLAKKLTLPQIWGILLGESFQRQNGATLKKSKGVITLSELNALSAHQWLSLAPACLVSKGESGKTFALQART

SEQ ID NO: 221493 - protein, 66 aa, Glycine max
  Coding DNA Sequence Number=SeqID_104715
MVAKEKKQRLVTMLECDEDDARVRRTRCLDADRDGFARRRLEEEESAKAWMEKKTECQLLRAHHIF

SEQ ID NO: 221494 - protein, 60 aa, Glycine max
  Coding DNA Sequence Number=SeqID_104716
MWNITLQTQFLLDQLADLQNKVRENANQQQRPTGELEDEFRLAEEKCEEAESRVRQLEPT

SEQ ID NO: 221495 - protein, 129 aa, Glycine max
  Coding DNA Sequence Number=SeqID_104717
MKVRVAEAEPFGGVDSGVEGKEEGVVELRVLDLGDECDRRGKAEVGEEDAVARELRTDLNAWGLLLSGRWAAAMVSGAIKGAGCCGMSVGRGGGVGMGDGVGTGGGVGMDVCVRSAFAEEEDGGASEWC

SEQ ID NO: 221496 - protein, 262 aa, Glycine max
  Coding DNA Sequence Number=SeqID_104718
  Subcellular localization annotation: CTP_CleavageSite=34; ConfidenceScore=5.08e-01
MAFLGETSSQAVVNSTLGFIFPNGSIVHNDSGVSFQASPPVPIRVPNGCDFQTLKTRIHNTLKLTDKQFLDEIYYRQPFTYADDADVNTMLLCNHEFSFVGPIELLCSIVRTPDGILNLLETTMTPTHDALLYYNGRWNMSRQNEFVGYSFTGKNPKNFDIPIGCTMDELKDLIKQVAPRGIPPYGVDETQMVRRLFFRKPSHHEYSEKVIKFEIIELKTNEDVMKVLIESNYWKNIGPIEILAVFSILAPQMEDDLSLSQN

SEQ ID NO: 221497 - protein, 44 aa, Glycine max
  Coding DNA Sequence Number=SeqID_104719
MMGKGVLGRVVHGSYRGSGRDGRVSARVVHGYLELTWRETVLTS

SEQ ID NO: 221498 - protein, 45 aa, Glycine max
  Coding DNA Sequence Number=SeqID_104720
MKRIASETMRGPPCSGLDGKTVTSTKEVVILIREEEGSDEDSMKV

SEQ ID NO: 221499 - protein, 53 aa, Glycine max
  Coding DNA Sequence Number=SeqID_104721
GTLGANLESETFVEAVKGFLNGPPLSDTLMTKRMKKDLHGSPGRLSQSTEAGA

SEQ ID NO: 221500 - protein, 117 aa, Glycine max
  Coding DNA Sequence Number=SeqID_104722
  Homolog annotation: Hit_ID=Q9SJK6; Match level="QueryCoverage=44%, HitCoverage=13%, E-value=2e-13, Identity=71%"; Hit description =Putative non-intrinsic ABC protein 12
MADNMSGTTTTLLPARHSYFFLLSGGRQHVWYNHYPHASSTLLLLAPLLEKGERLNPGNLLLDKKHIMRSMTGKLMLDRVSAVMGPSGASKTIFLSAMVGKARGCTMIGSFLINGKP

SEQ ID NO: 221501 - protein, 77 aa, Glycine max
  Coding DNA Sequence Number=SeqID_104723
MSRRLQEDWARVAEEGPRILMNLKMVPHLLYLPLQLHGGKSPLKELIEAQRSSLHRSLSSKLPSSGIRAQELPVGAP

SEQ ID NO: 221502 - protein, 60 aa, Glycine max
  Coding DNA Sequence Number=SeqID_104724
MCEWTLCKIHSEYTYSNGGAENSPLQPTISSSQGERIWPCTKVIEDQGDHWDMSPKEMEE

SEQ ID NO: 221503 - protein, 138 aa, Glycine max
  Coding DNA Sequence Number=SeqID_104725
  Gene Ontology: Mol. function=2-dehydropantoate 2-reductase activity; Biological process=pyrimidine base metabolic process
  Homolog annotation: Hit_ID=Q07VQ4; Match level="QueryCoverage=94%, HitCoverage=42%, E-value=4e-12, Identity=32%"; Hit description=2 -dehydropantoate 2-reductase
  Pfam annotation: Domain name=ApbA_C; Domain location=41-137; Score =8.2; E_value=1.6e-05; Accession=PF08546.1; Description=Ketopantoate reductase PanEApbA C termin
MQLSPLHVLYYGALDGNNDARLARVDAALRDAQFDSVFADNIISELWEKWLLLSTLGAVCCVARGNTQHILRSAGGEALLQGIFAEVLAVITADGYQQRPAVTAKIYETLNNPDAAMTSSMYICRRGDQSGAWRAWCA

SEQ ID NO: 221504 - protein, 182 aa, Glycine max
  Coding DNA Sequence Number=SeqID_104726
  Gene Ontology: Mol. function=protein binding
  Homolog annotation: Hit_ID=P34209; Match level="QueryCoverage=92%, HitCoverage=63%, E-value=1e-35, Identity=46%"; Hit description =Protein ydcF
  Pfam annotation: Domain name=DUF218; Domain location=3-140; Score =0.3; E_value=0.00024; Accession=PF02698.7; Description =Uncharacterized ACR, COG1434
MIASHPLYRQIDTAGKGEAQLLGEMARVFAELPDDQLLLETASRNCGENAALSQRLLDEQQWQPQRVLLVQDPLMQRRSWETFRWQWRDREHAPEFISWPVFVPQVMMDAGMLRIVGAPPQGLWSVERFLSLLMGEVQRLRDDASGYGPNGKGFFGHVDVPDAVEAAWQRLMQLPGVQSRLG

SEQ ID NO: 221505 - protein, 355 aa, Glycine max
  Coding DNA Sequence Number=SeqID_104727
  Gene Ontology: Mol. function=transcription factor activity; Cellular component=intracellular; Biological process=regulation of transcription, DNA-dependent
  Homolog annotation: Hit_ID=UPI00005F7A2F; Match level="QueryCoverage =92%, HitCoverage=97%, E-value=1e-79, Identity=50%"; Hit description =COG1609: Transcriptional regulators
  Pfam annotation: Domain name=LacI; Domain location=6-31; Score=50.4; E_value=6.1e-12; Accession=PF00356.11; Description=Bacterial regulatory proteins, lacI f
  Pfam annotation: Domain name=Peripla_BP_1; Domain location=63-325; Score=18.5; E_value=5.3e-08; Accession=PF00532.11; Description =Periplasmic binding proteins and sugar b
  Pfam module annotation: Pfam domain module=LacI::Peripla_BP_1; Domain location=6-31::63-325
  Subcellular localization annotation: CTP_CleavageSite=37; ConfidenceScore=5.33e-01
MTARSVTLDDVARLAGVSYQTVSRVLNHSAQVSPRTRARVEAAMQQLSYVPNRVAQQLAGKATRTLGLATSDLALMAPAQIASAIQQRAAAQGYHLVIAMANATSHAQDTVHELLAQRVDALLINLPLDAAQAAQIQQQCGSKPTLFLDVERSAAVAQCQYRSTSGAQQAVDHLVALGHRQIGVLNGPASSASARARFTAWQQALARHHLAPVCVLSGDWSAASGYQALLTRLPDQLPQALLVANDQMALGAMRALHQHGVRIPAEMSIIGYDDTAESAWYQPPLTTVRQDLQQLGTVSVNRLLAQLEGEMPDSQPLETELVLRATTAAPLQQQVDVAEIAQQLQQLARALKRSP

SEQ ID NO: 221506 - protein, 420 aa, Glycine max
  Coding DNA Sequence Number=SeqID_104728
  Gene Ontology: Mol. function=serine-type D-Ala-D-Ala carboxypeptidase activity; Cellular component=membrane; Biological process =peptidoglycan biosynthetic process
  Homolog annotation: Hit_ID=P37604; Match level="QueryCoverage=56%, HitCoverage=60%, E-value=4e-89, Identity=63%"; Hit description =Penicillin-binding protein 6B precursor
  Pfam annotation: Domain name=PBP5_C; Domain location=132-223; Score =116.9; E_value=5.9e-32; Accession=PF07943.3; Description=Penicillin -binding protein 5, C-termi
  Pfam annotation: Domain name=Peptidase_S11; Domain location=1-113; Score=-8.1; E_value=8.5e-10; Accession=PF00768.11; Description=D -alanyl-D-alanine carboxypeptidase
  Pfam module annotation: Pfam domain module=PBP5_C::Peptidase_S11; Domain location=132-223::1-113
MMNSYVQKLGLTHTHFETVHGLDAPGQHTTARDLAVLSRAIINGEQDFYAMYSEKTLSFNGITQNNRNGLLWDQNLHVDGMKTGHTESAGFNIVASNIVGRHRLIAVIMGGKSSKGREEQARKLLVWGQNNFDTVQLFHAGKKIGSENVWYGNPHKVDVGTTEDIYLSLPRSEVSNVMAKYVINRKDLEAPLKAGEQVGEIQVLDKDKQLASYPLYALQSVDEAGIITRISDYVKQKLYLAADYAGSGDGTDLHLGQCFAARGAAYQRYLCRADIRADRAEAGAAVTAADAGVVLYRDDRLRLSDARQTPVYGTADRHHAWRGGRRTGRRFHRGAVARRRCDSRLADGPAVQRHLGAARLYSLAHSAVGRLYQHGEDSSRWLFCQSGGEAAPQSALPEAAHQRDQNARAAGAGEQRDAHP

SEQ ID NO: 221507 - protein, 254 aa, Glycine max
  Coding DNA Sequence Number=SeqID_104729
  Gene Ontology: Mol. function=CTP synthase activity; Cellular component=cytoplasm; Biological process=pyrimidine nucleotide biosynthetic process
  Homolog annotation: Hit_ID=P76038; Match level="QueryCoverage=98%, HitCoverage=98%, E-value=5e-68, Identity=53%"; Hit description=Gamma- glutamyl-gamma-aminobutyrate hydrolase
  Pfam annotation: Domain name=GATase; Domain location=55-240; Score= -47.9; E_value=0.0044; Accession=PF00117.18; Description=Glutamine amidotransferase class-I
  Pfam annotation: Domain name=Peptidase_C26; Domain location=8-225; Score=283.3; E_value=4.7e-82; Accession=PF07722.3; Description =Peptidase C26
  Pfam module annotation: Pfam domain module=GATase::Peptidase_C26; Domain location=55-240::8-225
MGIIFDKPLIGVVMCQNPIGNHVGQTVHNKYLDAVVLAGGVPLPLPHQLMHAPQLLENSMTLLDGILLTGSPSNIEPWHYGEEGHEAHADPSRDRLSFALITHASGKKMPMPGICRGLQELVVANGGAVHRQLHQTHLFQEHREDDSQPLEQQYAPAHLVQPEPDGLLSQLLGSAAAFAVNSLHGQGIREPGPQLRIEARAPDGLIEAVSLRQHPFALAVQWHPEWQSDRDPVSRRLFEAFIHAAARYHKEKQP

SEQ ID NO: 221508 - protein, 385 aa, Glycine max
  Coding DNA Sequence Number=SeqID_104730
  Gene Ontology: Mol. function=amino acid transporter activity; Cellular component=integral to membrane; Biological process=amino acid transport
  Homolog annotation: Hit_ID=P0AA47; Match level="QueryCoverage=93%, HitCoverage=81%, E-value=1e-146, Identity=73%"; Hit description =Inner membrane transport protein yeeF
  Pfam annotation: Domain name=7tm_4; Domain location=126-343; Score= -145.8; E_value=0.064; Accession=PF01461.8; Description=7TM chemoreceptor
  Pfam annotation: Domain name=AA_permease; Domain location=34-385; Score=-23.4; E_value=4.1e-05; Accession=PF00324.11; Description =Amino acid permease
  Pfam annotation: Domain name=Aa_trans; Domain location=17-382; Score=- 164.1; E_value=0.1; Accession=PF01490.8; Description=Transmembrane amino acid transporter protein
  Pfam module annotation: Pfam domain module=7tm_4::AA_permease::Aa _trans; Domain location=126-343::34-385::17-382
MGLFTIAPAQAGSRFRDDYGAATIANTNITSHCSTLRSIPVPMTLFDTFGIVSGLTDGHVATAYAFALIAILFTAVSYGKLVRRFPSAGSAYTYAQKAISPHVGFMVGWSSLLDYLFMPMINILLAKSYFESLVPGIPSWIFVVLLVAFMTISNLRGIKTVANFNSVIVVLQVVVMAVITGMVVYGVAHGIGAGTLTSTKPFWSENAQVVPMITGATILCFSFLGFDGISSLSEETKDAERTIPRAIFLTALIGGVIFIGVSYFLQLYFPDISRFQNPDSSQPEIMLFVAGKALQIGILIFSVVTVLASGMAAHAGVSRLMYVMGRDGVFPQRFFGFVHPKFRTPSLNVLLVGAVALLAINFDLVTATALINFGALVAFTFVNLS

SEQ ID NO: 221509 - protein, 104 aa, Glycine max
  Coding DNA Sequence Number=SeqID_104731
MSEFTSNSPRISANPHQLDLAPYASGSYNAQWNAPELLHDKHMWHSSCILGKMEVEEPWLGQALADLGIAFVDDWVVGMIVSAWVPSSLSFSLFSPGFLFVKEG

SEQ ID NO: 221510 - protein, 195 aa, Glycine max
  Coding DNA Sequence Number=SeqID_104732
MVVAVAVEAATAGCDGGGGSGWLWWNGGSRGGSGGGGDSGGGGTVMVVRICPSLWSESMTLSFIQIQPDNLQHKKNDQSDIVPLTTVQLDIFWKEMDGDADWLMGFLTIFNCQGDLALLIEQGATACTNGGKDDRKSVEVVWICAKSIGGTAGEESRLHVFSPVKRSRGKPRRTLEEIVKRNLVVNNIPENLVSN

SEQ ID NO: 221511 - protein, 164 aa, Glycine max
  Coding DNA Sequence Number=SeqID_104733
  Gene Ontology: Mol. function=manganese ion binding; Cellular component=mitochondrion
  Homolog annotation: Hit_ID=Q93ZY7; Match level="QueryCoverage=81%, HitCoverage=66%, E-value=1e-48, Identity=68%"; Hit description=Nudix hydrolase 12, mitochondrial precursor
  Pfam annotation: Domain name=NUDIX; Domain location=2-133; Score =54.5; E_value=3.5e-13; Accession=PF00293.18; Description=NUDIX domain
GKVDQMGDAEEIIEVLMISSPKRDDLVFPKGGWEDDETVTEAACREALEEAGVKGIVREIPLGRWEFRSKSSNDSCSQEGWCRGYMFALEVTEELETWPEQKDHNRQWVNIKEAFRLSRYDWMCKALEVFLRVMAEERKLKKEENNVDSSSSSVLDEIAIHFGY

SEQ ID NO: 221512 - protein, 338 aa, Glycine max
  Coding DNA Sequence Number=SeqID_104734
  Homolog annotation: Hit_ID=Q54ZN7; Match level="QueryCoverage=30%, HitCoverage=14%, E-value=1e-10, Identity=36%"; Hit description=E set domain-containing protein
  Pfam annotation: Domain name=Rgp1; Domain location=9-282; Score= -110.1; E_value=4.2e-05; Accession=PF08737.1; Description=Rgp1
  Subcellular localization annotation: CTP_CleavageSite=40; ConfidenceScore=5.39e-01
MYDGVEDGYDSSRDDISSVSSYNPMRESLHRGFGSSLSLRSSSARSLSRDASTLEGFRTSLSSNMALPRLSVAEVLSDSGAGGHIKLYLVKTDVLSTQKSFAIVSPNEQQKLRKTFSAEDDVGVSSSPEAGAVESLSYALDIVLQNFKKVYIPSEGFIRGRSYNIRLDDQVLLKFSPRNSDSTYYFSDMIGGTLTFFHEGARRCLEISITLETSETINRRFVHPSRRNSPTITKVQSDHHEVVADLVQTSFLFSIPMDGPMSFSTQHVSVQWVLRFEFFTTPKHVDWKKYEHPLLIEGREKTEWVLPITVHAPPPRGAPASGTRSEKLFSLDPMWVHN

SEQ ID NO: 221513 - protein, 316 aa, Glycine max
  Coding DNA Sequence Number=SeqID_104735
  Homolog annotation: Hit_ID=Q1SPB9; Match level="QueryCoverage=71%, HitCoverage=46%, E-value=3e-15, Identity=27%"; Hit description =Transposase
MVLRYVLNQIAAELKQVNYASIESSHRGCIMRITHDQSLSALEVRITQEMKAIFKRFEDLDICGKVTLRSKLRELEYPDLTSMCAPLEKVKTKGGQKKRMTKQQRSMKPNPSYFEFVDALHSVQDNSSTLKRSGSSYEQTKLKRNMSMLDQFHPCIQDFIEDIVDVKADDNCRYRVITVILGLDEDSCGKLVSLLAAAGRRQYRHWHQRYTCIVIGSSRTKVESLHPCRYSNWRDMLTKHVAIRTGRTCQRGQSRHWCLRNTWVGLGFAVLKSLHVNVKNLNVGVSLCFAVCFLLCAPWFKFGAWLPSFKCSYPYL

SEQ ID NO: 221514 - protein, 554 aa, Glycine max
  Coding DNA Sequence Number=SeqID_104736
  Gene Ontology: Mol. function=transporter activity; Cellular component= integral to membrane; Biological process=cell division
  Homolog annotation: Hit_ID=Q9SCU1; Match level="QueryCoverage=76%, HitCoverage=99%, E-value=1e-165, Identity=70%"; Hit description =Patellin-6
  Pfam annotation: Domain name=CRAL_TRIO; Domain location=255-445; Score=76.7; E_value=7.1e-20; Accession=PF00650.10; Description =CRALTRIO domain
  Pfam annotation: Domain name=CRAL_TRIO_N; Domain location=159-240; Score=49.0; E_value=1.5e-11; Accession=PF03765.5; Description =CRALTRIO, N-terminus
  Pfam module annotation: Pfam domain module=CRAL_TRIO::CRAL_TRIO_N; Domain location=255-445::159-240
  Subcellular localization annotation: CTP_CleavageSite=70; ConfidenceScore=5.38e-01
MKLNFKVSNLTERNVNSKHAATARQSGVCPNHFPTALGLKVGNPPLLATTPARAFTLSSLFKFAFTPSTSSSTRSHSTERTKPKKAENFGTKPTSPPSNHPIFPIPMQRFHLGLPHSPPMDTSTPFQDLPEASPKPFFKKTTLTSFIMSSTPSFKEDTYYISHLKSSEKKALQDLKNKLQSSYSSTPSMWGVPLLNNNNADNADVILLKFLRARDFRVHDALSMLLKCLSWRTEFGADNIVDEELGGFKELEGVVAYTHGYDREGHPVCYNAYGVFKDREMYENVFGDEEKLKKFLRWRVQVLERGVRMLHFKPGGVNSLIQVTDLKDMPKRELRIASNQILSLFQDNYPEMVARKIFINVPWYFSVLYSMFSPFLTQRTKSKFVISKEGNAAETLYKFIRPENIPVRYGGLSRPSDLENGPPKPASEFTVKGGEIVNIQIEGIEDLFIACYWVTLGQSGATITWDIVVGGWDLEYSAEFVPIAQGSYTLAVDKARKIEATEEAIHNSFTSKEAGKMVLSVDNSASRKKKVAAYRYFVRKSSTPTPSEVQLSPK

SEQ ID NO: 221515 - protein, 462 aa, Glycine max
  Coding DNA Sequence Number=SeqID_104737
  Gene Ontology: Mol. function=calcium ion binding; Cellular component =mitochondrion; Biological process=protein amino acid phosphorylation
  Homolog annotation: Hit_ID=Q6YSW9; Match level="QueryCoverage=94%, HitCoverage=63%, E-value=1e-118, Identity=48%"; Hit description =Pentatricopeptide (PPR) repeat-containing protein-like
  Pfam annotation: Domain name=PPR; Domain location=131-165; Score =25.4; E_value=0.00021; Accession=PF01535.11; Description=PPR repeat
  Pfam annotation: Domain name=PPR; Domain location=166-199; Score =18.5; E_value=0.024; Accession=PF01535.11; Description=PPR repeat
  Pfam annotation: Domain name=PPR; Domain location=201-235; Score =13.1; E_value=0.21; Accession=PF01535.11; Description=PPR repeat
  Pfam annotation: Domain name=PPR; Domain location=21-54; Score=6.5; E_ value=1.3; Accession=PF01535.11; Description=PPR repeat
  Pfam annotation: Domain name=PPR; Domain location=236-270; Score =35.4; E_value=2e-07; Accession=PF01535.11; Description=PPR repeat
  Pfam annotation: Domain name=PPR; Domain location=289-323; Score =36.8; E_value=7.4e-08; Accession=PF01535.11; Description=PPR repeat
  Pfam annotation: Domain name=PPR; Domain location=324-358; Score=7.3; E_value=1; Accession=PF01535.11; Description=PPR repeat
  Pfam annotation: Domain name=PPR; Domain location=359-393; Score =29.5; E_value=1.1e-05; Accession=PF01535.11; Description=PPR repeat
  Pfam annotation: Domain name=PPR; Domain location=394-428; Score =39.3; E_value=1.3e-08; Accession=PF01535.11; Description=PPR repeat
  Pfam annotation: Domain name=PPR; Domain location=61-95; Score=1.0; E_ value=5.6; Accession=PF01535.11; Description=PPR repeat
  Pfam annotation: Domain name=PPR; Domain location=96-130; Score=25.1; E_value=0.00026; Accession=PF01535.11; Description=PPR repeat
  Pfam module annotation: Pfam domain module=PPR::PPR::PPR::PPR::PPR::PP R::PPR::PPR::PPR::PPR::PPR; Domain location=131-165::166-199::201 -235::21-54::236-270::289-323::324-358::359-393::394-428::61-95::96 -130
MRDARKVFDEMLESGVEPNSVTYSVLIGGVLRERDLEGGRELMCRLWERMSVEVEDSVKTAAFANLVDSLCREGFFGEVFRIAEELPFGSCFSEEVSYGQMVDSLCRVGRYNGAARIVYLVRKRGFVPSDVSYNHVIHGLSRDGDCMRAYQLLEEGAEFGFMLSEHTYKVLVEALCHVMDVDKAREVLKLMLRKEGVDKTRIYNIYLRALCFVNNPTELLNVLVFMLESQCQADVITLNTVINGFCKMGRVDEASKVLHDMLADAARVDEALDLFHKVMPENGLRPSVVTYNALLRGLFKLKRVSDALMAFNNMVSEGITADSTTYTVVVEGLCESDQVEEAKSFWHNVIWPSGVHDNFVYAAILKGLCHSGKLNEACHFLYELVDSGISPNIFSYNILINCACNLGLKIEAYQIVREMKKNGLTPDSVTWRILDKLHGKVRKDIHSEDPTMSTTYEGHDME

SEQ ID NO: 221516 - protein, 148 aa, Glycine max
  Coding DNA Sequence Number=SeqID_104738
MVDQFRCLLMTRVATYPSVGGRRGTHKMRLPREENARSRHQHLFEENIGKTRTCGLRTLSVKGIVDKSGAFASMYPRFVMRNSDLRNSCKSEYINFIYFQNTYQVRVRALEGRKPRTKFEPRSTKQEAHSKAQAHTQEKTQRELSKEK

SEQ ID NO: 221517 - protein, 79 aa, Glycine max
  Coding DNA Sequence Number=SeqID_104739
MPCQVEKSSCNIIPEVPVHPFLEMPLDFVKIDNFIDFLFHRLNASKIRKGNKECGGKSKVNVDVGGRGRRGGGRGMGLG

SEQ ID NO: 221518 - protein, 155 aa, Glycine max
  Coding DNA Sequence Number=SeqID_104740
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=P27066; Match level="QueryCoverage=99%, HitCoverage=37%, E-value=3e-83, Identity=86%"; Hit description =Ribulose bisphosphate carboxylase large chain precursor
  Pfam annotation: Domain name=RuBisCO_large; Domain location=1-142; Score=118.2; E_value=2.4e-32; Accession=PF00016.10; Description =Ribulose bisphosphate carboxylase large chain, catalytic domain
MHAVIDRQKNHGMHFRVLAKALRLSGGDHVHAGTVVDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTF

SEQ ID NO: 221519 - protein, 98 aa, Glycine max
  Coding DNA Sequence Number=SeqID_104741
MEVESASKKSAFCLEAMMDQLPTIPNLQRRHVYMAEATFCQFCKEDEEAIGHLFFGCCKVRAISIWVEACSPKLNECGTYGIVETSASSSENSLTIED

SEQ ID NO: 221520 - protein, 189 aa, Glycine max
  Coding DNA Sequence Number=SeqID_104742
  Gene Ontology: Mol. function=RNA-directed DNA polymerase activity; Biological process=RNA-dependent DNA replication
  Homolog annotation: Hit_ID=Q2HS44; Match level="QueryCoverage=64%, HitCoverage=52%, E-value=3e-14, Identity=35%"; Hit description =Hemopexin
MRRVSRCGGSRGCMDSRNCRKESWNMLRNLARDNSLSWCTMGDYNYLLSQKDKWGWQAQPAWMLQRLSHIVSNKLDHSPILLCLEGQAKRVSTKVFRFENSLLGEQDLDVVVTNWWDKEGPSNMLGKINSSMEDLKVRSRRLRLKFRKDIDMYRKEMDQLRGRRDSQAVGRMDELREKMAVLLAEEDSF

SEQ ID NO: 221521 - protein, 167 aa, Glycine max
  Coding DNA Sequence Number=SeqID_104743
  Gene Ontology: Mol. function=RNA-directed DNA polymerase activity; Cellular component=nucleus; Biological process=RNA-dependent DNA replication
  Homolog annotation: Hit_ID=Q1SWC8; Match level="QueryCoverage=88%, HitCoverage=17%, E-value=3e-23, Identity=34%"; Hit description=RNA -directed DNA polymerase
MKDLRPISLWNVLYKILSKVLANQLKPLLPKCVSLEQLVFVEHRSILDNALEVVEPFITRSARIRVGLRTYKILCSRWDFVKKWVEWLSMCLSYVYFSELVNGEGSSPIVPQRGLSQSDPLSRVEEKESRCIKEIRNTYEEASGQFVNIASQKFILAGIQLWSIEKR

SEQ ID NO: 221522 - protein, 134 aa, Glycine max
  Coding DNA Sequence Number=SeqID_104744
  Gene Ontology: Mol. function=RNA-directed DNA polymerase activity
MWPSTISLVIGRLFGGLRSVPNCYNIGQPFSLAEACTEEKVYGVRMCARDDRGQFVIAKTFWAHGDIHAVKAEAISLLDAIQWLRAIGFNAVSIEMDCKPVVDSVISNPVPQTELGDILLAFLFRDKLITLFIL

SEQ ID NO: 221523 - protein, 571 aa, Glycine max
  Coding DNA Sequence Number=SeqID_104745
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=1e-54, Identity=30%"; Hit description= UPI00006A17C9 related cluster
MTDPLDESIHCFLIRVDPWVLVPTTLRELHALAFRGLHVLALRGLHVLAFKGQHLLDFRGLHVLAIRGLHALPFRGLHALPFRGLHALSFRGLQTLDFRGLHVLTFKGLQVLTFRGLHVLTFRELHVLTFKGKHVLSFRGLHVLPIRGLHVLTFKGKHVLSFRGLHVLPIRGLHVLAFRGLHALAYGGLHTLAFRGLHILAFRRLHIFPFRGTHALAFRGLHVLAFRGLHLLAFRGIHVHPFRALHVLSFRGLQILPLRELNAFTFRGLHVLSFRGQHVLAFRGLHVLNFRGLHVLAFRGIHVHPYRALHVLAFRGIHIFHFRELYALAFRGLHVFTFRGQHILAFRGLHVLASRGLHRATRLCLQRTTRPPHHSITPAHHQKAALTRLQRLHVLPFRELHALALRGLHVLACKGLHVLAFRGLQVLPFRELHALAFRGLHVLPFRGLHVLTIRGLHALAFRGLHVLPFRELLAFAFARDLPFRERHTLALRGLLVLTIRGLHVVAFRGQHVLAFRRLHVLAIRGLNVLVFRGLHVLPFRELHAVAFRGLQVLAFRGLHVLTFRGLHVLLF

SEQ ID NO: 221524 - protein, 43 aa, Glycine max; identical to SEQ ID NO: 167653
  Coding DNA Sequence Number=SeqID_104746

SEQ ID NO: 221525 - protein, 204 aa, Glycine max
  Coding DNA Sequence Number=SeqID_104747
  Gene Ontology: Mol. function=chromatin binding; Cellular component =chromatin; Biological process=chromatin assembly or disassembly
  Homolog annotation: Hit_ID=Q1SAV4; Match level="QueryCoverage=62%, HitCoverage=32%, E-value=5e-33, Identity=49%"; Hit description =Integrase, catalytic region
MASSSLSELALDRVDSAMETSQQEHQIGRAFVYTGLRGPEPLEQKGRKEEKRGNALSPWPCSSWCLCILLVAIIFGYLQKHLVLKVLPLDFSKNGVPIGQQVIDNIHIGSSSNMLREGNGLLAKGYLVGRSTRPRVARCIIRPFNPTEKFPPCCWLLMNKATQTLFNDVIKHLGLSLRLRVISRTHSQMGTTEAKQLLPKTADE

SEQ ID NO: 221526 - protein, 303 aa, Glycine max
  Coding DNA Sequence Number=SeqID_104748
  Gene Ontology: Mol. function=calcium ion binding; Cellular component =membrane; Biological process=protein amino acid phosphorylation
  Homolog annotation: Hit_ID=Q2PP76; Match level="QueryCoverage=70%, HitCoverage=82%, E-value=3e-67, Identity=60%"; Hit description =Lectin-like protein
  Pfam annotation: Domain name=Lectin_legB; Domain location=31-246; Score=200.0; E_value=5.6e-57; Accession=PF00139.10; Description =Legume lectin domain
MAIKNSRAQTQTLFSILVLIISFLALVHNVKSVSFSFPSFGSYTNDITLQGDAYVNSEGAIKLTPVAPNSVGRASYAAPVHLWDAKTGKLAGFNTTFSFVVMPNVPGLFGDGIAFFLAPFNSNIPNNSSGGFLGLFSPNYALNVYKNQIVAVELDSFSGNPWDPPSAHVGIDVNSIASVATRKWETGNAVNGFVAYANLNYEPVGKSLNVLVTYPGSKVNATSLSFVIDLRTVLPEWVTVGFSVFELKQWLNLMEALNNVWKILKTVLINPSLKIHYDIGSWKIDVECERKCVPRASLRPNLI

SEQ ID NO: 221527 - protein, 369 aa, Glycine max
  Coding DNA Sequence Number=SeqID_104749
  Gene Ontology: Mol. function=RNA-directed DNA polymerase activity; Cellular component=chromatin; Biological process=chromatin assembly or disassembly
MVLGVQWLKYLGPVLTDYNMLSIKFSHEGRLVELQDYHALNAITIKDCFLISTIDELLDELGGTSWFSKLDLLQGYHHIRMHEQDIGKTGFCTHHGHYEFKSYTGRTRDSFGEGTPDSSGRAICFEDWPIPQSTLALRSFLGLAGFYRCFIRGYASIATPLHHLMTKDSFVWSNTAQQAFDMLKEALTTTLVLLLRNFFLPFTLDMDVFRVGMGVVLSQNGHPIAFFSKLISPKVLRASTYVREPCAITTAVVQTPEARLLGYDYRIQYRAGKHNLAADALSRLPDSTTSTMLLLSIPSPKFLEELKKQSSNDPVANDFILKRDHIWLPQGSKFILMLLEEYHSTPTRGHMGIAKTFARLTENFNWSGL

SEQ ID NO: 221528 - protein, 250 aa, Glycine max
  Coding DNA Sequence Number=SeqID_104750
  Gene Ontology: Mol. function=nucleic acid binding; Biological process= DNA integration
  Homolog annotation: Hit_ID=Q1SXR1; Match level="QueryCoverage=36%, HitCoverage=5%, E-value=4e-28, Identity=64%"; Hit description =Integrase, catalytic region; Zinc finger, CCHC-type
MLKGVAREEVTCLTKDFNKFLESSNNLIMLLKFNQHPHDKSGVCLEKETSSSKSQSDLEKCDFCGERSMFLDLNSVEGGIVVVGSSGKGKITNIGKIGIPSLASTDNVLCCFHFHTVITVAHGSIGTNKNVESGRSDHGTEFENVEFKSFYERNVSKREPKTIETTLTYDDWIIAMEEELHQFTRNGVWKLVHKSKSKSIIGTRWVLKKKLDEKGKVVRNKARLVSQGYNQQGGIDFTKTFTLIARLKAI

SEQ ID NO: 221529 - protein, 172 aa, Glycine max
  Coding DNA Sequence Number=SeqID_104751
MCDLKEEETSDASENLGDKLHSKELAGMHLAGKIIPTQNFDEYLDTLDDILGMPNTDIRPSNDVSHDFCSLVSSNDDVAQVAMLVSQVHKDTNLSVDQLVELKLVEQISLLSDAYLEAKGKFKEAQKLLADLEEKKLKVSSLEKDYIELKHKMLYMIFADVAFGPMGPGPNK

SEQ ID NO: 221530 - protein, 198 aa, Glycine max
  Coding DNA Sequence Number=SeqID_104752
MSILTPGSRKEKKRQFPIKEWEKVKKEERKGKERKFLIKEAEEMCRKRIQGTNRLRILCPNTLEGTSFVAQVEGTSTWVVILRKREGTSLAYQFKWRVHPLGFSKRTREGTSLVDLWLVKDFTRLKEISRTVGFLGTGCNHGLLPNQPLDPTGASEGVGCGGVCWSALIMLGGEMRGGDVGVVELGDWLCSGEDWILA

SEQ ID NO: 221531 - protein, 51 aa, Glycine max
  Coding DNA Sequence Number=SeqID_104753
MEGAKPMKTPMHASNPLSKDKSCKPTDKRSTKETELDEKAQVVDAITLDPI

SEQ ID NO: 221532 - protein, 110 aa, Glycine max
  Coding DNA Sequence Number=SeqID_104754
MLRNLTDYVIIPFLPSRMLRNFTDCALTLPFNFWHVTKFTDCATMLSLDFRHVTELHELPNDGCQVPRSGQTRVASQQQMLCKSVLKTMLATSNRLLPSSNRLPESKTLW

SEQ ID NO: 221533 - protein, 67 aa, Glycine max
  Coding DNA Sequence Number=SeqID_104755
MACFHPTCWRALDTYVVGDVGGVATVEAMLSKIILMMPKTQVKNQRVLQSKQVSRIKESFNQDSRFK

SEQ ID NO: 221534 - protein, 85 aa, Glycine max
  Coding DNA Sequence Number=SeqID_104756
  Homolog annotation: Hit_ID=Q1T1E6; Match level="QueryCoverage=56%, HitCoverage=8%, E-value=2e-13, Identity=73%"; Hit description=Zinc finger, CCHC-type; Peptidase aspartic, catalytic
MCGLKQTSPVWYNELKSFLVAYGFFNSRSNSSFFIYKKLLWLMPSLFAHLCPLLALLALLEMTPHVMSPLIAASKAHFITYPSPA

SEQ ID NO: 221535 - protein, 280 aa, Glycine max
  Coding DNA Sequence Number=SeqID_104757
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-28, Identity=36%"; Hit description= UPI00006A17C9 related cluster
GQHVLPFRDLHALAFRGLHVLTFRELHVLPFRGLHVLAFSRLHILALRGLHVLAFRGLQVLPFRELHVVAFRRLHVLTIRGLHALAFRGLHVLPFREIHALAFRGLHVLPFRGLHVLLLSGLHVFTFKGLHVLPFRVLHALAFRGLNVLTFGGLHVLTFRELHVLPLRRLHVLLFRIHVPNFRGLHALALGRLHTLALGGLHTLAFRGLTSSHSEGFTASPSEDYTSSPLEDYRTTRPPLLRATRPRLQRTTFPHLSEDYTTSPSKGCTSDAILPRKGIG

SEQ ID NO: 221536 - protein, 85 aa, Glycine max
  Coding DNA Sequence Number=SeqID_104758
MRIERSFKVVMGPRTRLVVSFKTRKGKQGSKGLSKELSQGKSIWLEAYKNKNASIISKYACELGSINKNQAKAIVHAINGAKHTK

SEQ ID NO: 221537 - protein, 41 aa, Glycine max
  Coding DNA Sequence Number=SeqID_104759
MKLLTARNGFLTQPWLWTDKNKTTYSVTKIQIRTSLVALPC

SEQ ID NO: 221538 - protein, 112 aa, Glycine max
  Coding DNA Sequence Number=SeqID_104760
  Gene Ontology: Mol. function=nucleoside-triphosphatase activity; Cellular component=membrane
  Homolog annotation: Hit_ID=Q1RYI3; Match level="QueryCoverage=58%, HitCoverage=9%, E-value=9e-12, Identity=54%"; Hit description=AAA ATPase, central region
MSQCQPSFTSKWFGEDEKNIGALFTLPAKVDSMIGQRTRIGEHEAMRKRMKDMEKKQREAEGQSSQDASNNKDKEEQEIKARPLNMEDMRQAKSQVDASFASEGSVMNELKQ

SEQ ID NO: 221539 - protein, 241 aa, Glycine max
  Coding DNA Sequence Number=SeqID_104761
MTQQIRDQLKELITEKVTRQLMASLSQMQSQFQSQILYEGSTIVHNTPLLPGQVKVGVEEVKDPDAPVPVPTDEAVVSPAKPPEKPDPKVNDPLYLMTLTIQELFLRPYQVSWDATMFGVFNPDFLLYIKHEDISEIAHGGQCLSISVLQLWTLHLPEKSMRAGISDLYGFLEPQSIQRSRQSQFETKSYIKSWIQSSKRDVYLGAYLNGGHWQMVVIMPKEHLVSSFVHCITGQTTTLRG

SEQ ID NO: 221540 - protein, 110 aa, Glycine max
  Coding DNA Sequence Number=SeqID_104762
MFGSKGENLGKSRRIGPAHGHPGTLDLRGAIDAFLAFYDRKESPVVAILADLYGTFDRRCEKNSARIVCCTTTLYVWLVSHLFRQEVRHVCPLEGHRSCTEKTEATGTDS

SEQ ID NO: 221541 - protein, 150 aa, Glycine max
  Coding DNA Sequence Number=SeqID_104763
MNESYFLGRSHCYFYRGQGWKFSSWVEVYGGLRFWLKRLCRKASHDVCQGVGLASEILCKTGCLHPRYAEIPYGYLHPFARQTQLCPMASRDQVWSFCTQDTRRYLTVIRTLLSSRGGGPDDKQRPSLVILHPRYAEIPYGYSHPFFCYL

SEQ ID NO: 221542 - protein, 165 aa, Glycine max
  Coding DNA Sequence Number=SeqID_104764
DFDSLGIMKASVRITKVCLYMLPNFSQDQQMLCLYGLPLGISACRLTQGSGSGDVGLVQITARYIRLPPDSRVRISKTMFVRITLGYLRLPPDSRVRISRTMFIRITLGYLRLPPDSRVRISKTVLCADNPWVSPYDVELLSHCNKMCGVVDKSRAFAPTYPQLR

SEQ ID NO: 221543 - protein, 93 aa, Glycine max
  Coding DNA Sequence Number=SeqID_104765
  Homolog annotation: Hit_ID=Q1T132; Match level="QueryCoverage=97%, HitCoverage=16%, E-value=1e-07, Identity=30%"; Hit description=IMP dehydrogenase/GMP reductase
MTYLLHLINNMIFADNSSTHIHVTYLKYLNNLNACHEYAWGGEDYVVDKSVATRLKPLRGSGRALLIMERLDDLHMDAIMWCPYKDHRAVRPF

SEQ ID NO: 221544 - protein, 54 aa, Glycine max
  Coding DNA Sequence Number=SeqID_104766
MISVANGINYISDTNIEGNHRETGDNNTNSRPRRDIVKPTYQQWYQLRVQAVDA

SEQ ID NO: 221545 - protein, 303 aa, Glycine max
  Coding DNA Sequence Number=SeqID_104767
MYDKETKTKRKYSTETSYNKSLCYLYPFILSIPPQRNNNSLSIFSIGKTLRRLRKIKGSILHSRPREKKTTYIYPVLCPIRYASLNIYIFLLLFKMAEIPKLDLSSSCFDHREALDSEQKSQKILVSDHINAFQYTADSFVIDMDAFSSGHNKDATNANSRITKLQRSLSRKGSQRLGDRKVNNNATLYDKDIAPAICSPKGALVGPFTPEKPAGMEVGTMDHSMNPHVHHPITTTANNIPTESKCSITRRNSFRRPSSWAIDPKRVLLFFATLSSMGTMLLIYFTLTISKQSADEYGGDWKH

SEQ ID NO: 221546 - protein, 210 aa, Glycine max
  Coding DNA Sequence Number=SeqID_104768
  Gene Ontology: Mol. function=hydrolase activity, hydrolyzing O -glycosyl compounds; Cellular component=cell wall; Biological process= carbohydrate metabolic process
  Homolog annotation: Hit_ID=Q27SZ1; Match level="QueryCoverage=42%, HitCoverage=52%, E-value=8e-40, Identity=84%"; Hit description =Xyloglucan endotransglycosylase
  Pfam annotation: Domain name=Glyco_hydro_16; Domain location=12-189; Score=48.4; E_value=2.4e-11; Accession=PF00722.11; Description =Glycosyl hydrolases family 16
MNPYSSSKLESTQEGQAINKKASNGDYGGLWMKLKWGGIFRISYLQKSHKAKEDKSNKGMQRIGFCCHIKYLDIDDIEGYFSSTSESTIQRCRRCFSLSGDPYTLHTKVFSQGKGNREQQFHLWFDPTKDFHTYSVQWNPASIIFSVNGIPIREFKNLETKGVPFPKNQPMRIYSNSGEKEEPALKWWKFHLTYISNSFKFDILSEERHI

SEQ ID NO: 221547 - protein, 132 aa, Glycine max
  Coding DNA Sequence Number=SeqID_104769
  Homolog annotation: Hit_ID=Q1SD99; Match level="QueryCoverage=98%, HitCoverage=68%, E-value=3e-52, Identity=75%"; Hit description =Harpin-induced protein 1 (Hin1), putative
  Pfam annotation: Domain name=Hin1; Domain location=1-99; Score=-7.2; E_value=0.0062; Accession=PF07320.4; Description=Harpin-induced protein 1 (Hin1)
LQIENPNKDSSIYYDKTILSFLYGEPEDEVGETTIVPFHQGTGNTRDVSDTVNAKPRPFKPLFSAISNATTELKVALITRYRYKTWGIKSKFHGLQLKGILPIDSDGKLSRKKKKYPLSRNSNKLGRFKIRH

SEQ ID NO: 221548 - protein, 122 aa, Glycine max
  Coding DNA Sequence Number=SeqID_104770
  Gene Ontology: Mol. function=acyltransferase activity; Biological process=lipid A biosynthetic process
  Homolog annotation: Hit_ID=Q2HSL8; Match level="QueryCoverage=44%, HitCoverage=27%, E-value=3e-23, Identity=92%"; Hit description =Trimeric LpxA-like
  Pfam annotation: Domain name=Hexapep; Domain location=19-36; Score =18.8; E_value=0.019; Accession=PF00132.14; Description=Bacterial transferase hexapeptide (three rep
  Pfam annotation: Domain name=Hexapep; Domain location=68-85; Score =4.8; E_value=37; Accession=PF00132.14; Description=Bacterial transferase hexapeptide (three rep
  Pfam module annotation: Pfam domain module=Hexapep::Hexapep; Domain location=19-36::68-85
FGFYVDGDGNMIKKPQMLNVIIGNNVEIGANTCIDRGSWRDTVIGDNSKIDNLVQNCLLCGQVGIAGSAIIGDYVTTEGRVAVRDHLSIISKLLLVQLDAASCVTKDIKEPGDYGGFPAVMI

SEQ ID NO: 221549 - protein, 74 aa, Glycine max
  Coding DNA Sequence Number=SeqID_104771
MHIKWEQEKEKAKALLDRRYAGVLCISFEDMMIVLGMQDNESPVRSLLEAILYSLLSAFVYYAVKHRISIKEWC

SEQ ID NO: 221550 - protein, 335 aa, Glycine max
  Coding DNA Sequence Number=SeqID_104772
  Gene Ontology: Mol. function=protein serine/threonine kinase activity; Cellular component=membrane; Biological process=protein amino acid phosphorylation
  Homolog annotation: Hit_ID=Q1T3J5; Match level="QueryCoverage=96%, HitCoverage=51%, E-value=1e-152, Identity=83%"; Hit description =Protein kinase; N-6 Adenine-specific DNA methylase
  Pfam annotation: Domain name=Pkinase; Domain location=21-292; Score =155.8; E_value=1.1e-43; Accession=PF00069.15; Description=Protein kinase domain
  Pfam annotation: Domain name=Pkinase_Tyr; Domain location=21-292; Score=135.7; E_value=1.2e-37; Accession=PF07714.7; Description =Protein tyrosine kinase
  Pfam module annotation: Pfam domain module=Pkinase::Pkinase_Tyr; Domain location=21-292::21-292
KNGIDNHQINLGSLRVATNNFSDLNKLGQGGFGPVYKGKLSDGQEVAIKRLSTCSEQGSEEFINEVLLIMQLQHKNLVKLLGFCVDGEEKLLVYEFLPNGSLDVVLFDPNQRERLDWTKRLDIINGIARGILYLHEDSRLKIIHRDLKASNILLDYDMNPKISDFGMARIFAGSEGEANTATIVGTYGYMAPEYAMEGLYSIKSDVFGFGVLLLEIIAGKRNAGFYHSKNTPSLLSYAWHLWNEGKEMELIDPLLVDSCPGDEFLRYMHIGLLCVQEDAYDRPTMSSVVLMLKNESAMLGQPERPPFSLGRFNANEPGCEDYSLNFLTLSDIVPQ

SEQ ID NO: 221551 - protein, 480 aa, Glycine max
  Coding DNA Sequence Number=SeqID_104773
  Gene Ontology: Mol. function=extracellular matrix structural constituent; Cellular component=proteinaceous extracellular matrix; Biological process=multicellular organismal development
  Homolog annotation: Hit_ID=Q67YL8; Match level="QueryCoverage=95%, HitCoverage=90%, E-value=4e-15, Identity=24%"; Hit description=MRNA, complete cds, clone: RAFL24-22-E06
MIKRSPSRNNRSKGIKVKHSHDKKKEFEENDAKVSVGTQTAYQTLKLGRKDLHPGKDEVNQNEKHEEEEEDDNVEDAYKHDHNEHEEEGNEHESEEKGDKRGVRGGGSEQEEDENKSNEVEDQRGGGDDEIDENDQEQSAVDTDHDEEFTDEEKEEESDEKEKENSRDEEKDGSVENHNSHEAREENYKGDDASSAVTHDTGTTSTESETLLENFDVTSAMNITKSENRPNYTEESNRSQNSSNFNITEAELLGGTSSNATSDKETGSDSLSNTVDSSHLDNTTTTYSDSLSGTGSNLTAAISGGNLTGTSANTSSESNQAQNGTVNATVIEDVKNVQTEGLDQSGNIVSEENLSGSNSTVPGEKEKGHAAADESSNLEGGELENTTKSVASNETEKNSNTEMSETNKNQTISHVENTDATKNEFKGDTQTDETSDSVEHQDTDSSDSHILKNVAEGRTDLDTLPDIRNEGDNRDATATD

SEQ ID NO: 221552 - protein, 151 aa, Glycine max
  Coding DNA Sequence Number=SeqID_104774
MTKRTKSKSEETKSQLTMNDNQIHRGSSSFHQDKTGNRKDKGFLLRRTYLGDKLRLIMNFVPSVKGNQSLPHICSSHVRKKSLCGGISIPRLGETEFFTVGQWIIFSSTQLQQIFDISKLVDDTNFLTWSWLRGWERDFNVLLIDGPQLCL

SEQ ID NO: 221553 - protein, 174 aa, Glycine max
  Coding DNA Sequence Number=SeqID_104775
  Gene Ontology: Mol. function=kinase activity
  Homolog annotation: Hit_ID=Q1T2M9; Match level="QueryCoverage=95%, HitCoverage=5%, E-value=1e-51, Identity=67%"; Hit description=PIK -related kinase, FAT; PIK-related kinase, FATC; Peptidase M, neutral zinc ...
  Homolog annotation: Hit description=metallopeptidases, zinc-binding site; FKBP12-rapamycin- associated protein, FKBP12-rapamycin-binding
MESNDILVEKLLISAVADADVTVRHSIFTSLHGDRGFDEYLAQADNLSAVFAALNDEDFDVREYAISVAGRLSEKNPAYVLPALRRHLIQLLTAEVMFKCLILLVDKAHVWKYSLLMECIGRLKNSFYYMSILFSCCVSSADSKCKEESAKLIGCLIRNCERLIIPYIAPIHKV

SEQ ID NO: 221554 - protein, 61 aa, Glycine max
  Coding DNA Sequence Number=SeqID_104776
MENPKENNKVENHHTVNAVLSLAFVFSATKLADEFGDAEGNMDPNPEQQILDPKLKRIFAN

SEQ ID NO: 221555 - protein, 173 aa, Glycine max
  Coding DNA Sequence Number=SeqID_104777
  Gene Ontology: Mol. function=fatty-acyl-CoA synthase activity; Cellular component=peroxisome; Biological process=jasmonic acid biosynthetic process
  Homolog annotation: Hit_ID=Q9M0X9; Match level="QueryCoverage=69%, HitCoverage=22%, E-value=1e-34, Identity=61%"; Hit description=4 -coumarate--CoA ligase-like protein
MRKEKIPHQAPFAIQAAQLLGRAIGAGLFAITPAGERGMCCKAIKLGNARVFPVTTLSTLEDPPLAKHGLVDKYDLSSLKHIGSGAAPLGKELMKECAKRFPHAIVSQGYGMTETCGIVSVENARMGIRNSGSTGMLVAGMEAQVVSVDTLKPLPPGQLGEIWVRGRVPSSNS

SEQ ID NO: 221556 - protein, 444 aa, Glycine max
  Coding DNA Sequence Number=SeqID_104778
  Gene Ontology: Mol. function=phosphotransferase activity, alcohol group as acceptor; Cellular component=phosphoinositide 3-kinase complex; Biological process=regulation of progression through cell cycle
  Homolog annotation: Hit_ID=Q1T2M9; Match level="QueryCoverage=92%, HitCoverage=18%, E-value=0.0, Identity=84%"; Hit description=PIK -related kinase, FAT; PIK-related kinase, FATC; Peptidase M, neutral zinc ...
  Homolog annotation: Hit description=metallopeptidases, zinc-binding site; FKBP12-rapamycin- associated protein, FKBP12-rapamycin-binding
  Pfam annotation: Domain name=HEAT; Domain location=109-146; Score =16.0; E_value=0.14; Accession=PF02985.12; Description=HEAT repeat
  Pfam annotation: Domain name=HEAT; Domain location=154-190; Score =5.7; E_value=8.6; Accession=PF02985.12; Description=HEAT repeat
  Pfam module annotation: Pfam domain module=HEAT::HEAT; Domain location=109-146::154-190
DFDVREYAISVAGRLSEKNPAYVLPALRRHLIQLLTYLEQSADSKCKEESAKLIGCLIRNCERLIIPYIAPIHKALVARLIDVNANTGTISGVLVTVGDLARVGGFAMRQYIPELMPLIVEALLDGAAVSKREVAVATLGQVVQSTGYVITPYNEYPQLLGLLLKLLNGELVWSTRREVLKVLGIMGALDPHLHKRNQKTLPGPHGDVTRPASDSSQQIQSMDEFPLDLWPSFASSDDYYSTVAINSLMRILRDPSLASYHLKVVGSLMFIFKVLPDLFHTVRTCEDSLKDFITWKLGTLVSIVRQHIRKYLQDLLSLISEFWSAFTLPAPARPGPGYPVSVASSLVLHLVEQLCLALNDEFRTYLPVILPGCIQVLSDAERCNDYTYVLDILHTLEVFGGPKGVMHLIIAKKVGMGSEGAKTLLKVPKESIYCKKCYISGSGP

SEQ ID NO: 221557 - protein, 1504 aa, Glycine max
  Coding DNA Sequence Number=SeqID_104779
  Gene Ontology: Mol. function=phosphotransferase activity, alcohol group as acceptor; Cellular component=cytosol; Biological process =signal transduction
  Homolog annotation: Hit_ID=Q1T2M9; Match level="QueryCoverage=96%, HitCoverage=62%, E-value=0.0, Identity=81%"; Hit description=PIK -related kinase, FAT; PIK-related kinase, FATC; Peptidase M, neutral zinc ...
  Homolog annotation: Hit description=metallopeptidases, zinc-binding site; FKBP12-rapamycin- associated protein, FKBP12-rapamycin-binding
  Pfam annotation: Domain name=FAT; Domain location=405-819; Score =328.2; E_value=1.5e-95; Accession=PF02259.13; Description=FAT domain
  Pfam annotation: Domain name=PI3_PI4_kinase; Domain location=1094 -1368; Score=287.9; E_value=2e-83; Accession=PF00454.17; Description =Phosphatidylinositol 3- and 4-kinase
  Pfam annotation: Domain name=Rapamycin_bind; Domain location=924 -1027; Score=207.3; E_value=3.4e-59; Accession=PF08771.1; Description= Rapamycin binding domain
  Pfam annotation: Domain name=TPR_2; Domain location=450-483; Score =15.2; E_value=0.24; Accession=PF07719.7; Description=Tetratricopeptid e repeat
  Pfam annotation: Domain name=TPR_2; Domain location=612-645; Score =11.3; E_value=1.6; Accession=PF07719.7; Description=Tetratricopeptide repeat
  Pfam module annotation: Pfam domain module=FAT::PI3_PI4 _kinase::Rapamycin_bind::TPR_2::TPR_2; Domain location=405-819::1094 -1368::924-1027::450-483::612-645
MFQVSKWIFEINIVVALRASPGAAAAYNIPPPYLRIAKSLWAMGKNDELRKDAVDALCCLAHALGEDFTIFIPSIHKLLQKYRLRHKEFEEIEGRLQRREPLILGITASQRLNRRLPVEVISDPLDDVEIDPYEDGSDAHKLRDHQVNDGRLRTAGEASQRSTKEDWAEWMRHFSIQLLKESPSPALRTCARLAQLQPFVGRELFAAGFVSCWAQLNETSQKQLVQNLEMAFSSPNIPPEILATLLNLAEFMEHDEKPLPIDIRLLGALAEKCRAFAKALHYKEMEFEGARSKKMDANPVAVVEVLIHINSQLHQHEAALGILTYAQQHLDFQLKESWYEKLQRWDDALKAYTAKASQATSPHLVLDATLGKMRCLAALAQWDELNILCKEFWTPAEPAARLEMAPMAASAAWNMGEWDQMAEYVSRLDDGDETKLRGLGNTAASSDGSSSGTFFRAVLLVRRGKYDEAREYVERARKCLATELAALRLFAMRRYEGGMLYAALPLHMQRGCFRIQTHDQQVTKAQLYRCTRARPQVLESYERAYSNMVRVQQLSELEEVIDYRTLPIGNRVADERRALIRNMWTQRIEGAKSNVEALLAVRALVLPPVEDVESWLKFASLCRKSGRISQAKSTLVKLLQYDPEKSPENVRYHGPPQVMLAYLKYQWSLGEDSKRREAFIRLQNLAMELSSAPNIQPVTPSSFTNGLNLSVPLLARVYLNLGSWQWSLSPGLVDESIKDILNAFTKATQYANKWAKAWHKWALFNTAVMSHYTLRGFPDVAAQFVAAAVTGYFHSIACAANSKGVDDSLQDILRLLTLWFNHGATAEVQMALKKGFSLVNINTWLVVLPQIIARIHSNNHAVRELIQSLLVRIGQNHPQALMYPLLVACKSISNLRKAAAQEVVDKVRQHSGVLVDQAQLVSKELIRVAILWHEMWHEALEEASRLYFGEHNIEGMLNVLEPLHEMLEEGAMKNNVTIKERIFIEAYRQELLEAYECCMNYKRTGKDAELTQAWDIYYHVFRKIDKQLQSLTTLDLESVSPELLECRNLELAVPGSYRADAPVVTIASFARQLVVITSKQRPRKLTIHGSDGDDYAFLLKGHEDLRQDERVMQLFGLVNTLLENSPKTAEKDLSIQRYAVIPLSPNSGLIEWVPNCDTLHHLIREYRDARKITLNQEHKCMLSFAPDYDHLPLIAKVEVFEHALHNTEGNDLAREDKLYKEFGSYEHVPPSSFAKPLTLQSAGKGGTCAFVYNKSLVPLGRALCKLVGYLLGLGDRHPSNLMLHRFSGKILHIDFGDCFEASMNREKFPEKVPFRLTRMLVKAMEVSGIEGNFRSTCENVMQVLRTNKDSVMAMMEAFVHDPLINWRLFNFNEVPQMSMLTSNHVPPVVNSEESAPNRELPHPQRGARERELLQAVNQLGDANEVLNERAVVVMARMSNKLTGRDFSTCSSVSNNSLQHAVDHSSLISGDTREVDHALSVKLQVVHYPHDSSPKGLLCEGGALS

SEQ ID NO: 221558 - protein, 45 aa, Glycine max
  Coding DNA Sequence Number=SeqID_104780
METSGLGIQSDKLLKANYAFKGGQSCVVRYNAGASSRQQIAEFSF

SEQ ID NO: 221559 - protein, 327 aa, Glycine max
  Coding DNA Sequence Number=SeqID_104781
MDTSKPQSAKQLKEHLQHHQEPFSLQSYLIERSYMFKNSSSDSSNIQHLYSAKDLKWSIKYDLHKIRKRLLHASGILRSLLYKFIPTEDNQEFSNEEHNSDLYYVHEYLTAHTQATQQTDSLKTLAVSSCHFTNNDVQDKVLPANMFQTLTLPKLRRSEVDKGTKPYWITSKENRQQFSRESGWKEPLPNAVCDLKSSEGQAPTLSQKLVREYVRKLLVNSNILKFRRAKKDKDKIQEICGRYRRKQLQFDYVENEGKAVSESEDFNLLEKQYRQVKKMSQLLYAESCVASEEWKSFQIVNWEICKEIGDSITDEIVREIIDLIRLG

SEQ ID NO: 221560 - protein, 303 aa, Glycine max
  Coding DNA Sequence Number=SeqID_104782
  Homolog annotation: Hit_ID=P49200; Match level="QueryCoverage=38%, HitCoverage=94%, E-value=1e-54, Identity=91%"; Hit description=40S ribosomal protein S20-1
  Pfam annotation: Domain name=Ribosomal_S10; Domain location=22-117; Score=185.3; E_value=1.5e-52; Accession=PF00338.12; Description =Ribosomal protein S10pS20e
MAYAAMKPTKAGLEEPQEQIHKIRITLSSKNVKNLEKVCADLVRGAKDKRLRVKGPVRMPTKVLNITTRKSPCGEGTNTWDRFELRVHKRIIDLYSSPDVVKQITSITIEPGVEVEGTEESKGVTRQGSGGRWGVQRREELSGTMPVRNQTSLVPMIRNETLTRASVYKYKYNRRKMSYYTEPEVRKMGTIEEDKHCYFEEDDHSNSKANLLYLYPRTRPHVVHSRAVPVPVPVEDEGRGGEIDDRDSKEGKRSEAMAGTGRQRRDGGGGGREARHHEADGTPRARPAYIGPSLVLPLHPSWP

SEQ ID NO: 221561 - protein, 231 aa, Glycine max
  Coding DNA Sequence Number=SeqID_104783
  Gene Ontology: Mol. function=metal ion transporter activity; Cellular component=membrane; Biological process=metal ion transport
  Homolog annotation: Hit_ID=Q8S1N1; Match level="QueryCoverage=95%, HitCoverage=61%, E-value=6e-53, Identity=48%"; Hit description =Putative magnesium transporter
  Pfam annotation: Domain name=CorA; Domain location=2-230; Score =167.5; E_value=3.4e-47; Accession=PF01544.9; Description=CorA-like Mg2+ transporter protein
HQDSSLRVVSLEACLEAACSVLENEAKTLEQEAHPALDKLTSKISTLNLERVRQIKSRLVAITGRVQKVRDELEHLLDDDEDMAEMTAPELSFDNVLGRDSASFSAVTKQLDVEELEMLLEAYFVQIDGTLNKLSTLREYVDDTEDYINIMLDDKQNHLLQMGVMLTTATLVVSAFVVVAGIFGMNIHIELFDDQKAGMTQFLWTVGGSTAGTIFLYVVAIAWCKHKRLLE

SEQ ID NO: 221562 - protein, 647 aa, Glycine max
  Coding DNA Sequence Number=SeqID_104784
  Gene Ontology: Mol. function=kappa DNA polymerase activity; Cellular component=nucleus; Biological process=DNA repair
  Homolog annotation: Hit_ID=Q6JDV7; Match level="QueryCoverage=67%, HitCoverage=74%, E-value=1e-149, Identity=58%"; Hit description=DNA -directed polymerase kappa
  Pfam annotation: Domain name=IMS; Domain location=241-513; Score =133.7; E_value=5.1e-37; Accession=PF00817.11; Description =impBmucBsamB family
  Subcellular localization annotation: CTP_CleavageSite=44; ConfidenceScore=5.47e-01
MSYYNQQQQPPPVGVPPPQAGGVRKGRLSTARIPAAGIPTAGISAATRLSSAALPGAGESVILEVTISGVSEILNDVIHGAELLRSALGSSLPTSWSLEADISYIGYNVGSDTGHQECSDEKRDTVSAEADGSANAMMKGKGTEDDRPWQSYHTVYTTAKAGMELVDKEKVQRVVYEMSKGSKYFQNEERKEAFIKQKIDNLRIQCANLTQEDLAHYQKVADRRIVELEASRDLSRIWLHVDMDAFYAAVETLSNPTLKGKPMAVGSMSMLSTANYEVHYDLDIVSVLSAAMPGFIARKLCPELIFVPTDFKKYTYYSDLTRKVFGRYDPNFIAGSLDEAYLDITEVCRERNVKSEEIAQELRAGVYEETGLTCSAGVAPNRLLAKVCSDINKPNGQYVLPNDRMAVMTFVSSLPIRKGVFGINTCEQMLEKSSYICAFFSQSTAEELAEMLSADMQKEGLSGRTLTLKLKTASFEKYISSSEDILKHAKKLLQAELPISVRLIGLRVSQFNGDKCSAKSDPTQKTITNFITSGDVNRNCSSFPDVADHDFVSNAETDMSIDSRQTGQLDWRDPFDGNYLSDVDYQSCTVQKSDGVEEVQTSSNDATSSHYSGLTEVLGSTSYLGQVEGINVKNGSNLLEDERLDSC

SEQ ID NO: 221563 - protein, 221 aa, Glycine max
  Coding DNA Sequence Number=SeqID_104785
MNALASQCSSGCESGWTLYLEHSFQLNHNASSHTTSQLFKDKQTKKLEEAEEEDLSMVSDASSGPPHLHLPDAQDNGSFYSASKAAKLGKKSKKRQKVKENQHLPSLLDDTASSPVFDFSMVTFTFLALPYLLFLNNFTVTKQQTSAESMLDYSQGFSATYYETTLSFYSNLNQKMEFVTTSKQMFLLYTDKFYFYGWLPQLYNLLQWKILKIDEDGVEGI

SEQ ID NO: 221564 - protein, 105 aa, Glycine max
  Coding DNA Sequence Number=SeqID_104786
MITNITGKEDTKSAHRLSKNLSIFTSSATKEFISSTSYEDAFRLPTKSRRVLFARYLEKKKKKLARVLPFGGQGIAPLKASVASGEDHSSNKAYIPNAINFNYDK

SEQ ID NO: 221565 - protein, 50 aa, Glycine max
  Coding DNA Sequence Number=SeqID_104787
MEDLVVTFVFETDYVMDQCSASVAMPRKLASLSIAEGLVSNCPIRFGFLH

SEQ ID NO: 221566 - protein, 607 aa, Glycine max
  Coding DNA Sequence Number=SeqID_104788
  Gene Ontology: Mol. function=calcium ion binding; Cellular component =integral to membrane; Biological process=protein transport
  Homolog annotation: Hit_ID=P93484; Match level="QueryCoverage=99%, HitCoverage=99%, E-value=0.0, Identity=81%"; Hit description =Vacuolar sorting receptor 1 precursor
  Pfam annotation: Domain name=PA; Domain location=56-168; Score=98.4; E_value=2.1e-26; Accession=PF02225.12; Description=PA domain
MKVWRWLMSLWFVGLVLVPVSIMGRFVVEKNSLRVTSPEKIRGTHDSAIGNFGIPQYGGSMAGNVLYPKDNKKGCKEFDDFGISFKSSPGALPTIVLLDRGSCFFALKVWNAQKAGASAVLVADDVEEPLITMDTPEEDGSSAKYVENITIPSALVGKSFAQKLKDAIIVGDMVNVNLDWREAVPHPDDRVEYELWTNSNDECGLKCDMLMQFVKDFKGAAQILDKGGYTQFTPHYITWYCPHAFTLSKQCKSQCINHGRYCAPDPEQDFSTGYDGKDVVVENLRQLCVFKVANETQKPWVWWDYVTDFQIRCPMKDNKYNKECANAVIKSLGLNIEKIEKCMGDPDADTDNPVLKEEQDAQIGKGSRGDVTILPTLVVNNRQYRDVETNECLTNNGGCWQDKAANITACKDTFRGRVCECPLVDGVQFKGDGYMTCEASGLGRCKINNGGCWHDTRNGHAFSACLDNGGVKCQCPTGFRGDGVKNCEGETYYSLNIDECKEKKACQCPECSCKNTWGSYDCSCSGDLLYMRDHDTCISKTGSQGRSTWAAFWLILLGVVMIAGGAFLVYKYRIRQYMDSEIRAIMAQYMPLDSQAEVPNHVNDQRA

SEQ ID NO: 221567 - protein, 225 aa, Glycine max
  Coding DNA Sequence Number=SeqID_104789
  Gene Ontology: Mol. function=protein binding; Cellular component =integral to membrane; Biological process=protein amino acid phosphorylation
  Homolog annotation: Hit_ID=Q96477; Match level="QueryCoverage=61%, HitCoverage=62%, E-value=3e-47, Identity=65%"; Hit description=LRR protein
  Pfam annotation: Domain name=LRRNT_2; Domain location=22-62; Score =48.8; E_value=1.9e-11; Accession=PF08263.3; Description=Leucine rich repeat N-terminal domain
  Pfam annotation: Domain name=LRR_1; Domain location=114-136; Score =14.4; E_value=0.42; Accession=PF00560.23; Description=Leucine Rich Repeat
  Pfam annotation: Domain name=LRR_1; Domain location=138-160; Score =16.2; E_value=0.12; Accession=PF00560.23; Description=Leucine Rich Repeat
  Pfam annotation: Domain name=LRR_1; Domain location=66-88; Score =13.1; E_value=1; Accession=PF00560.23; Description=Leucine Rich Repeat
  Pfam annotation: Domain name=LRR_1; Domain location=90-112; Score =19.7; E_value=0.01; Accession=PF00560.23; Description=Leucine Rich Repeat
  Pfam module annotation: Pfam domain module=LRRNT_2::LRR_1::LRR_1::LRR_ 1::LRR_1; Domain location=22-62::114-136::138-160::66-88::90-112
  Subcellular localization annotation: CTP_CleavageSite=19; ConfidenceScore=5.05e-01
MSSLVFVFALFVFLQRPLSCLSNSQVDALSALRSRLSDPKNVLESWDTSLVDPCTWFHVTCDSNNNVIRLDLGHNDLSGTLAPELAQLSSLQYLELYGNQISGTIPEQLGNLKSLISMDLYDNLLEGNIPNSFGNLKSLKFLRLNNNKLTGSIPKEVIDLNLQVLKIGQRIKHARITAPLTKNVRKEAKHITRISNKAGGEQKMLTVELCKVYKAANSRRHSYSI

SEQ ID NO: 221568 - protein, 741 aa, Glycine max
  Coding DNA Sequence Number=SeqID_104790
  Gene Ontology: Mol. function=binding; Cellular component=plastid chromosome; Biological process=positive regulation of transcription, DNA-dependent
  Homolog annotation: Hit_ID=Q6ZLH4; Match level="QueryCoverage=89%, HitCoverage=84%, E-value=0.0, Identity=56%"; Hit description =Putative pentatricopeptide (PPR) repeat-containing protein
  Pfam annotation: Domain name=PPR; Domain location=120-154; Score =44.3; E_value=4.1e-10; Accession=PF01535.11; Description=PPR repeat
  Pfam annotation: Domain name=PPR; Domain location=155-190; Score=6.8; E_value=1.2; Accession=PF01535.11; Description=PPR repeat
  Pfam annotation: Domain name=PPR; Domain location=191-225; Score =42.5; E_value=1.5e-09; Accession=PF01535.11; Description=PPR repeat
  Pfam annotation: Domain name=PPR; Domain location=226-260; Score =45.9; E_value=1.3e-10; Accession=PF01535.11; Description=PPR repeat
  Pfam annotation: Domain name=PPR; Domain location=261-295; Score =52.2; E_value=1.7e-12; Accession=PF01535.11; Description=PPR repeat
  Pfam annotation: Domain name=PPR; Domain location=296-330; Score =41.3; E_value=3.4e-09; Accession=PF01535.11; Description=PPR repeat
  Pfam annotation: Domain name=PPR; Domain location=331-365; Score =32.5; E_value=1.5e-06; Accession=PF01535.11; Description=PPR repeat
  Pfam annotation: Domain name=PPR; Domain location=366-400; Score =31.8; E_value=2.4e-06; Accession=PF01535.11; Description=PPR repeat
  Pfam annotation: Domain name=PPR; Domain location=401-435; Score =46.1; E_value=1.2e-10; Accession=PF01535.11; Description=PPR repeat
  Pfam annotation: Domain name=PPR; Domain location=436-470; Score =35.1; E_value=2.5e-07; Accession=PF01535.11; Description=PPR repeat
  Pfam annotation: Domain name=PPR; Domain location=471-505; Score=0.7; E_value=6.2; Accession=PF01535.11; Description=PPR repeat
  Pfam annotation: Domain name=PPR; Domain location=506-540; Score =10.9; E_value=0.38; Accession=PF01535.11; Description=PPR repeat
  Pfam annotation: Domain name=PPR; Domain location=541-575; Score =21.2; E_value=0.0037; Accession=PF01535.11; Description=PPR repeat
  Pfam annotation: Domain name=PPR; Domain location=576-610; Score =34.8; E_value=3.1e-07; Accession=PF01535.11; Description=PPR repeat
  Pfam annotation: Domain name=PPR; Domain location=611-645; Score =51.3; E_value=3.2e-12; Accession=PF01535.11; Description=PPR repeat
  Pfam annotation: Domain name=PPR; Domain location=646-680; Score =32.9; E_value=1.1e-06; Accession=PF01535.11; Description=PPR repeat
  Pfam annotation: Domain name=PPR; Domain location=681-715; Score=6.8; E_value=1.2; Accession=PF01535.11; Description=PPR repeat
  Pfam annotation: Domain name=PPR; Domain location=85-119; Score=5.5; E_value=1.7; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR; Domain location=120-154::155-190::191-225::226-260::261-295::296-330::331 -365::366-400:...
  Pfam module annotation: Domain location=:401-435::436-470::471 -505::506-540::541-575::576-610::611-645::646-680::681-715::85-119
PDTASVWASPWTPTAASPGLLTAFLPQLDLDHVLRPLLLSDHPHPASDILGIIKALGFSNKCDLALAVFHWVRTNNSNTNLFSSSAIPVIIKILGKAGRVSSAASLLLALQNDGVHIDVYAYTCLINAYSSSGRYRDAVNLFNKMQQDGCNPTLITYNVVLNVYGKMGMPWSNVTALVEAMRSRGVAPDLYTYNTLISCCRRGSLYEEAVHLFQQMKLEGFTPDKVTYNALLDVFGKSRRPQEAMKVLQEMEANGFSPTSVTYNSLISAYAKGGLLEEALDLKTQMVHKGIKPDVFTYTTLLSGFEKAGKDDFAIQVFLEMRAVGCKPNICTFNALIKMHGNRGKFAEMMKVFDDIKLCNCSPDIVTWNTLLAVFGQNGMDSQVSGIFKEMKRAGFVAERDTFNTLISAYSRCGSFDQAMAVYKSMLEAGVVPDLSTYNAVLAALARGGLWEQSEKVLAEMEDGRCKPNELSYSSLLHAYANGKEIERMNAFAEEIYSGSVETHAVLLKTLVLVNSKSDLLIETERAFLELRRRGISPDITTLNAMLSIYGRKQMVAKAHEILNFMHETRFTPSLTTYNSLMYMYSRSENFQKSEEILREVLEKGMKPDRISYNTVIYAYCRNGRMKEASRIFSEMKDSALVPDVVTYNTFIATYAADSMFAEAIDVVRYMIKQGCKPDQNTYNSIVDWYCKLDQRHEANSFVKNLSNLDPHVSKEEEKKGSSKCLRMDACRCGCTERWGK

SEQ ID NO: 221569 - protein, 164 aa, Glycine max
  Coding DNA Sequence Number=SeqID_104791
  Gene Ontology: Mol. function=receptor activity; Cellular component =integral to membrane; Biological process=signal transduction
  Homolog annotation: Hit_ID=Q851U1; Match level="QueryCoverage=86%, HitCoverage=87%, E-value=3e-40, Identity=47%"; Hit description =Putative leucine-rich repeat protein
  Pfam annotation: Domain name=LRRNT_2; Domain location=23-63; Score =47.1; E_value=6.1e-11; Accession=PF08263.3; Description=Leucine rich repeat N-terminal domain
  Subcellular localization annotation: CTP_CleavageSite=22; ConfidenceScore=5.01e-01
MSSLVLLSVLFLLLQRPLSSFSANSEGNALHALRSRLSDPSNVLQSWDPNLVNACTWFHVTCDSNNHVIRLDLGNSKLSGTLGPELAQLPHLQYLFVSVSFVSPNPTIHHANLKPPLCSDVSNNDLCGTIPVDGNFESFPMESFENNKLSGPELKGLVPYDFGC

SEQ ID NO: 221570 - protein, 112 aa, Glycine max
  Coding DNA Sequence Number=SeqID_104792
  Gene Ontology: Mol. function=DNA binding; Cellular component=nucleus; Biological process=nucleosome assembly
  Homolog annotation: Hit_ID=O82326; Match level="QueryCoverage=78%, HitCoverage=47%, E-value=9e-17, Identity=51%"; Hit description =Expressed protein
  Pfam annotation: Domain name=SWIB; Domain location=1-89; Score=68.1; E_value=2.8e-17; Accession=PF02201.9; Description=SWIBMDM2 domain
MEDLVGAPEMARTQVLKRIWAYIKDNNLQAYVSMLLHWLTNETLSFLYKCSDPTDKRTINCDEKLKKVFAGKDQVEMLEIARLISPHFLKSERITGGVESRAEKGGSVNCKF

SEQ ID NO: 221571 - protein, 68 aa, Glycine max
  Coding DNA Sequence Number=SeqID_104793
MEREMITMIVDTLPVFYYEKMVGYMPSSFADLVFAGERIEVGLRGGKVDYVASMNRKPGANGENKKEG

SEQ ID NO: 221572 - protein, 102 aa, Glycine max
  Coding DNA Sequence Number=SeqID_104794
MDELINKTQLSPKIIPTSSRRLSGSTKESHFSYSTTVILLPRTKVRDHHRYQPHDTKIVRGISNKVTAPPVYIHNIHLHSAFSTSALSHLNDIINNNNIISH

SEQ ID NO: 221573 - protein, 164 aa, Glycine max
  Coding DNA Sequence Number=SeqID_104795
  Gene Ontology: Mol. function=protein dimerization activity
  Homolog annotation: Hit_ID=Q1SYN6; Match level="QueryCoverage=90%, HitCoverage=27%, E-value=2e-23, Identity=31%"; Hit description=Zinc finger, BED-type predicted
MRALEARKTAFKECVLQVRGINAKVGLRMDVASRWNSTYVMLASEIKYQCAFGCLVICYRNDVHCPSNDDWKRVKKIDDPMIKEMNLKMFAKFTKYWHEYFEILSIGDILDPQLKFKVIRFAYTKIDHSTCEEKITDLRKNIENLFDEYVKAKSSESNSNASTS

SEQ ID NO: 221574 - protein, 248 aa, Glycine max
  Coding DNA Sequence Number=SeqID_104796
EFDANLYNSEGPSPKQARVRGHLVKIDADSLNTYLETPVVLEEAETLPTYSRYYRLPIDHREIEVALYILGRGFILNGKGHPGRILGKDLTTLAQVWSVLSYSNLAPTSHTLNLTMDRARLIFGLVSHMDMNIDALISRQMTSIAQSNSCRLGFPALITALCRAQGVVSDSLTFECLSLAINLAYIRKNCWNIDDLTVAFQGTRRARPTNIPSSSTAPAHTPTSTFAAPSIPAHVDSQRFEAMLQSIH

SEQ ID NO: 221575 - protein, 71 aa, Glycine max
  Coding DNA Sequence Number=SeqID_104797
MGTLTFKSGVILMMTLKKEEDYFHSSLVMFVYVHMMEDTYSWGLHEDQHALRGKDERTKLHGCVRVRVIIV

SEQ ID NO: 221576 - protein, 49 aa, Glycine max
  Coding DNA Sequence Number=SeqID_104798
GEWKLVVETERVEVKREQVAEKTGREVEMLGVWEAQESLTKMIQEENIG

SEQ ID NO: 221577 - protein, 102 aa, Glycine max
  Coding DNA Sequence Number=SeqID_104799
MVEVFAVRVKRSWSLTMVATCMVEDKVKLQRFTEDQKQRIPLMELDLKKNLRVRRQRSMSRTTWTAKHIRILSSQSSSERTTSFEPHSAMPQIKFVNLAAYF

SEQ ID NO: 221578 - protein, 192 aa, Glycine max
  Coding DNA Sequence Number=SeqID_104800
  Gene Ontology: Mol. function=histone deacetylase activity; Cellular component=nucleus; Biological process=histone deacetylation
  Homolog annotation: Hit_ID=Q9LKG1; Match level="QueryCoverage=92%, HitCoverage=35%, E-value=2e-96, Identity=91%"; Hit description =Histone deacetylase
  Pfam annotation: Domain name=Hist_deacetyl; Domain location=18-192; Score=72.3; E_value=1.5e-18; Accession=PF00850.10; Description =Histone deacetylase family
MESGGNSLPSGSDGVKRKVSYFYDPEVGNYYYGQGHPMKPHRIRMTHALLAHYGLLQHMQVLKPTAAKDRDLCKFHADDYVAFLRGITPETQQDQLRQLKRFNVGEDCPVFDGLYSFCQTYAGGSVGGALKLNHGACDVAINWAGGLHHAKKCEASGFCYVNDIVLAILELLKIHESIAAEWSGPYPRRAPL

SEQ ID NO: 221579 - protein, 437 aa, Glycine max
  Coding DNA Sequence Number=SeqID_104801
  Gene Ontology: Mol. function=protein binding; Cellular component =cellulose and pectin-containing cell wall; Biological process =protein amino acid phosphorylation
  Homolog annotation: Hit_ID=Q9LT85; Match level="QueryCoverage=75%, HitCoverage=65%, E-value=1e-95, Identity=54%"; Hit description =Similarity to receptor protein kinase
  Pfam annotation: Domain name=LRRNT_2; Domain location=68-106; Score =21.3; E_value=0.0035; Accession=PF08263.3; Description=Leucine rich repeat N-terminal domain
  Pfam annotation: Domain name=LRR_1; Domain location=144-166; Score =5.0; E_value=33; Accession=PF00560.23; Description=Leucine Rich Repeat
  Pfam annotation: Domain name=LRR_1; Domain location=168-188; Score =7.6; E_value=11; Accession=PF00560.23; Description=Leucine Rich Repeat
  Pfam annotation: Domain name=LRR_1; Domain location=196-218; Score =15.7; E_value=0.17; Accession=PF00560.23; Description=Leucine Rich Repeat
  Pfam annotation: Domain name=LRR_1; Domain location=219-241; Score =8.8; E_value=6.4; Accession=PF00560.23; Description=Leucine Rich Repeat
  Pfam annotation: Domain name=LRR_1; Domain location=242-264; Score =6.3; E_value=19; Accession=PF00560.23; Description=Leucine Rich Repeat
  Pfam annotation: Domain name=LRR_1; Domain location=267-289; Score =2.5; E_value=98; Accession=PF00560.23; Description=Leucine Rich Repeat
  Pfam annotation: Domain name=LRR_1; Domain location=291-313; Score =11.1; E_value=2.4; Accession=PF00560.23; Description=Leucine Rich Repeat
  Pfam annotation: Domain name=LRR_1; Domain location=315-337; Score =8.0; E_value=9.2; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=68-106::144 -166::168-188::196-218::219-241::242-264::267-289::291-313::315-337
MGTRYMCALLILSLLLHSFMFIGAEEGVGGRETIRASGHVQGGYFYGSPPPPPPKCHPPPPPPPPVRLERARRALEKFTRLVDDPNGYTSNWKGSDACKFRGVRCAKYPDGQQAVAGLDLNGAGLSGKKCTALMLSGLLDRIPELTFFHVNSNNFSGAIPTDITKYKFFFELDLSNNKLEGEFPKEVLQPKPKDQQLVFLDLRFNRLSGPIPPQLFDLDLDVIFINNNEFTGNLPDNFGSTPARYLTFANNQLTGPIPPSIGKASKTLTEVLFLGNHFQGCLPFQIGYLVKATVFDVSKNSLTGPIPHSFACLASIQFLNLEHNQFYGEVPEMLCQLPGLRNNGSLSLSDNYFTQVGPACRNLIKNKVLDVSNNCILGLPNQRPHGQCTEFFSKIKPCPNPKNLHYVPCKGYYPHTHPAAAAPPLTYNSLNPHHLHR

SEQ ID NO: 221580 - protein, 132 aa, Glycine max
  Coding DNA Sequence Number=SeqID_104802
  Gene Ontology: Mol. function=kinase activity; Biological process =response to cold
  Homolog annotation: Hit_ID=Q1ENY2; Match level="QueryCoverage=72%, HitCoverage=55%, E-value=4e-12, Identity=39%"; Hit description=C2 domain-containing protein / protein kinase-related
MSSITGIQGQPLEVTGMYDFEFMDGSGFVLQVEGHRMDFKTRSSLTHDDLDLPDGGKNPVFQEKFIFPLIEGLRELNVLVWNSNTLTFDDFIGSGKYDTIALCLFLPSIILSFLLFFDLQDSIAQGSLSRLR

SEQ ID NO: 221581 - protein, 134 aa, Glycine max
  Coding DNA Sequence Number=SeqID_104803
  Homolog annotation: Hit_ID=Q1SQE1; Match level="QueryCoverage=52%, HitCoverage=21%, E-value=1e-17, Identity=67%"; Hit description=Seed maturation-like protein, putative
MRTKRGDKGKRSKGEEEAVFGDSEDDSEVVGGEQSEHGGNGLLHGFSGGGGHTFRDGRVVKGLDAAEDGGDHGEAAVEVARGDNVIGEAGGDEAAAAAHEGEEDGGWRRRRERGRLRSSGAKNSSKTCAAPAAT

SEQ ID NO: 221582 - protein, 235 aa, Glycine max
  Coding DNA Sequence Number=SeqID_104804
  Gene Ontology: Mol. function=histone deacetylase activity; Cellular component=nucleus; Biological process=histone deacetylation
  Homolog annotation: Hit_ID=Q94F82; Match level="QueryCoverage=62%, HitCoverage=28%, E-value=4e-82, Identity=97%"; Hit description =Histone deacetylase HDA101
  Pfam annotation: Domain name=Hist_deacetyl; Domain location=5-234; Score=183.5; E_value=5.2e-52; Accession=PF00850.10; Description =Histone deacetylase family
MGPCSAVFKKAADSAKNSSFQQLQMVHLETRRIGAFGHWGGADPQNSACAVVFSETRDDFKLTRQLFRMFSFHIAYFNNLRVLYVDIDIHHGDGVEEAFYTTDRVMTVSFHKFGDYFPGTGDIRDIGYGKGKYYSLNVPLDDGIDDESYQSLFKPIMGKVMEIFRPGAVVLQCGADSLSGDRLGCFNLSIKGHAECVRHMRSFNVPLLLLGGGGYTIRNVARCWCYEVMCGVITH

SEQ ID NO: 221583 - protein, 108 aa, Glycine max
  Coding DNA Sequence Number=SeqID_104805
  Subcellular localization annotation: CTP_CleavageSite=40; ConfidenceScore=5.16e-01
MAVQKWEVVWQPWKLRLASSVGGGSGRWSGSHGRQSGRLRMTSGVGCGSGGWKLKSWFRGYQCLQNKEEEKNTWNLRTKLPPRTKRKRKENSAISHILWKRHYNRYIY

SEQ ID NO: 221584 - protein, 68 aa, Glycine max
  Coding DNA Sequence Number=SeqID_104806
MGSLAQDSASPHREDEGLTAQVADPSTPEDQTTPVLSPNTSPPATPVLHLTNEEDVQTQDTQDRSQDF

SEQ ID NO: 221585 - protein, 559 aa, Glycine max
  Coding DNA Sequence Number=SeqID_104807
  Gene Ontology: Mol. function=calcium ion binding; Biological process =cell adhesion
  Homolog annotation: Hit_ID=Q1XJL1; Match level="QueryCoverage=98%, HitCoverage=30%, E-value=5e-94, Identity=38%"; Hit description =Thrombospondin type 3 repeat:YD repeat precursor
GIDIYYDKLAYPTSNFVVLSVNYYDSYPRDAPSVIPEKILDQYVLLATFGTGNTTSTKSLKTASYLKNIEDDKWTKTYHYYDFKGRQIATKTTNHLEGYTNKESKLDFSGLATESYTYHKRTPTETEVKIKERFVYDNGNRLLKQYHQVDSKPEELLVENTYNEIGQLINKKTGNTTGTPLQSIDLTYNIRGWLTKVNNPANLNGKLFGYEIRYQNPIYSSVSTGKYNGNIAEMDWSNANNGIFRRYNYKYDGLDRLKDGIYSEPNTTTPQNNYYNESMTYDVNGNIQSLKRNMLIQNLGTQVMDDLSYIYAGNRLSSVKESAGNYIGYPDSSQNPISYDDNGNMTDHVDRGILKIDYNYLNLPDYVKFDKTYLPRDLNPGVLDYNVNTRYLYNAEGVKLRKVYTYGSGRGQMETVEKTDYLDGFQYTNDKLSFVPTSEGYFDFVQNKYIYNYTDQVGNIRLAYYKDASGNPKIDRVTDYYPFGLEFGDYLGTSLSISPNYKYSSQGQEKQMETGWSSYKWRNYDSAMGRFLNVDPLSEKYAYQSHYNFSENRVIMQES

SEQ ID NO: 221586 - protein, 69 aa, Glycine max
  Coding DNA Sequence Number=SeqID_104808
  Gene Ontology: Mol. function=nucleic acid binding
  Homolog annotation: Hit_ID=Q1SJY4; Match level="QueryCoverage=98%, HitCoverage=14%, E-value=2e-10, Identity=47%"; Hit description=Zinc finger, CCHC-type
MKLFLESKDVDLWDIIKIDSYKPTRRNQARVEINKPKAEWTQEEKPRVLLNSRAMFFLKCALSESEYDK

SEQ ID NO: 221587 - protein, 85 aa, Glycine max
  Coding DNA Sequence Number=SeqID_104809
MDELVDSLKVHEKELMDELQLPKGNAIALKNSDDELSKEEEELAFLTKRVQYFLEGEKGQEGTSSKDTFNKEKPLGKSDALNEQA

SEQ ID NO: 221588 - protein, 156 aa, Glycine max
  Coding DNA Sequence Number=SeqID_104810
MDKVKDNRKQNSSNHVEGSQTPLGFIPQTTTHVPPPLPQAQERHRKHIYAQNPKCKHPRKDPLKSVPYGPNSRLGSDKVVGKKPISPPQDPSAQPYHPKGSTLKDDGPLSSKSPNLQYVPTLTIQKSTHTLPTSNEINDNTTMMETTPKHDPGPQQ

SEQ ID NO: 221589 - protein, 102 aa, Glycine max
  Coding DNA Sequence Number=SeqID_104811
  Gene Ontology: Mol. function=RNA-directed DNA polymerase activity; Biological process=RNA-dependent DNA replication
MRLPIAEVKGATFYQARANKFLEFVHYCSLLDIEAEGSKFAWFHKDQNGTNKAKKLDRVLVDSTWNHAFPGAYAINLPRIYSNHCPIILYLRDNGTSKRGRP

SEQ ID NO: 221590 - protein, 54 aa, Glycine max
  Coding DNA Sequence Number=SeqID_104812
MGSKIYPKDCISLEVEDVMGVKDGEGDDRVVAERGDRASGKTVEEDFVNGGLQL

SEQ ID NO: 221591 - protein, 157 aa, Glycine max
  Coding DNA Sequence Number=SeqID_104813
  Gene Ontology: Mol. function=DNA binding
  Homolog annotation: Hit_ID=Q1SFS3; Match level="QueryCoverage=93%, HitCoverage=28%, E-value=2e-17, Identity=32%"; Hit description =Lambda repressor-like, DNA-binding
MVEVSVEAIASLTQYYDQPLRCFTFRDFQLVPIVEEFEEIMGCPLGGRKPYLFSRFYPSMEKVVKVVKISIQELDHVKQNRNGVVEIPRKHLEEKAKALADQGEWASFIDILTLLIFGFVLFPNVDGLVDLEAIDAFLAYHHSKESPIIAILADVYD

SEQ ID NO: 221592 - protein, 88 aa, Glycine max
  Coding DNA Sequence Number=SeqID_104814
MGIRIGGGEGIKEGNKRMMREKREFPKEEFSGFRFGSAYSCLACSARLAQVPVFALSAEISKFEPGHDMLRITRLSVAGGMCWASIYI

SEQ ID NO: 221593 - protein, 361 aa, Glycine max
  Coding DNA Sequence Number=SeqID_104815
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q8RZF8; Match level="QueryCoverage=93%, HitCoverage=85%, E-value=1e-117, Identity=57%"; Hit description =Lustrin A-like
  Pfam annotation: Domain name=DUF231; Domain location=201-358; Score =263.7; E_value=3.8e-76; Accession=PF03005.6; Description=Arabidopsis proteins of unknown function
MEWSFSISVVLFLTLLIQIHGSGYLDHKQARGFAENYGCNLFQGSWVYDDSYPLYETSQCPFIEREFDCQNNGRPDKFYLKYRWQPAGCNLTRFNGEDFLTRLRGKSIMFVGDSLGLNQWQSLTCMLHIAMPQAPYNLARNGDVSIFTFLTYDVKVMFSRNALLVDIVGESIGRVLKLDSIQAGQTWKGIEVMIFDSWHWWIHTGRKQPWDLIQVGNHTYRDMDRLVAYEIALNTWAKWVDYNIDPTRTRVFFQGVSPDHQNPAQWGEPRANLCEGQTRPILGFRYPGGPLPAELVLEKVLRAMQKPVYLLDITTLSQLRIDGHPSVYGFGGHLDPDCSHWCLAGVPDTWNELLYASLVKN

SEQ ID NO: 221594 - protein, 50 aa, Glycine max
  Coding DNA Sequence Number=SeqID_104816
MALNEKLGASGNEKEQLTSDDDVGVILRRKAARELRLRFHGGGGGGSLNL

SEQ ID NO: 221595 - protein, 301 aa, Glycine max
  Coding DNA Sequence Number=SeqID_104817
  Gene Ontology: Cellular component=integral to membrane; Biological process=red or far red light signaling pathway
  Homolog annotation: Hit_ID=Q6R8G0; Match level="QueryCoverage=84%, HitCoverage=36%, E-value=6e-57, Identity=46%"; Hit description=PHO1 -like protein
  Pfam annotation: Domain name=SPX; Domain location=1-289; Score=46.6; E_value=8.2e-11; Accession=PF03105.10; Description=SPX domain
MVFSSSLVIEKSFFHMVILAASTSLLLACKHMNNHTTKGVRLRLERAFSGIHLQGSNHQREGDIEDQAIEVKTLEQDGSRQLYKTNFQKFDEEGGEVEARLFQKLDEELNKVNAFYKDQVEAAQHEVTLLSKQMEALVALRVKIISSPEETMDESHQQKDSMVGPEDNALQQANRNTHHEEQAEANNNYITKDPLEILQHVKVDNVPQSPISTIKKAFTDSSDNELSFSKEELRKVEEQLRLVFVEFYQKLLHLKDYSFMNLSAFSKIMKKYEKHTSRAASAAYITVVDNSYVGSSDELQS

SEQ ID NO: 221596 - protein, 89 aa, Glycine max
  Coding DNA Sequence Number=SeqID_104818
MDIIIGIFFSGLEATHHELGPQTEKKGKKPAVSKCKDKFPLNPIPKSKSYLEVISYQVEALSSLHDLGKWKGSGFSTPLFRAKSLISSL

SEQ ID NO: 221597 - protein, 88 aa, Glycine max
  Coding DNA Sequence Number=SeqID_104819
MGFERPSAPLTNTPTKPGFFGSGVLRIDFLLTAFFSGGSDTKIETEEGKESTQQQTSIWGKNGGRMLIVSGNQKLLRPREMCLWAVQC

SEQ ID NO: 221598 - protein, 199 aa, Glycine max
  Coding DNA Sequence Number=SeqID_104820
  Homolog annotation: Hit_ID=Q2QM63; Match level="QueryCoverage=47%, HitCoverage=29%, E-value=8e-25, Identity=60%"; Hit description =Transducin family protein, putative, expressed
  Pfam annotation: Domain name=WD40; Domain location=24-72; Score=23.4; E_value=0.00084; Accession=PF00400.22; Description=WD domain, G-beta repeat
MELNGLLYTGGEDRNITAWDIKTGKIAYCLEEAHTARVKGIVALTESDGATGDDDPYLVASASSDGIIRVWDVRMAAREKPLTEHNTRSRLTCLAGSSLKFKRQRPQDGKSKSKVVKQQRALSGKSKSKDYDTDNPPYPLLPSLHPTTICCLAWDTNTKLASPSALILSFASLDMPKSFQTCVYLNGTSIQLHLVSWQV

SEQ ID NO: 221599 - protein, 146 aa, Glycine max
  Coding DNA Sequence Number=SeqID_104821
  Gene Ontology: Mol. function=DNA binding; Cellular component=oxygen evolving complex; Biological process=DNA integration
  Homolog annotation: Hit_ID=Q0KIN0; Match level="QueryCoverage=93%, HitCoverage=9%, E-value=2e-36, Identity=48%"; Hit description =Integrase core domain containing protein
MADPRMNTFSPMAKIAYVHLFLAMAAIQQWQFHYLDIKMPSYMSASRAWFDRFSFALLQFGMTCCEADHSVFFIHSLSSRCIYFIVYVDDIAITGNDSEGILRLKSHLRSQFQTKDTGPLNYFLGIEVVGSSSSIAISQQKYALIS

SEQ ID NO: 221600 - protein, 39 aa, Glycine max
  Coding DNA Sequence Number=SeqID_104822
MEIVGTSSNGSEVIIVGNGHQRKFVIGVEGNLLVKVKVV

SEQ ID NO: 221601 - protein, 100 aa, Glycine max
  Coding DNA Sequence Number=SeqID_104823
MGMSSICDTDEGTVGAEYDSRELGDGTTSGSCGRLWLAEVYQEQQLGWHNRWNTRVNLQRNIFNSGTREGKMHNLKEVKDNNNNNLFEDESNKRKDTLWT

SEQ ID NO: 221602 - protein, 112 aa, Glycine max
  Coding DNA Sequence Number=SeqID_104824
MEMLTCMTTMVWSWSLVNMVFEGFTTSEREGGVNGMKYIEPHDSPYPCVPIPPSQHKVPFSSGVQCGREGLRRNLQHAHVCTPLTEQDQTETINADRNGMDNSLELIKVNKG

SEQ ID NO: 221603 - protein, 183 aa, Glycine max
  Coding DNA Sequence Number=SeqID_104825
  Subcellular localization annotation: CTP_CleavageSite=23; ConfidenceScore=5.06e-01
MANPTLQVPSSFIAPHAIAFPARDAHASSLDRRVMPISTYTLAILLATLPILRLRLCWSLDNLGEGYSHLRTIPWEAIDSSLCNFLWFTLGPNLQQQFQAFLTCYEIWNKAKKLVNNYFASPLCAPLNHPLHKLEIPLLLSPILLIVVDETKVVVVNDILFVAIIATFMVILKPNVTTRLVIK

SEQ ID NO: 221604 - protein, 215 aa, Glycine max
  Coding DNA Sequence Number=SeqID_104826
MKVAPIVVFLFRDTEGFASAISQALHANPSSSFTRQEDFFELSLEAYGIKHLKTSGSVSHFVDDHGAYKVTIVAMEHYEPPVLACALNEVKGHSKSLRSDESKPLIFGTKIGQNTDIMQALLNKTQEPPSSLGVQHETFACFLHFVHVMQLPTFFLIGQASQYLDNKSTKQHEILHAIGEILASTTGLQFSEDRVVWNPKKASGESKEPWRALYG

SEQ ID NO: 221605 - protein, 69 aa, Glycine max
  Coding DNA Sequence Number=SeqID_104827
MRVQVGFLNFLGFQFLKLVDNFVIITVEECYLSPNNNTTPAASLPSNSETCLQLHGGWFCGSNNGLTGD

SEQ ID NO: 221606 - protein, 83 aa, Glycine max
  Coding DNA Sequence Number=SeqID_104828
MRIKRSFKVVMGPRTRLIWLEAYKNKMPKSSPNMHVKQEVSTRVKPRLLCKQSMGQNTPNKIDNDGSNSHKGKSITFNSSFQN

SEQ ID NO: 221607 - protein, 87 aa, Glycine max
  Coding DNA Sequence Number=SeqID_104829
MVEINSRDAICFQLFNSWESVFEECQKCHFDIVQGKYYIRVKDMGNEEAPSVQDVTVTTKCSSRIVGSEADHLNYVHGLSADIIDRS

SEQ ID NO: 221608 - protein, 309 aa, Glycine max
  Coding DNA Sequence Number=SeqID_104830
  Gene Ontology: Mol. function=oxidoreductase activity; Cellular component=outer membrane-bounded periplasmic space; Biological process=electron transport
  Homolog annotation: Hit_ID=P75804; Match level="QueryCoverage=99%, HitCoverage=83%, E-value=1e-124, Identity=66%"; Hit description =Hypothetical protein yliI precursor
  Pfam annotation: Domain name=GSDH; Domain location=200-307; Score =231.3; E_value=2.2e-66; Accession=PF07995.2; Description=Glucose Sorbosone dehydrogenase
VLQDKLDHPWSVAFLPDQQTLLITERSGQLRSWQPGRGLSQPISGVPDVWANRQGGLLDVVLAPDFAQSRRVWLSYTTADDTGRAGGVVGYGTLSADLRQLQDFKVVLEQTPKLSGGANIGTRLAFDRQGYLYIAFGDNFASRSAQQLDKLSGKIVRLTQDGKVPADNPFNHRQGARAEIWSYGVRNPQGLALNPWTQQMWESEHGPRGGDEVNLAAKGKNYGWPLATYGIDYSGQKVPEAQGSAVAGTEQPLFYWQQSPAISGMAFYNSARFPQWKNSLFIGALKDKSLIRLRVNGEKVEEAQRLLSD

SEQ ID NO: 221609 - protein, 179 aa, Glycine max
  Coding DNA Sequence Number=SeqID_104831
  Gene Ontology: Mol. function=calcium ion binding; Cellular component =mitochondrion; Biological process=embryonic development ending in seed dormancy
  Homolog annotation: Hit_ID=Q6ZHK7; Match level="QueryCoverage=87%, HitCoverage=23%, E-value=2e-64, Identity=72%"; Hit description =Putative fertility restorer homologue
  Pfam annotation: Domain name=PPR; Domain location=131-165; Score=2.9; E_value=3.4; Accession=PF01535.11; Description=PPR repeat
  Pfam annotation: Domain name=PPR; Domain location=27-61; Score=40.9; E_value=4.3e-09; Accession=PF01535.11; Description=PPR repeat
  Pfam annotation: Domain name=PPR; Domain location=62-96; Score=10.7; E_value=0.4; Accession=PF01535.11; Description=PPR repeat
  Pfam annotation: Domain name=PPR; Domain location=97-130; Score=4.4; E_value=2.2; Accession=PF01535.11; Description=PPR repeat
  Pfam module annotation: Pfam domain module=PPR::PPR::PPR::PPR; Domain location=131-165::27-61::62-96::97-130
MADEGCPGSHIVTMLSWMREGCEQTVYTFTILISELFKERRNEEALKLWDEMIDKGVTPNLACFRALSIGLCLSGKVARACKVLDELAPMGIVLDSAYEDMIAVLCKAGRVKEACKLADGIVDRGREIPGKIRTVLINALRKAGNADLAIKLMHSKIGIGYDRMRSVKKRVKFQTLVDS

SEQ ID NO: 221610 - protein, 815 aa, Glycine max
  Coding DNA Sequence Number=SeqID_104832
  Gene Ontology: Mol. function=transmembrane receptor activity; Cellular component=integral to membrane; Biological process=signal transduction
  Homolog annotation: Hit_ID=Q8GF11; Match level="QueryCoverage=32%, HitCoverage=59%, E-value=1e-128, Identity=83%"; Hit description=Fe-S oxidoreductase
  Pfam annotation: Domain name=HAMP; Domain location=547-616; Score =58.6; E_value=2e-14; Accession=PF00672.15; Description=HAMP domain
  Pfam annotation: Domain name=MCPsignal; Domain location=647-815; Score=225.9; E_value=8.7e-65; Accession=PF00015.11; Description =Methyl-accepting chemotaxis protein (MCP) signaling domain
  Pfam annotation: Domain name=Radical_SAM; Domain location=6-162; Score=5.0; E_value=0.047; Accession=PF04055.11; Description=Radical SAM superfamily
  Pfam annotation: Domain name=TarH; Domain location=395-532; Score =115.4; E_value=1.7e-31; Accession=PF02203.6; Description=Tar ligand binding domain homologue
  Pfam module annotation: Pfam domain module=HAMP::MCPsignal::Radical _SAM::TarH; Domain location=547-616::647-815::6-162::395-532
MRGDLDSRPIGAVLDEAKRLVEAGVKELLVISQDTSAYGVDVKHRTGFWNGSPVKTSMVSLCEQLAKLGVWVRLHYVYPYPHVDDVIPLMAEGKILPYLDIPLQHASPRILKLMKRPGAVERTLERIKRWREICPELTLRSTFIVGFPGETEEDFQMLLDFLREARLDRVGCFQYSPVEGATANQLPDQVPDDVKQARFDRFMQLQQQISAERLQEKIGREIMVIIDEVDEEGAVGRSMADAPEIDGAVYLNGDRQVKVGEVIIVIGAQPVPARFEYGRRSGLFFFYRPRQLFAVSTVFPSALMIAVAARAARRCESASAAEFRSYKVPPSAPPARRARPDTAPDADGNAHMFNKMKIVTAIVVILVVFTAMQAISGSLFFSSLRAGQHNFTASNQLSHQQRELGDGWQTLVKTRVTINRVAIRILKNQTDEQSLAAINKLLLAAGASLEAAQQHFNQYRSYPRIDGQSASTADLIDNKFKAFAALLQQSAVFLKANNYAAYGNLDAQQAQDELEQAYQQWRDENMQLINQRSLQNDSNYQQVLIMIAVIALVVVLMVAAVWTLVRRVLLAPMQQVQQQIERFAEGDLSASLQVAGRSEMAAIAASLNHMQQALLGTINNVRDSADAIFGSASAIANGNNDLSARTEQQAASLEETAASMEQLTATVKQNADNARQATQLAKTASDTADKGGNVVEGVVKTMRDIADSSKKIADITSVIDGIAFQTNILALNAAVEAARAGEQGRGFAVVAGEVRNLAQRSAQAAKEIKLLIENSVQRVDLGSQQVSSAGDTMQEIVSAVTRVTDIMGEIASASD

SEQ ID NO: 221611 - protein, 100 aa, Glycine max
  Coding DNA Sequence Number=SeqID_104833
MTASSLSTTTSCVFAMESDSTSSRFKYIVEDPVKLVEKDDALTTIDSVECGDDAKVQVQDLVDSGDGTCDYGNQRRFELDLIAYGGLVVVVDGQHTMGLD

SEQ ID NO: 221612 - protein, 572 aa, Glycine max
  Coding DNA Sequence Number=SeqID_104834
  Gene Ontology: Mol. function=serine-type endopeptidase activity
  Homolog annotation: Hit_ID=Q1RW49; Match level="QueryCoverage=85%, HitCoverage=89%, E-value=3e-79, Identity=34%"; Hit description=IMP dehydrogenase/GMP reductase
  Pfam annotation: Domain name=Tweety; Domain location=109-489; Score= -166.2; E_value=0.0019; Accession=PF04906.4; Description=Tweety
  Subcellular localization annotation: CTP_CleavageSite=26; ConfidenceScore=5.29e-01
MKASSFNGFWILLLLFPVSLFLSSVSAFSPTGSIRHPVKFIIGSCLSFVVISEYADGLCVDLGKGEEEENLGSWKSELTQVAPAPGPKGEDVLILAANRTNRPDILRGFQRYRGGWDIADQHYWASVGFTGAAGFILAVLWFISFGLALMIHLCCGWGINIKDKGSNHSQRICLILLISFTFAAATGCILLSVAQDKFHGQALDTLHYFVNQSDYTVQTLRNVTEYLSLAKTINVTQILLPSDVMDGIDKLNVDLNSAADTLSEKTNENSVKIRRVFNDVRLALYVVAAVMLLLALVGLVLSVLGYRHAILIFVITGWLLVATTFILCGVFIILNNAISDTCMAMGEWVANPRTESALSNVLPCVDQRTTNKTLFQSKQVINNIASVVNTFIFATANINETQGSPGYYNQSGPRMPSLCYPFDSQFQERQCTDQEVSSANASRVWKNYECEVSESGICTTVGRVTPQIYLQIVAAVNESYALEHYTPPLLSLQNCNFVRDAFTKITSSYCPPLNHYLKIINVGLGLISVGVLLCLVLWILYANRPRRREVFEKSSLPETTTNLPLSNANSEV

SEQ ID NO: 221613 - protein, 118 aa, Glycine max
  Coding DNA Sequence Number=SeqID_104835
MACSLSSFCALNQAFCRDKRIKYPKIRSQSFNDDNGKRANIVDANLNILRERIQQVRKRERLIHTQEWNYKRSYDRKYKRDSMISQSSEVIGLSCGAIGLVFLVGSLSIFLLSLLVCM

SEQ ID NO: 221614 - protein, 99 aa, Glycine max
  Coding DNA Sequence Number=SeqID_104836
MPKPDIEDYGDFMRGRKKKPKARKNTLLHRFRNKRGLFVTDVTKTEWCERQMEFFLFSEEWKNIEAKKMDFGGGRRNNEAIKAGRDRHVQLEQEVHASV

SEQ ID NO: 221615 - protein, 128 aa, Glycine max
  Coding DNA Sequence Number=SeqID_104837
  Pfam annotation: Domain name=Maf1; Domain location=25-122; Score= -33.7; E_value=0.0035; Accession=PF09174.1; Description=Maf1 regulator
MKFLECSALDRLNDFLGNLNLGERTIKGCLEAYSCKEEQILDYLGKSSDTDSSSPDQTLLTRNSRKTLVYLVLTLYHMYPDYDFRTLYNAKYTACSFFPLPSSSPIYRREFYRTCLWICYTHGMPRGA

SEQ ID NO: 221616 - protein, 299 aa, Glycine max
  Coding DNA Sequence Number=SeqID_104838
  Gene Ontology: Mol. function=zinc ion binding
  Homolog annotation: Hit_ID=Q1SHK9; Match level="QueryCoverage=50%, HitCoverage=85%, E-value=2e-41, Identity=46%"; Hit description=Zinc finger, RING-type; RINGv
  Pfam annotation: Domain name=zf-C3HC4; Domain location=62-107; Score =70.2; E_value=6.6e-18; Accession=PF00097.15; Description=Zinc finger, C3HC4 type (RING finger)
MGDHFELLVDRLLTESTLEAALESRNRSILAASSAGNDAKIDLNLMKMGVDDIKFPGKVVECRICHDDDEDSNMETPCSCRGSLKYAHRRCIQRWCNEKGDTTCEICHQQFKPGYTAPPPLFQFGRIPMSFRGNWEISRRDLNSTHLFMVLLILRHTLPLVISGNKEYSFPLFLLMLFRTAGVVLPIYFMVRAVALIQRHRRQNREHLNASASSSDDESEQADLQSQPQPHVIHMGTTSPRTSSLLRDGDTEIQMCNSCCSSHKRHCMPLVLPSPFAITYSSGSLGSSKLYIYISVSAY

SEQ ID NO: 221617 - protein, 339 aa, Glycine max
  Coding DNA Sequence Number=SeqID_104839
  Gene Ontology: Cellular component=integral to membrane; Biological process=cell adhesion
  Homolog annotation: Hit_ID=Q2MGQ7; Match level="QueryCoverage=70%, HitCoverage=80%, E-value=1e-48, Identity=47%"; Hit description=Beta -Ig-H3/fasciclin
  Pfam annotation: Domain name=Fasciclin; Domain location=195-310; Score=14.6; E_value=0.00022; Accession=PF02469.12; Description =Fasciclin domain
  Pfam annotation: Domain name=Fasciclin; Domain location=40-154; Score= 14.1; E_value=0.00025; Accession=PF02469.12; Description=Fasciclin domain
  Pfam module annotation: Pfam domain module=Fasciclin::Fasciclin; Domain location=195-310::40-154
MAYSVPLLLLILPFIFFSFGRALPREAIFDAADVLSDSGYVSMALTLEIVAETLLEQSPSATVFAPSDSAFKKSGQPSLDLLRFHLSPLPLPPASLRLLTAGSKIPTMLPGQTLTVTTSSSDRVTSFNNIKLTGSPIYDDGILLVYGIDRFFDPTFQFNSQRPSDNSDTSCSAKNHTASASDSFDQAIQTLKTGGYSAMASFLGMQLSGVADQSGITVFAPTDDTVMSRIGDFGEYPSFFRRHVVPCRLLWNDLVNFGDGSELPTFLDGFAINITRSDGVLILNGVPVFFPDVFFNDRVVVHGVSDVLAAQDSAIKDNALRIDDDDDDDDEILFDPSEF

SEQ ID NO: 221618 - protein, 409 aa, Glycine max
  Coding DNA Sequence Number=SeqID_104840
  Gene Ontology: Mol. function=transporter activity; Cellular component= integral to membrane; Biological process=transport
  Homolog annotation: Hit_ID=Q6D3B1; Match level="QueryCoverage=62%, HitCoverage=93%, E-value=1e-115, Identity=83%"; Hit description =Putative ABC transporter permease protein
  Pfam annotation: Domain name=BPD_transp_1; Domain location=198-408; Score=163.1; E_value=7.2e-46; Accession=PF00528.12; Description =Binding-protein-dependent transport s
TAQKVLQFTQQQLAQVGVKVKVTAMDAGQRAAEVESKGQKESGVRMFYTGWSASTGEADWALTPLFATSSWPPAIFNTAFYSNPQVDKDLADALKTTDRDQKARLYKDAQDRIWNDHPWIPLVVEQLLSANNKNLTGFYVMPDTSFNFDEAELNAGVPVRASAAGRSGAPDCRTGSGCLSGGAGASGAGTRSAADSAVLALYPQCFAGMVWAVVFGMAIGIVSAVWRNRWPDRIGMTLAVSGISFPAFALGMLLMQVFSVELGWLPTVGADSWQHYILPSITLGAAVAAVMARFTRASFVEVMQEDYMRTARAKGVRESLVVVKHGLRNAMIPVVTMMGLQFGFLLGGSIVVEVVFNWPGLGRLLVDSVEMRDYPVIQAEVLLFSLEFILINLIVDMLYAAINPAIRYR

SEQ ID NO: 221619 - protein, 431 aa, Glycine max
  Coding DNA Sequence Number=SeqID_104841
  Gene Ontology: Mol. function=oxidoreductase activity; Cellular component=endoplasmic reticulum; Biological process=electron transport
  Homolog annotation: Hit_ID=Q9C7S7; Match level="QueryCoverage=81%, HitCoverage=81%, E-value=8e-71, Identity=63%"; Hit description =Endoplasmic oxidoreductin-1 precursor
  Pfam annotation: Domain name=ERO1; Domain location=166-423; Score =277.6; E_value=2.5e-80; Accession=PF04137.6; Description=Endoplasmic Reticulum Oxidoreductin 1 (ERO1)
  Subcellular localization annotation: CTP_CleavageSite=34; ConfidenceScore=5.17e-01
RQNASIGSINARQKSRLFAFPLVAPTLGNSVMVKSEIEKKGCSTRQWLWLVMALVAVFVAMAMSSKTSPKALFGAIDRACPCARGTPKYSGMVEDCCCDYETVDRLNEEVLHPSLQELVKTPFFRYFKAFQLLSKCGVDVECVTGRWWTLPYKHHAVADEATKDEHHAVPAISSYLLVKLWCDCPFWPDDGMCRLRDCSVCECPENEFPESFKKPDRRLSMTDLVCQEGKPQAAVDRTLDSKAFRGWTEIDNPWTNDDETDNDEMTYVNLQLNPERYTGYTGPSARRIWDAVYSENCPKYYLEQAEYDTGNPNEDLTTQSLIKQLLYNPKLQAACPIPFDEANLWKGQSGPELKQKIQQQFRNISALMDCVGCEKCRLWGKLQVLGLGTALKILFSVDGQENSSHTEKLEESQEIARDVVITVGAYVNLLR

SEQ ID NO: 221620 - protein, 72 aa, Glycine max
  Coding DNA Sequence Number=SeqID_104842
MSLLDCPQKIDMGLMSGNQFGLLGDNGNPNRLKPKAWLWFPIHQIKKQFLLSPSEENEGPIKEEGDLVEEGH

SEQ ID NO: 221621 - protein, 195 aa, Glycine max
  Coding DNA Sequence Number=SeqID_104843
  Homolog annotation: Hit_ID=Q1SEK1; Match level="QueryCoverage=25%, HitCoverage=15%, E-value=1e-10, Identity=64%"; Hit description =Tetratricopeptide-like helical
MVYMLFEDDKVFVEEVRVETRNNGKLEICRLETSLGWEHVDFAQVQSFYTALKKLRTPLPRDSSLCEGGMGEGCCTQPYPCICKEAVSGFEPMTNRSPRHNFTAAPRLALKTDLGEWNRGVEEQDRIRVATWRFCHRDWVGNKCLEDGKDLLLLLQLWITVLLLWDYSSHSLTEEEEEEVEDSDGCNCKCTRVYY

SEQ ID NO: 221622 - protein, 464 aa, Glycine max
  Coding DNA Sequence Number=SeqID_104844
  Homolog annotation: Hit_ID=O22159; Match level="QueryCoverage=87%, HitCoverage=75%, E-value=2e-13, Identity=24%"; Hit description =Expressed protein
  Pfam annotation: Domain name=DUF247; Domain location=23-453; Score =68.1; E_value=2.9e-17; Accession=PF03140.6; Description=Plant protein of unknown function
MELDEIRWLAQLKEAEERFKEKNQILTPKIQRVPLLLRQNKKFTKYCSPKLISLGPIHHNHNHNNESLKLGEDYKLLWTSKFVTKYHENINEDTNQVAQFLLKRIKDDIKELKNLFDEDTILLGWKSNDNYLAWMLFVDGCSLLYFMENIDMQHPEALNLELDQLMQMWRDMWLLENQLPRKLLEMLSKKKGSDLDDLFLNFCVLGESKRYGNVVVSIHNHKAIHILDYYRSILISPHNHMEVNTISPYQDEGNNEQHHDVGWYTYKNIRDLKRIGIQVKPPNSPRGNSIAWSNIRFNSKWNGGELRLPILMFNDVTPYIFRNLIAYEMCPDVHCRFECCSFFSFMDSLIDNAEDVKELRLSGVIQNMLRSDEDLANLINELGNDLPTNLFFDKFHSRAVTFSEKYIKVKTQIEKHYSNRWRRWLATGYNTYFSTPWSIIAFLAALLALVLSFLQTWFTIHPNK

SEQ ID NO: 221623 - protein, 298 aa, Glycine max
  Coding DNA Sequence Number=SeqID_104845
  Homolog annotation: Hit_ID=Q75WV0; Match level="QueryCoverage=12%, HitCoverage=4%, E-value=1e-10, Identity=75%"; Hit description=ALG2 -interacting protein X
MDSLIDTAEDVKELRLNGVFQNLLGSDEALANFFNELGDDLPTKMYCNNISTDVVAFSKKYIAVKHQIQKHYRTRWKTWLAEVYNTHFNTPWDIIAVSAASLINPHFYPNLVRHTSQMIDNAKGIVSDNDNRKNIIFILQDVWMNTIAAYSSHFGEAEGMEMEWYKEAEEQNQVVVLVHCSMDHAIRDMLVGHTHGLAVADDEPERVGMAQLMMVECGMEVEADDVVQDYHMGEGDDGHRWELVAAQLAAADNKVFGDEEDLVRAGDGRQQGCKEGVQRRRENARDLSLGVFTGMGHP

SEQ ID NO: 221624 - protein, 275 aa, Glycine max
  Coding DNA Sequence Number=SeqID_104846
  Gene Ontology: Mol. function=binding
  Homolog annotation: Hit_ID=Q1SEK1; Match level="QueryCoverage=42%, HitCoverage=36%, E-value=6e-46, Identity=78%"; Hit description =Tetratricopeptide-like helical
  Subcellular localization annotation: CTP_CleavageSite=30; ConfidenceScore=5.10e-01
MVSEPVLPGGVDSAASPRFVVTSPGSRECVASPTSGDNLGNACLTSFFVTGAWDHTKLLHSLKAYQNAEKDESMKSNPDLFFNGATVNKYLENYQRALSGFEAAALKDPGLNAVEEVQKIVNLLDKVDNLLKGHVRAKRMASLASSLVAVDLKSSYRRVTIDLLSEGPNRALALEGKVFFFVRSESVAPLYYLLCDSNQSCFVLSIYGVRTDVIKEGDQLTLLDPYFRDVDLSWKEKRYQFKSIRLDFYEQVLVNGKALTPQQAIRTSIYAQHKP

SEQ ID NO: 221625 - protein, 68 aa, Glycine max
  Coding DNA Sequence Number=SeqID_104847
MRAIFLPKKSEYAIYGDNKQRPLDQQPQQVISNDTNRSYWKLKVKNGSWKLEVEVTGSWKLEMKVIGS

SEQ ID NO: 221626 - protein, 204 aa, Glycine max
  Coding DNA Sequence Number=SeqID_104848
  Homolog annotation: Hit_ID=Q8W0T0; Match level="QueryCoverage=66%, HitCoverage=100%, E-value=4e-38, Identity=55%"; Hit description =Putative RNA polymerase II complex component SRB7
MGFMNFQRTHSRAREATSERVEFLLLLYKITIYKVLRSLPLFVTHTNELSYISASQNFLQKVARVMDIISQLQEQVNLIAHLAFNTVGTLQRDAPPNRLSPNYPEPPAHATEDGSNFSEQPKLMSTTLVKAAKQFDALVAALPISESGEEAQLKRISELQAENDAIGLELQKQLEAAEKELNQVQELFRQASDNCLNLKKPDDS

SEQ ID NO: 221627 - protein, 577 aa, Glycine max
  Coding DNA Sequence Number=SeqID_104849
  Gene Ontology: Mol. function=protein binding; Biological process =electron transport
  Homolog annotation: Hit_ID=Q010S1; Match level="QueryCoverage=97%, HitCoverage=81%, E-value=1e-76, Identity=31%"; Hit description=[S] KOG2477 Uncharacterized conserved protein
  Pfam annotation: Domain name=CwfJ_C_1; Domain location=340-465; Score= 217.3; E_value=3.4e-62; Accession=PF04677.5; Description=Protein similar to CwfJ C-terminus 1
  Pfam annotation: Domain name=CwfJ_C_2; Domain location=474-571; Score= 149.9; E_value=6.8e-42; Accession=PF04676.4; Description=Protein similar to CwfJ C-terminus 2
  Pfam module annotation: Pfam domain module=CwfJ_C_1::CwfJ_C_2; Domain location=340-465::474-571
MKSKKANPKELNPYLKDNGSGYPEESGAKVGADQLLSSSLVGDGGASWRLKALKRAQEQAAREGRRFNEVVEERWSSLGELTAAVASHAAAPARAHLRAIKNRQRGITEENSQDSDKLGRRDSKRDYLKDVSVRHHEMKAPKVQDSLSWGKRKSQQVVAEGAGVISAAVSSLNKFANDGNFMHDFGSKMSNNSDGSVLESSELEKVSLEANTPGERSVVVKNEMSENQLAAKVMQLRLKGKHEEADKLMQEAKVMNTKQGNQDHSIRSGTEGSSSRYAMQKISSEQKKGEDDGDMHLAHKIMQNKQFRASTQADDEYDFEDGPSRKSRKKQGGDDHKSIQKKTNRFLTQQERCLFCLENPNRPMHLVVSIANFTYLMLPKWQPVVPGHCCILPIQHESATRTVDDNVWTEIRNFKKCLIMMFAKQEKEVVFLETVMGLAQQRRHCMVECIPLPEDIAKEAPLYFKKAIDEAEDEWSQHNAKKLIDTSQKGLRNSIPKHFPYFHVEFGLNKGFVHVIDDEKQFNISLGLNVIRGMLHLAEEDMYRRRRYEAVEVQKQAVESFSKEWKHFDWTKQLHET

SEQ ID NO: 221628 - protein, 71 aa, Glycine max
  Coding DNA Sequence Number=SeqID_104850
MPASPVYNIEARPTHGYGYLCFILDGNHHQLTRTNPSASYVCQSNLPPSYDMENEIVLAGPLNGNLYPAIA

SEQ ID NO: 221629 - protein, 109 aa, Glycine max
  Coding DNA Sequence Number=SeqID_104851
MSFETRLGRYVLHAMKKAKNCRLRCLILSKVNEIIMEYQKMIQQCSKIHFGQKFFNILSADTPSATRIDVTSCNNIFKGHALEPRDKENASNTIFDVLLLSETAFDLTN

SEQ ID NO: 221630 - protein, 137 aa, Glycine max
  Coding DNA Sequence Number=SeqID_104852
MENIANAIDDQNLKGHRKHQKHHKRSHNVELRSSDSDYHHSHGQRSRSKSLEENSEDESKRSMHKKSDRHHHHHRHHHHHHHKHRHHLDDERNHMQQHSPKFNGKHDEKLDKTETDKKDGGHHESRAMVENNDGQIV

SEQ ID NO: 221631 - protein, 441 aa, Glycine max
  Coding DNA Sequence Number=SeqID_104853
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=P19023; Match level="QueryCoverage=94%, HitCoverage=82%, E-value=0.0, Identity=84%"; Hit description=ATP synthase subunit beta, mitochondrial precursor
  Pfam annotation: Domain name=ATP-synt_ab; Domain location=94-316; Score=335.9; E_value=7.1e-98; Accession=PF00006.15; Description=ATP synthase alphabeta family, nucleotide-binding domain
  Pfam annotation: Domain name=ATP-synt_ab_C; Domain location=329-436; Score=166.7; E_value=5.8e-47; Accession=PF00306.17; Description=ATP synthase alphabeta chain, C terminal domain
  Pfam module annotation: Pfam domain module=ATP-synt_ab::ATP-synt_ab _C; Domain location=94-316::329-436
MNSPRKGTIRQVCQVIGVVINVRFDEGLPSMMTTLECLHSIQVPVGRATLGRIINVIGEPIDAKGEINTEHYLPIHREAPAFVEQETAQQILVTGIKVVDLLAPYQRGGKIGLFGGAGVGKTVLIMELINNVAKAHGGFSVFAGVGERTREGNDLYREMIESGVIKLDDKQSESKCALVYGQMNEPPGARARVGLTGLTVAEHFRDAEGQDVLLFVDNIFRFTQANSEVSALLGRIPSAVGYQPTLSTDLGALQERITTTKKGSITSVQAIYVPADDLTDPAPATTFAHLDATTVLSRQISELGIYPAVDPLDSTSRMLSPLILGADHYETARGVQKVLQNYKNLQDIIAILGMDELSEDDKLTVARARKIQRFLSQPFHVAEVFTGAPGKYVELKENVASFQGVLDGKYDDLPEQSFYMVGGIEEVIAKAEKIAKESAAS

SEQ ID NO: 221632 - protein, 178 aa, Glycine max
  Coding DNA Sequence Number=SeqID_104854
  Gene Ontology: Mol. function=nucleic acid binding; Cellular component= ribonucleoprotein complex; Biological process=regulation of transcription, DNA-dependent
  Homolog annotation: Hit_ID=Q6YW54; Match level="QueryCoverage=56%, HitCoverage=35%, E-value=6e-39, Identity=75%"; Hit description =Putative transformer-SR ribonucleoprotein
  Pfam annotation: Domain name=RRM_1; Domain location=84-155; Score =84.1; E_value=4.3e-22; Accession=PF00076.12; Description=RNA recognition motif. (a.k.a. RRM, R
  Subcellular localization annotation: CTP_CleavageSite=72; ConfidenceScore=5.38e-01
MTIKDNFIFSIAECDVLCKNTKVFTFYFNDAKSYSSMLLTCSARSASPSPVRSRRSRSKSLSRSRRSRSRSQDSADVENPGNNLYVTGLSTRITDSDLHKYFSKEGKVVDCHLVKDPHTKESRGFGFVTMETNDDAECCIKYLNRSVFEGRLITVEKAKRNRGRTPTPGKYCGPRDKR

SEQ ID NO: 221633 - protein, 172 aa, Glycine max
  Coding DNA Sequence Number=SeqID_104855
  Gene Ontology: Mol. function=ribonuclease H activity; Biological process=RNA-dependent DNA replication
MEFKSRLLENVTSNLMVNGRNWCMIFAVALNYIWRYRNKGIFDNNSLLQLIDIANQILLQVDAISIVNPVTSSSIQWFPPPTNQFKLNCDPAVHTASRKPAAGGVLRDHTGLVLFPFVADIGCCSVLAAELWAIFLGLQLAWSRGFKEFIVESACWSLSLLRSVPILILVSC

SEQ ID NO: 221634 - protein, 478 aa, Glycine max
  Coding DNA Sequence Number=SeqID_104856
  Gene Ontology: Mol. function=drug transporter activity; Cellular component=membrane; Biological process=multidrug transport
  Homolog annotation: Hit_ID=Q1SHJ6; Match level="QueryCoverage=99%, HitCoverage=98%, E-value=1e-137, Identity=52%"; Hit description =Multi antimicrobial extrusion protein MatE
  Pfam annotation: Domain name=MatE; Domain location=256-419; Score =134.9; E_value=2.2e-37; Accession=PF01554.9; Description=MatE
  Pfam annotation: Domain name=MatE; Domain location=34-195; Score =112.2; E_value=1.5e-30; Accession=PF01554.9; Description=MatE
  Pfam module annotation: Pfam domain module=MatE::MatE; Domain location=256-419::34-195
MEENLIITKQSEKQRVTWDGLGEEMKRIIRVAGPMVFVYASQNLLQVVSIMMIGHLNDELFLSGAALAISLATVTGFSLLTGMASGLETICGQAYGARQYQKTGVQTYTAIFSLTCVCLPLTIIWISLENILVFIGQDPLIAHEAGNFIIWLLPALFAYAILQPLVRYFQMQSLLLPMLATSCVTLCLHIPLCWALVFKTELSNVGGALAMSISIWLNVIFLVLYMRYSPACEKTRAPVSMELFQGIWEFFRFAIPSAVMICLEWWSFELLILLSGLLPNPQLETSVLSICLNTISTLYAIAFGIAAAASTRISNELGAGNPHSARVAVLASMSFAIMEATIISGILFVCRHVFGYTFSNKKEVVDYVTVMAPLVCISVILDNIQGVLAGIARGCGWQHIGVYVNLGAFYLCGIPVAASLAFLAKMSGKGLWIGLQVGAFVQCALLSTVTSCTNWEQQAMKARKRLFDSEISAENILV

SEQ ID NO: 221635 - protein, 177 aa, Glycine max
  Coding DNA Sequence Number=SeqID_104857
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=P29685; Match level="QueryCoverage=67%, HitCoverage=21%, E-value=2e-38, Identity=71%"; Hit description=ATP synthase subunit beta, mitochondrial precursor
  Pfam annotation: Domain name=ATP-synt_ab_N; Domain location=90-156; Score=76.6; E_value=7.8e-20; Accession=PF02874.13; Description=ATP synthase alphabeta family, beta-barrel domain
  Subcellular localization annotation: CTP_CleavageSite=52; ConfidenceScore=5.66e-01
MASRRLVSSLIRSSLRRSQSKPSISASTSRLTSSNRASPHGYLLNRVAEYATAAAAATTPPSPPPPGKKELGGGGKITDEFTGKGAIGQVCQVIGAVVDVRFDEGLPPIMTALEVLDHSSRLVLEVAQHLGEGVVRTIAMDATEGVVRGWRVLNIWLPYYRKYLITCFLLLAQPCIW

SEQ ID NO: 221636 - protein, 396 aa, Glycine max
  Coding DNA Sequence Number=SeqID_104858
  Gene Ontology: Mol. function=drug transporter activity; Cellular component=membrane; Biological process=multidrug transport
  Homolog annotation: Hit_ID=Q1SHJ6; Match level="QueryCoverage=98%, HitCoverage=82%, E-value=1e-124, Identity=54%"; Hit description =Multi antimicrobial extrusion protein MatE
  Pfam annotation: Domain name=MatE; Domain location=174-337; Score =142.3; E_value=1.3e-39; Accession=PF01554.9; Description=MatE
  Pfam annotation: Domain name=Nuc_sug_transp; Domain location=152-329; Score=-174.8; E_value=0.056; Accession=PF04142.6; Description =Nucleotide-sugar transporter
  Pfam module annotation: Pfam domain module=MatE::Nuc_sug_transp; Domain location=174-337::152-329
MASGLETICGQAYGAQQYEKVGVQTYTAIFSLTVVCLPLTFIWISMEKILVFIGQDPLIAQEAGKFLIWLVPALFAHAIMQPFVRYFQMQSLLLPMLISSCVTLCIHIPLCWALVFQTGMNNIGGALAMSISIWLNVTFLGLYMRYSPACAKTRAPISMELFQGIWEFFRFAIPSAVMICLEWWSFELLILLSGLLPNPQLETSVLSICLNTISTLFSIPFGIAAAASTRISNELGAGNPHAAHVAVLAAMSFAIMETAIVSGTLFVCRHDFGYIFSNEKEVVDYVTVMAPLICISVILDSIQGVLAGVARGCGWQHIGVYVNLGAFYLCGIPVAATLAFLAKMRGKGLWIGVQVGAFVQCILFSTITSCINWEQQAIKARKRLFDSEISADNRLV

SEQ ID NO: 221637 - protein, 167 aa, Glycine max
  Coding DNA Sequence Number=SeqID_104859
  Gene Ontology: Mol. function=drug transporter activity; Cellular component=membrane; Biological process=multidrug transport
  Homolog annotation: Hit_ID=Q1SHJ6; Match level="QueryCoverage=94%, HitCoverage=28%, E-value=3e-35, Identity=46%"; Hit description=Multi antimicrobial extrusion protein MatE
MSFTITEATIVSGTLFACRHVFGYIFSNEKKVVDYVTVMAPLICISVILDSIQGVLAGVARGCGWQHIGVYVNLVAYYLCGIPVAASLAFLEKMRGKGLWIGVQVGAFVQCVLLSIITSCINWEQQLILSLATILILLNKVECPVEEAIKARKRLFDSEFPADNRLV

SEQ ID NO: 221638 - protein, 441 aa, Glycine max
  Coding DNA Sequence Number=SeqID_104860
  Gene Ontology: Mol. function=drug transporter activity; Cellular component=membrane; Biological process=multidrug transport
  Homolog annotation: Hit_ID=Q5N7N1; Match level="QueryCoverage=87%, HitCoverage=46%, E-value=1e-48, Identity=47%"; Hit description=MATE efflux protein-like
  Pfam annotation: Domain name=MatE; Domain location=184-338; Score =46.9; E_value=7e-11; Accession=PF01554.9; Description=MatE
  Pfam annotation: Domain name=MatE; Domain location=25-165; Score =65.5; E_value=1.7e-16; Accession=PF01554.9; Description=MatE
  Pfam module annotation: Pfam domain module=MatE::MatE; Domain location=184-338::25-165
MELFKGMWEFFRFAIPSAVMDSYQIHNLKLQFCPFGILNTIATLYTIPFGIGAAASTRVSNELGAGNSHAARVAVLAAMSLAVIETSIVSATLFACRNVFGYIFSNEKEVVDYVTAMAPLVCISVILDSIQGVLTGIARGCGWQHLGVYVNLGAFYLCGIPMAALLAFLVRLGGKGLWIGIQSALNGGHLSYYSCFLVFYQIQNLKLQSYPYVTTTIYTIPEAIGSAASTRVSNALGGGSPQLAQVSVSAAMTLAASAAILVSSIIFACRQVVGYAFSNELDVVDYFTEMVPLLSISVILDTLHDTLSGIARGCGWQHRGAYVNLDAYYVVGIPIAAILGFCLQLRGKGLWIGILTGAFCQTVMVSLITSCTNWEKQAIKAWERIFQRNFAVEDGLVLANGEDSLNLSASFVGIGKSFSFGGRKDQILELEEEKVLMTRHL

SEQ ID NO: 221639 - protein, 58 aa, Glycine max
  Coding DNA Sequence Number=SeqID_104861
MSLPIYGYGRRQMKEGDELQAPVVTEEAETYLLSHGGSATVVGEAAVLTIQGYCNNKA

SEQ ID NO: 221640 - protein, 389 aa, Glycine max
  Coding DNA Sequence Number=SeqID_104862
  Gene Ontology: Mol. function=cytochrome-c oxidase activity; Cellular component=integral to membrane; Biological process=electron transport
  Homolog annotation: Hit_ID=Q94G17; Match level="QueryCoverage=99%, HitCoverage=100%, E-value=1e-130, Identity=64%"; Hit description=TatC
  Pfam annotation: Domain name=TatC; Domain location=128-372; Score =223.9; E_value=3.5e-64; Accession=PF00902.8; Description=Sec -independent protein translocase protein (TatC)
  Subcellular localization annotation: CTP_CleavageSite=62; ConfidenceScore=5.52e-01
MGLISTSVPTNIVPQFGSLRTSIRVGNPNPSGLSFPRKRNNSFVCLAVDDELRQKQQDLSTSATGLGSALEERPENADLFESTAEETQGNFGQDGDRGAIYDFLYPDKELLPDDKEMSIFDHLEELRQRIFVSVLAVGASILGCFAFSKELIMILEAPVKTQGVRFLQLAPGEFFFTTLKECTKLCRNSYVRLITSSQIIVSGYCGLLLGSPVILYEVIAFVLPGLTKSERRFLGPIVLGSSVLFYAGITFSYLVLTPAALNFFVTYAEGAVESLWSIDQYFEFVLVLMFSTGLSFQLTPIHAMRPLSIDLIACLLLPKYVPVIQFLLGQLGLVSGDQMLSIWRYVVVGAVVAAAIVTPSTDPLTQILLAAPLLGLYLGGAWMVKLTGR

SEQ ID NO: 221641 - protein, 97 aa, Glycine max
  Coding DNA Sequence Number=SeqID_104863
  Homolog annotation: Hit_ID=Q6E7G9; Match level="QueryCoverage=100%, HitCoverage=26%, E-value=1e-28, Identity=62%"; Hit description =Origin recognition complex protein 4
MEQENHKIKAVSLLRSRICDPKFIFISESPESNYSKLKFMISSSVTEACNNSILLLGPRGSGKNALVIQDLLQEYPDSVSVIRLNGLLHSDDISAFK

SEQ ID NO: 221642 - protein, 330 aa, Glycine max
  Coding DNA Sequence Number=SeqID_104864
MGVRLKKEKEQLNLLLGSHLTTIHETLSSSESLSYPPKVTWDDVIKITVGAGPTLSSSVHSSLKQVVDEGNGLFIRLTRSSCFNPLLDTFSPDWSHSKDLKISVPHLVGAVWEACSALKKTPSTNITAIGRGMTQVAVSVKDVLREMKELKPVSCDDQVDEAAGEGCAEAASEPHDDNSSEGDLGNDLSPEEMKVAERAIEVVSNTLSVRKVLIHSIIGLLKLEKPNDNSGFINSLEKLLQLCQELGRQIDEIGACLYPPQEIPAINAALEEIHSIIDAVQVEVGELLGASDVFLEACNDLRSSLRQLASELRNSSTADIEARVENITLT

SEQ ID NO: 221643 - protein, 168 aa, Glycine max
  Coding DNA Sequence Number=SeqID_104865
  Gene Ontology: Mol. function=acyl carrier activity; Cellular component=chloroplast; Biological process=fatty acid biosynthetic process
  Homolog annotation: Hit_ID=Q5QMV2; Match level="QueryCoverage=85%, HitCoverage=34%, E-value=7e-41, Identity=59%"; Hit description =Putative acyl-(Acyl carrier protein) thioesterase
  Subcellular localization annotation: CTP_CleavageSite=15; ConfidenceScore=5.27e-01
MVATFSYPASTYFVRCCSVRENHDQVKLQVNSSIRTNGSFRSPVKVESLKQTVSTTTTLGQAVTIDENGLRQNIPTKKQLVDPHRQGLIIEGGVGYRQTVVIRSYEVGADKTATLESILNLLQETALNHVWMSGLLSDGFGATHGMVRNDLIWVVSRMQVLVDYYPIW

SEQ ID NO: 221644 - protein, 114 aa, Glycine max
  Coding DNA Sequence Number=SeqID_104866
  Homolog annotation: Hit_ID=Q6EWX1; Match level="QueryCoverage=73%, HitCoverage=21%, E-value=9e-22, Identity=60%"; Hit description =Origin recognition complex 4 subunit
MKRLEVKEQSLCNFNSVMKEYISTLTSERYARHVCLRAFEHLIHRELICFTDNRGQSLSVEFRPVKLLISSAELHQGLRANTSCPFSLYLTSSIHPLHVISVEPKLLKLMDREG

SEQ ID NO: 221645 - protein, 203 aa, Glycine max
  Coding DNA Sequence Number=SeqID_104867
  Gene Ontology: Mol. function=acyl carrier activity; Cellular component=chloroplast; Biological process=fatty acid biosynthetic process
  Homolog annotation: Hit_ID=Q5QMV2; Match level="QueryCoverage=95%, HitCoverage=51%, E-value=9e-59, Identity=61%"; Hit description =Putative acyl-(Acyl carrier protein) thioesterase
  Pfam annotation: Domain name=Acyl-ACP_TE; Domain location=2-194; Score=4.4; E_value=1.3e-10; Accession=PF01643.8; Description=Acyl -ACP thioesterase
MGWSIRQEWNAAGLADKKPSHRPHFCTCNKVRAEVSPWFIEKQAIKEDDVQEKIVKLDKEAKYMNSDLKPKRSDLDMNQHVNNVKYVRWMLETIPDQILEGHQLSGITLEYRRECGSSDIVQSLCEPEEDEILHGVVEPDYCTNLLNGLSSDIINGSGVLTCLEKRPLRYTHLLQTKGEKQNDEIVRGRTTWKRKISTMPFST

SEQ ID NO: 221646 - protein, 83 aa, Glycine max
  Coding DNA Sequence Number=SeqID_104868
MSGEVVVDSKHSLKRMHNGVRVESEKAGYNKGFCFAEAEREEERYLRRERKLGRVCNSGEKAKGDDEPKLKRVRRSKIDLKMF

SEQ ID NO: 221647 - protein, 48 aa, Glycine max
  Coding DNA Sequence Number=SeqID_104869
MVHKAWSQESLSPYITTYFYDASIEHWLHRKLVIHTKFGQSMSGVKIV

SEQ ID NO: 221648 - protein, 83 aa, Glycine max
  Coding DNA Sequence Number=SeqID_104870
MRKCRKKKRKGCEEEEKKTAGRRSGNASGAGEIESRLMECFISQANTIHLIRFLFPPPPILLIFGLLDRPPPRPPPTPFSHSN

SEQ ID NO: 221649 - protein, 679 aa, Glycine max
  Coding DNA Sequence Number=SeqID_104871
  Gene Ontology: Cellular component=microtubule; Biological process =microtubule cytoskeleton organization and biogenesis
  Homolog annotation: Hit_ID=Q9LV73; Match level="QueryCoverage=72%, HitCoverage=33%, E-value=1e-145, Identity=58%"; Hit description =Arabidopsis thaliana genomic DNA, chromosome 5, P1 clone:MJE7
  Pfam annotation: Domain name=Frigida; Domain location=158-461; Score =438.7; E_value=8e-129; Accession=PF07899.2; Description=Frigida-like protein
MEDSDSVATLIDSTTSKIQQLQKAFAELESYRAVTLNLKWKELEEHFHGLEKSLKRRFDELEDQEKEFENKTRKAREILEKREAAVFAKEQDSLQRLQEKRDAASFAIVNAREKQRKISSRELATFSNGGKGGMPGVEEKPVDTLSTAAEGNVEDVKLPDNGNVELVSYPELVKLCKEMDAAGLHKFISDNRKNLAAVRDEIPNALRAAPNAACLVLDSLEGFYCTEVSNQDVKKDANLLGLRRTCIMLMECLCDFLSSSGFVSNVISEDIKDRAKAVAEEWKPRLDALDMDASNGNSLEAHAFLQLLASFGIASGFDEEELSRLIPMVSRRRQTADLCRFLGLSEKMPGVIEVLVNSGRQIDAVNLAFAFDLTEQFCPVSLLKSYLKDARKASSPVRSAHSSPTAQIEVNERELVALKAVIKCIEEHKLDEQYPLDPLQKRLVQLEKAKADKKRETEATKPQPKRPRANGVGYGPRVTNILSDKTCYARVADRYPQYVYDRPPYMYPAPTENHCPPLMTTATYNISPSHGNYFGNGALGLTDGLANDSTLKAMPRQLLPAPPILLGRICVGSNLRMLGGGGVEVEVLVEFEWEKGVGGGLGGGRSRSPKIRRMGGGGNKNRMRGGCGKRFFFFFFVEELATIVAVNRRLPWCIEEAFGKSNATVLRPPLRELCHRPPS

SEQ ID NO: 221650 - protein, 343 aa, Glycine max
  Coding DNA Sequence Number=SeqID_104872
  Gene Ontology: Mol. function=acetylglucosaminyltransferase activity; Cellular component=membrane; Biological process=electron transport
  Homolog annotation: Hit_ID=Q9ARU3; Match level="QueryCoverage=74%, HitCoverage=67%, E-value=2e-76, Identity=50%"; Hit description =Putative xylosyltransferase I
  Pfam annotation: Domain name=Branch; Domain location=69-222; Score= -4.0; E_value=1.1e-07; Accession=PF02485.11; Description=Core-2I -Branching enzyme
MCVKSQEEKPRQKLRGAAKGKKGIQDHFCRERSEEVEMVEGYLWGTGQFGMFHSGIHLLQEMKILRCWSILKTLNHLRATWKVSEISSLMALVQGKQFLCWLPQRWAFDDPIYLSHVFSSVRRDLNFIDHTGDLGWKEYETTANSSCYFLALIQSDRFQPIVVDPGLYLARKSSPWLILSRPFLEFCIFGWDNLPRTLLMYFTNVKLSQEGYFHSVVCNAPEFKNTTVNGDLRYMIWDNPPKMEPHFLNASVYNQMAESGAAFARQFQLNNPVLDMIDERILQRGRHRVTPGAWCTGRRSWWVDPCSQWGDVNTVKPGPRAKKLEGSVSNLLDDWNSQTNQCK

SEQ ID NO: 221651 - protein, 801 aa, Glycine max
  Coding DNA Sequence Number=SeqID_104873
  Gene Ontology: Mol. function=RNA binding; Cellular component =spliceosome; Biological process=protein modification process
  Homolog annotation: Hit_ID=Q1SIS0; Match level="QueryCoverage=99%, HitCoverage=99%, E-value=0.0, Identity=69%"; Hit description =SWAP/Surp; Ubiquitin
  Pfam annotation: Domain name=Surp; Domain location=190-234; Score =66.1; E_value=1.2e-16; Accession=PF01805.10; Description=Surp module
  Pfam annotation: Domain name=Surp; Domain location=67-111; Score =71.5; E_value=2.7e-18; Accession=PF01805.10; Description=Surp module
  Pfam annotation: Domain name=ubiquitin; Domain location=727-796; Score=38.5; E_value=2.4e-08; Accession=PF00240.13; Description =Ubiquitin family
  Pfam module annotation: Pfam domain module=Surp::Surp::ubiquitin; Domain location=190-234::67-111::727-796
MLGSLPILPLPAPPSDGNLGPLPESQVIDNEEQNKSNSVSVPAPATVATHTRTIGIIHPPPDIRTIVDKTSQFVAKNGPEFEKRIIANNTGNVKFNFLNSSDPYHAYYQHRLSEFRAQNQSSGLQPPSQPADSAVPESAPSDSNGVAAAAEKIDVSAQFKAVRKVLEPPEAEQYTVRLPEGITGEELDIIKLTAQFVARNGKSFLTGLTSREVNNPQFHFLKPTHSMFTFFTSLADAYSKVLMPPKGLPEKLKKSVSDMTTVLERCVNRLEWERSQEQARQKAEDEIEQERIQMAMIDWHDFAVVETIDFADDEDEELPPPMTIEEVIRRSKVTAMEEEDIVEPGKEIEMEMDEEEAQLVEEGMRAASLEDRDDVKQNEVRVTEDPEPPMRIVKNWKRPEERISAERDSTKFVVSPITGELIPISEMSEHMRISLIDPKYKEQKERMFAKIRETTLAADDEISRNIVGLARTRPDIFGTTEEEVSNAVKAEIEKINDEQPKQVIWDGHTGSIGRTANQAMSQTIGSEDQNDAFNNEAKNLLGPAAPPPRPGMPSIRPLPPPPGLALNLPRVPVQYSVPHSGALPMPPPRPMMPSIRPAPPPPMSMNSGQQSVMAGQPHPMHPSIHMNNQGIPIPPPPGSQFTPVPVPRPFVPLSVPPSVMPMMHPPPLPQGVPPPPPPEEAPPPLPEEPEPKRQKLDDSALIPEDQFLAQHPGPVCICVSVPNVDEGNLKGQVLEITVQSLSETVGSLKEKIAGEIQLPANKQKLSGKPGFLKDNMSLAHYNVGGGETLTLTLRERGGRKR

SEQ ID NO: 221652 - protein, 507 aa, Glycine max
  Coding DNA Sequence Number=SeqID_104874
  Gene Ontology: Mol. function=GTP binding; Cellular component =intracellular; Biological process=RNA-dependent DNA replication
  Homolog annotation: Hit_ID=Q5QN81; Match level="QueryCoverage=89%, HitCoverage=83%, E-value=1e-139, Identity=52%"; Hit description =Pentatricopeptide (PPR) repeat-containing protein-like
  Pfam annotation: Domain name=PPR; Domain location=121-154; Score=6.4; E_value=1.3; Accession=PF01535.11; Description=PPR repeat
  Pfam annotation: Domain name=PPR; Domain location=155-189; Score =25.9; E_value=0.00014; Accession=PF01535.11; Description=PPR repeat
  Pfam annotation: Domain name=PPR; Domain location=190-224; Score =30.9; E_value=4.5e-06; Accession=PF01535.11; Description=PPR repeat
  Pfam annotation: Domain name=PPR; Domain location=225-259; Score =22.8; E_value=0.0012; Accession=PF01535.11; Description=PPR repeat
  Pfam annotation: Domain name=PPR; Domain location=260-294; Score =45.9; E_value=1.3e-10; Accession=PF01535.11; Description=PPR repeat
  Pfam annotation: Domain name=PPR; Domain location=295-329; Score =27.5; E_value=4.6e-05; Accession=PF01535.11; Description=PPR repeat
  Pfam annotation: Domain name=PPR; Domain location=330-364; Score =37.1; E_value=6e-08; Accession=PF01535.11; Description=PPR repeat
  Pfam annotation: Domain name=PPR; Domain location=365-399; Score=8.0; E_value=0.84; Accession=PF01535.11; Description=PPR repeat
  Pfam annotation: Domain name=PPR; Domain location=402-436; Score =31.0; E_value=4.3e-06; Accession=PF01535.11; Description=PPR repeat
  Pfam annotation: Domain name=PPR; Domain location=437-471; Score =33.9; E_value=5.5e-07; Accession=PF01535.11; Description=PPR repeat
  Pfam module annotation: Pfam domain module=PPR::PPR::PPR::PPR::PPR::PP R::PPR::PPR::PPR::PPR; Domain location=121-154::155-189::190-224::225- 259::260-294::295-329::330-364::365-399::402-436::437-471
  Subcellular localization annotation: CTP_CleavageSite=69; ConfidenceScore=5.55e-01
MALFRSFKRFTTLNLAKSSSTSLPPSPTSVFDHHHSNGPSKTHTLAFHTAQPRPTPDAEAICRILSTTPASTVDACLAAVPAKPSPELVLEVLNKLSNAGVLALSFFRWAEKQSEFKHTTEAFHALIEALGKIRQFKMIWTLVNDMKQRKLLTSDTFSLVARRYARARKAKEAIKTFEKMEHYGLKPHVSDFNKLVDVLCKSKSVEEAHEVFDKMRKLRLDPDIKSYTILLEGWSQQQNLIKVNEVCREMEDKGFQLDVVAYGIIMNAHCKAKKFDEAIGLYHEMKARGVRPSPHVYCTLINGLGSDKRLDEALEFFEVSKASGFVPEAPTYNAVVGAYCWSLRMDDAYRMVGEMKKCGIGPNSRTFDIVLHHLIKGRRIEEASSVFRRMNGGEFGCEPSVSTYEIMVRMFCNEELLDMAVAVWDEMKGKGILPGMHMFSTLVCALCHESKLDEACKYFQEMLDVGIRPPAKMFSTLKEALVDAGMEHVAMHFTLKIDKLRKSPLVA

SEQ ID NO: 221653 - protein, 177 aa, Glycine max
  Coding DNA Sequence Number=SeqID_104875
  Gene Ontology: Mol. function=acetylglucosaminyltransferase activity; Cellular component=membrane; Biological process=electron transport
  Homolog annotation: Hit_ID=Q9ARU3; Match level="QueryCoverage=70%, HitCoverage=31%, E-value=4e-30, Identity=53%"; Hit description =Putative xylosyltransferase I
  Pfam annotation: Domain name=Branch; Domain location=50-177; Score =27.5; E_value=7e-10; Accession=PF02485.11; Description=Core-2I -Branching enzyme
  Subcellular localization annotation: CTP_CleavageSite=39; ConfidenceScore=5.01e-01
MGAERKWLFTLLSAAFLSLMLLLMSSFSAFSTPKVFPSLVQHGSHYPPAFAYFISGGNQDKDRILRLLLAVYHPRNRYLLHLGRDARDEERQALAAAVRAVPVIRAFGNVDVVGKADYVTYLGSSNVAIILRAAAIMLKLDSGWNWFITLSARDYPLITQDVYAWGGVLEGKERESK

SEQ ID NO: 221654 - protein, 182 aa, Glycine max
  Coding DNA Sequence Number=SeqID_104876
  Gene Ontology: Mol. function=nucleoside-triphosphatase activity; Cellular component=integral to membrane; Biological process=transport
  Homolog annotation: Hit_ID=Q9ZU35; Match level="QueryCoverage=97%, HitCoverage=22%, E-value=2e-72, Identity=79%"; Hit description=White- brown complex homolog protein 7
  Pfam annotation: Domain name=ABC_tran; Domain location=1-159; Score =15.7; E_value=6.9e-09; Accession=PF00005.17; Description=ABC transporter
FAYVRQEDLFFSQLTVRETLSLATELQLPNISSAEERDEFVNNLLFKLGLSYVTDTPCGICMLFLQKVSCADTNVGDAKVRGISGGEKKRLSMACELLASPSVIFADEPTTGLDAFQAEKVMETLQQLAQDGHTVICSIHQPRGSVYSKFDDIILLTEGSLVYAGPARDEPLAYFSKFGLSS

SEQ ID NO: 221655 - protein, 170 aa, Glycine max
  Coding DNA Sequence Number=SeqID_104877
  Gene Ontology: Mol. function=nucleoside-triphosphatase activity; Cellular component=integral to membrane; Biological process=transport
  Homolog annotation: Hit_ID=Q9ZU35; Match level="QueryCoverage=81%, HitCoverage=19%, E-value=2e-51, Identity=65%"; Hit description=White- brown complex homolog protein 7
MAVHDWIAVYQCPDHINPAEFLADLISIDYSSADSVYTSQKRIDGLVESFSQRQSAVIYATPITINDLSNSRKKISQRAVVKKKGVWWKQFWLLLKRAWMQASRDAPTNKVRARMSIASAIIFGSVFWRMGNSQTSIQDRMGLLQVCDVLDSCMLLSHIGLLLTYIAEQL

SEQ ID NO: 221656 - protein, 145 aa, Glycine max
  Coding DNA Sequence Number=SeqID_104878
  Homolog annotation: Hit_ID=Q9ZU37; Match level="QueryCoverage=75%, HitCoverage=68%, E-value=4e-13, Identity=40%"; Hit description =Predicted by genscan and genefinder
MEIISTNYTPNQIQRGDRSSPHKLFSDGTTTRRSLIYASKRDPFGHHYDGNLVDENMILLRMRIREIEMVEMKGKATSDWSVWEKKYFAENYGSDVCEAVGLLQRVLMNTRPSFALGMLALVMLSMSMSTLQVGFHLIEFAKGII

SEQ ID NO: 221657 - protein, 101 aa, Glycine max
  Coding DNA Sequence Number=SeqID_104879
  Subcellular localization annotation: CTP_CleavageSite=41; ConfidenceScore=5.28e-01
MALIIGKPFGGGHTRKGLPATIPQVGPNVKTNPLPSHGGPSVNAIKENRPSRSKKLEDVAASRRFIYQSLQAACMVSRGRGKSDTCLFHLGELRDMETCPV

SEQ ID NO: 221658 - protein, 112 aa, Glycine max
  Coding DNA Sequence Number=SeqID_104880
  Gene Ontology: Mol. function=lyase activity
  Homolog annotation: Hit_ID=Q8U6P9; Match level="QueryCoverage=99%, HitCoverage=33%, E-value=3e-49, Identity=87%"; Hit description =Ornithine cyclodeaminase
MGSDAEHKNEIDPAVFARVRYVADRLTQTRILGELHHAIAAGYVERDQPFAELGEVIAGKSQGRLSNEDITFADLTGTGVQDTAIANLAFARAKDAGSGQIIENSVKMGDAA

SEQ ID NO: 221659 - protein, 168 aa, Glycine max
  Coding DNA Sequence Number=SeqID_104881
MVCNDQAGITERLLVGSLTFDCRIMHYIIVRILLPRSSNLAQASEENLILIWAFQTGHQIDWAHLVRYRMHKALWANAPLPYPHLVTLFLHHFNIPLDDEPFVKVKRSFSISAGAVASFGFRRDVDGQWVRKQDLPPPIPDERTPSPPPQRVDSTSLLIEVLTELRDL

SEQ ID NO: 221660 - protein, 50 aa, Glycine max
  Coding DNA Sequence Number=SeqID_104882
MARIALTVKVGTLPHVARPCNRRRKVPHLLREGVLPLLRHQCAANAPGVL

SEQ ID NO: 221661 - protein, 676 aa, Glycine max
  Coding DNA Sequence Number=SeqID_104883
  Gene Ontology: Mol. function=protein serine/threonine kinase activity; Cellular component=membrane; Biological process=protein amino acid phosphorylation
  Homolog annotation: Hit_ID=Q9LYI8; Match level="QueryCoverage=90%, HitCoverage=66%, E-value=1e-122, Identity=41%"; Hit description =MAP3K delta-1 protein kinase
  Subcellular localization annotation: CTP_CleavageSite=57; ConfidenceScore=5.42e-01
MKHLLRKLHIGGGAATINPSTNHNALSSHAHNHTPSPSTSTLPSPTVVSDRSPVSVEAQNEVADFNLLQEEEFQMQLALAISASDSDRRDTAESAQIDAAKQISLGYSASLTDTHALVQFQSLRYWNYNVIGYDEKVMDGFYDVYGVTSNLVERGKMPLLLDLQTASVFGDVDCEVILVNHVVDLELNHLERKACSLVEECCVSELGLVLSGLLQKLADAVVNRMGGPVVNAEKLTKRWAMRSRELRDSMQTIVLPLGCLDVGLSRHRALLFKVLADRINVPCKLVKGSYYTGTDDGAVNLIKADDGSEYIIDMMGAPGTLIPAEVPSSQLGNNSFAVRGCSEVVVLPNKTHSMVDDGTGVLGVFSDRGRISTMERVQTEELLVMGSQTKPDEKNIFKVNETRRFEHTESYECSSHTEPSPAENMRVKNVSKYVLSAAKDPEFAQKLHNVLVESGALPPPDLFSDINPQDRGVDKVNENIVDSVQADNSLIPSHGVGSASDTKLCQSADWLAEQQKELHRNVEFYNFSQGSNTRNGFVNVYDRDNDIEQSNTINVVLASIHSHKICKEKRPESSLPKAALSCKMHNGVDCFCEDEENGFRNNVEASLNNSELRKDSAILINEMGVNGDCYDGRNKEVNPVLGESSEWEIQWEDLDIGERIGIGSYGEVYRADCNGT

SEQ ID NO: 221662 - protein, 183 aa, Glycine max
  Coding DNA Sequence Number=SeqID_104884
MQGSCMSEHENKSAPCVQFKKVIWIFRLPMTKDETNIQRGPTREKPKGLLMIIPKVVISLLMVSRGIIPFEEHIAAVGTTSNNMLSKRKTLDEGSLPQRSCQLSQPTLRREGDARAHGCVFQERKMHGVATNVYSRKTSDKSETCGLRTLIVKGSGVVFTHGEGISTPSVRHKGRHLQSSVQI

SEQ ID NO: 221663 - protein, 98 aa, Glycine max
  Coding DNA Sequence Number=SeqID_104885
  Gene Ontology: Mol. function=transition metal ion binding
MGDRLEDMICDLGQESFQQAHALMYKGFQSDSKKPLYTRCKNSLSLLLAVLSLVNVKARYGWSEKSFSSLLQVVHNLLLEENMLPKSWYQAKKILCPM

SEQ ID NO: 221664 - protein, 115 aa, Glycine max
  Coding DNA Sequence Number=SeqID_104886
DTLLRRPYRTRAKARVMGEVEEVQEKMKGRHGGHERANGRNDGGHDDHEEDNGKPVQLQLLLPALLLSMGGPHDVQIQNKHAFPPYGLPPNYTPSNVAYTPSENVNNSTPILIES

SEQ ID NO: 221665 - protein, 72 aa, Glycine max
  Coding DNA Sequence Number=SeqID_104887
  Subcellular localization annotation: CTP_CleavageSite=65; ConfidenceScore=5.08e-01
MLTSPERVQMTTLASACQSNLGSLNDGTLGSLDSKGCVRVTVRCLRMPPDSWVTVTKGGVVDKSRAFAPTYP

SEQ ID NO: 221666 - protein, 458 aa, Glycine max
  Coding DNA Sequence Number=SeqID_104888
  Gene Ontology: Mol. function=protein binding; Cellular component =integral to membrane; Biological process=xylan catabolic process
  Homolog annotation: Hit_ID=Q949G7; Match level="QueryCoverage=97%, HitCoverage=86%, E-value=1e-107, Identity=33%"; Hit description =HcrVf3 protein
  Pfam annotation: Domain name=LRR_1; Domain location=104-126; Score =7.5; E_value=11; Accession=PF00560.23; Description=Leucine Rich Repeat
  Pfam annotation: Domain name=LRR_1; Domain location=128-150; Score =8.7; E_value=6.7; Accession=PF00560.23; Description=Leucine Rich Repeat
  Pfam annotation: Domain name=LRR_1; Domain location=152-175; Score =12.3; E_value=1.4; Accession=PF00560.23; Description=Leucine Rich Repeat
  Pfam annotation: Domain name=LRR_1; Domain location=177-199; Score =9.1; E_value=5.6; Accession=PF00560.23; Description=Leucine Rich Repeat
  Pfam annotation: Domain name=LRR_1; Domain location=201-223; Score =17.3; E_value=0.057; Accession=PF00560.23; Description=Leucine Rich Repeat
  Pfam annotation: Domain name=LRR_1; Domain location=273-295; Score =7.6; E_value=11; Accession=PF00560.23; Description=Leucine Rich Repeat
  Pfam annotation: Domain name=LRR_1; Domain location=297-319; Score =13.6; E_value=0.72; Accession=PF00560.23; Description=Leucine Rich Repeat
  Pfam annotation: Domain name=LRR_1; Domain location=31-54; Score=4.1; E_value=50; Accession=PF00560.23; Description=Leucine Rich Repeat
  Pfam annotation: Domain name=LRR_1; Domain location=321-343; Score =15.7; E_value=0.17; Accession=PF00560.23; Description=Leucine Rich Repeat
  Pfam annotation: Domain name=LRR_1; Domain location=345-366; Score =8.5; E_value=7.5; Accession=PF00560.23; Description=Leucine Rich Repeat
  Pfam annotation: Domain name=LRR_1; Domain location=7-29; Score=6.8; E_value=15; Accession=PF00560.23; Description=Leucine Rich Repeat
  Pfam annotation: Domain name=LRR_1; Domain location=80-101; Score =12.2; E_value=1.5; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=104-126::128-150::152-175::177-199::201-223::273-295::297 -319::31-54::...
  Pfam module annotation: Domain location=321-343::345-366::7-29::80-101
MWEALSQVLYLNLSRNHIHGEIGTTLKNPISIPTIDLSSNHLCGKLPYLSSDVLQLDLSSNSLSESMNDFLCNDQDKPMQLQFLNLASNNLSGEIPDCWMNWTSLVDVNLQSNHFVGNLPQSMGSLADLQSLQIRNNTLSGIFPTSVKKNNQLISLDLGENNLSGTIPTWVGEKLLNVKILRLRSNRFGGHIPNEICQMSHLQVLDLAQNNLSGNIPSCFSNLSAMTLKNQSTDPRIYSQGHYGTFYSSMESLVIVLLWLKGREDEYRNILGLVTSIDLSSNKLLGEIPREITSLNGLNFLNLSHNQVIGHIPQGIGNMGSLQSVDFSRNQLSGEIPPTIANLSFLSMLDLSYNHLKGNIPTGTQLQTFDASSFIGNNLCGPPLPINCSSNGKTHSYEGSHGHGVNWFFVSMTIGFIVGFWIVIAPLLICRSWRYAYFHFLDHVWFKLQSFRLGSITV

SEQ ID NO: 221667 - protein, 133 aa, Glycine max
  Coding DNA Sequence Number=SeqID_104889
MSNQEAVSAIKDVKDARSATKIKIPTNPTWNWKFKLQETHGRAKSLSLNKLKIQLDHIDYPSKSLSTCTIDIKMNIAHGRRGRIWKIIVNGVDRFVADRTNDAGEVTVVVYPHFWWVAPFLENSSLDDASFSA

SEQ ID NO: 221668 - protein, 110 aa, Glycine max
  Coding DNA Sequence Number=SeqID_104890
  Gene Ontology: Mol. function=protein phosphatase type 2C activity
  Homolog annotation: Hit_ID=Q9ZPL8; Match level="QueryCoverage=74%, HitCoverage=29%, E-value=1e-25, Identity=68%"; Hit description =Protein phosphatase type 2C
MEAVTDKFKDKEEKVLGSSDPDSGKGKSKMKKHITHGFHLVKGRSGHAMEDYLVAQFKQVDNKELGLFAIFDGHSGHSVPDYLKSHLFDNILKEVMRVRNLFQLLNLYVS

SEQ ID NO: 221669 - protein, 88 aa, Glycine max
  Coding DNA Sequence Number=SeqID_104891
  Gene Ontology: Mol. function=protein phosphatase type 2C activity
  Homolog annotation: Hit_ID=Q9LDA7; Match level="QueryCoverage=55%, HitCoverage=16%, E-value=4e-13, Identity=73%"; Hit description =Protein phosphatase type 2C
MASDILNKVQVEKDEGLEKWRHLNSVTCIKRSTPNKVHIKLKVSRAFGHKSLKIHLSSKPYVTVEMIEDDAKFLILASDGLWKLTFEK

SEQ ID NO: 221670 - protein, 114 aa, Glycine max
  Coding DNA Sequence Number=SeqID_104892
MAKEKALIIQKQDDKLLAMLHDSDLYIVVVVVVFWRGGRRSGMAATREESAFLAGRTWPSPRGVCLRAATAISARRWRFLMASRPRLMALQTSRDLTTRSRSSGRTLSSGGFVI

SEQ ID NO: 221671 - protein, 398 aa, Glycine max
  Coding DNA Sequence Number=SeqID_104893
  Homolog annotation: Hit_ID=Q00M66; Match level="QueryCoverage=31%, HitCoverage=25%, E-value=1e-53, Identity=79%"; Hit description =Remorin
  Pfam annotation: Domain name=HTH_9; Domain location=1-56; Score=65.2; E_value=2.1e-16; Accession=PF08221.2; Description=N-terminal HTH domain of molybdenum-binding protein
MITQHGKIVAKVCENLFSHGPLTLDQLVRYTDLTKDQVRNSLLVLVQHNCAQALVSAPQDDDDDADRLRVRTQYLVLFDNIIHRLRFPKFLEIVLRKLDEEFVKLLVGLLQDGRLTLKQMVDRESQGKGKCFMMHETTSRKLGAKSVKVNSARIADSIHYGCIPALVAFITPRTRIATIKKSLIDPMGNLRNWNSGDLCMANWTGVWRSDREEADGYFHEKNSIRGDGTGRASLHAPQRRPKYKSGPLGPPGVAYHSMYSLAAPVFEVENGGSFMAGSPFSGDGLTICSGGHGGALSARTKPCMAFLASVHGCSKIQNDKFGGFKDVGTNVSCVVSRRDMATQMSPQGPYSLAEAQNKSKAGKKKKAKSEEAKISAWENLQKAKAEAAIRKLEVTSSE

SEQ ID NO: 221672 - protein, 190 aa, Glycine max
  Coding DNA Sequence Number=SeqID_104894
  Gene Ontology: Mol. function=DNA binding; Cellular component=nucleus; Biological process=regulation of transcription, DNA-dependent
  Homolog annotation: Hit_ID=Q52UU1; Match level="QueryCoverage=63%, HitCoverage=70%, E-value=1e-39, Identity=62%"; Hit description =Squamosa promoter binding-like protein
  Pfam annotation: Domain name=SBP; Domain location=69-147; Score =188.1; E_value=2.1e-53; Accession=PF03110.5; Description=SBP domain
MEGRRVERKKTLFERVRKNSTVDEEVENEGEEEDESGVNITEEEKKIGVSSGGGRRGSSGGGGGVSPPSCQAERCGADLTDAKRYHRRHKVCEFHSKAPVVVVAGLRQRFCQQCSRFHDLAEFDESKRSCRRRLAGHNERRRKTNPEAANEGNSKGQHPKETTHCRLADERGRIQMNLTGSSEYKSFNIR

SEQ ID NO: 221673 - protein, 250 aa, Glycine max
  Coding DNA Sequence Number=SeqID_104895
  Subcellular localization annotation: CTP_CleavageSite=36; ConfidenceScore=5.02e-01
EVAQSGSTNTIVDPPSPIRRHVKWKITRTKKTSQMRSKAIKEISDRIASQGSFVTHRRQDVMTVPIGQLEHPVVSVLLDPLYMQSQGLALPPEVEVGPSTARVSTKESFVNPSGVYEGFTNVHNIPLGNDQVKVGVKEVRDADGLFPLKSAHWQMILILPKDNVVICTLKRFNNSQGSKSKAATRWIQEGSTKCGYYVMYWMSMIVLQGFKDNWETYFTDHRSLEPERMKAIRIEWARYYLKVKDQTLGV

SEQ ID NO: 221674 - protein, 73 aa, Glycine max
  Coding DNA Sequence Number=SeqID_104896
MEQLLDPQVLKNNHQKVTSIGLRPRVNPKAIRQRLAETKLVQSSLGRDQPLEPQARGSKRIGLELLKKALGFS

SEQ ID NO: 221675 - protein, 130 aa, Glycine max
  Coding DNA Sequence Number=SeqID_104897
MGSEIYPKVHENPRAFFSSSSPILLEPLACGSSGWSLPREDCTSFVSASRCLIALGFTRVLGDRAIVPLLLYYESSVKALVFLGLDAGGLGHEYPCGFDVFSEKVMRLRDVQAGVNSWWNAEIFFNRDAL

SEQ ID NO: 221676 - protein, 145 aa, Glycine max
  Coding DNA Sequence Number=SeqID_104898
MAASDHAILHDRTHIPTKRSLLELSSQNALLAQNKLLSKQLETLTETLSKSLNQFNVNQPSHSTVLQVGGCSICGGAHKFGRCIPLDDTTQEVNYMGGNQPRPNFHAGGYSGFQRGLNYNQQQGQWRSHPGNQFNKDQGGPSNRP

SEQ ID NO: 221677 - protein, 160 aa, Glycine max
  Coding DNA Sequence Number=SeqID_104899
MHVAQLVSDAIYCLQGSHPQDTQWTRRSPTGPWSSSSDYGPPSVLRSDHHFDLPLPKCQLVYAIMTQGSRLQDTQWARRSPTGSWSSDYEPPSVLRGARRPQQGHQAPINRAFIEKYCSPRQATNAPPPPPEFTSAHPQKGWSIAYDTWPTSRRPSPKQR

SEQ ID NO: 221678 - protein, 134 aa, Glycine max
  Coding DNA Sequence Number=SeqID_104900
  Subcellular localization annotation: CTP_CleavageSite=16; ConfidenceScore=5.01e-01
MAPFVYDDVSLKRRVCSFGGTNLRRHPSDDSVVPTVTLPFRPPRTKTLAIVLTTTTYPISCPLEWCRDLASVKIKREISTLKLLKHPNVRNLDQLEDLLNKVKLKTIRTEPPSASIAGTRYFLIINFDCAFTND

SEQ ID NO: 221679 - protein, 87 aa, Glycine max
  Coding DNA Sequence Number=SeqID_104901
MVALTNGGGNGGVVVVDVAKTRCNDNGVGEMTGCGGGDGDNDDDDGSDYDGMVTMKTTIIVVVAVRTLGSSSKNTGDDKMMVIVIIR

SEQ ID NO: 221680 - protein, 134 aa, Glycine max
  Coding DNA Sequence Number=SeqID_104902
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q2MV13; Match level="QueryCoverage=88%, HitCoverage=19%, E-value=1e-17, Identity=36%"; Hit description=Beta -mannosidase 4
MLLPHAKAIELYRKHFQVGGKRIKFQDGSLISKLLMLIQAKQRGTIGIVAFSSMCDPLRDEECDRQAVSRGLAFDIAWVLDPLVFGEYPPEMRSILGSKMPVFSPMEMSLIKGSLDFIGMIGVPDYNLHIISAM

SEQ ID NO: 221681 - protein, 155 aa, Glycine max
  Coding DNA Sequence Number=SeqID_104903
MTRPCLKAFNLNYKIVRFDSRPVKEVSACICLHIIGLTKPTPGTTFVQGDGLSILRAELKSLKKQVKHLKKQSHSGPEVWRRKSILLRCVEAMTSKIILMMPKNQELSKFQNTRSQKASRIKFQDSRFKNNQVSRIKIQEQSRSRFKNQEKTQSR

SEQ ID NO: 221682 - protein, 194 aa, Glycine max
  Coding DNA Sequence Number=SeqID_104904
MASRKGRASTFRPQEPYDTSRFVFEVAWERYEQNMHNQNILPKRNVELTFSHYDEYLRELERCRWHRALNRQPNNHIDLPQVKEFYANLYDLEDLFLRQCKVRGKLIKFDVATLNEFLEIPVVLELEERGGPMEAAQEGPCKILMMKKMMTKSPKNDFKIEPTSSRSSLISSFKRRNQEDSRIKRSLISRFKKR

SEQ ID NO: 221683 - protein, 78 aa, Glycine max
  Coding DNA Sequence Number=SeqID_104905
MFNDIVSDELESKVPKMARIFDSRSKYEIGRDLYGILKDEVKRKDEEEGMSVKKKGCYGDADEDEEESLLTEHVVNHY

SEQ ID NO: 221684 - protein, 1488 aa, Glycine max
  Coding DNA Sequence Number=SeqID_104906
  Gene Ontology: Mol. function=ATPase activity, coupled to transmembrane movement of substances; Cellular component=integral to membrane; Biological process=response to nematode
  Homolog annotation: Hit_ID=Q9M1C7; Match level="QueryCoverage=94%, HitCoverage=93%, E-value=0.0, Identity=62%"; Hit description =Multidrug resistance-associated protein 9
  Pfam annotation: Domain name=ABC_membrane; Domain location=284-554; Score=96.2; E_value=9.6e-26; Accession=PF00664.13; Description=ABC transporter transmembrane region
  Pfam annotation: Domain name=ABC_membrane; Domain location=909-1185; Score=80.0; E_value=7.5e-21; Accession=PF00664.13; Description=ABC transporter transmembrane region
  Pfam annotation: Domain name=ABC_tran; Domain location=1258-1441; Score=144.5; E_value=2.9e-40; Accession=PF00005.17; Description=ABC transporter
  Pfam annotation: Domain name=ABC_tran; Domain location=628-799; Score= 127.4; E_value=3.9e-35; Accession=PF00005.17; Description=ABC transporter
  Pfam annotation: Domain name=MMR_HSR1; Domain location=1259-1358; Score=-11.4; E_value=0.011; Accession=PF01926.13; Description=GTPase of unknown function
  Pfam annotation: Domain name=SMC_N; Domain location=617-802; Score= -129.7; E_value=0.041; Accession=PF02463.9; Description=RecFRecNSMC N terminal domain
  Pfam module annotation: Pfam domain module=ABC_membrane::ABC _membrane::ABC_tran::ABC_tran::MMR_HSR1::SMC_N; Domain location=284 -554::909-1185::1258-1441::628-799::1259-1358::617-802
MYLYDIDINDRLTLTEFKSLFWTSWQPLESTCLLEHIILPVELGFLVILLFQLLRKYVSQFSKQTKVVHSSQLLLMLNNETQCTSKLQAFTSEIVQVLSWSISLIAIWKISKSHTYFPWILRAWWLCSFILCIITTALHAHFSVINNGQIGLRECADFLGLLASTCLLVISTRGKTGTVLLATNGASEPLLGEKAERHSECLKESPYGKATLLQLINFSWLNPLFAVGYKKPLEQNDIPDVDINDSAEFLTCSFDESLRQVKEKDGTANPSIYKSIYLFARKKAAINALFAVVNASASYVGPYLITDFVDFLGEKGSRGLKSGYLLSLAFLCAKMVETIAQRQWIFGARQLGLRLRAALISHIYQKGLHLSSRSRQSHTGGEIMNYMSVDVQRITDFVWYVNVIWMLPIQISLAVFILHTNLGLGSLAALAATLAVMTLNIPLTKIQKRYQAKIMDAKDNRMKATSEILRNMRTLKLQAWDRQFSQRIEALRQIEYNWLMKSLRQAAFSAFIFWGSPTFISVITFWACMFMGIELTAGRVLSAFATFRMLQDPIFSLPDLLNAIAQGKVSVDRIASFLREEEIQHDVIENVAKDKTEFDIVIEKGRFSWDPESKTPTIDEIELKVKRGMKVAVCGSVGSGKSSLLSGLLGEIYKQSGTVKISGTKAYVPQSAWILTGNIKDNITFGKEYNGDKYEKTIEACALKKDFELFSCGDMTEIGERGINMSGGQKQRIQIARAVYQDADIYLFDDPFSAVDAHTGTHLFKECLMGILKEKTIIFVTHQVEFLPAADLILVMQNGRIAQAGKFEDLLKQNIGFEVLVGAHSKALESIIVAENSSRTNLNSIAEEGESNFSSKPSHQHVQTQHDSVQDNPPEGKGNDGKLVQEEERETGSIAKEVYWEYLTTVKGGILVPLILLAQSSFQILQIASNYWMAWVCPTSSDAKPIFDMNFILLIYMALSVAGSFCVLLRAMMVLNAGLWTAQTLFTKMLHSVLRAPMAFFDSTPTGRILNRASTDQSVLDLEMANRIGWCAFSIIQILGTIAVMCQVAWQVFVIFIPVTAVCIWYQRYYTPTARELARLAQIQITPILHHFSESLAGAASIRAFDQEGRFIYTNLLLVDGFSRPWFHNVSAMEWLSFRLNLLSNFVFAFSLVMLVSLPEGIINPSIAGLAVTYGINLNVLQASVIWNICNAENKMISVERILQYTNITSEAPLVIEDSRPPSNWPETGTICFKNLQIRYAEHLPSVLKNITCTFPGRKKVGVVGRTGSGKSTLIQAIFRIVEPREGSIIIDNVDICKIGLHDLRSRLSIIPQDPALFEGTVRGNLDPLQQYSDIEVWEALDKCQLGHLVRAKEEKLEFPVVENGDNWSVGQRQLFCLGRALLKRSSILVLDEATASVDSATDGVIQNIISQEFKDRTVVTIAHRIHTVIDSDLVLVLSDGRVAEYDEPSKLLEKEDSFFFKLIKEYSGRSHNFSNLATQHVQSREQL

SEQ ID NO: 221685 - protein, 176 aa, Glycine max
  Coding DNA Sequence Number=SeqID_104907
  Gene Ontology: Mol. function=ribose phosphate diphosphokinase activity; Cellular component=chloroplast; Biological process =ribonucleoside monophosphate biosynthetic process
  Homolog annotation: Hit_ID=Q9XG98; Match level="QueryCoverage=90%, HitCoverage=47%, E-value=2e-82, Identity=96%"; Hit description =Ribose-phosphate pyrophosphokinase 1
  Pfam annotation: Domain name=Pribosyltran; Domain location=7-138; Score=117.4; E_value=4e-32; Accession=PF00156.17; Description =Phosphoribosyl transferase domain
MIVISVNNEKYLACAASVILDYLASKTICSDDLVVVSPDVGGVARARAFAKKLSDAPLAIVDKRRHGHNVAEVMNLIGDVRGKVAVMVDDMIDTAGTIAKGAALLHQEGAREVYACTTHAVFSPPAIERLSSGLFQEVIITNTIPVAEQNYFPQLTVLSVANLLGETVWRVHDDCS

SEQ ID NO: 221686 - protein, 94 aa, Glycine max
  Coding DNA Sequence Number=SeqID_104908
MDVLNDDRNSKTMLTQFFAINYRDLQARNHLYREIPEHYFWHKGNKEWHQRRDPASWEYLLSPGETCLPTFKKTVKHWSFLESDNSLRECLVEV

SEQ ID NO: 221687 - protein, 158 aa, Glycine max
  Coding DNA Sequence Number=SeqID_104909
MHHNLFIFLPKISGYVIYEDNKQRPHLSPRQVNLKKSEYVIYGDNKVEGPYEPSCLEASRRLTLGAGRPSSLLDLPSVLLTIEATTAIDVVATLASPPSPTTGVNMPTTSASYVVTSTSTIATPLPSASVATTSAPMMPHPPSLAPPIPPFAVLLVAP

SEQ ID NO: 221688 - protein, 89 aa, Glycine max
  Coding DNA Sequence Number=SeqID_104910
MRDALTSPPLFLAPSKAEQGSIIVIEIRSLTEEATKGHVIPWRREVPPPIQHKALNLFKEEESLSKAPRRVSSEEEPPMEMTSQSIRGC

SEQ ID NO: 221689 - protein, 87 aa, Glycine max
  Coding DNA Sequence Number=SeqID_104911
MPPRKLSAKRSRRDAAAKGTSAAPEYDSHRFRSAEHQQRFEAIKGWSFHRERRVQLRDDEYTNFQEEIARRRWTSLVTPMAKFDPDI

SEQ ID NO: 221690 - protein, 86 aa, Glycine max
  Coding DNA Sequence Number=SeqID_104912
  Gene Ontology: Mol. function=chromatin binding; Cellular component =chromatin; Biological process=chromatin assembly or disassembly
MTEAPILATPYFTIPFPLETDALGMTMGVDLLQILHPIAYYNKAFCPRLQWVSTYVYELQVITSAVCNGVITCWAIPSSSSQITAA

SEQ ID NO: 221691 - protein, 119 aa, Glycine max
  Coding DNA Sequence Number=SeqID_104913
  Gene Ontology: Mol. function=chromatin binding; Cellular component =chromatin; Biological process=chromatin assembly or disassembly
  Homolog annotation: Hit_ID=Q1SAV4; Match level="QueryCoverage=84%, HitCoverage=28%, E-value=3e-14, Identity=39%"; Hit description =Integrase, catalytic region
MALFRLRIALVRWPTALSCLLLPGFIRDHPQLFQITFPPRSWTTILSSNHTRCWTGSGILLPHHQPNSSWFNGRACPPKTPCGRIGNSCKILTTLGTRSFYQMGGMIATPTPQYPLADP

SEQ ID NO: 221692 - protein, 63 aa, Glycine max
  Coding DNA Sequence Number=SeqID_104914
GQGFAPFACPTPEQFGAEVAWPGDWLEAQAREEPAGSPGEAEEAHMDEEMNDLLDFLGGSGAT

SEQ ID NO: 221693 - protein, 604 aa, Glycine max
  Coding DNA Sequence Number=SeqID_104915
  Gene Ontology: Mol. function=nucleic acid binding; Cellular component= intracellular; Biological process=DNA integration
  Homolog annotation: Hit_ID=Q1S9T9; Match level="QueryCoverage=80%, HitCoverage=42%, E-value=1e-112, Identity=43%"; Hit description =Peptidase S8 and S53, subtilisin, kexin, sedolisin; Integrase, catalytic region; Zinc finger, CCHC-type
  Pfam annotation: Domain name=rve; Domain location=17-172; Score=32.4; E_value=1.6e-06; Accession=PF00665.16; Description=Integrase core domain
  Pfam module annotation: Pfam domain module=RVT_2::rve; Domain location=358-549::17-172
MVEGMSLISNDCKREGHTKKYYPERQKTNGGSDRQKYLGDAAIVHDNYETSKVLVSNSSSLETEWIMDSGYFCEQAEGFVLFGDNKSCKIAAFNDFCKANGIARHKIVVGSPQQNGLAERFNRTSLERVRCMLLSAYLPKTFWAETVATATYLTNRCLSTTLDMETPEEIWSNHPPKLDQLKVFGCVACAHIRQDKLDPRVVKCMFLGYPKGVKGYKLWCLEPGHKKCLISRGVVLNENIIAYQDKFDLTKPSTSDTDKTESKRVNFEVEQISKGGQATENYLLSDEDDDESEQQTSELDNYQLARDRVRRETKAHERYGYADLIAFALFFASEVLEEEPKSYEEVLASKEKGKWLRTMNEEIKYLHDNNTWELIRKPPDSKLVSCKWIYKRKEGIFGVEPERFEARLVARGFTQKERIDYNEPEGFIVKGKEDYVCKLKNSLYDLKQSPMQWNKRLPAVGTFVILLLYVDDILIANNSKLEINKVKGELNREFEMKDLGAISKILGMEIKRNRRKGTLKLSQESYLKKVLEKFGMTKLKPVITSQSQQFKLSANQALKTAEEVNYMDSVQYANLVGLLCVLWKSLTGYIFAAFGTVINWKTWL

SEQ ID NO: 221694 - protein, 160 aa, Glycine max
  Coding DNA Sequence Number=SeqID_104916
  Gene Ontology: Mol. function=oxidoreductase activity; Cellular component=integral to membrane; Biological process=electron transport
  Homolog annotation: Hit_ID=O81211; Match level="QueryCoverage=85%, HitCoverage=14%, E-value=8e-44, Identity=61%"; Hit description =Respiratory burst oxidase protein E
MLLLEKDRYMNYSRQLSTASVNWSQNMTDLRPKNEIQRFCRTLQCLALEYWRRGWILLLWLVTTACLFAWKFYLYRNRSTFQVMSYCIPIAKGAAETLKLNMALILLPVCRNTLTWLRSTGARKFVPFDDNINFHKEVQPFYLGFSNSLKCQVRHPRWDT

SEQ ID NO: 221695 - protein, 73 aa, Glycine max
  Coding DNA Sequence Number=SeqID_104917
MEIKNQPCMKKVCDLNQERMKVVATVKVCDLNEVIAIELCNPNKDCRDYERVRTRVSKSQGRVCGRRGVSESK

SEQ ID NO: 221696 - protein, 249 aa, Glycine max
  Coding DNA Sequence Number=SeqID_104918
  Gene Ontology: Mol. function=methyltransferase activity
  Homolog annotation: Hit_ID=Q2JJQ0; Match level="QueryCoverage=44%, HitCoverage=35%, E-value=4e-12, Identity=40%"; Hit description=TRNA (Guanine-N(7)-)-methyltransferase
  Subcellular localization annotation: CTP_CleavageSite=62; ConfidenceScore=5.76e-01
MASSYCCSRLLLQSQSWRLMLRFSPFLATSPPSSSLSFSSNCHVSSSAQLTTLQQQQQPLPRSSQLVALEYADLNLSHNLDLGHVRIRQHVNPLSSSLSVPAQVPEWNHAFADPTLPLMVDIGCGNLNLNDNLFDAFCVSVKDWDRSCSGRFLMWLAKRTPKERNFLGLEIRQKIVKRAESWAKDLALDNVLSSTLFFSTRLVGPIEQPKAVQQEGGSAFGGNSDPYGALQGKKRCHWAKGLLATLLLL

SEQ ID NO: 221697 - protein, 555 aa, Glycine max
  Coding DNA Sequence Number=SeqID_104919
  Homolog annotation: Hit_ID=O80792; Match level="QueryCoverage=18%, HitCoverage=11%, E-value=9e-12, Identity=37%"; Hit description =Putative DEAD-box ATP-dependent RNA helicase 33
MGGGPRTYPGGVSKWVWKRMQAKKAKQLMKARLCRERQIYEMRKRAELKAAVSELERPWEVVEREEATAAPNLFSIKADEQVKVLADRFQRPGGFDLWSERDGPVLFESPDELPSARFFPKGVVHSVKPYRRVDGYGLVKDGGGDGDGIGERGLLKGNDFGGGLRELGDGGMEIEFGGDLSGFKDVDGFELEDDDEECSSSDVSYGSDGGLRRNGNGGRFLPDDVGRSSNRGRGRSSQLNYGRNVVDGDARMRKNGKGRRFLSNNVDRSSGGERSPPLNYGGEGVDGDGRLRRNGNGRRALSDDDGSDGKQSSHLSYGRNGVDGDDRLRRNGTGWSFLSSGDGGRSSHLNYGRDGVDGDGRLRRNGDENGRRVLSDDDGRSRDGGWSSRLNNGRRNGLNADGRMRRNENGSKYVSQGVDETDGGESSPRSSSSGRYGASFDGRLRSKHSGRRVLSKDVDRFGDGRLRSKENGRRFMSKDVDGSNGLYSGEVGSVRKQRGGYSIGGRSRGKYTNRTSDYASPRGRDTNSEVYDMNLQRDGSYGFLKKREQPDSTSW

SEQ ID NO: 221698 - protein, 69 aa, Glycine max
  Coding DNA Sequence Number=SeqID_104920
MGLCFGCLDGGNKRMTKEEERLASEEARARAAEAAQKKLEQQGEAKQPETVKEPENSSNGEAFVKWQMD

SEQ ID NO: 221699 - protein, 580 aa, Glycine max
  Coding DNA Sequence Number=SeqID_104921
  Gene Ontology: Mol. function=binding; Cellular component=thylakoid; Biological process=photosynthesis
  Homolog annotation: Hit_ID=Q10QD7; Match level="QueryCoverage=97%, HitCoverage=75%, E-value=1e-139, Identity=48%"; Hit description=TPR Domain containing protein, expressed
  Pfam annotation: Domain name=TPR_2; Domain location=335-368; Score =16.3; E_value=0.11; Accession=PF07719.7; Description=Tetratricopeptid e repeat
  Pfam annotation: Domain name=TPR_2; Domain location=528-561; Score =8.9; E_value=3.1; Accession=PF07719.7; Description=Tetratricopeptide repeat
  Pfam module annotation: Pfam domain module=TPR_2::TPR_2; Domain location=335-368::528-561
MLCACSSGEQFIFEEPPHSPESLATRDFSASGLSSRTGEWEPKFDETQVEEAESILKEALSLNYEEARALLGRLEYQRGNFDAALQVFQGIDIKGLAPRMIKAIAERTKQRKPRSKADIMVPNVMSLHSVSLLLEAILLKARSLEELGQCIGWFRVPILISLVLSHLLEAAKECRIILDTVESALPNGMPEGIGEDCKLQEMFHIALELFPSLWIKAGFLDEAVTAYHRALVKPWNLEPRRLAAVQKDLAMILLYGGVEVSLPSQLQVWSKTAPKSSVEEAILMLLILMSKVAIREIDWDAEIMDHLTFALSVTGMFELLADHVEQILPVIYSRAERWYFLALCYSAAGHDEVALNLLRKACGSSEANHRPHFPSFLFGAKLCSLDPHHAHEGINFSREVIDLAKHQNEHFLSQGHKFLGICYGAAARISVLDSERSIFQRESLDSLNYAAVSENDDLEVIFSLGLENAIQRNLDAAYNNIMMSSDMTVGSSRGWQLLALIVSAQQRFKDAETIVDCALDESGGMDQLELLRLKAVLQIAQRQPKQAIETYRILLALIQAKKELLIQDNNIDQGQTFRHE

SEQ ID NO: 221700 - protein, 59 aa, Glycine max
  Coding DNA Sequence Number=SeqID_104922
MWFWREERTPLPLVVIIWRKHFLRDQGEAKQMNSLEPRECSDQKEAKSFLFYELYPFCL

SEQ ID NO: 221701 - protein, 50 aa, Glycine max
  Coding DNA Sequence Number=SeqID_104923
MDDFKLGNFIGPSYMNREAQWVAQTTKLSDSCLVGKLIRSFTILCLTSLD

SEQ ID NO: 221702 - protein, 75 aa, Glycine max
  Coding DNA Sequence Number=SeqID_104924
MKFKLQPRGDGLCQVLSKIGDNSYKYISALQGLGRPMTKANAKKATEALNQMVTTLIEADSHLEGLKPKLINYIQ

SEQ ID NO: 221703 - protein, 450 aa, Glycine max
  Coding DNA Sequence Number=SeqID_104925
  Gene Ontology: Mol. function=protein binding; Cellular component =nucleotide-excision repair complex; Biological process=transcription- coupled nucleotide-excision repair
  Homolog annotation: Hit_ID=Q6Z0X1; Match level="QueryCoverage=96%, HitCoverage=98%, E-value=1e-148, Identity=57%"; Hit description =Putative cockayne syndrome 1 homolog
  Pfam annotation: Domain name=WD40; Domain location=105-144; Score =25.8; E_value=0.00015; Accession=PF00400.22; Description=WD domain, G-beta repeat
  Pfam annotation: Domain name=WD40; Domain location=192-231; Score =37.6; E_value=4.2e-08; Accession=PF00400.22; Description=WD domain, G-beta repeat
  Pfam annotation: Domain name=WD40; Domain location=304-342; Score =23.3; E_value=0.00085; Accession=PF00400.22; Description=WD domain, G-beta repeat
  Pfam annotation: Domain name=WD40; Domain location=391-429; Score =29.9; E_value=8.7e-06; Accession=PF00400.22; Description=WD domain, G-beta repeat
  Pfam annotation: Domain name=WD40; Domain location=41-80; Score=22.6; E_value=0.0014; Accession=PF00400.22; Description=WD domain, G-beta repeat
  Pfam module annotation: Pfam domain module=WD40::WD40::WD40::WD40::WD4 0; Domain location=105-144::192-231::304-342::391-429::41-80
MHKQTHRHVWKRIRDREAGKLRANHFANRIKSNRISQLQLSNHKDIVSPHKGAINSLQVDSTEGRYLLSAASDASVAVYDVQRPTVYEAGGGGGGGISKHSSIFVVDKQHQQGHKYAVSTAIWYPIDTGLFVTGSYDHHINVWDTNTTQVVVNFKMPGKVHRAAMSNLSTSHMLIAAATEDVQVRLCDIASGAFAHTLSGHRDGVMTVEWSNSSEWVLVTGGCDGAIRFWDIRRAGCFQVLDQSQTQLGRRPPILKRSMITKDSSTKLRAAQKKHANGSGSRQQPIGRVPSKGPMKQRLHPGMLSTQDRATAHYGAVTGLKATEDGMYLLSAGSDSRLRLWDVESSCNTLVNFETVRLQINKPLQLATTQDSALVFVPCMRSVKAFDMWSGNTYTILRGHYECVNSCWFNQHDQELYTGGNDRQILVWSPARSIADEMEGTAEDQDNWSS

SEQ ID NO: 221704 - protein, 401 aa, Glycine max
  Coding DNA Sequence Number=SeqID_104926
  Gene Ontology: Mol. function=molecular_function; Cellular component =nucleus; Biological process=cell differentiation
  Homolog annotation: Hit_ID=Q6ZIP6; Match level="QueryCoverage=88%, HitCoverage=89%, E-value=4e-63, Identity=40%"; Hit description =Putative interferon-related protein
  Pfam annotation: Domain name=IFRD; Domain location=16-286; Score =170.6; E_value=4.1e-48; Accession=PF05004.4; Description=Interferon -related developmental regulator (IFRD)
  Pfam annotation: Domain name=IFRD_C; Domain location=331-387; Score =44.2; E_value=4.4e-10; Accession=PF04836.3; Description=Interferon -related protein conserved region
  Pfam module annotation: Pfam domain module=IFRD::IFRD_C; Domain location=16-286::331-387
MGKRNSQRKSAAMFDSDDDSSVTSSSTALSDLMSVSGAEDVQFVQDSFLDQALDALDEKRGSTREKALSSIIDAFNSNMQHEFVEKKFATLLHQCLASIKKGSKKASAKEIALASHAIGCLALTVGCGDNAREIFEESIRPLDESLTSRIDVSKTPSCLAIITFVGGNDQEETERSMDMMWRVINPKLGSNVDKEDRSVRIAAGEALALIFEIGVIDKFSAKSDSASDTTQEGSKPLESYIFLQGLKGKVINQCKNLSIEAGGKGSAKKDLNSQRNLFRDILDFFEYGYSPDISMKIGGDSLQASSWSEMIQLNFIKHFLGGGFIKHMQENEFLHEVFGFSPKRKYLNTNEHRMSGGEKRMFKSPNSVLNKARTQSLNKQRILSEGRNFGHYAVGMVDEEA

SEQ ID NO: 221705 - protein, 146 aa, Glycine max
  Coding DNA Sequence Number=SeqID_104927
MDQRNLGDVEWLHLTFLTRAEPYPWLDSMSSTPLNPLFFIDAIEMWWKHDNMLHVDNFYSFFRYRSVPMGALDYRSYIVDFYVWWTQPMPSYYHFVMLVPEIVITSESHSLSLDDSMSSARSNSSSEDTNVISSTPMSPRSMLPES

SEQ ID NO: 221706 - protein, 51 aa, Glycine max
  Coding DNA Sequence Number=SeqID_104928
MLTVRLRMARIPDKIQDINGSKETLKLAVRITDLWFVGTLDKSKQADRPDI

SEQ ID NO: 221707 - protein, 82 aa, Glycine max
  Coding DNA Sequence Number=SeqID_104929
MYELLHCLPLFIDIAIVGNPTCHLQLVHHTYSIVMMDGEEHELKKMHHFGGKVVVIGDGEEASVVAMNDGLKELLWILKLDI

SEQ ID NO: 221708 - protein, 77 aa, Glycine max
  Coding DNA Sequence Number=SeqID_104930
MNVCPHTKLKLGDNCFRNAIQSIATVKAFDSAMVCRNVENWEHMPKCFELGNHDDATLQMVQWGKWLRGRKGSGPVG

SEQ ID NO: 221709 - protein, 151 aa, Glycine max
  Coding DNA Sequence Number=SeqID_104931
  Gene Ontology: Mol. function=RNA-directed DNA polymerase activity; Cellular component=chromatin; Biological process=RNA-dependent DNA replication
MAWFLNLPTSQMTKLQVMVGNSSILDCDTSSSQVPIFVQGHTFTLYLFHLPLSGAEIVLGVQWLKLLSSVTIDYATLTMSFSYLGQPITLHADMLMSPSSSLDQQLKRFAQTQSIVALFHLAQIPTQDHTSSSPQHPLDQPTPPVITSIIN

SEQ ID NO: 221710 - protein, 191 aa, Glycine max
  Coding DNA Sequence Number=SeqID_104932
MGWRSNRGRVSNHPHLQLGGEGTTCICDRGSISRHNDSRGLCLIEQCDGAGTAASIIELVFLEFGPGSRLGQRIMIEEPELPKDCRRMKEQSRTLRPGALSTTMNFELYVRPRLSGRIWCLWRFWGCGGGGDGYEEVSGGFSVVLVGHGGWGVKVEAVLEVVRPLSDPYGSASGYRGVEVAINFSLYTFFL

SEQ ID NO: 221711 - protein, 130 aa, Glycine max
  Coding DNA Sequence Number=SeqID_104933
  Subcellular localization annotation: CTP_CleavageSite=67; ConfidenceScore=5.70e-01
MDATLQLIYYNMIPSLTTPFLPHAATTTSSTSSGASSLSPLSQNPPSVEKIRGFSFEWSRQRRFWVLVEKGVGFDLEAHMFMVLFKVAQRDDFSWFVEDFFDDVGALLITLVVLYGSVQCWVLMPHYFEA

SEQ ID NO: 221712 - protein, 212 aa, Glycine max
  Coding DNA Sequence Number=SeqID_104934
  Gene Ontology: Mol. function=transition metal ion binding; Cellular component=cytoplasm; Biological process=electron transport
MNASRMSPAYEEGIEEFLSFASERSRLDKDGKYFCPCINCLNARRQVLDDIWEHLLCEGIKKNYTTWIRHGELIDMKMGSKTKPIDVEMGDRLEDMICDLGQDSFEQEHALMCDTLESDSKKPLYQECKKSLTLLSAVLSLVNVKARYRWSDKKFTSLLQVVQVMFPKENTLPKSYYQAKKILCLMGMEYQEIHACPNDCILYRQEPKTTKK

SEQ ID NO: 221713 - protein, 129 aa, Glycine max
  Coding DNA Sequence Number=SeqID_104935
  Homolog annotation: Hit_ID=O81323; Match level="QueryCoverage=83%, HitCoverage=45%, E-value=9e-07, Identity=33%"; Hit description=LOB domain-containing protein 30
MVKHWSLTQEVMEETHVYEECHVPRLECQHQRWLMEQQQQLGIDVSLWPSVAWPMKFGPVDQKVKTNHRWWPALPQLWPAVGRQLRNRRVVLPLFAVVEEVVMVEVTPFEQGGHVGKRVLLVSLPAVEQ

SEQ ID NO: 221714 - protein, 36 aa, Glycine max
  Coding DNA Sequence Number=SeqID_104936
MNAFKGRSQTTKRIWMARCAGNEPAANKPLLNHGCY

SEQ ID NO: 221715 - protein, 57 aa, Glycine max
  Coding DNA Sequence Number=SeqID_104937
MKRSMYRVVKLWQGKRYNGISHRRQEDQQGPLGYQSLYMMLNNFCLYQLHYAFLRLG

SEQ ID NO: 221716 - protein, 34 aa, Glycine max
  Coding DNA Sequence Number=SeqID_104938
MIQKWLICSWLIASTSSHPDSFGCLRPENKHIHQ

SEQ ID NO: 221717 - protein, 71 aa, Glycine max
  Coding DNA Sequence Number=SeqID_104939
  Pfam annotation: Domain name=CutA1; Domain location=10-70; Score= -36.4; E_value=0.0027; Accession=PF03091.6; Description=CutA1 divalent ion tolerance protein
MEGSNTIVPSIVVYVIVPNKEAGKKLTGSIVKEKLAACVNRVLDQCTSERERFVLQTVKHTLTWTRTLQHN

SEQ ID NO: 221718 - protein, 1258 aa, Glycine max
  Coding DNA Sequence Number=SeqID_104940
  Gene Ontology: Mol. function=RNA-directed DNA polymerase activity; Cellular component=chromatin; Biological process=chromatin assembly or disassembly
  Pfam annotation: Domain name=RVP; Domain location=395-500; Score= -12.3; E_value=0.063; Accession=PF00077.10; Description=Retroviral aspartyl protease
  Pfam annotation: Domain name=RVP_2; Domain location=386-514; Score= -38.1; E_value=0.00093; Accession=PF08284.2; Description=Retroviral aspartyl protease
  Pfam annotation: Domain name=RnaseH; Domain location=897-1018; Score=- 7.7; E_value=0.0003; Accession=PF00075.14; Description=RNase H
  Pfam annotation: Domain name=rve; Domain location=1151-1258; Score =3.3; E_value=0.0032; Accession=PF00665.16; Description=Integrase core domain
  Pfam annotation: Domain name=zf-H2C2; Domain location=1092-1133; Score=5.9; E_value=0.059; Accession=PF09337.1; Description=His(2) -Cys(2) zinc finger
  Pfam module annotation: Pfam domain module=RVP::RVP_2::RVT _1::Retrotrans_gag::RnaseH::rve::zf-H2C2; Domain location=395 -500::386-514::639-808::160-250::897-1018::1151-1258::1092-1133
MQKVYVTLSLSLYFLRRLPSLEVGPILPLLFFPHSPLLLSLVRPAAATSAMADHATRKTTTDRLEEAINRLSNSQATLLDKHADLFDKYSELSGKVDTLLDHLHLRSPAREHHGSSSHFHQRNSVKLDVPRFDGRDPMGWIFKISQLFEYQNTPEEERIIVASFYLDGAALSWYQWMFRNGFITSWSGFLQALESRFAPSYYDDPKGALFKLTQRGTVNEYLTEFERLANRVIGLPPPFLLSCFVSGLTQDIRREVLALQPISLPQAMALAKLQEDKLRDRRQAPPRNHNTPSASYAPPTRKPHSTYVQRTPDEMALRREKGLCYNCEEKWSSTHRCKGRVLLFIADNLSPTSDEPISEPPLLPLPEPTPACPPDLDSTSELTPPHVSLHALSGLPSSETFRLVGIINHSPLTILIDSGSTHNFLQPRLAQFLRLKTQPTNPLNVLVGNGSVLKCDQVCHDISLLLQDHHFLVTFHLLPISGADVVLGIEWLKQFGPIITDYTTFSMKFTHMGQPIELHADVSTGPTPISAPQVKRLLQTGAASALFHLKVIPNPQPDPLLHLPHPIPAVQALLTQFHNLFQQPSSLPPPRSIVHHITLLPNTPPINVRPYRYPQFQKSEIEKQVSELLESGLIQPSMSPYSSPVLLVKKKDGTWRMCVDYRALNAATVRDRFPIPTIDELLDELGSATWFSKLDLRQGFHQILMHGPDVEKTAFRTHQGHYEYRVMPFGLCNAPSTFQAAMNTLLTPFLRKFAAVFFYDILIYSRTLALHLHHLELVFRTLLQGQYYLKKTKCLFAQKQIEYLGHIVSGQGVKPEPSKIQAMVQWPTPSSAKELRSFLGLTGFYRKFIQNYAMIAAPLTSLFTKDAFEWSLDAQSAFEKLKTAMTSAPVLALLDFNEPFTIETDASGTGMGAVLMQKGHPLAFFSKQFGPRMIHASAYVRELHAIVAAVRKWRQYLLGHPFTIFTDHQSLRELMSQVIQTPEQHYYLSKLLGFDYTIQYKKGSSNAVADALSRSSPSGQFLLLSVPHLDFMHDLRNTLLSSNAFQELLTKVRDKPHDYPDYRIHQGLILFKNRIWLNNDHPSIPNLMLEFHSTPLGGHLGVTKTTHRLESNFFWPSLRKDIKRFVKECTICQQTKSTTQRPAGLLQPLPPPTGVWEDISMDFITQLPSSHGYTVILVVVDRYSKGVHLGALPTNHSTFKVASLFIDIVCKHHGFPKSIVSDRDPIFLSSFWRELFRLSGTRLRMSTAYHPQSDGQTE

SEQ ID NO: 221719 - protein, 525 aa, Glycine max
  Coding DNA Sequence Number=SeqID_104941
  Gene Ontology: Mol. function=RNA-directed DNA polymerase activity; Cellular component=chromatin; Biological process=chromatin assembly or disassembly
MAVGNREVLEQGLLIMPVLASQMLPEPEWIAEPTTELRQLLWQLQAEPPSETLHAPSIPPTYVIKEDDGKTTEVRTEYGVHGRLKRGRGITQPEGHDLELKIELGEVVSTSQFIKEFVNHRNGKSILDARVEAWNLLVIQSHVSESEDIDMGVRSPAWIGEEDECDDQWVVMAEGQYGVETGPQNESKEFELGQVSSQHEKWMGPPAGLQHGSNCQVLVSYIDGEIGLPITDSDQLPSILEGVSGATWEAQLGHKLLLDKVVSTSSINKEEERVADNVAHQAESFQCDMVRQRIEGNLGWVQICGIGWVRGWCIGWVRYNYIRRGWVWVVIICHDEEKNPKGTMVTSVFGHGVVARGVEGVAKVGQTGGLDQGHRLVRLHLAPYLRGQSNDSISKVLELGESVEERRARGELAVGVHPLESREGVALYVKRHNGVGVGEGKGEGLGEVCDGAGPKHWISSSILRVMVLTDSPRSCILSMKAPNGRGANVQTGFEVTSSSKNSRKERKGTEREGNISITELGGDDS

SEQ ID NO: 221720 - protein, 228 aa, Glycine max
  Coding DNA Sequence Number=SeqID_104942
  Gene Ontology: Mol. function=chromatin binding; Cellular component =chromatin; Biological process=chromatin assembly or disassembly
  Pfam annotation: Domain name=zf-H2C2; Domain location=1-34; Score =18.4; E_value=0.0013; Accession=PF09337.1; Description=His(2)-Cys(2) zinc finger
MGIAKTIARLSENFNWTGLREDVTQFVANCIECQFTKYETKNVVGLLYPLPVPFRLWEDLSLDFIIGLPPDHDKMVLLVIVDRFLKGTWGKFLPWVELSHNTSWNLATGNTPYEITFRRKPFSIPEYLSGSSKIDVVDEMLTHWEKVFQSIRKKLLKAQASMKLQANAKRREVHHQVGDWVLLRLRPYRQTSVKNLPTVPAKLAKRYYGPFQIIECIGPVAYRLQLPQ

SEQ ID NO: 221721 - protein, 195 aa, Glycine max
  Coding DNA Sequence Number=SeqID_104943
  Gene Ontology: Mol. function=chromatin binding; Cellular component =chromatin; Biological process=chromatin assembly or disassembly
  Homolog annotation: Hit_ID=Q1SAV4; Match level="QueryCoverage=79%, HitCoverage=39%, E-value=4e-40, Identity=50%"; Hit description =Integrase, catalytic region
  Pfam annotation: Domain name=Chromo; Domain location=103-151; Score =28.4; E_value=2.6e-05; Accession=PF00385.14; Description='chromo' (CHRromatin Organisation MOdifier
MKKAADKHRRDVNYNVGQWVYVKLRPFRQRFVAGPIHPKLSKRYFGPFQIIERVGHVSYKLELPEAARIHPVFHYSLLREHHGPPPPRQDTWPLEFITHQPVPRPLCILDSKLDTSSSPPNKLVLVQWTGQPPEDTTWEPWSEVRNNYHLEDEVVLAGDGIDNSSQEDTKNEPTTTKTKPKRTTSRPCYLNDYET

SEQ ID NO: 221722 - protein, 82 aa, Glycine max
  Coding DNA Sequence Number=SeqID_104944
  Subcellular localization annotation: CTP_CleavageSite=54; ConfidenceScore=5.44e-01
MDKSLKIEKMNGGRGSGRGPWAHNLPMGTKSTLRLMRTLGSSPTPLAQSSWSLLAMALVKGALLRRIASVQPTNPRFSTKCA

SEQ ID NO: 221723 - protein, 72 aa, Glycine max
  Coding DNA Sequence Number=SeqID_104945
PNNYFKGIINSALKGLDDAPQPKSKAPTRWIVVKAAVSPTKPPQKPDPEVDDPLYLMTSTITKLFLRLYQVT

SEQ ID NO: 221724 - protein, 148 aa, Glycine max
  Coding DNA Sequence Number=SeqID_104946
MLHDRDVMNHHVLVVPENNLRQKSSLLNIDSCRRVFPKEEKLQQEQSTPDSVVNRDQNTIPTNPTTAPRHFVNFVYDTKFERTGIPIYPISDYSNHHHHHHQKYSSKGSSHRHKRDQGHLPVNTLHKVAIKAVDVLTVMAIRVELSPS

SEQ ID NO: 221725 - protein, 121 aa, Glycine max
  Coding DNA Sequence Number=SeqID_104947
  Homolog annotation: Hit_ID=Q6ZL37; Match level="QueryCoverage=43%, HitCoverage=5%, E-value=5e-17, Identity=78%"; Hit description =Putative karyopherin-beta 3 variant
  Subcellular localization annotation: CTP_CleavageSite=48; ConfidenceScore=5.18e-01
MALSISPSFILYSLKSLTQEKLMFNTLQFNMSVPTTYVFMKRFLKAAQADRKEHAASAVLNFSEDCTPHMLTPYLDGIVSKLLNGKQMVQEGALTALASIVDYSQEPNTEICASMLDSLIE

SEQ ID NO: 221726 - protein, 91 aa, Glycine max
  Coding DNA Sequence Number=SeqID_104948
  Gene Ontology: Mol. function=GTP cyclohydrolase I activity; Cellular component=cytoplasm; Biological process=aromatic compound biosynthetic process
  Homolog annotation: Hit_ID=Q8VYU3; Match level="QueryCoverage=57%, HitCoverage=11%, E-value=4e-17, Identity=79%"; Hit description=GTP cyclohydrolase I
MNHDNVPSTGLSMLFMETIHMSICFEGLIFGQKGYRQKVKDIVQGALFPEAGLDNRVGHAGGVGGLVIVRDLDLLSYCESCLLHMYLFSKY

SEQ ID NO: 221727 - protein, 123 aa, Glycine max
  Coding DNA Sequence Number=SeqID_104949
  Gene Ontology: Mol. function=identical protein binding; Biological process=negative regulation of enzyme activity
  Homolog annotation: Hit_ID=Q1S4Q1; Match level="QueryCoverage=54%, HitCoverage=9%, E-value=4e-16, Identity=59%"; Hit description =Protease-associated PA; Proteinase inhibitor I9, subtilisin propeptide
  Pfam annotation: Domain name=Subtilisin_N; Domain location=50-122; Score=9.6; E_value=0.018; Accession=PF05922.7; Description =Subtilisin N-terminal Region
MVPLKIMVEKGESSLQKQCFLPPSVLKNMVITKMSPIKQQRRVLNTDVEGSHSFGPNPSSIDVESVTMSHYDLLESYVGSTGKAQEAIFYSYKRYINGFAAILNEDEAANVSSTINQTLGTYV

SEQ ID NO: 221728 - protein, 85 aa, Glycine max
  Coding DNA Sequence Number=SeqID_104950
  Subcellular localization annotation: CTP_CleavageSite=33; ConfidenceScore=5.16e-01
MYACSNNILSVTLLSYIFPYKSTGRNVTNNMVRHQRAWELCSMTWNGDSSRSENPQSKWISGSQGMACKTINDIHISSDKFVVRL

SEQ ID NO: 221729 - protein, 121 aa, Glycine max
  Coding DNA Sequence Number=SeqID_104951
  Gene Ontology: Biological process=ubiquitin cycle
  Homolog annotation: Hit_ID=Q1S9B4; Match level="QueryCoverage=89%, HitCoverage=34%, E-value=4e-22, Identity=50%"; Hit description =Cyclin-like F-box; Serine/threonine protein phosphatase, BSU1
MPPLLTTCIHFSQTSVELSTLSHCDAATKDVDLAVEDSCGGEFAADAHGGTAEPAVEVAVNEPDVGGGEVVDGAAEDIDGGAEDGVGGADGGGGDRGKGSEEGVIRVCGVEREALEEKGVT

SEQ ID NO: 221730 - protein, 185 aa, Glycine max
  Coding DNA Sequence Number=SeqID_104952
  Homolog annotation: Hit_ID=Q1SKD7; Match level="QueryCoverage=94%, HitCoverage=46%, E-value=2e-16, Identity=30%"; Hit description =Ankyrin
MAPRKLASKRSRKDKAAEGTSSAPEYDSHRFRSAVHQQRFEAIKGWSFLRERRVQLRDDEYTDFQEEIGRRRWASLVTPMAKFDLEIVLEFYANAWPTEEGVRDMRSWVRGQWIPFDADAIGQLLGYPLVLEEGQECEYGQRRNRSDGFDEEAIAQLLCIPGQDFARTAADMDDVGPQQHPAQRS

SEQ ID NO: 221731 - protein, 110 aa, Glycine max
  Coding DNA Sequence Number=SeqID_104953
  Subcellular localization annotation: CTP_CleavageSite=39; ConfidenceScore=5.15e-01
MDTSEPYTRVMKDTMHKPQANLGADHKFSPNRFPATKFPTSNVQSFEFGMTGPFDASISYFLIRLDPWVLVPIAFRGLHILDFRGLHVLTFRGLPVLTFRVLHVLAFRGL

SEQ ID NO: 221732 - protein, 98 aa, Glycine max
  Coding DNA Sequence Number=SeqID_104954
  Subcellular localization annotation: CTP_CleavageSite=51; ConfidenceScore=5.08e-01
MRKSVMSETNFGGSVLLIKGGKGNSHFPSSCLPHRSRCCIGTEVTVWIIVSGLTRRNHSLNLCIGNHIIFVQQLCFNNCEGNQDGLCFGAMKEGGCGA

SEQ ID NO: 221733 - protein, 74 aa, Glycine max
  Coding DNA Sequence Number=SeqID_104955
MQDKSKVQKASPKERKSERSENGNRREEEMKKKTQERKSERSKNGKGKSKKAKTGRTGGLKIDNRQSEPCLYIR

SEQ ID NO: 221734 - protein, 617 aa, Glycine max
  Coding DNA Sequence Number=SeqID_104956
  Gene Ontology: Mol. function=protein serine/threonine kinase activity; Cellular component=integral to membrane; Biological process=protein amino acid phosphorylation
  Homolog annotation: Hit_ID=O04086; Match level="QueryCoverage=93%, HitCoverage=94%, E-value=1e-142, Identity=47%"; Hit description =Ser/Thr protein kinase isolog; 46094-44217
  Pfam annotation: Domain name=Pkinase; Domain location=303-576; Score =121.1; E_value=3.2e-33; Accession=PF00069.15; Description=Protein kinase domain
  Pfam annotation: Domain name=Pkinase_Tyr; Domain location=303-576; Score=79.2; E_value=1.3e-20; Accession=PF07714.7; Description =Protein tyrosine kinase
  Pfam module annotation: Pfam domain module=Pkinase::Pkinase_Tyr; Domain location=303-576::303-576
  Subcellular localization annotation: CTP_CleavageSite=21; ConfidenceScore=5.31e-01
MENNVTILLFLPLFTILTTVAASNSSSSSCPINFTYVETFPWNTSSCTNPINKQPCCIALNTIFHIGLTQHLKETSLFQLPNENTSSTCLSDFQTKLKALSIDLSLVPFCFPNPSQFVTNSSTCAGIITTQDWEQKVDSVRLGPLYSYCKESLDDETRCQNCIASSFKVAFQLTSTNQNASVKECFSFASLYAAAVVNPQGASDATTIGCILRVPLNGEVTTKGSSKKRRKVVKLVFAVLGGMVGVVVIAFVVMVVYRKWDRRRKERVYYHREIENGVRNSVLPNTGAKWFHISELERATDRFSRRNMLGQGGDGVVYKGKLSDGTLVAIKENFNLESKGDEEFCYEVEIISKIKHRNLLALKGCCIASDDLKGKRRFLVYDFMPNGSLCYQLSLNVANRLTWPQRKNIIIDVAKGLAYLHYEIKPPIYHRDIKATNILLDSKMSAKLSDFGLAKEGSEEEQSHVTTKVAGTYGYVAPEYALYGQLTEKSDVYSFGIVILEIMSGRKVLDNLNSSADAITDWVWTLVESGKMVEVFDESIREGPEKVMERFVHVGMLCAHAVVALRPTIAEALKMLEGDTDVPKLPDRPVPLGHASFQSSLLHGLQGSGRSKAHVSS

SEQ ID NO: 221735 - protein, 65 aa, Glycine max
  Coding DNA Sequence Number=SeqID_104957
MSDTMSRTSCPKTLEVLYNIFRKNDRSPPAQAVAAQKRTLLYKHEGCTSSVPSPGLKSYFVRFGT

SEQ ID NO: 221736 - protein, 33 aa, Glycine max; identical to SEQ ID NO: 174273
  Coding DNA Sequence Number=SeqID_104958

SEQ ID NO: 221737 - protein, 613 aa, Glycine max
  Coding DNA Sequence Number=SeqID_104959
  Gene Ontology: Mol. function=protein serine/threonine kinase activity; Cellular component=membrane; Biological process=protein amino acid phosphorylation
  Homolog annotation: Hit_ID=O04086; Match level="QueryCoverage=92%, HitCoverage=93%, E-value=1e-157, Identity=51%"; Hit description =Ser/Thr protein kinase isolog; 46094-44217
  Pfam annotation: Domain name=Pkinase; Domain location=288-561; Score =122.1; E_value=1.6e-33; Accession=PF00069.15; Description=Protein kinase domain
  Pfam annotation: Domain name=Pkinase_Tyr; Domain location=288-561; Score=86.7; E_value=7.2e-23; Accession=PF07714.7; Description =Protein tyrosine kinase
  Pfam module annotation: Pfam domain module=Pkinase::Pkinase_Tyr; Domain location=288-561::288-561
MDKQILFLLPLLIMSLFTVSIAAESSSSCPMDLNYVETFPWDSSSCRDPVDKNHCCQVLLSVIGIGLSQHLKQTSLFQLPNETISSNCLSNFQAKLTALSIDPSLVNSCFPNSSQFVTNSSTCAGIITIDDWKQKVGLISPLDTSCNGDLSDQTRCSICSDAGLKVTSGLNSNSTRCFYFTILYAAAIVNQFGPTNLGTASCILGMPLSVKGSSNRGLVLKLVIGLLGAFVGVLLAFVLIVVYRKWDKRRKEDMHHREIESGVRNSVLPNTGAKWFHISELERATSKFSQRNMLGQGGDGVVYKGTLSDGTVVAVKEIFGLETKGDEDFTYEVEIISKIKHRNLLALRGCCISSDNVKGKRRFLVYDFMPNGSLSHQLSIAGANRLTWPQRKNIILDVAKGLAYLHYEIKPPIYHRDIKATNILLDSKMKAKVSDFGLAKQGNEGQSHLTTRVAGTYGYLAPEYALYGQLTEKSDVYSFGIVILEIMSGRKVLDTMNSSVVLITDWAWTLAKSGNMEDIFDQSIREEGPEKVMERFVLVGILCAHAMVALRPTIAEALKMLEGDIDIPQLPDRPVPLGHESFPSSLLQGLQSGRSTAYFSSYLSSFSTRMSTV

SEQ ID NO: 221738 - protein, 73 aa, Glycine max
  Coding DNA Sequence Number=SeqID_104960
MANANCPQESLHSVSNGNLSCETSHNNTSKSKMDPMPYETSPTLEVWDSSVGSKREIPPTGSEKVVSKNSLGN

SEQ ID NO: 221739 - protein, 138 aa, Glycine max
  Coding DNA Sequence Number=SeqID_104961
MASNGINLFKELRHGPIYQKTIPSKVLDRVDLWNGNHLGISKEDMKKHVVPYLKDHIFVQDSINKARFRMQGVNQKVIQSNMMEQSQKEEVEPSSSQLLDGSLSYWWPTPRKLLQIQHNMVKEGCAKGFLLGAGIQSF

SEQ ID NO: 221740 - protein, 379 aa, Glycine max
  Coding DNA Sequence Number=SeqID_104962
  Pfam annotation: Domain name=Transposase_23; Domain location=205-273; Score=-14.3; E_value=0.042; Accession=PF03017.5; Description =TNP1ENSPM transposase
KYDISKEKWAQFCQTRRDPSWEDVRKKAQVIQKQNTAPHVLSRGGYEYLELKLLAEKTKKKLEEAAQSGSVDGVIDPPSPVRRHMKWKMARTKKTREMTTEAAKEITEKIHPGCVRAVGAGVTIKQYFGSAPWTSHSSSSLPPEELQQLAQQIRDQLEESITEKTQSQKQSQGLALPPEPLVGPSVPRVSTKGSCVDPSGNDPKTGDSDRCALYIEADPARLVALGRVYEGSNVVHNTPLLPGQVKVGVEEVTDADAPVPVPSDEVTWDATVFGVFNPDFSLYIKHEDLSEIAHGGQCLSISIGHWQMVVIMPNEHLVVWFYSLHNRPDNYLKGIISSLNQRLLLGGLSSRQKGILSAATMSCTGCPPSFYEVLGITGK

SEQ ID NO: 221741 - protein, 72 aa, Glycine max
  Coding DNA Sequence Number=SeqID_104963
  Subcellular localization annotation: CTP_CleavageSite=54; ConfidenceScore=5.36e-01
MLKPSLVGVVIRKQPSNFPIAVSAIAGNNGGKNKTRRRSRNAKKKQTHTFLLITATMAAGEVHLGGEEEEEE

SEQ ID NO: 221742 - protein, 353 aa, Glycine max
  Coding DNA Sequence Number=SeqID_104964
  Homolog annotation: Hit_ID=Q1SS26; Match level="QueryCoverage=68%, HitCoverage=31%, E-value=8e-09, Identity=23%"; Hit description =Unnamed protein product; no similarity, hypothetical start
MAESMKKRKGSSTTAAAAGHRRHEPSKAPTTPVPPSLIISDPKYLDIAFFDDETFDCYQVFQNSGIVEFMSLKLPHYPELVTVFYNNLRIQDSTLYSEVHGIPFVIDQSLFFSLAKLPSQYVPFEGTVVDDWKFDYSSHDARRMVCNDQADMTNKLFVGSLAFDCRIMHYIIVRILLPHSSNLAQASKEDLILMWAFLTDCQINWADLVKYRMHKALRTNAPLPYPQLVTLFLRHFQIPLDDEPFVQVKRSFAIGVGAVTSFGYRKDIDGYWIRKQDSPPPVPDERTLSPLPQRDASSTLMHEVLSELRGLRAFVGDCLDAMDAHFKGMDTRITQLEDDMGFIHRCFDPPAAP

SEQ ID NO: 221743 - protein, 354 aa, Glycine max
  Coding DNA Sequence Number=SeqID_104965
  Gene Ontology: Mol. function=DNA binding; Cellular component=nucleus; Biological process=regulation of transcription, DNA-dependent
  Homolog annotation: Hit_ID=Q6Q789; Match level="QueryCoverage=73%, HitCoverage=82%, E-value=4e-73, Identity=55%"; Hit description=Myb transcription factor
  Pfam annotation: Domain name=Myb_DNA-binding; Domain location=43-90; Score=46.8; E_value=7.4e-11; Accession=PF00249.21; Description=Myb -like DNA-binding domain
  Pfam annotation: Domain name=Myb_DNA-binding; Domain location=96-141; Score=42.5; E_value=1.4e-09; Accession=PF00249.21; Description=Myb -like DNA-binding domain
  Pfam module annotation: Pfam domain module=Myb_DNA-binding::Myb_DNA -binding; Domain location=43-90::96-141
  Subcellular localization annotation: CTP_CleavageSite=54; ConfidenceScore=5.50e-01
MRNPSSTTTTAATTTTKTKVKNNSNNNIGSNNSPCCNKVGLKRGPWTPEEDEVLANYIKKEGEGRWRTLPKRAGLLRCGKSCRLRWMNYLRPSVKRGHIAPDEEDLILRLHRLLGNRWSLIAGRIPGRTDNEIKNYWNTHLSKKLISQGIDPRTHKPLNPASINVPSSSTTSSKPLPMIITNNHINPVHHDLTNMFNQGVHQVHHLGQHHHQPPASNPYDNHNPVPAAATGDVSAMAFMDNNNEDCNDDININYYSDDVFSSFLNSLINDDAFAAQQHHVQTEIPTPSERSIMNPLPCDDRVGGHLGSIATASAAQGYDDELGVLWESPLVNAATFSQHVDDHITKRVHDHHNQ

SEQ ID NO: 221744 - protein, 163 aa, Glycine max
  Coding DNA Sequence Number=SeqID_104966
  Gene Ontology: Mol. function=catalytic activity; Biological process =trehalose biosynthetic process
  Homolog annotation: Hit_ID=Q45RR4; Match level="QueryCoverage=48%, HitCoverage=61%, E-value=4e-28, Identity=76%"; Hit description =Trehalose-6-phosphate phosphatase
  Pfam annotation: Domain name=Trehalose_PPase; Domain location=1-162; Score=-21.4; E_value=1.1e-05; Accession=PF02358.7; Description =Trehalose-phosphatase
MDATSTLPAPASPTLLCTPPGSSQKKEYTPDISGLCAMSHCFPFPPRGYTNNGYEKKATTEDVELLTKSWAALVEKVRLVLNEYPQLRLTQGRKVLEICVTIKWDKGKALEFLLESLGYENSNDVFPIYIGDDRTDEDAFRDRIQGLHTPNSHCISFVQLELP

SEQ ID NO: 221745 - protein, 955 aa, Glycine max
  Coding DNA Sequence Number=SeqID_104967
  Gene Ontology: Mol. function=nucleic acid binding; Cellular component= ribonucleoprotein complex; Biological process=rRNA processing
  Homolog annotation: Hit_ID=UPI0000162ACD; Match level="QueryCoverage =90%, HitCoverage=98%, E-value=0.0, Identity=46%"; Hit description =RNA binding / nucleic acid binding
  Pfam annotation: Domain name=RRM_1; Domain location=27-94; Score =44.4; E_value=3.8e-10; Accession=PF00076.12; Description=RNA recognition motif. (a.k.a. RRM, R
  Pfam annotation: Domain name=RRM_1; Domain location=331-402; Score =85.8; E_value=1.4e-22; Accession=PF00076.12; Description=RNA recognition motif. (a.k.a. RRM, R
  Pfam annotation: Domain name=RRM_1; Domain location=526-591; Score =30.4; E_value=6.4e-06; Accession=PF00076.12; Description=RNA recognition motif. (a.k.a. RRM, R
  Pfam annotation: Domain name=RRM_1; Domain location=689-765; Score =38.0; E_value=3.4e-08; Accession=PF00076.12; Description=RNA recognition motif. (a.k.a. RRM, R
  Pfam annotation: Domain name=RRM_1; Domain location=789-884; Score =41.1; E_value=3.8e-09; Accession=PF00076.12; Description=RNA recognition motif. (a.k.a. RRM, R
  Pfam module annotation: Pfam domain module=RRM_1::RRM_1::RRM_1::RRM _1::RRM_1; Domain location=27-94::331-402::526-591::689-765::789-884
MLSVLDLNQEGETLMDSLECRPWGHPNLPKDVAEDELREFFSGKGGIITDAKLMRTKDGKSRQFAFIGYRTEDEAQEAIRYFNKNFLRTSRIICEVARKHGDENLPRPWSRHSKKKDDKVTAPDVEKPARANKGQGENSKGSVGDDVDDPQLQDFLQVMQPRVKSKMWANDTSIATNVDNRQAMPNKDNDGASVASDQSGSLEDGFLEDSEPKNKSHEPERDKVISDMDYFKSRVTTEWSDSESSDGEDDDDDNDSSCIDSDRDDHSNAGKDEDNCDSRNGAREVDVDLEGKEDTSGENVTNGKTQVNVTEQGGQLSKSEDEKGVFDSCRLFVRNLPYTTTEEELEEHFSRFGSVSQVHLVVNKDTKRSKGIAYILYTAPNIAARAQEELDNSIFQGRLLHVMPALQRHSDNQENNVLKDQSSKTLKQQRQEKRQADEASGDTRAWNSLFMRSDTVVENIARKFGVSKSDLLDREADDLAVRIALGETQVISETKKAFKNAGVNVEALEELANNKTDELKRSNHVLLVKNLPYGSTENELAKMFGKFGSLDKIILPPTKTLALVVFLEPVEARAAFRGLAYKRFNCALVTCWSSVRIRKQPLCICKGKTAYNIPPSYLRIAKSLWAMRDAPLYLEWAPSNILSQSSTSKNNEINGAIGENEAKRQILEQQVERITDVDIDSDRVQARSLFVKNLNFKTIDESLRKHLTEHMKEGSILSVKVKKHLKNGKNVSMGFGFVEFDSPETATNVCKDLQGTVLDSHALILQPCNVKNDGQKQKTLEKDRSSTKLLIKNVAFEATEKDLRRLFSPFGQVLSEYRYSSDNKGTGIEVASHVNMGKIKSLRLPMKFGNHRGFAFVEYVTQQEAQNALKALSSTHLYGRHLVIERAKEAESLEELRARTAAQFSDEQNGFQSAMKFSKKRKQVDFLDEGKMNLRYGDYLPDANVGDFEVVICRA

SEQ ID NO: 221746 - protein, 90 aa, Glycine max
  Coding DNA Sequence Number=SeqID_104968
MPYLPFIFVFLSSLPKALSFARNPPNLFQKNYGLELIHRWTVVKFEHHGEKKELHEDSKNGGFNPFSVSLTFGNSIEAVGGKTGEISGNR

SEQ ID NO: 221747 - protein, 78 aa, Glycine max
  Coding DNA Sequence Number=SeqID_104969
SHVQTGNYECGCYVMQWIWCIVSGGLKDDWIHGGGDKDYKEVPPPPLFKPAGGHINQAVTFNRSYYKVISSMKKWLSH

SEQ ID NO: 221748 - protein, 252 aa, Glycine max
  Coding DNA Sequence Number=SeqID_104970
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=22%, E-value=1e-29, Identity=39%"; Hit description=Chromo
  Pfam annotation: Domain name=zf-H2C2; Domain location=61-102; Score =9.1; E_value=0.023; Accession=PF09337.1; Description=His(2)-Cys(2) zinc finger
MEQFQQTWLQDTTYQALLQQVLRSPADHPGFTVKQNMLIFHDKLWLPLGHILSKVLLDEFHLTPIGGHMGVEKTLHRIQQHFYWPKMRQDIRHYIAECVTCQQIKLETRKPIGLLQLLPISSSVWVDLSMDFITGLPTSQGYNTIMQWFKFLSLAEWSYNTSVHSGTCYSPFEVMYGKRPPVLPLYSARKSPVESVDAILTSRATIHHTLTRRLQKYQDKMKSMADSHRRDVNFSVGDWVYVCLRPYRQTSL

SEQ ID NO: 221749 - protein, 66 aa, Glycine max
  Coding DNA Sequence Number=SeqID_104971
GQDHLELPSGVGTKHEQQKPVKERMQVRMESRPTDRCPFSALSRQRTSLQGSPVSFVFAVFFYYLF

SEQ ID NO: 221750 - protein, 151 aa, Glycine max
  Coding DNA Sequence Number=SeqID_104972
  Homolog annotation: Hit_ID=Q1RXS1; Match level="QueryCoverage=58%, HitCoverage=20%, E-value=6e-08, Identity=34%"; Hit description=Zinc finger, CCHC-type; Peptidase aspartic, catalytic
  Pfam annotation: Domain name=zf-CCHC; Domain location=131-148; Score =15.5; E_value=0.0027; Accession=PF00098.13; Description=Zinc knuckle
MKTKAKINLQIKLCPQKSLEAILRSNTLNSDEELHKSDFLITIKLLYLETDMWGANTFLRDLDDLVQLCIRVEQQLKRNPTSKSYGSHSYPKKDQGQGILWAAPSKPKDDKGKTVEKKPPKASMQEKTRSIKCFKCLGRGDIASQCPNNKP

SEQ ID NO: 221751 - protein, 310 aa, Glycine max
  Coding DNA Sequence Number=SeqID_104973
AMKEKMATMMEAMMSIKKIMKVNAATVAAASAVARVDSTPPSGLNQINHPASNVDGPHFVQIHNKHAFPPYGLPPNYTPPNVVYTPGEDDNNSATILIESRQPQTDHAHVSQPMGEMHEIPYRNLVDFEPRLGYATEGKAVGAGKIPPVMAKMRKLDHLEERLRAIEEGKDYAFADIEELFLAPNMVIPPKFKVLKFDKYTTTTCPKNHLKMYYRKMGVYAKDEKLLMHLFQESLIGAVVTWYTNLEPSRVHSWKDPMVSFVRQYQHNSKYNSGMTSDRMQLQNMCKRSTNPSRNMPKGGGIWQLKWHLQ

SEQ ID NO: 221752 - protein, 145 aa, Glycine max
  Coding DNA Sequence Number=SeqID_104974
MPLQGEDESRITSRPLEAMDKSLKLWFSPLIQDQVQDSPLNVLRCHEASHGPKIYPKAYENPKVLSCISGPIFLESSIQCPWGVRLHHHPYLALTLTRLYTADNNVKDLFTLDTKLVWSRYIVVVVHLHFAVDVVLGVAVQWQRS

SEQ ID NO: 221753 - protein, 67 aa, Glycine max
  Coding DNA Sequence Number=SeqID_104975
  Homolog annotation: Hit_ID=Q0PW22; Match level="QueryCoverage=77%, HitCoverage=8%, E-value=1e-14, Identity=75%"; Hit description =Leucine-rich repeat receptor-like kinase
MPKGDGLAEKWEASQSADTSNCKPQELSSSDRYFDLTDDSSLLVQAMELSGPRKQKEKNMYLHKYLT

SEQ ID NO: 221754 - protein, 361 aa, Glycine max
  Coding DNA Sequence Number=SeqID_104976
  Homolog annotation: Hit_ID=Q60EP7; Match level="QueryCoverage=36%, HitCoverage=19%, E-value=6e-23, Identity=44%"; Hit description =Unknow protein
PGGSGTGPRWTQPGRCSSAAGRLGIVSAVEAVDGEEGEGSLLVAVGQLLQNQTREAQRQWRVRVTVVGELMGRERRVRLLQVEVLRWKVAREKDVRFQLIKKEVIEMIKMQAPTIESKLQQQAAASGEQELGPDGKPITKKNFSMDTALEDKICDLYDLFVDGLDENSGPQIRKLYAELAELWPNGYMDNHGIKRAICRSKERRRALYSRHKEKIKRKKLLAPRPEENVQVDPSPITLQQPLRERLATDSSGHPHASVNKTVSNTVTTARVHNPVNGPKQEKAKGSSGGSLDDVKGADGVLIKKKVKRKLEQGLEGTHFRPEKIGASLQGEEKTRSLKQSAGVPPKSNLQPTSLPGLEQSS

SEQ ID NO: 221755 - protein, 418 aa, Glycine max
  Coding DNA Sequence Number=SeqID_104977
  Homolog annotation: Hit_ID=Q60EP7; Match level="QueryCoverage=99%, HitCoverage=44%, E-value=4e-25, Identity=42%"; Hit description =Unknow protein
MEIEEQGAPQTNRFSAVIEKIERLYMGKDSSDEEDALDVPDDQYDTDDSFIDDAELDEYFEVDNSSIKHDGFFVNRGKLERMASLGATLRLLPCGLEVTSLSPGNSLFTSGAKSVYIFPPQIPLGWNLMHWQAKKRRRKDVPKNPGEHIDSHVSNKHVKVGKTAAGKTASLPVKNTISSSHNLGVPGEHYEDMTFQNQLDVSGISLKRKTADTRPMLDPPVCSKVSTNAPAAAEDAEKQKTRVLQSKNTSDKYKDASGLLDTSRQKYHEKSASAKSKSQPGKISISVDNLEKAGRSKDKNDIHELPDLNLYVGKSAIQAPKSENVLKKDGSSARPKTTTLEKAIRELEKIVAESRPPTMENQEVDTTPQGVKRRLPREIKLKLAKVARLAASQGKVSKELLNRLMSILGHLIQLRTLK

SEQ ID NO: 221756 - protein, 78 aa, Glycine max
  Coding DNA Sequence Number=SeqID_104978
  Gene Ontology: Mol. function=peptidase activity
MASTNFLFSEGNSINRPHIFNGEGYHYWKTCMQIFIEAIDLNIWEAIEIRPYAPTIVDASTTTEKPRNQWSEEDRRRF

SEQ ID NO: 221757 - protein, 152 aa, Glycine max
  Coding DNA Sequence Number=SeqID_104979
MFLEAFFVAAKVDTNNFTLKATLKGVPSDSERLYDDWLEVKGLRKKKIQGKLLEGEEEDFKSKSLTSFGRIIVHWINMFFVLLRVGTFQQSTSNVPYVMLMTLIFRHYGVSMEEECKDNEGLSWGAKNVVALRLNPRPRMETIYTCFNEEDS

SEQ ID NO: 221758 - protein, 69 aa, Glycine max
  Coding DNA Sequence Number=SeqID_104980
MDSYIHRCGEGNCFFSNCRSIYLKREISYQIKKTTGETKHHSKAKHKDEEDHFELVNEECEVDASDQPA

SEQ ID NO: 221759 - protein, 101 aa, Glycine max
  Coding DNA Sequence Number=SeqID_104981
MSIDALKQAIENNISLPNGSNQDSKVILLASFVEAMISKIIFMMSKNQELSKLQRIRSEKASRIKFQRIKIQEQSSFKIQDSRAIKTQDSRIKRRLNQDKY

SEQ ID NO: 221760 - protein, 82 aa, Glycine max
  Coding DNA Sequence Number=SeqID_104982
MKKRDPFVVVERVCVHHKHLAEGLVYEPINHPYPSDIQRMQQRQLQWQKNENRVREHGEEREGLGGVGGSPKVSWTRADIGL

SEQ ID NO: 221761 - protein, 67 aa, Glycine max
  Coding DNA Sequence Number=SeqID_104983
MKLQDWEQVRELSLEGSLSTSSNFHFTVSFALNFEWQVKEEVASHYLGQGGIGLVSSYVAYSPKIAS

SEQ ID NO: 221762 - protein, 295 aa, Glycine max
  Coding DNA Sequence Number=SeqID_104984
  Gene Ontology: Mol. function=protein kinase activity; Cellular component=cell surface; Biological process=protein amino acid phosphorylation
  Homolog annotation: Hit_ID=Q1S8T9; Match level="QueryCoverage=92%, HitCoverage=48%, E-value=2e-83, Identity=54%"; Hit description =Protein kinase
  Pfam annotation: Domain name=Pkinase; Domain location=3-240; Score =100.4; E_value=5.5e-27; Accession=PF00069.15; Description=Protein kinase domain
  Pfam annotation: Domain name=Pkinase_Tyr; Domain location=5-240; Score=25.7; E_value=4.8e-14; Accession=PF07714.7; Description =Protein tyrosine kinase
  Pfam module annotation: Pfam domain module=Pkinase::Pkinase_Tyr; Domain location=3-240::5-240
MARGFKEKLGGGGYGIVFKGKLHSGPSVAIKMLHKAKGSKRALVYEFMPNGSLDKFIFPKDGNIHLTYDEIYNIAIGVARGIAYLHHGCEMKILHFDIKPHNILLDETFTPKVSDFGLAKLYPIDNSIVTRTEARGTIGYMAPELFYGNIGGISHKADVYSFGMLLIDMTNKRKNPNPHADDHSSQLYFPTWIYNQLGKETDIEMEGVTEEEKKMIIVSLWCIQLKPSDRPSMNKVVEMLEGDIESLEIPPKPSLYPHDTMENDQSIYSSQTMSTDFISSSSYSKEIVTNPLVED

SEQ ID NO: 221763 - protein, 177 aa, Glycine max
  Coding DNA Sequence Number=SeqID_104985
  Gene Ontology: Mol. function=receptor activity; Biological process =protein amino acid phosphorylation
  Homolog annotation: Hit_ID=Q84KS6; Match level="QueryCoverage=82%, HitCoverage=62%, E-value=3e-13, Identity=29%"; Hit description =Membrane located receptor-like protein
VSEKQFERHVETESFIGVRVITSDPKGCGDKWYELACENNVTVLYLYSGKYHVQAINYNNFTIRVVDPVIDNEKYVETDPCIKWHFSKGYIYAIAGDLIAKDFEVGCEVKLVAPTSWWGLDTNNSSYTQMHRALLYGFELSWINLACDDQCGNSNCAFHASSHMLQCTQNMNGTKAY

SEQ ID NO: 221764 - protein, 94 aa, Glycine max
  Coding DNA Sequence Number=SeqID_104986
  Gene Ontology: Mol. function=nucleotide binding; Cellular component =membrane; Biological process=small GTPase mediated signal transduction
  Homolog annotation: Hit_ID=Q40207; Match level="QueryCoverage=87%, HitCoverage=40%, E-value=1e-31, Identity=78%"; Hit description=RAB1Y
  Pfam annotation: Domain name=Ras; Domain location=5-60; Score=-96.0; E_value=0.044; Accession=PF00071.12; Description=Ras family
MNGSIPHPNNLIFQESERVVSKKEGIDFAREYGCLYTECSAKTRVNVTQCFDELVMKILETPSLLAEGSSGVKKNIFKQKPPLSDASSSGCCSW

SEQ ID NO: 221765 - protein, 131 aa, Glycine max
  Coding DNA Sequence Number=SeqID_104987
MKWEGKERKGKGSRGSGGFTVLMRNIVFHGKYFFAGGNSFLSALVCPSDSEKNGIMRGLAFGVYVPPLMGFEDPGKDNFSVILWLELKAEEKNCHKKKTGPTGSRTQVAGFKVQSANHYTIEPLDVLGNKF

SEQ ID NO: 221766 - protein, 287 aa, Glycine max
  Coding DNA Sequence Number=SeqID_104988
  Gene Ontology: Mol. function=heat shock protein binding; Cellular component=integral to membrane; Biological process=protein folding
  Homolog annotation: Hit_ID=UPI00001971A6; Match level="QueryCoverage =99%, HitCoverage=77%, E-value=6e-94, Identity=60%"; Hit description =heat shock protein binding / unfolded protein binding
MAVFALLFGSELFEDYIGHLAVASMASSELADGTEDPDKLNEKLKARMDYLGQYVRGDKKGFFQRAESEARRLSRAAFGVDMLHTIGYIYSRQAAQELGKKAIYLGVPFLAEWVRNKGHFWKSQFTAAKGAYQLLQLQDDIRKQFKMDGSSVPENDVDSHIRLNKDTLMNSLWKLNVVDIEVTLVHVCQMVLKENNVKKEELRLRATALKILGKIFQDKYPKGETLKKKIAADSDDEESSSDSSDDESPRAISYRTPFFTQGLGRLFKCLCNPAFDVDDEEIVYKSK

SEQ ID NO: 221767 - protein, 90 aa, Glycine max
  Coding DNA Sequence Number=SeqID_104989
MAPDQHKYRVRSRKCLGCGELWVEVWWLQHKPDCKSWFIEEEHDEVMNDIDSDGDVVAFTTRDAPVALIINGGDKGPSLPQLAKVPQPRN

SEQ ID NO: 221768 - protein, 169 aa, Glycine max
  Coding DNA Sequence Number=SeqID_104990
MACFHFLSDYASDTEEESVTLCNDVGLDSWTCTDPGMAFSLLEYVIFFPNFLLLGAGSDAGPAVPSSGAGSTTDSGAYSDSTTRCSTTDSDMRVTLGRLIGIIHVVKAIPFSSINHIGGQFRDMKDMFYSLSCCCYKGSICCENFLVARTWRICGVFREWCHMVSGSRV

SEQ ID NO: 221769 - protein, 176 aa, Glycine max
  Coding DNA Sequence Number=SeqID_104991
  Gene Ontology: Cellular component=extrachromosomal circular DNA
  Homolog annotation: Hit_ID=Q3SKR3; Match level="QueryCoverage=70%, HitCoverage=16%, E-value=2e-11, Identity=30%"; Hit description =Hypothetical protein precursor
  Subcellular localization annotation: CTP_CleavageSite=23; ConfidenceScore=5.37e-01
VAKISAKLQLSRPASNTPPQSVTLSAKPVDDDGVTSTATTVITTAGIPFRYGRLAMTPAHGSELLPLSVPIEAQYWNGSTAYIRSTNDSCTTVDPKAVTMKNYKAPKIGSDGKPNTGSVDLEININSASGEQTCQSSGGSISSIVDSKPWFGNIEPGARATFGIYKAPIIYMRENF

SEQ ID NO: 221770 - protein, 569 aa, Glycine max
  Coding DNA Sequence Number=SeqID_104992
  Homolog annotation: Hit_ID=Q3SKR2; Match level="QueryCoverage=32%, HitCoverage=60%, E-value=3e-23, Identity=34%"; Hit description =Hypothetical protein precursor
MEWFKRQKNKQQVGISYTDMHVSTVALTPPSEGAKPVVSFAAVEQVPLHATSTLRHFVTKNDLKSLPCNLVLNVDQYNIVQIDKPNMPDNEVKPALRWKLKGLLDYSVEQAVVDGIDVPVDPAYANRQPLMLAICAKKATVSEVGNQLTEAGFNVKSVDVHALVQRNIAHLLEHEDRALVMLSILPRGCLLTFTAKGELYHARLIELDRDFLNDRDEIFRTNFDKLVLELQRSLDSFDRQFPYLSLNRLVVAPVAHRDYLPGKTSHAVASPGCCLASGDGSMSQQINLFEGGLVRSKDWFTLPVVGGIYAFAAGVMFYLGTGLEAESAQLQVQRSQAMAQYENIQKKVDELSQRVVPVDNSKLETELKNLKARFDMQSQILAIFQQSISDTASHLVDYMRALTARQQPGLWLTGFKIEPAAQHVTLNGQALQSGDIPLYLDLLSSQPIFEGTQFSGIQFKQVELHKTQPATPAPAPANAVPLVASSVSEQPTSGKGASEPSSASAAPAVTTAAAVAPAAPAQEVTLKVYDFEVKGQDLQNRAKRDNAVSWDEFVRQTTQSQPAQQPRKE

SEQ ID NO: 221771 - protein, 157 aa, Glycine max
  Coding DNA Sequence Number=SeqID_104993
NHPNLRWSNPSQQQQQQQQPYFQNDTGPSRPYVPPPIQQQKQQIVEAPLALKAIKRDSHDASICYRTRSSLPSGEESCALSDLNVRITIRYLCMSSDSPSLDDKGADDEITISYLRMSLDSPSLDDKGADDNVRITIRYLRMSSDSPSLDDKGADDD

SEQ ID NO: 221772 - protein, 132 aa, Glycine max
  Coding DNA Sequence Number=SeqID_104994
MTTSFTLCSHSPSRDHSSHSLILIVSHSFQTLAYKIVSIQDYQPMIPFYSQNIEPRPHKKLEYRGRRETHSWNSHEEAQSQGTECCSSTECHEASRLGTSKRTQLGRKVRSKDTDSCNRYAIVLKRKLQVIT

SEQ ID NO: 221773 - protein, 258 aa, Glycine max
  Coding DNA Sequence Number=SeqID_104995
  Gene Ontology: Mol. function=nucleic acid binding; Cellular component= chromatin; Biological process=DNA integration
MTLLSTIEPKNIEEALSEDSWVIAMEEELSQFTKNTVWNLVPPPMNHSVIGNKWVLKNKLNEEGEVVKNKARLACPLHPDSINQGGFAVPKSPSDIVIETLSCVYGLKQALRAWYERLSSFLVSNGFTRGITDPALFRKAQKGNLLIIHIYVDDIIFGATSKRMCKEFFELMKDGFETSMKGELKFLLGLQIIQKVYGIFIHQEKYTKSHLKRFRMDEAKPMATPMHRSTIIDKDEKGYCDVYFAGDKVERKSTSRNG

SEQ ID NO: 221774 - protein, 617 aa, Glycine max
  Coding DNA Sequence Number=SeqID_104996
  Gene Ontology: Mol. function=protein serine/threonine kinase activity; Cellular component=membrane; Biological process=protein amino acid phosphorylation
  Homolog annotation: Hit_ID=Q1S8T0; Match level="QueryCoverage=95%, HitCoverage=93%, E-value=1e-147, Identity=46%"; Hit description =Protein kinase
  Pfam annotation: Domain name=Pkinase; Domain location=307-576; Score =137.3; E_value=4.1e-38; Accession=PF00069.15; Description=Protein kinase domain
  Pfam annotation: Domain name=Pkinase_Tyr; Domain location=309-576; Score=86.0; E_value=1.2e-22; Accession=PF07714.7; Description =Protein tyrosine kinase
  Pfam module annotation: Pfam domain module=Pkinase::Pkinase_Tyr; Domain location=307-576::309-576
MLQGNSILITLLLMLLLIRNGNGQNKGNKELSCGPGEPLIRFPFQLVKGIKDECANPGFCLYCTKKNETMVVLSTIEFRVYSIDYEFNFFRLKDPENCLPNKFLQINNFFLQHNQLELGFPGHEGTNNLSFFNCSSVGYTYLRRFVYGPYCLDFSQQDMISCPIYVSSSYDSVLDLDLTSCTRMFDLISPAEADDLQWNSLNMRWSIPNCTKCEAKGKRCKWKNNSNTEGDIECFGYKRKRIHVPQSFIFATTGSIFLGLVVIVVFKIALYFRQKEDDQARVAKFLEDYRAEKPARFTYADLKRITGGFKEKLGEGAHGAVFRGKLSNEILVAVKILNNTEGEGKEFINEVGIMGKIHHINVVRLLGFCAEGFHRALVYNLFPNGSLQRIIVPPDDKDHFLGWEKLQQIALGIAKGIEYLHQGCNQPIIHFDINPHNVLLDDNFTPKISDFGLAKLCSKNPSLVSMTAARGTVGYIAPEVFSRNFGNVSYKSDIYSYGMLLLEMVGGRKNVDMSSAQDFHVLYPDWIHNLIDGDVHIHVEDEVDIKIAKKLAIVGLWCIQWQPVNRPSIKSVIQMLETGEENQLNVPPNPFNSTTSTITSGHTRVTRRPLELEVIQE

SEQ ID NO: 221775 - protein, 300 aa, Glycine max
  Coding DNA Sequence Number=SeqID_104997
  Gene Ontology: Mol. function=protein kinase activity; Cellular component=cell surface; Biological process=protein amino acid phosphorylation
  Homolog annotation: Hit_ID=Q1S8T9; Match level="QueryCoverage=87%, HitCoverage=45%, E-value=4e-96, Identity=61%"; Hit description =Protein kinase
  Pfam annotation: Domain name=Pkinase; Domain location=3-243; Score =99.8; E_value=8.3e-27; Accession=PF00069.15; Description=Protein kinase domain
  Pfam annotation: Domain name=Pkinase_Tyr; Domain location=5-243; Score=22.8; E_value=7.2e-14; Accession=PF07714.7; Description =Protein tyrosine kinase
  Pfam module annotation: Pfam domain module=Pkinase::Pkinase_Tyr; Domain location=3-243::5-243
MARGFKDKLGEGGYGFVFKGKLRSGPSVAIKMLHKSKGSKRALVYEFMPNGSLDKFIFTKDGNIHLTYDKIYNIAIGVARGIAYLHHGCEMQILHFDIKPHNILLDETFTPKVSDFGLAKLYPIDNSIVTMTAARGTIGYMAPELFYKNIGGISHKADVYSFGMLLMEMASKRKNLNPHADHSSQLYFPFWIYNQLGKETDIEMEGVTEEENKIAKKMIIVSLWCIQLKPSDRPSMNKVVEMLEGDIESLEIPPKPSLYPHETMENDQSIYSSQTMSMDFISSSSYSKEIVTNPLVEDAI

SEQ ID NO: 221776 - protein, 103 aa, Glycine max
  Coding DNA Sequence Number=SeqID_104998
MRHFPKLNNPGSGRETKSDFALGSKSTKSIILYAASGTESNALEGKGLLRFRAIPHTGSSHLTNGLCRFGPRGLRVARKEDEDVEMEMAQATSNMKSFVVGDV

SEQ ID NO: 221777 - protein, 189 aa, Glycine max
  Coding DNA Sequence Number=SeqID_104999
  Gene Ontology: Mol. function=receptor activity
  Homolog annotation: Hit_ID=Q84KS6; Match level="QueryCoverage=75%, HitCoverage=52%, E-value=8e-09, Identity=30%"; Hit description =Membrane located receptor-like protein
VSEKQFERHVETESFIGVPAINYNNFTIRVVDPGVQQPYCSSIPRYFLSPTNFSAIDEGHAVIDNEKYVETDPCIKWHSKGYIYAIAGDLIAKDFEVGCEVKLVAPTSWRGLDTNNSSYTQMHRALLYGFELSWINFACGDQCGYFYSDCAFDASIQKLQCPCRNFLGGQLFQLQCAKGCKNYIFTNHQ

SEQ ID NO: 221778 - protein, 247 aa, Glycine max
  Coding DNA Sequence Number=SeqID_105000
  Gene Ontology: Mol. function=receptor activity; Biological process =protein amino acid phosphorylation
  Homolog annotation: Hit_ID=Q84KS6; Match level="QueryCoverage=88%, HitCoverage=67%, E-value=3e-27, Identity=36%"; Hit description =Membrane located receptor-like protein
MWRQSALLVFLLLLVHQICATNEQEHACPPSSCGKITNITYPFRLRGDPKGCGDNRYELACENNVTVLYSYSGKYHVQAINYNNFTIRVVDPGVQQPNCSSLPRYFLSPTNFSDSDNFYLDRYQIQNRCYPWKRAFQKHIIFLNCRHAVIDNEKYVETDPCIKWHSKGYIYAIAGDLIAKDFEVGCEVKLVAPTSWWGLDTNNSSYTQMHRALLYGFELSWINLACVDQCGNPDCAFDAYSQKLQCS

SEQ ID NO: 221779 - protein, 108 aa, Glycine max
  Coding DNA Sequence Number=SeqID_105001
  Gene Ontology: Mol. function=transcription factor binding; Cellular component=intracellular; Biological process=regulation of transcription, DNA-dependent
  Homolog annotation: Hit_ID=O23657; Match level="QueryCoverage=83%, HitCoverage=42%, E-value=2e-40, Identity=90%"; Hit description =AtRab18 (Putative GTP-binding protein) (GTP-binding protein(RAB1Y), putative)
  Pfam annotation: Domain name=Arf; Domain location=1-107; Score=-97.5; E_value=0.031; Accession=PF00025.11; Description=ADP-ribosylation factor family
  Pfam annotation: Domain name=Miro; Domain location=18-106; Score= -1.4; E_value=0.0075; Accession=PF08477.3; Description=Miro-like protein
  Pfam annotation: Domain name=Ras; Domain location=18-108; Score=39.9; E_value=2.9e-12; Accession=PF00071.12; Description=Ras family
  Pfam module annotation: Pfam domain module=Arf::Miro::Ras; Domain location=1-107::18-106::18-108
MDASSSSSSQPEFDYLFKLLLIGDSGVGKSTLLLSFTSDTFEDLSPTIGVDFKVKYVTIGGKKLKLAIWDTAGQERFRTLTSSYYRGAQGIIMEYNNIVLCMKHHSVK

SEQ ID NO: 221780 - protein, 154 aa, Glycine max
  Coding DNA Sequence Number=SeqID_105002
  Gene Ontology: Mol. function=chromatin binding; Cellular component =chromatin; Biological process=chromatin assembly or disassembly
  Pfam annotation: Domain name=Chromo; Domain location=46-100; Score =38.6; E_value=2.1e-08; Accession=PF00385.14; Description='chromo' (CHRromatin Organisation MOdifier
AYKLQLPDQSKIHPIFHVSLLKKAVGEYHVQNELPKDLEVIMDEEIYPVRVLGTRIIMKNGSSVPQSLIQWKDKSIDDVTWEDDVVIRGQFPKFNLEDKVLIEEGGIDRNADELVGIDEGPRPKVWRVYQRKNKKGIMGNVGNRKNDYVEGNIV

SEQ ID NO: 221781 - protein, 224 aa, Glycine max
  Coding DNA Sequence Number=SeqID_105003
  Gene Ontology: Mol. function=3'-5'-exoribonuclease activity; Cellular component=exosome (RNase complex); Biological process=RNA processing
  Homolog annotation: Hit_ID=Q2PYZ2; Match level="QueryCoverage=80%, HitCoverage=56%, E-value=3e-61, Identity=68%"; Hit description=3'-5'- exoribonuclease/RNA binding protein-like protein
  Pfam annotation: Domain name=RNase_PH; Domain location=39-185; Score =46.2; E_value=1.1e-10; Accession=PF01138.11; Description=3' exoribonuclease family, domain 1
MGLSNASEDLSSEMEVDAFRRLFPLRYFERHLAESIRPDGRPLGKARETSAVASANGSALVKIGSTTMLTAIKMEVMTPSLESPDEGCLAIDFHMPPICSPIVRPGRPAEASPVVSKQLSDTISRHIIIFAVTFSRMIDLKELSLVGGKAAWMAYLDIYCLDADGALFDAALISAVAALSHCKNKKKKKPADDMSAKGAITSCYVALAKDMMVSTKTGNETVNY

SEQ ID NO: 221782 - protein, 249 aa, Glycine max
  Coding DNA Sequence Number=SeqID_105004
  Gene Ontology: Mol. function=protein kinase activity; Cellular component=cell surface; Biological process=protein amino acid phosphorylation
  Homolog annotation: Hit_ID=Q1S8T9; Match level="QueryCoverage=82%, HitCoverage=32%, E-value=3e-73, Identity=63%"; Hit description =Protein kinase
  Pfam annotation: Domain name=Pkinase; Domain location=3-192; Score= -20.3; E_value=2.4e-07; Accession=PF00069.15; Description=Protein kinase domain
  Pfam annotation: Domain name=Pkinase_Tyr; Domain location=5-192; Score=-89.4; E_value=5.5e-07; Accession=PF07714.7; Description =Protein tyrosine kinase
  Pfam module annotation: Pfam domain module=Pkinase::Pkinase_Tyr; Domain location=3-192::5-192
MARGFKDILGEGGYGFVFKGKLRTIGVARGIAYLHHGCEMQILHFDIKPHNILLDETFTPKVSDFGLAKLYPIDNSIVTMATARGTIGYMALELFYKNIGGISHKADVYSFGMLLIEMASKRKNLNPHADHSSRLYFPFWIYNQLGKETDIEMEGVTEEENKIAKKMIIVSLWCVQLKPSDRPSMNKVVEMLEGDIESLEIPPKPSLYPHETMENDQSIYSSQTMSTDFISSSSYSKEIVTNPLVEDAI

SEQ ID NO: 221783 - protein, 178 aa, Glycine max
  Coding DNA Sequence Number=SeqID_105005
MYPFLFSVTTTQVDVPSTCTTKDVPSNVLRQSFEAVSPLKLCEGKTKDISGDTLVIDYQYIEIDYTIQKTIGTLQIQLKAFEIKLCHCMHQSPSISIRGSSSSSTSFSAFLSGIDPSTCIHFSTPTYAWTDAQVPVSGPANHYSRPASIVLTYEDGSAPHNSKGLYSVGRMTKSPTLY

SEQ ID NO: 221784 - protein, 263 aa, Glycine max
  Coding DNA Sequence Number=SeqID_105006
MVEVDKSSYGIYANFASEGGQAMARATPFEVEDSFYVNNKPTYASLMAYIADNKKQMATVIVEIRKMATPAVEIGKTATVIIEIEKMAITTIEIGKSINAVVKIGKAITTVVEKKEKMDIDAINEKRKEMDIDAIEEKKKKMDTDAIFHTLISSGDDHLQTFRFLPAELSCITLIAAHSVRFFDVSKGNVKITQKEGKRDEVISSPRVSKFPEVQREEERIERKKKEEKTRLKRFRIASVINSYTVCRLFFGRSSFMLRSSFD

SEQ ID NO: 221785 - protein, 70 aa, Glycine max
  Coding DNA Sequence Number=SeqID_105007
MQKAREKLKKRRKLEAGSVQYTLSGHKRGVKHEDAGSVTRAKHTIQHKHTLSLQHALSAQSKHAKHEVSC

SEQ ID NO: 221786 - protein, 142 aa, Glycine max
  Coding DNA Sequence Number=SeqID_105008
MSLPELMVEENTITVDSNLDHFLNYETEQHTPVAGEELGFIDPTDKIFKERQIQLMFMPLYLSTFDFFDSMPSKASESSYNRPFTHFDEAEAKFRRLAFDQSLKDSLSNPNYKPQLQQSINEVFKFQNLVVDEIQKENGIFP

SEQ ID NO: 221787 - protein, 130 aa, Glycine max
  Coding DNA Sequence Number=SeqID_105009
  Homolog annotation: Hit_ID=Q5N7G7; Match level="QueryCoverage=37%, HitCoverage=22%, E-value=2e-10, Identity=66%"; Hit description =Prolyl 4-hydroxylase alpha subunit-like
  Pfam annotation: Domain name=DUF584; Domain location=4-128; Score =98.3; E_value=2.3e-26; Accession=PF04520.4; Description=Protein of unknown function, DUF584
MREVYYNFLEVVIYFARPISGRMIPRSSNSNSASSSNEDTVLQQSAPDKIPDWFDGDGVANYGGGSDEDGEENDESDSKLPPHEFIAQRLERSKISSFSILEGAGRTLKGRDLSKVRNAVLSKTGFLESL

SEQ ID NO: 221788 - protein, 288 aa, Glycine max
  Coding DNA Sequence Number=SeqID_105010
  Homolog annotation: Hit_ID=Q9ZV49; Match level="QueryCoverage=81%, HitCoverage=77%, E-value=1e-07, Identity=23%"; Hit description =Expressed protein
MQFLGFFGIYKEASKIILSWRRIFTQITSTLILPLSFIFLIHMEISNLLFRKILINEIVMDETKPNTPQYNKLDHMISSEMVTLVVFKIAYFTLLLIFSLLSTSAVVYTIASIYTAKDVTFKRVMSVVPKVWKRLMLTFLCAFAAFFAYNIMTALVMFLSIVTIGLSSGGLAVLVSITVLYFIGFVYLTVVWQLASVVTVLEDSWGVRAMAKSKELIRGKMVLSIFIFFTLVASFVSIRVLFKVMVVDGWRSYHHENIDKSALADHLEGYRGEYVPLTAKDVQLEQYQ

SEQ ID NO: 221789 - protein, 171 aa, Glycine max
  Coding DNA Sequence Number=SeqID_105011
MEVWLGKWLRCFGEDEQRGCVGKRMNECVKASSCSCSSHFSNPSSSHEFKNLKTKTSSSCALVKAKPSNTAKVDHTFTTMVKKFMDRKPKFSSSTVATTTRWLIPSNLLAKDLKKDVKKVVGFSVLQKKLIGKGASEKKEKVKALTEVKNNTRTLAMVLKSEKEFLNINKE

SEQ ID NO: 221790 - protein, 76 aa, Glycine max
  Coding DNA Sequence Number=SeqID_105012
MELLRWIENWMNESRMIPEYEDGVEQFLQFASEREMGDRLEDMIRDLGQESFQQAHAPAYEGLQSDSKKPLYTGIL

SEQ ID NO: 221791 - protein, 45 aa, Glycine max
  Coding DNA Sequence Number=SeqID_105013
MWVQAIGLFAQATCAPEFGLPRPLNQRLLVLHVGGGAVKQQVLKI

SEQ ID NO: 221792 - protein, 68 aa, Glycine max
  Coding DNA Sequence Number=SeqID_105014
MKGGEHKYGFNNNKREKAEKVRVVDDETGEHELYEVLRMPSRCVCNSLYFSSQHLNIPKDQQVFYVEF

SEQ ID NO: 221793 - protein, 119 aa, Glycine max
  Coding DNA Sequence Number=SeqID_105015
MLGFTSDSPQISASLHQLDLTPYALGPCNAQWNAPELLHDMHTSRSSRILGKMEVVDKENGCYWLSNDIVGLVGVATCPFAGERGEAHGCAFQRRKDARSRHQRLFVGNVGKTKGNRSK

SEQ ID NO: 221794 - protein, 122 aa, Glycine max
  Coding DNA Sequence Number=SeqID_105016
MEGAGSNFQPGIRRVTPGALFTVVRRQVVVVTVVGLAINDGASYGLPIRKKLMDCQSIYFLRIANPSFLFVIEIFECFVKMDEDQWMYDNIMTEEVDMNDQNEGEVGVNEEHVDCFDAFNAY

SEQ ID NO: 221795 - protein, 77 aa, Glycine max
  Coding DNA Sequence Number=SeqID_105017
MVNNLSYLSLPLDSDYLVIKCDGCEQRWGTILKKKKNKYEKIHDEEICRYTSRKYHTKPQGYNKMKPSKVSYQNIKK

SEQ ID NO: 221796 - protein, 476 aa, Glycine max
  Coding DNA Sequence Number=SeqID_105018
  Gene Ontology: Mol. function=protein serine/threonine kinase activity; Cellular component=integral to membrane; Biological process=protein amino acid phosphorylation
  Homolog annotation: Hit_ID=Q1S8T0; Match level="QueryCoverage=93%, HitCoverage=70%, E-value=1e-102, Identity=45%"; Hit description =Protein kinase
  Pfam annotation: Domain name=Pkinase; Domain location=305-473; Score=- 19.1; E_value=2e-07; Accession=PF00069.15; Description=Protein kinase domain
  Pfam annotation: Domain name=Pkinase_Tyr; Domain location=307-471; Score=-27.8; E_value=9.2e-11; Accession=PF07714.7; Description =Protein tyrosine kinase
  Pfam module annotation: Pfam domain module=Pkinase::Pkinase_Tyr; Domain location=305-473::307-471
MLQGNSILITLLLMLLLIRNGNCQNKCNKELSCGPDEPLIRFPFQLVKGMKDECANPGFCLYCTQKNETMVVLSTIEFHVLFINYKRNYFRLRDPENCLPNKFLQINNFFLQHNQLELGFPGHEGTNNLSFFNCSSVGHRYLTRWVCYSEYVVGQQDMISCPIHVSRYYDSVLEWDLTSCTKMFDTISPVEAYDLQSNSLNMRWSIPNCTKCEAKGKRCKWKNNNTEGDIECFDCKPKRIHVPQSFIFATTGSIFLGLVVIVVFKIALYFRQKEDDQARVAKFLEDYRAEKPARFTYADLKRITGGFKEKLGEGAHGAVFRGKLSNEILVAVKILNNKEGEGKEFINEVGIMGKIHHINVVRLLGFCAEGFHRALVYNLFPNGSLQRFIVPPDNKDHFLGWEKLQKIALGIAKGIEYLHQGCNQPIIHFDINPHNVLLDDNFTPKISDFGLAKLCSKNPSLVSMTGCKRNLGIHCT

SEQ ID NO: 221797 - protein, 174 aa, Glycine max
  Coding DNA Sequence Number=SeqID_105019
  Homolog annotation: Hit_ID=Q1S7C5; Match level="QueryCoverage=40%, HitCoverage=5%, E-value=2e-11, Identity=46%"; Hit description =Integrase, catalytic region
MLEQKMMDKFLLRIKCIIDGLGLCGDHVLSHEHLDLVLESLLKEYGPMISVIESKFEPLLIGEVDALLLAHEACMKKIHKCFADSPLINVAQEIVVAYITEVATVVEVMIMTAAVATVVEAMILVVVEVVVVATKAVVVMQILSAKFASNLLTQHGYVISAMILNFCQTPLSLC

SEQ ID NO: 221798 - protein, 156 aa, Glycine max
  Coding DNA Sequence Number=SeqID_105020
  Gene Ontology: Mol. function=protein kinase activity; Biological process=protein amino acid phosphorylation
  Homolog annotation: Hit_ID=Q1S8T8; Match level="QueryCoverage=68%, HitCoverage=17%, E-value=5e-15, Identity=42%"; Hit description =Protein kinase
MSSKFVLPVSKSMLAPLLPVITNITYPFRLKGDPKGCGDNRYELACENNVTVLYLYSGKYHVQAINYNNFTIRVVDPGVQQPYCSSIPRYFLSQSNFSAIEGDPYLAFLKRAYSWEHVFQHIVFLNCSHAVINNEKYVDTDPCIKWHSQVEFRVRI

SEQ ID NO: 221799 - protein, 343 aa, Glycine max
  Coding DNA Sequence Number=SeqID_105021
MASQHSPPVEALDIQVLAARVSSKGSYAKATTNPLGEKPSAVDVATMGLYVVGDQCTRLMALGKVYDSVTTIHNVPYADDVVRDSHNCVPKLVVAVERSNTIVGVDLLGELIKNLFVVYQKPIELSWDGTKFRIPNVQGSFFITHADLTEIISGDKCLNISILQLWMIAMKTLTTSLEGDGDEFYHELIDHGYPDGNEKALWTKVLESCKSSSAVKLPLKNVYMPVENENSVSFARRIPVLNSKNSQWLNFNGNNSENCMIYFHLVNLTTSLAYFGVYSTSDSPPMLAVVFSQPQGVDEVKFPAYSSMVEIQVINYDYYQTLFDQSQIAAPPVANSSLTVAQK

SEQ ID NO: 221800 - protein, 386 aa, Glycine max
  Coding DNA Sequence Number=SeqID_105022
  Gene Ontology: Mol. function=phosphotransferase activity, phosphate group as acceptor; Cellular component=chloroplast thylakoid membrane; Biological process=nucleobase, nucleoside, nucleotide and nucleic acid metabolic process
  Homolog annotation: Hit_ID=Q8VYL1; Match level="QueryCoverage=92%, HitCoverage=58%, E-value=1e-151, Identity=73%"; Hit description =Putative adenylate kinase
  Pfam annotation: Domain name=ADK; Domain location=2-181; Score=237.9; E_value=2.1e-68; Accession=PF00406.12; Description=Adenylate kinase
  Pfam annotation: Domain name=ADK_lid; Domain location=121-152; Score =11.2; E_value=0.024; Accession=PF05191.4; Description=Adenylate kinase, active site lid
  Pfam module annotation: Pfam domain module=ADK::ADK_lid; Domain location=2-181::121-152
MISGAPASGKGTQCELIVQKFGLVHISTGDLLRAEVAAGTEIGNKAKEFMNTGQLVPDEIVTAMVAARLAREDVRHKGWLLDGYPRSFGQAQSLEKMQIRPDVYIVLDVPDEILIDRCVGRRLDPVTGKIYHLKFFPPDTEEIKARLITRPDDTEEKVKSRLNIYKQNAEAASSSYSSITHKIDGSHSKEAVFKEIESLLSQLQQDKVKIIESGEKPIPDTKKGRTSLSQDKWRGIPTRLNNIPHSREIRKYFYDDVLQATQRAISDGKTRVKVDINIPELNPEMDVYRIGTLMELVRALALSFADDGKRVKVCVQGSMGEGALAGMPLQLAGTRKILEFMDWGDYGAKGTFINIGSIAFDLVPLVFPSCTPLDFYIPDSSLNLNI

SEQ ID NO: 221801 - protein, 99 aa, Glycine max
  Coding DNA Sequence Number=SeqID_105023
MIERFDFGNLPVEDRRTTKNERRTMKNGGKPSRNRPRKRLGSVTEAPRLGFSSRKQFFSLILSDSQIPGGGKEGGGCRPARPGELGCFHQKAPPSVGTS

SEQ ID NO: 221802 - protein, 70 aa, Glycine max
  Coding DNA Sequence Number=SeqID_105024
  Homolog annotation: Hit_ID=Q1SVN4; Match level="QueryCoverage=70%, HitCoverage=12%, E-value=7e-09, Identity=57%"; Hit description=IMP dehydrogenase/GMP reductase
MVPACDIPLSQLPVPCINEDAIAVTILKEEYKEGLEECKNNLNGRIILSMGDQPSRFQNLGPSYQLYRNC

SEQ ID NO: 221803 - protein, 113 aa, Glycine max
  Coding DNA Sequence Number=SeqID_105025
MEKTNNKVLWIVLNRRIMLMVVNMLMEILAIIVTNPYTLSLLRVKRIMLKNMFVVPCIITRTKRLDNNLGTISLEKDGAVNNNEFVSPIVQQDLRIVSRLWVNEVEEEDIGTS

SEQ ID NO: 221804 - protein, 471 aa, Glycine max
  Coding DNA Sequence Number=SeqID_105026
  Homolog annotation: Hit_ID=Q10L99; Match level="QueryCoverage=95%, HitCoverage=93%, E-value=2e-31, Identity=25%"; Hit description=IQ calmodulin-binding motif family protein, expressed
  Pfam annotation: Domain name=IQ; Domain location=130-150; Score=11.1; E_value=2.7; Accession=PF00612.17; Description=IQ calmodulin-binding motif
  Pfam annotation: Domain name=IQ; Domain location=165-185; Score=14.3; E_value=0.44; Accession=PF00612.17; Description=IQ calmodulin-binding motif
  Pfam module annotation: Pfam domain module=IQ::IQ; Domain location =130-150::165-185
MAKKGWFSMFKKLFLWDTHSSQEKEKRRAWIFGRVKTKRLPSITAPPPPSKETRLSEVEEEHSKHALTVAIASAAAAEAAITAAQVAVEVVKLQSAAHQQLKEKQEQLQPVKTSHDVPHSTHQCQRKIQESSAIKIQIAFRGYLILAHHSLTGKSLQARKASRALKGIVKLQAIIRGRAVRRQALNTLKCLESIVSIQSQVFARKLQMVEGRWDCGEHEEMQGSRDKIIRMDSNSERRWDDSILLKEEVKASCISKKEAVLKREKVKEYSFNHRRSAESERNKINGRWRYWMEQWVDTQLSKGKELEDLDSVFSSHYSRPGEECERSQLKLRNVHRQNQVEAFDSPPLASRNSFPHRSQTSEAEDHSVPSSPAIPTYMAATKSTQAKARSTSSPRARIGGSFDINSDSYSLCKKKLPIVTSINGEVFSNGRMGKLSSNQQRSPSLKGLPSPVKLSQTLRDLSINSDCSVPI

SEQ ID NO: 221805 - protein, 157 aa, Glycine max
  Coding DNA Sequence Number=SeqID_105027
  Gene Ontology: Mol. function=phosphotransferase activity, phosphate group as acceptor; Cellular component=chloroplast thylakoid membrane; Biological process=nucleobase, nucleoside, nucleotide and nucleic acid metabolic process
  Homolog annotation: Hit_ID=Q8VYL1; Match level="QueryCoverage=67%, HitCoverage=18%, E-value=2e-37, Identity=65%"; Hit description =Putative adenylate kinase
MWCPFGFKVVKPAIRLTLQDLPGSSGIMQTIGRDQRLKYAASFESCYFFRLLYYAGTQYPIMGAIRMTYPYQYDLYKRVDESPGKEKYVILSTFPERPTTDEINDAFQGKPSKDPRKTSGICSYPFMIVSKSELVVQLAGGGAACLKLSVDDWEMMI

SEQ ID NO: 221806 - protein, 92 aa, Glycine max
  Coding DNA Sequence Number=SeqID_105028
MASDPGQIRDLVWRQIQPFHEHNHGVSAEGSLVRHLVPRLSRLVHQNAQILMIHLVAPPPKEFVWVNWKRKRWGGACRRHTLVRGAFVVESW

SEQ ID NO: 221807 - protein, 77 aa, Glycine max
  Coding DNA Sequence Number=SeqID_105029
MLPIISSLRRSETSLIHVHQSKHSDEDTTKGKDHEALKGPMTRGRLKQAQHSDEDTTKGKDHEALEEPMTRGRLKQA

SEQ ID NO: 221808 - protein, 291 aa, Glycine max
  Coding DNA Sequence Number=SeqID_105030
  Gene Ontology: Mol. function=DNA binding
  Homolog annotation: Hit_ID=Q1EMS1; Match level="QueryCoverage=61%, HitCoverage=57%, E-value=8e-27, Identity=41%"; Hit description =Putative DNA-binding protein
  Pfam annotation: Domain name=MBD; Domain location=22-89; Score=28.4; E_value=2.5e-05; Accession=PF01429.10; Description=Methyl-CpG binding domain
MSFHPPPDPMYDLDFNNLAPSYDSQITYCISLQFIPKKAGTPKKNEIVFTAPTGEEINNRKQLEKYLKAHPGGPAVSEFDWGTGETPRRSTRISEKAKAAPPIESEPPKKRTKRSSASQKETSQEEKEEKTKEAEMQEADYTTKDDNDIEKEKDVVMENQDVKSVEDTDVNKSTHSGEAKAGENVEVPIEKDKGIEVSEVFLRKDEEKIEQPQEETKEYRGSGEPEKLETCTIADKKVEVEGVNKEENIKSTREFEAEEIEGTKVNSEEYHKLDEINKAEAELTMNGNHGS

SEQ ID NO: 221809 - protein, 186 aa, Glycine max
  Coding DNA Sequence Number=SeqID_105031
  Subcellular localization annotation: CTP_CleavageSite=39; ConfidenceScore=5.11e-01
MKNSGKPSRNRPWKLLGSVTEAPRLGFSSRKQFFSLILSDSQIPGGLNEFVLPSFPGEKRKSRNLTDYAIIPFLASGMLGNFTDCALTLPFNSRHVAEFHGLSNDGCQEEEELCEEPSIISTSTSSPNLEVNFPSLTSIKAPRVFRKGHPKMIGTSSSSSMSRITKSMGKMNFPTFTKKFSIIPPG

SEQ ID NO: 221810 - protein, 161 aa, Glycine max
  Coding DNA Sequence Number=SeqID_105032
MVRITTNIVLPYTGDQNSKSEQLVREIENFAQYEQESLSKTWDNLRDCKRVVHTMATHHRGQSTFSREANKTGPGPDVVIGENLVHKLTNVAVEIIEAMASNACKNTGDRRILKRPIGVHQVEASSSNTTIHQKLDVLAKHIETLMKALIQMMTPAPLPCL

SEQ ID NO: 221811 - protein, 649 aa, Glycine max
  Coding DNA Sequence Number=SeqID_105033
  Gene Ontology: Mol. function=metal ion binding; Biological process =metal ion transport
  Homolog annotation: Hit_ID=Q5JL93; Match level="QueryCoverage=15%, HitCoverage=25%, E-value=8e-12, Identity=42%"; Hit description =Glycine-rich protein-like
MASAVVEENNNVEYDSDPEEAKRPLTMRRREASDDEEEAEAEGEEEVTHKRQDHKVEVPSDDVDDEGGVEDYDDDDVVVEEEEEEEEVEVEEEVYEKKGGASGGVEVDVEGSVDVVKEPGDDDVRPPLEDSVEDHSEEKKENEPFAVPTAGAFYMHDDRFRDNAGACQRQIHGGRSLWEAKDNRKWGHDKYEEITLHEKHYEERRPSKGNYRSRGKSRGNYHGGHVRGNRTGYNDSSNQNQVPKRVVRGRGPQKYERTNKSNAASSQVQNKHSGRTSTHAAKAESGPVPAKNQVVASNLNSASLPFYPSGSSNKDNNLAQRREVQTGGSSRNISPVVVDEGFPVQQNNAQLRGKNVVDSISMAKLYIDESIPPPSVGKPGYSAVSASQSPHLRASGTGRGVSIPVQTNYQRAHSLNKVSPSQFQAIQTSSAPGWNSTSVQATAPQLGNRPGSGSQSSSPPRTSTPVNSHDSGEMDSASESGKAKGASVGKGRGGSQGAGRGSFVYGGAQVMGTTGNVAVSHGDPNFPAFLPVMQFGGQHPGGMGVPAVGMAFPGYVGQPQLGLGKSEMTWLPVLAGPAGALGATYPFLPVDGASSRQSGQASAMGTSSKEHNDKANNELKPPQRSELASDEFGQRQNKPRRQVGLQNHH

SEQ ID NO: 221812 - protein, 142 aa, Glycine max
  Coding DNA Sequence Number=SeqID_105034
  Subcellular localization annotation: CTP_CleavageSite=30; ConfidenceScore=5.02e-01
MAEKRTQTEMTMAVWQQCKQDEQMQNTMISATNGSAMARHSETSASRAVGGRSTPPPRNYSMIDYYANWTHISVSTRRGSLIPQLSNEDCNATEIPLLHNLWHELARKGAPDVYEIVQLQDLNRDLNNSCLESNLTNLKEKI

SEQ ID NO: 221813 - protein, 80 aa, Glycine max
  Coding DNA Sequence Number=SeqID_105035
MEEMTNFKEQVHIEAPKKAVEQEKAESSQSIGNWAKRAPTAKHSFSALSVTEESGKASISGPHAKRKISVLSATIVFSQA

SEQ ID NO: 221814 - protein, 370 aa, Glycine max
  Coding DNA Sequence Number=SeqID_105036
  Gene Ontology: Mol. function=transferase activity; Biological process= biosynthetic process
  Homolog annotation: Hit_ID=Q9LSB5; Match level="QueryCoverage=98%, HitCoverage=53%, E-value=1e-116, Identity=60%"; Hit description =Glycosyl transferases-like protein
  Pfam annotation: Domain name=Glycos_transf_1; Domain location=184 -345; Score=46.2; E_value=1.1e-10; Accession=PF00534.10; Description =Glycosyl transferases group 1
MKQYIEHFPAGASQVAWWIMENRREYFDRAKDVLQRVNTLVFLSESQSRQWQKWCEEEGIKLSSQLAIVPLSVNDELAFVAGIPSTLNALSFSAAKMDERRKLLRDSVRREMALNDNDMLVMTLSSINRGKGQLLLLESAHSIVEHGPLQDDDKKMQKSSDDGEYLSTLARRHHFRNLLKDNSVALNNISSNFINRTRKVFSQNNGTIAQSLKILIGSVGSKSNKVDYVKGLLSFLARHSNLSKSVLWTSATIRVAALYFAADVYVINSQGLGETFGRVTIEAMAFGLPVLGTDAGGTQEIVEHNVTGLLHPIGRAGNHVLAQNLRFLLENRLTREQMGMEGRKKVQRMFLKQHMYEKFVEVLVMCMRRI

SEQ ID NO: 221815 - protein, 53 aa, Glycine max
  Coding DNA Sequence Number=SeqID_105037
MASSVEKEGGASEETFSVELPAPPGWKKLFWGTVVSFQKRRKEEKLQKFGDPT

SEQ ID NO: 221816 - protein, 67 aa, Glycine max
  Coding DNA Sequence Number=SeqID_105038
MGRKSGTEFEEPDRSSSEREERDELRHGFTILPLGNEDDVMDGVDLIIHMNYCDKIIWEFLVTRESV

SEQ ID NO: 221817 - protein, 368 aa, Glycine max
  Coding DNA Sequence Number=SeqID_105039
  Gene Ontology: Mol. function=protein serine/threonine kinase activity; Cellular component=integral to membrane; Biological process=protein amino acid phosphorylation
  Homolog annotation: Hit_ID=O04086; Match level="QueryCoverage=97%, HitCoverage=57%, E-value=2e-63, Identity=38%"; Hit description =Ser/Thr protein kinase isolog; 46094-44217
MDRQVMQMLLFLMSLFTIFAPWITASFSCPIDLSYVDTIPWNTSTCKDPIDKEPCCDILLSVFAIGLAELLKDTKTFYLPNESTSSSCLHDFNLRLQALSIPPKMVPLCFPNSTRFVFNASACAGIRTTLDWTQRVGMVSPVDTFCNGDLKDKTRCKTCTEAAYQVTSQLTTIDPNANTTKCFYYIVLYAAAVVNQFGTTDVSTTSCILGLRQPSSGVIEEGSSNTEEVLKLGFSLLGVIIGVVLALLTIVMYKKWDKRRKEHVYHREIENKVRAGVLPNAGAKWFDVSELKCATNKFSPRNVVGQGGDGVVYKGILSDGAVVAVKEIFDLEAKGDEDFCYEVEIISKIKHRNLLALRGCCVASDNLN

SEQ ID NO: 221818 - protein, 48 aa, Glycine max
  Coding DNA Sequence Number=SeqID_105040
MACTSWQQGLKFQIMSPKAPDVRDGNLGRHSRSATKDRGTSLADSTAQ

SEQ ID NO: 221819 - protein, 399 aa, Glycine max
  Coding DNA Sequence Number=SeqID_105041
  Gene Ontology: Mol. function=sulfate porter activity; Cellular component=integral to membrane; Biological process=sulfate transport
  Homolog annotation: Hit_ID=Q6ZXB7; Match level="QueryCoverage=97%, HitCoverage=60%, E-value=1e-138, Identity=62%"; Hit description =Plasma membrane sulphate transporter
  Pfam annotation: Domain name=Sulfate_transp; Domain location=217-397; Score=58.3; E_value=2.5e-14; Accession=PF00916.10; Description =Sulfate transporter family
MGVNSYSNSRVEHLACNNNGSNNNMKIQAEIQMPPLEIHKVRLPPERTTLQKLRHRLSEIFFPDDPLHRFKNQTCLMKLLLALQYFFPIFQWAPHYNLSLLRSDIISGLTIASLAIPQGISYAKFANLPPILGLYSSFVPPLIYSLLGSSRHLGVGPVSIASLVMGSMLSETVSFSQDPILYLKLAFTATFFAGLFQSSLGILSNLKAIYILIGIWLGFVIDFLSKATLVGFMAGAAIIVSLQQLKGLLGIVHFTNKMQITPVLISVFKQRDESLKKPKLFWVSAAAPLTSVILSTIFVFILRNKTHKIAIIGELPKGLNPPSSNMLYFNGPYLALAIKTGLVTGILSLTEGIAVGRTFAALKNYQVDGNKEMMAIGLMNIAGSCSSCYVTTGNDSSLF

SEQ ID NO: 221820 - protein, 852 aa, Glycine max
  Coding DNA Sequence Number=SeqID_105042
  Gene Ontology: Mol. function=nucleotide binding; Cellular component =cytoplasm; Biological process=response to unfolded protein
  Homolog annotation: Hit_ID=Q96269; Match level="QueryCoverage=98%, HitCoverage=99%, E-value=0.0, Identity=72%"; Hit description=Heat -shock protein
  Pfam annotation: Domain name=HSP70; Domain location=3-698; Score =527.4; E_value=1.5e-155; Accession=PF00012.10; Description=Hsp70 protein
MSVVGFDFGNESCIVAVARQRGIDVVLNDESKRETPAIVCFGDKQRFIGTAGAASTMMNPKNSISQFKRLIGRKFSDPELQRDLKSLPFLVTEGSDGYPLIHARYMGESKTFTPTQVFGMMLSNLKEIAEKNLTTAVVDCCIGIPVYFTDLQRRAVLDAATIAGLHPLRLIQEMTATALAYGIYKTDLPENDQLNVAFVDVGHASMQVCIAGFKKGQLKVLAHSYDRSLGGRDFDEVLFHHFAGKFKEEYKIDVFQNARACIRLRTACEKIKKMLSANPVAPLNIECLMDEKDVRGFIKRDEFEQLSLPILERVKGPLEKALAEAGLTVENVHTVEVVGSGSRVPAINKILTEFFKKEPRRTMNASECVARGCALECAILSPTFKVREFQVNESLPFSISLSWKGSGPDAQDNGSENQQSSLVFPKGNPIPSIKALTFCRAGTFSVDVLYDDASGLQTPAKISTYTIGPFQTTNGERAKVKVKVRLNLHGIVSLESATLLEEEKVGVPVTKEAAGENTKMDIDEVPAEAAAPPASNDTGANMEGAKASTDASGVENGIPEGGDKPLQKDTDTKVQAPKKKVKKTNIPVAELVYGAMVPVDVQKALEKEFEMALQDRVMEETKDKKNAVEAYVYDMRNKLNDEYQEFVTASERDDFTAKLQEVEDWLYDEGEDETKGVYIAKLEELKKQGDPIDGRYEEFTERGTIIEQFVYCINSYRQVAMSNDPRFEHIDINEKQKVINKCVEAEKWFNEKQQQQSSLPKYANPVLLSAEMRKKAEDVDRFCKPIMTTQKPTKAVTPAGPATPSSQSDEQQQPQGDSDVNSNENAGNSSSQAAPASTEPMETEKSENTGSA

SEQ ID NO: 221821 - protein, 184 aa, Glycine max
  Coding DNA Sequence Number=SeqID_105043
  Gene Ontology: Mol. function=helicase activity; Biological process =protein amino acid phosphorylation
  Homolog annotation: Hit_ID=Q9LTU4; Match level="QueryCoverage=91%, HitCoverage=12%, E-value=5e-42, Identity=48%"; Hit description =Helicase-like protein
  Pfam annotation: Domain name=DUF889; Domain location=30-184; Score =93.6; E_value=6.2e-25; Accession=PF05970.5; Description=Eukaryotic protein of unknown function (DUF889)
MCHKFAFEALDKSLKEIMQNNLPFGGKIMVFGGDFRQILPIVPKGNRSDIVHATINASYIWDHCQILKLTKNMRLLSNAPQQPNNEELKQFSHWLLDIGDGKIGQYNEGFSEITIPYEFLIKNYDDPIHAIVEATYPNLIDNYSDTDYLQKRVVLASKKEIVDKINDYVLSLITQSRKRVLQRR

SEQ ID NO: 221822 - protein, 169 aa, Glycine max
  Coding DNA Sequence Number=SeqID_105044
  Gene Ontology: Mol. function=protein serine/threonine kinase activity; Cellular component=membrane; Biological process=protein amino acid phosphorylation
  Homolog annotation: Hit_ID=Q60EP3; Match level="QueryCoverage=87%, HitCoverage=23%, E-value=1e-47, Identity=64%"; Hit description =Unknow protein
  Pfam annotation: Domain name=Pkinase; Domain location=1-169; Score= -39.9; E_value=3.5e-06; Accession=PF00069.15; Description=Protein kinase domain
  Pfam annotation: Domain name=Pkinase_Tyr; Domain location=4-163; Score=-123.7; E_value=7e-05; Accession=PF07714.7; Description =Protein tyrosine kinase
  Pfam module annotation: Pfam domain module=Pkinase::Pkinase_Tyr; Domain location=1-169::4-163
NADGVKTEDTPTLLLLEESEKAKRRFLVCDFMPNGSLIYQLSLAGANRLTWPQRKNIILDVAKGLAYLHYEIKPPIYHRDIKATNILLDSKMNAKLADFSLAKQGSEIQSHLTTRVAGTYGYLAPKYALYGQLTEKSDVYSFGIVILETISSRKVFDNLNSSMDSITDW

SEQ ID NO: 221823 - protein, 46 aa, Glycine max
  Coding DNA Sequence Number=SeqID_105045
MVWELWSIECSVQRLDVNWQNDKCERLWWWRQMNDLSNAEVDNDQA

SEQ ID NO: 221824 - protein, 99 aa, Glycine max
  Coding DNA Sequence Number=SeqID_105046
  Gene Ontology: Mol. function=protein serine/threonine kinase activity; Biological process=protein amino acid phosphorylation
  Homolog annotation: Hit_ID=O04086; Match level="QueryCoverage=88%, HitCoverage=16%, E-value=1e-17, Identity=45%"; Hit description =Ser/Thr protein kinase isolog; 46094-44217
MVIWHQNPIHDWVWTLVESGKMEEVFYESIIEAQVKFMEKFVLVGILCAHGVVDLRPSIVEALKMLEGDTEIPKLPERPMALVHVSFQSSLLHGLQRSS

SEQ ID NO: 221825 - protein, 251 aa, Glycine max
  Coding DNA Sequence Number=SeqID_105047
  Gene Ontology: Mol. function=nucleic acid binding; Cellular component= extracellular region; Biological process=DNA recombination
  Homolog annotation: Hit_ID=Q8Z0Z3; Match level="QueryCoverage=99%, HitCoverage=20%, E-value=1e-136, Identity=93%"; Hit description =Helicase related protein
MEMGVDIGGISAVVMNNVPPHPANYLQRAGRAGRSKESRAISYTLCKGNPHDRQVFANPLWPFETVIPAPMVAMNSERLVQRHVNSLLLSDYLCHVIGETEKERTSLNSQWFFGEELEQSVCNRFKAWLERPTLSIDAALVRLVKGTALHGVAAEKLRDKTCDAIAALQKRWLGIYRDLVKQESESQPNTPYRKRLELEKKRHCGEYLLRDLAARTFLPGYGFPTDVVTFDNFTMEDYIREKTYKVRDKSD

SEQ ID NO: 221826 - protein, 55 aa, Glycine max
  Coding DNA Sequence Number=SeqID_105048
MGDEASRKRCWSPKIYVWMDQWDAPRWPHILKIIYYYYVRSVFQKQLPLAMIVVL

SEQ ID NO: 221827 - protein, 97 aa, Glycine max
  Coding DNA Sequence Number=SeqID_105049
MLADIDRFLFENFKSLFLNDLEEPANRVEKSPEPGPPSHQLRHVGKRDRGGADGDSGKLCGGAGELSEPQQGFPAIHGERCGSEELLFCHMNLNNKK

SEQ ID NO: 221828 - protein, 80 aa, Glycine max
  Coding DNA Sequence Number=SeqID_105050
MKGKHFLGSNGGKWELCSEMSHSWAEFQTVVIRTFQPSMMQKPYKLCSKQVKGRRNKMKLHTLELLPEMMDYAWQITEKN

SEQ ID NO: 221829 - protein, 328 aa, Glycine max
  Coding DNA Sequence Number=SeqID_105051
MASNDGGGKEERRRRIAERGSDRMALITGRINALPPTPPSSASSPTHRNIPRHAQSMSVAAFDSNSDDQQQHHLPPRHQRPQSLSAFTDYHEDLTVKHQGESILIMISEINTDLPCGAENKRSVSLSSARLKHQGGFRYSNMESFDFNPEEEPLIQDSDTITEANNQVSEGNVAKMKPPSVPSNTKNPAHDTQQLKQPLRHNKDTFFSSRELNICILASEPTRALSSLIIALLVVFYYMISERVLASRPLYILLLTDVTIVLARLYGGKASVLEEAEGEKVKATGDGHNWGDAVKLMERGLVTYQAIRGLFIDCSIYLVVVVCGTSLM

SEQ ID NO: 221830 - protein, 71 aa, Glycine max
  Coding DNA Sequence Number=SeqID_105052
  Homolog annotation: Hit_ID=Q00M75; Match level="QueryCoverage=51%, HitCoverage=6%, E-value=2e-09, Identity=83%"; Hit description=PPR -repeat containing protein
MGEGCCTQPYPCVCKEAVSGFEPMTNKSPRHNFTAAPGLALMVKKPHTPLLKVKSYADNFKWKGPPKSGEE

SEQ ID NO: 221831 - protein, 295 aa, Glycine max
  Coding DNA Sequence Number=SeqID_105053
  Gene Ontology: Mol. function=transporter activity; Cellular component= integral to membrane; Biological process=transport
  Homolog annotation: Hit_ID=Q2YB73; Match level="QueryCoverage=99%, HitCoverage=27%, E-value=1e-112, Identity=69%"; Hit description =Hydrophobe/amphiphile efflux-1 HAE1 precursor
MVGKLIGIGMSQPDGLSFAVNPPAIRGLGSAGGFEVYVQSKGDTDPIKLAQVMNNFMDAMRADSKLTGINSFFRPTVPQLFIEVDEAKALSQNVKISDIYATLQSTMGSLYVNDFNRSGRTYRVQLQAEAEYRMKPEDLGKVYVRSQPTADNPDGNMIPMSALAKVSNIVGAEQLERYNGLLSAKVFGSGAAGVSSGDAIKLVEKIAKESLPDGYQIAWTGQAYQEKRTGSAALVAFGFATIMVFLILAAQFETWALPLAVIMAIPFAMTGALIAVLTRGMNNDIYFQIGLITLI

SEQ ID NO: 221832 - protein, 96 aa, Glycine max
  Coding DNA Sequence Number=SeqID_105054
MQATCAGYVLQQGTGLAQREELVIGVDEMQLWIREELVILTGELRFKIFFIKREICGSHMHAFFFCLYLPHCIPFFSYCCFHCIVSSLGITCSYVD

SEQ ID NO: 221833 - protein, 125 aa, Glycine max
  Coding DNA Sequence Number=SeqID_105055
  Gene Ontology: Mol. function=oxidoreductase activity, acting on NADH or NADPH; Cellular component=mitochondrion; Biological process =electron transport
  Homolog annotation: Hit_ID=Q1SKQ7; Match level="QueryCoverage=88%, HitCoverage=72%, E-value=7e-51, Identity=84%"; Hit description=ETC complex I subunit conserved region
  Pfam annotation: Domain name=ETC_C1_NDUFA4; Domain location=43-125; Score=120.4; E_value=5.1e-33; Accession=PF04800.3; Description=ETC complex I subunit conserved region
MANTLQRALRATMARRFSTDALAEIKRGEIGMVSGIPQEHLRRRVVIYSPARTASQQGSGKVGKWKINFLSTQKWENPLMGWTSTGDPYSHVGDSALTFDSEEAAKAFAEKHGWEYSVCLALLGH

SEQ ID NO: 221834 - protein, 46 aa, Glycine max
  Coding DNA Sequence Number=SeqID_105056
MLSASVCKNNCAMSAENISRGNVRSASSDDASILNLDRLTFLADVG

SEQ ID NO: 221835 - protein, 117 aa, Glycine max
  Coding DNA Sequence Number=SeqID_105057
MGKGSLKASRTFQQTKAPTISHWYWKNKATLRELKGVNTKQSNLALNFLILFPQIPPKLHKAQRMSVFKPPIHTFHPCQQTLFSMKKFPKDWLFQDEALPLKEETTSSQQRRPPKHL

SEQ ID NO: 221836 - protein, 74 aa, Glycine max
  Coding DNA Sequence Number=SeqID_105058
MGLNEGERGIKLDNILIVGRCEVYEVDGFKLDLHVIEHDMAFALYLKFYLLHNFDYERILAFSIANPCNIVIQS

SEQ ID NO: 221837 - protein, 302 aa, Glycine max
  Coding DNA Sequence Number=SeqID_105059
  Gene Ontology: Cellular component=mitochondrion
  Homolog annotation: Hit_ID=Q3LHL2; Match level="QueryCoverage=46%, HitCoverage=28%, E-value=2e-17, Identity=32%"; Hit description =Hypothetical protein PPS5
  Pfam annotation: Domain name=DUF292; Domain location=1-129; Score =123.4; E_value=6.6e-34; Accession=PF03398.5; Description=Eukaryotic protein of unknown function, DUF292
MKTRLEIIQKKKKAEQKFMKSDIAELLRSGLDYDAYIRAKGLLLEQNMLSCYELIEKFVGCLSDHVEDLTKQKDCPDECKEAVSSLMYAAARFADLPELRDLRTLFTETFGNSLEPYINKEFVEKLRQDPPTREMKIGLLYDIAQEFSVEWDDNALRQRLYTESSLCEERPNPRRDLITSKGKERDTDTLPLGRKDFNDVSLIHQNSSDDETSTELSSHDGRKGSSSNSLGSFSEDEVETKRPISSYLLIPPPYLKQKTNTGESNSKRTTHSEAAGKGKRYPSQQQEHDTGENRRLRTSHVR

SEQ ID NO: 221838 - protein, 163 aa, Glycine max
  Coding DNA Sequence Number=SeqID_105060
  Homolog annotation: Hit_ID=Q10EQ8; Match level="QueryCoverage=76%, HitCoverage=55%, E-value=3e-13, Identity=34%"; Hit description =Expressed protein
MVKAFSSNCVVLRRFCCLKWTVFVVVSLAGVLVLWPWEPELKIERMNVKRVKVHPIPPVSADVWISLSVRVQNRCMYWMELTDVDVGVKYRGKKMGHVESEGWHVRGWASTKVDGVLEFSGLPSSEVAHLLQDLAMGKIYFHTVIKVYGQLGFLLFRIPHFLQ

SEQ ID NO: 221839 - protein, 486 aa, Glycine max
  Coding DNA Sequence Number=SeqID_105061
  Gene Ontology: Cellular component=plastid chromosome; Biological process=embryonic development ending in seed dormancy
  Homolog annotation: Hit_ID=Q1S6U5; Match level="QueryCoverage=89%, HitCoverage=52%, E-value=1e-170, Identity=67%"; Hit description =Pentatricopeptide repeat
  Pfam annotation: Domain name=PPR; Domain location=241-275; Score =23.5; E_value=0.00076; Accession=PF01535.11; Description=PPR repeat
  Pfam annotation: Domain name=PPR; Domain location=324-358; Score =23.5; E_value=0.00077; Accession=PF01535.11; Description=PPR repeat
  Pfam annotation: Domain name=PPR; Domain location=359-393; Score =12.3; E_value=0.26; Accession=PF01535.11; Description=PPR repeat
  Pfam annotation: Domain name=PPR; Domain location=400-434; Score =13.2; E_value=0.21; Accession=PF01535.11; Description=PPR repeat
  Pfam module annotation: Pfam domain module=PPR::PPR::PPR::PPR; Domain location=241-275::324-358::359-393::400-434
MESLHLHLQGHPVAQFRPNTDKIRLRLIEKGVQPAPKIVHTLRKKEIQKHNRKLKARPAPPLTPAQAQAAAEEQHFETIKREFRRVMAGKPWEGIQKVEFLEKARPERECRGGVKLRRESLNELKEMFEARKMDELKWVFDSDLEIDEVWLDEGYGVRGKTRNRSEGEVIRFLVDSLSDREIIMKDWKFSRMMKMSGLPFTEEQLLRIVELLGFKHCWKQALSVVQWVYNYKDHRKFQSRFVYTKLLSVLGKAGRPKEALQIFNMMRENIHIYPDIAAYHSIAVTLGQAGLLKELLNTVECMRQKPKAFMHRKNWDPVLEPDLVIYNAVLNACVPSKQWKGVSWVFKQLRKSGLKPNGVTYGLAMEVMLESGNYDLVHEFFGKMKRSGEVQKPLLIKVVLYFVVLVRTFWKEGKVDEAVKAVRDMERRGVIGTASVYYELACCLCNNGRWQDAILEVLCLISSSKPPNLALRNLVVDILGSGHISP

SEQ ID NO: 221840 - protein, 51 aa, Glycine max
  Coding DNA Sequence Number=SeqID_105062
MVISRALKGFMDDKALVTSSNKIGLGLEIPEGLLKDSLNGAEKAIRKSQSL

SEQ ID NO: 221841 - protein, 111 aa, Glycine max
  Coding DNA Sequence Number=SeqID_105063
  Gene Ontology: Mol. function=ribonuclease H activity; Biological process=RNA-dependent DNA replication
MKDSFLIRVNSSLSHRPARKRGELTSRAVKAYLIQSQEMFVEKKARSLQPSFIHIENRMVADQPDNKFYLLRSSNVSNPVPGGSVHKVPSLLKQPPITIFVGVVTPQIILS

SEQ ID NO: 221842 - protein, 119 aa, Glycine max
  Coding DNA Sequence Number=SeqID_105064
  Gene Ontology: Mol. function=ribonuclease H activity
  Homolog annotation: Hit_ID=Q1T1H6; Match level="QueryCoverage=94%, HitCoverage=38%, E-value=2e-10, Identity=31%"; Hit description =Ribonuclease H
MKLGCNDLGFFSTNISCDWIKYALAAPEVNSPLFLAGLWEVWKFNNKHVFYNTTIPQHTVLANICTLAEVVWHRDHEEGAILNVDGSCLTNSGKVRFGRILRNHEGVWMKAFLWFCWLY

SEQ ID NO: 221843 - protein, 696 aa, Glycine max
  Coding DNA Sequence Number=SeqID_105065
  Gene Ontology: Mol. function=microtubule motor activity; Cellular component=microtubule associated complex; Biological process =microtubule-based movement
  Homolog annotation: Hit_ID=Q9AVP4; Match level="QueryCoverage=98%, HitCoverage=98%, E-value=0.0, Identity=68%"; Hit description=BY-2 kinesin-like protein 10
  Pfam annotation: Domain name=Kinesin; Domain location=165-505; Score =412.5; E_value=5.8e-121; Accession=PF00225.13; Description=Kinesin motor domain
MNRQAQRSGATGVHHNRQYSEHYLDASSKWFNDSSSNHIPPLQDYNLYGGGGGRMYRSNAQRSFNEYCFDPATPPRSYAIKKNANGYGDEDYSPRDFSPGLLDLHSFDTELLPQITSSNLYDSEPYIFGKQTVRARASENNVSNSLAAADNAKSSNVAKIKVVVRKRPLNKKEVAKQEEDIIDTVSDSLTVHETKLKVDLTQYVERHEFVFDAVLNEEVTNDEVYCETVEPIVPIIFQRTKATCFAYGQTGSGKTYTMKPLPLKASRDILRLMHHTYRNQGFQLFVSFFEIYGGKLFDLLNGRKKLCMREDGKQQVCIVGLQEYRVSDVETIKELIEQGNATRSTGTTGANEESSRSHAILQLAIKRSVEGNVSKPPRVVGKLSFIDLAGSERGADTTDNDKQTRFSLLSLNEFVCLDGVPNYMECRIEGAEINKSLLALKECIRALDNDQGHIPFRGSKLTEVLRDSFVGNSRTVMISCISPSSGSCEHTLNTLRYADRVKSLSKGNNSKKDVLSSNFNLKESTTISLSSANTYTYEDRAADAWPEENGGDEFSSPEDYCEPVKPSWKKNEKVEQYSATDEKFKKPNHQIKWKDIPKVEPKTVHSDDDLTALLQEEEDLVNTHRKQVEETMSIVREEMNLLVEADKPGNQLDDYIAKLNAILSQKAASIMQLQTRLAHFQKRLKEHNVLASSAGY

SEQ ID NO: 221844 - protein, 142 aa, Glycine max
  Coding DNA Sequence Number=SeqID_105066
  Homolog annotation: Hit_ID=Q9SII4; Match level="QueryCoverage=37%, HitCoverage=30%, E-value=7e-14, Identity=68%"; Hit description =Expressed protein
  Subcellular localization annotation: CTP_CleavageSite=50; ConfidenceScore=5.81e-01
MAMALVSLSTILTPPSSSSSSFSSPKPSSSSIVRFRPLTPLPRFRRHLVRMAPDEEKMTRRSPLDFPIVESVHNLVDLTEWERPKPGRRPDIFPQFSPMKTPLPPPLPADPPEEDEEEEEKKEEEEEPEKEEPDKPDKPEKQ

SEQ ID NO: 221845 - protein, 167 aa, Glycine max
  Coding DNA Sequence Number=SeqID_105067
  Homolog annotation: Hit_ID=Q9LW80; Match level="QueryCoverage=51%, HitCoverage=57%, E-value=1e-09, Identity=37%"; Hit description =Arabidopsis thaliana genomic DNA, chromosome 3, P1 clone: MSL1
  Subcellular localization annotation: CTP_CleavageSite=44; ConfidenceScore=5.31e-01
MLLRETFRKTKVFFSKSFQKFWSFFFGEYQKLPRSLSFNPFLSRVGNARTHTSDQLYNDMLQSDLGRTKMYGNNMSMTAMEDAQKSIHEERAQEKKNKGKKEYLSSQNMNKKAHVLAQKMKAMDMMDAGDLEHVLDIEEVLHYYSRLKSPVYLDIVDKFFKDMQSEL

SEQ ID NO: 221846 - protein, 82 aa, Glycine max
  Coding DNA Sequence Number=SeqID_105068
  Gene Ontology: Mol. function=binding; Cellular component =mitochondrial inner membrane; Biological process=transport
  Homolog annotation: Hit_ID=Q1SK80; Match level="QueryCoverage=80%, HitCoverage=25%, E-value=1e-21, Identity=72%"; Hit description =Mitochondrial carrier protein
  Pfam annotation: Domain name=Mito_carr; Domain location=2-78; Score =11.2; E_value=0.00033; Accession=PF00153.17; Description =Mitochondrial carrier protein
MDFWPEFLASGSGREFVAGYPLDTLRIRLQNSKNGSAFTILRQMVSREGPTSLYRGMGAPLASVTFQVHWAIAIGPFKAIGT

SEQ ID NO: 221847 - protein, 223 aa, Glycine max
  Coding DNA Sequence Number=SeqID_105069
  Gene Ontology: Mol. function=binding; Cellular component =mitochondrial inner membrane; Biological process=transport
  Homolog annotation: Hit_ID=Q1SK80; Match level="QueryCoverage=99%, HitCoverage=73%, E-value=1e-88, Identity=70%"; Hit description =Mitochondrial carrier protein
  Pfam annotation: Domain name=Mito_carr; Domain location=124-215; Score=111.6; E_value=2.2e-30; Accession=PF00153.17; Description =Mitochondrial carrier protein
  Pfam annotation: Domain name=Mito_carr; Domain location=24-117; Score= 78.5; E_value=2.1e-20; Accession=PF00153.17; Description =Mitochondrial carrier protein
  Pfam module annotation: Pfam domain module=Mito_carr::Mito_carr; Domain location=124-215::24-117
MVFQTYAVLSRVFDSSVFAKDPPSYKGVALGGTGAGVLQSLLISPVELTKVQLQLQNGGKMTESVKGSLTLAKNIWRKEGLRGIYRGLGLTVMRDGPSHGLYFWTYEYMREQLHPGCRKSGEESLDTMLIAGGLAGVTSWISCYPFDVVKTRLQAQTPSSIKYKGIIDCFKKSVNAEGYGVLWRGLGTTVARAFLVNAAVFSAYEISLRLLFNNGSIQMQETL

SEQ ID NO: 221848 - protein, 108 aa, Glycine max
  Coding DNA Sequence Number=SeqID_105070
  Subcellular localization annotation: CTP_CleavageSite=38; ConfidenceScore=5.10e-01
MGLKALGSCPRQGHYQSRPAAGRYQTRPRQGRYPAATSCAALCHVSRAPWKRLPGGRFVIKKQTPQKQVLLKVLAGGLDKSISHLMFKREFTDLANNPFNKSFLAIDR

SEQ ID NO: 221849 - protein, 179 aa, Glycine max
  Coding DNA Sequence Number=SeqID_105071
MAPLGALDSMGAAQQEQPHRPTLFKSLTIGRGRCAPRCPLIIGFTPIELAPRAPSYPEGNFGGNPATRRYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISSTL

SEQ ID NO: 221850 - protein, 63 aa, Glycine max
  Coding DNA Sequence Number=SeqID_105072
MNRKLGYGAQLRANLDPTEGVGRLRQQDGGHGSRGTGEARLIALCARTPKGNRVKIPEPGRGG

SEQ ID NO: 221851 - protein, 276 aa, Glycine max
  Coding DNA Sequence Number=SeqID_105073
  Gene Ontology: Mol. function=N-acetylmuramoyl-L-alanine amidase activity; Cellular component=integral to membrane; Biological process=peptidoglycan catabolic process
  Homolog annotation: Hit_ID=Q1LR14; Match level="QueryCoverage=84%, HitCoverage=47%, E-value=9e-57, Identity=50%"; Hit description=Cell wall hydrolase/autolysin
  Pfam annotation: Domain name=Amidase_3; Domain location=53-268; Score= 314.4; E_value=2e-91; Accession=PF01520.9; Description=N -acetylmuramoyl-L-alanine amidase
MAKTDLLNTRLSRRRMMLAGLAALALNGAASPLAHAHGLPRPKSHGARKRFLVMLDPGHGGIDSGAIGHTGSLEKHVVLEIARNVRAQLDRHGIDARLTRDSDVFIPLYDRVEIAHRHGADLFMSIHADGFTCPIACGASVFALSNKGASSAMAKYLSNSENAADDLAGPNVIKKDRYLQKILFDLEQTETIKESLTLGSHLIQHIAPIHHLHAKNTEQAAFVVLKSPYIPSVLVETSFITNPEEERLLGTPAFRNKIATAIAQGIVSYFKRETHA

SEQ ID NO: 221852 - protein, 111 aa, Glycine max
  Coding DNA Sequence Number=SeqID_105074
  Gene Ontology: Mol. function=transporter activity; Cellular component= integral to membrane; Biological process=transport
  Homolog annotation: Hit_ID=UPI00005F90D2; Match level="QueryCoverage =96%, HitCoverage=30%, E-value=7e-17, Identity=40%"; Hit description =COG3203: Outer membrane protein (porin)
RRAIGQGGHIIEHAPIAADIEAAEGCVLHPNIGESGAVASRVGEADGIFPVGVGPPARRDLFFAYQAEIEVAAVAVVARVLAAVASGDNRAVEIQAVLLRPRQRHGEGAAW

SEQ ID NO: 221853 - protein, 238 aa, Glycine max
  Coding DNA Sequence Number=SeqID_105075
MGETYEIPHHNLADFKPCLGYATEGHAVGAGKIPPAMVEMGKLDHLEERLRAIEEDGVPKFDKYMGTACPTNHLKMYCRKMGANAKDEKLLMHFFQESHTGAAITWYTNLEPFQVFLEGQYQYNFDMAPDRMQLQSMCKRRHRSFKEYAPKVEGPGNSSSTSHDGERDDHIDRGHITSKFVYPALMKEKTGANGENEIEGGTRAAITVPTWPNSPSPQQHHYSANINPSHYPLPSHPQ

SEQ ID NO: 221854 - protein, 194 aa, Glycine max
  Coding DNA Sequence Number=SeqID_105076
MACLPTIHHPMLHPLPMRMSITPLPYSLRVNNPNLIMHMSLNPWGTHEVPRDDNLADFEPYLGYATEGQEFCSIPLPNTLEGTQFRRQPQPLHFAVGRVPPAIVERGRFNHIEERMTAIKGDRDYVFADMAELCLMPDVIIPLKFKVPDFDKYKGTTCPKNHLEMYSWKMGAYTKDEKLLMNFFQESLTRAAIT

SEQ ID NO: 221855 - protein, 73 aa, Glycine max
  Coding DNA Sequence Number=SeqID_105077
MTILRRFRPPLQWNVVVLDKGIGDKYVTLPWYKFLQEGDFSHGDELSFYYRRAEKIWEVVIRRAIDWDDSDID

SEQ ID NO: 221856 - protein, 52 aa, Glycine max
  Coding DNA Sequence Number=SeqID_105078
MKKKKITIYGSRFDEEMSEIGRFGGLGMEERRKEEGAAQGFLENVIFIEQDA

SEQ ID NO: 221857 - protein, 70 aa, Glycine max
  Coding DNA Sequence Number=SeqID_105079
MALGTMAACSGEPGSRNLLKMTLLPLPLGIFASLTRTSNNLVPCAKTDVEQHLSVSENQKHQWMTVPGRN

SEQ ID NO: 221858 - protein, 147 aa, Glycine max
  Coding DNA Sequence Number=SeqID_105080
MEYSLPYYHFQDQKTSQTLFPSFYIDVIETKWEQDDMLHMDHFSGFLCSHRIPDVPGDRICIIDFYFSWTHPTPSNYHFPIPMPRCVAKGLGTTQGRYGGSCVGDEREKEEEDTSYKEDPFMDEEDPTTEPEIMEEDSSQDSSEDSY

SEQ ID NO: 221859 - protein, 62 aa, Glycine max
  Coding DNA Sequence Number=SeqID_105081
MRLRHYRIATVIDFYIVLCSDLDTIYAPLEVIFVVLLIFISFFYHHSSLFFVKFNLNRSLVL

SEQ ID NO: 221860 - protein, 43 aa, Glycine max
  Coding DNA Sequence Number=SeqID_105082
LVDHCSLGDDLGSLPRYSIFNVYLIRVRPRSNLAPLPGSSGPK

SEQ ID NO: 221861 - protein, 121 aa, Glycine max
  Coding DNA Sequence Number=SeqID_105083
  Gene Ontology: Cellular component=outer membrane; Biological process =regulation of conjugation
  Homolog annotation: Hit_ID=P13980; Match level="QueryCoverage=50%, HitCoverage=25%, E-value=5e-21, Identity=75%"; Hit description=TraT complement resistance protein precursor
ILRQHRLQIAHVLIGGVANLQVNSLLAGRLKPNGLTHLGFDVEVAFFDGGAHGTTAGKHQGGSGNRRHEGVTGFREKPFRQSAGRVIGGSRGNLNLFNQTADFFKRQTSAKSANFSPNNHV

SEQ ID NO: 221862 - protein, 143 aa, Glycine max
  Coding DNA Sequence Number=SeqID_105084
LSAERRGSGVTEESLQRRERNLTAPAGAPSQAMSEDFRSGSQRVGEKASGAGIESNVANKVAAQRSGLMETIRENDGKIAENKTTVQTSSDILRNEHQGAVRSQQIGRTEEDIRQTKPKIDDAETEQFRHKLEKLRSSQQKAS

SEQ ID NO: 221863 - protein, 380 aa, Glycine max
  Coding DNA Sequence Number=SeqID_105085
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-45, Identity=28%"; Hit description= UPI00006A17C9 related cluster
MDPWVLVPIALRGLYALTFRWLHVLAFRGLHVLALRGLHALAFRGLLALALRGLHALTFRGLHVLAFRELHILALRGLHALAFRGLHALAFRGLQVLTFRGLHILAFRGLRTLTFKGLHVLAYRGLLVLAFRGLHVLAFRGPHALAFRGLHVLTFRGLHIRTFKRLHALPFRGLHVLAFRGFHVLAIRGLHALAFRGLHALAFRGLQVLAFRGLHILAFRGLRTLTFKGLHVLSFRGLHVHAFKGLHVLAFSGPHALDFRGLHVLAFRELHALTFRGLHALTFRGLRALTFRGLHVLTFRGGLHALVFRGLHVLTFIGLHVLAFRELHALAFRGLHILTFRGLHALAFKGLHILAFKGLHVLAFRGIHICAFRGLKVLCP

SEQ ID NO: 221864 - protein, 70 aa, Glycine max
  Coding DNA Sequence Number=SeqID_105086
MTIGVLKIITFGLPLSDKGTLSAIPTEGNCAERPKAALSPIPTKRKCAERLEGAALSLNPCAKRNKWASA

SEQ ID NO: 221865 - protein, 659 aa, Glycine max
  Coding DNA Sequence Number=SeqID_105087
  Gene Ontology: Mol. function=pyridoxal phosphate binding; Biological process=metabolic process
  Homolog annotation: Hit_ID=UPI000067EA87; Match level="QueryCoverage =49%, HitCoverage=74%, E-value=7e-85, Identity=48%"; Hit description =putative isopenicillin N epimerase
  Pfam annotation: Domain name=Aminotran_5; Domain location=370-659; Score=-28.4; E_value=2.5e-11; Accession=PF00266.9; Description =Aminotransferase class-V
  Pfam annotation: Domain name=Pyridoxal_deC; Domain location=365-626; Score=-181.1; E_value=0.019; Accession=PF00282.9; Description =Pyridoxal-dependent decarboxylase con
  Pfam annotation: Domain name=TonB_dep_Rec; Domain location=22-324; Score=76.9; E_value=6.2e-20; Accession=PF00593.14; Description=TonB dependent receptor
  Pfam module annotation: Pfam domain module=Aminotran_5::Pyridoxal _deC::TonB_dep_Rec; Domain location=370-659::365-626::22-324
  Subcellular localization annotation: CTP_CleavageSite=81; ConfidenceScore=5.04e-01
RALEHRCGSRYEDFSSFGSTLDGKLSARFAITPDVALRGTVSTGFRAPTPAQLNTTSTTQGLDTRTLQIFTSGRLSPNDPLAQLLGAMPLKPEESRTASLGLTWRTDLGLSGSVDVYQIRLTDRFSQSASFAIPAGTPNPLGYTSVNYFTNDFDTTTTGVDVVGNYLRDLGAGRMTLTLAYNYNRTRVDNGSTSVATNETQRVLFEDRLPEHKGSLTGSWDVGAWSLMARMRYYGAWTDSSGNAVGDIYQRFGAMSFLDLAVGYRINEHHSLRVGADNVFDRYPDEATFQASRGLVYSRNAPYDTDAALYSLPAKASARYAAPMQIPATTAAPDVLARDEGYWAAVASHFDITDEVNHLENGYWGAMGRETLASYQRHTAEVNRGNAWYGRREFPAQYMAVQRQVAELLGVGADEIALTRGATEAMLALIGGYNRLQPGDQVLYADIDYDSMIGAMRWLQQRRGVQVERIALPAVPDHAQILQAYEAAFARLPRLKLVLLTQVSHRHGLVLPVAEIAERARARGIDVIVDAAHGFGQIDYAVPQLKADFVGINLHKWIGAPVGVGAMYVRRGRVADLDPYMGETDDGRVGSRVHTGTVNFAAYLALPEAIALHQRIGVANKQARLRYLRERWTLPARQMAHIEVLSSPDPALASALASF

SEQ ID NO: 221866 - protein, 264 aa, Glycine max
  Coding DNA Sequence Number=SeqID_105088
QGKPGRRHFGHGMTRSTGDVKRVAQELFVVHWLSMCGWGCINYNPVLAIRQLGYPMRGVPSDESITPFIARGFSDHNARDRELRGSRNGIIGGYHKWLRVQTRGLDWLPNLKTVRDDEVKASEESDEVQALKAELERARVVEEKFKAAIVTQAPKSERNHHGQRHDLEGRAKGNMWAIIDKCKEKLNLAATHEQRLEDEYAKISAESEARERVIDSWHQEATMWTDRFALTLNRSQELPRLLAKAKAMADTYSAPEEIHGLLSY

SEQ ID NO: 221867 - protein, 207 aa, Glycine max
  Coding DNA Sequence Number=SeqID_105089
  Homolog annotation: Hit_ID=Q1SP45; Match level="QueryCoverage=42%, HitCoverage=16%, E-value=8e-13, Identity=83%"; Hit description =Translation factor; Elongation factor G, III and V
MEKINQKHLTVYSNISLQVAGENKKDRIHDMGNSLELISGADANTTTNTNKIIVATFVDTNANINDEHAVTDVGTNAIADASTIGVDRLISELKLSPPKDAYHKLRLTLKVINTQISAAGDVQVVDPVAGNPLYKIYSQVIEEHNKKSVETTLAELGVTLSNSAYRLNVRPLLRHDISPLGLAKQAPITLTTGTAAMGFAGDISELG

SEQ ID NO: 221868 - protein, 67 aa, Glycine max
  Coding DNA Sequence Number=SeqID_105090
MTTRGKGVTSRNVPSSDDGHSSGGGPFIDDVIPSLNDSQPTMEPSSVDSHTKVDRRLALFVEDINNL

SEQ ID NO: 221869 - protein, 68 aa, Glycine max
  Coding DNA Sequence Number=SeqID_105091
MRVKSVNILPVQMIRHGHSLTQRGTAPERNPCDKDQCGSVDKAEYGSLQNKNLTTDMNISYIDRESTP

SEQ ID NO: 221870 - protein, 135 aa, Glycine max
  Coding DNA Sequence Number=SeqID_105092
MGTRGCSSYNPVLAIRQLGYPMRGAPVEEEIAPKVRKAWEVVQKKDKELRCSNNGPIGGYRKWLRAHVQGLDWLSSLRTAKSKEVEAPDEDEEVQANSQRKVQISSSDDPKGECRIERYKYSYHQSLGTRDQEGS

SEQ ID NO: 221871 - protein, 80 aa, Glycine max
  Coding DNA Sequence Number=SeqID_105093
AFSGGALVLTNMDGEELPSPVNSDVGQDHLGLPSGVKTKYEWQKPVKVLKDERKRGWGHDRPIVALLCAKQAWNVAARQP

SEQ ID NO: 221872 - protein, 78 aa, Glycine max
  Coding DNA Sequence Number=SeqID_105094
  Homolog annotation: Hit_ID=Q1SWI6; Match level="QueryCoverage=49%, HitCoverage=17%, E-value=4e-09, Identity=61%"; Hit description =Leucine-rich repeat, plant specific
MGSKVVAEDSIPVATVGMIRIPRPKPIGRIYEIILKLQKCLTLTWDAHTLSACLHHQVNLKVFHFFILNLWPLHKVQP

SEQ ID NO: 221873 - protein, 72 aa, Glycine max
  Coding DNA Sequence Number=SeqID_105095
MNFEICQIVQQKAIKFVQQNFQRVQKMLVHYWLWERFFCLYSVFLVEGSFTIVGIDLLGYYGSLEGLIGTRC

SEQ ID NO: 221874 - protein, 99 aa, Glycine max
  Coding DNA Sequence Number=SeqID_105096
  Gene Ontology: Mol. function=methyltransferase activity; Cellular component=cellulose and pectin-containing cell wall
  Homolog annotation: Hit_ID=Q1S1Q1; Match level="QueryCoverage=98%, HitCoverage=15%, E-value=4e-50, Identity=85%"; Hit description =Generic methyltransferase
GIYLNEVDRVLRPGGYWILSGPPINWENHWNGWKRTRESLKEEQDGIEKVAKSLCWKKLVQKGDLAIWQKPTNHIHCKITRKVYKNRPFCEAKDPDTAW

SEQ ID NO: 221875 - protein, 228 aa, Glycine max
  Coding DNA Sequence Number=SeqID_105097
  Gene Ontology: Mol. function=methyltransferase activity; Cellular component=cellulose and pectin-containing cell wall
  Homolog annotation: Hit_ID=Q1S1Q1; Match level="QueryCoverage=99%, HitCoverage=35%, E-value=1e-113, Identity=84%"; Hit description =Generic methyltransferase
  Pfam annotation: Domain name=DUF248; Domain location=1-217; Score =42.0; E_value=2.6e-28; Accession=PF03141.7; Description=Putative methyltransferase
MDICLTPLPEVNDIREVSGGELPKWPQRLKSVPPRISSGSLKGITGKMFKENNELWKKRVAYYKTLDYQLAERGRYRNLLDMNAYLGGFAAALIDDPVWVMNTVPVEAEVNTLGAIYERGLIGTYMNWCEAMSTYPRTYDFIHGDSVFSLYQNRCKVEDILLEMDRILRPEGSVILRDDVDVLLKVKSFTDAMQWESRIADHEKGPHQREKILFAVKQYWTAPSPDQK

SEQ ID NO: 221876 - protein, 91 aa, Glycine max
  Coding DNA Sequence Number=SeqID_105098
MLLPSAVHVSSTFEFGAVFHDCLSADPQGNPPFSPFSKPHECYCLALFMCPPLSSVKPLKKKRRSRDESRHHGKGRTDEISVLSLFSSYLR

SEQ ID NO: 221877 - protein, 157 aa, Glycine max
  Coding DNA Sequence Number=SeqID_105099
  Homolog annotation: Hit_ID=Q1RUD8; Match level="QueryCoverage=50%, HitCoverage=20%, E-value=2e-08, Identity=48%"; Hit description=IMP dehydrogenase/GMP reductase
MTPSTEDVKKAMQGLFAVLQLSMWGWFHTFFSKKVGPSIRYKEGRIKILSSCEGCPNVPLMGTRGCINYNPVLAIRQLGYPMRGAPLDESITPFIARGFSDHKREGTPRSSQGMGCGTVRDDEVKASEDSDEVQALKAELERARVVEEKFKSIAIKV

SEQ ID NO: 221878 - protein, 191 aa, Glycine max
  Coding DNA Sequence Number=SeqID_105100
MGEVDEVQDRIKADLEAIKEKMATMMEAMMSMKKIMEVNATAIAATSAIAEVDLTPPSSLNQINHAISDMVGQTGKELGSTGGPHFVQVQNKNSFPPYDLAPNFAPPNVARTPDKNVNNFTPILIENQKPQSDHAFVPQHMGETHEIPHHNLADFKPHLKYALRFFHNHNPCFLWQEESLLLWQRREGWII

SEQ ID NO: 221879 - protein, 88 aa, Glycine max; identical to SEQ ID NO: 135423
  Coding DNA Sequence Number=SeqID_105101
  Gene Ontology: Mol. function=nucleic acid binding

SEQ ID NO: 221880 - protein, 122 aa, Glycine max
  Coding DNA Sequence Number=SeqID_105102
GKRARWRAEIYIVLDTFFRLDPLTLFAAPFVVLTREVNGHAGLPYGDMRGYLMVTRTFGQPGANEPIDAQRLTSSSAPFVVLTREGYLIVTHTVRQPWANEPIDAQRLTSSSAPFVVLTREV

SEQ ID NO: 221881 - protein, 83 aa, Glycine max
  Coding DNA Sequence Number=SeqID_105103
MLQPYGINIGLKEHSNPVTPKAYTQKSPSGPLLPDSAINESEIAILMRQFWVYAGKERILGEEEGKTNMRRRRSVKTYRQSKN

SEQ ID NO: 221882 - protein, 435 aa, Glycine max
  Coding DNA Sequence Number=SeqID_105104
  Gene Ontology: Mol. function=transmembrane receptor activity; Cellular component=membrane; Biological process=defense response
  Homolog annotation: Hit_ID=Q2HUN2; Match level="QueryCoverage=78%, HitCoverage=30%, E-value=9e-27, Identity=32%"; Hit description=TIR; Disease resistance protein
  Pfam annotation: Domain name=FNIP; Domain location=130-167; Score =16.6; E_value=0.0084; Accession=PF05725.3; Description=FNIP Repeat
  Pfam annotation: Domain name=FNIP; Domain location=172-209; Score =5.6; E_value=0.18; Accession=PF05725.3; Description=FNIP Repeat
  Pfam annotation: Domain name=LRR_1; Domain location=137-156; Score =6.2; E_value=20; Accession=PF00560.23; Description=Leucine Rich Repeat
  Pfam annotation: Domain name=LRR_1; Domain location=158-183; Score =11.9; E_value=1.7; Accession=PF00560.23; Description=Leucine Rich Repeat
  Pfam annotation: Domain name=LRR_1; Domain location=200-222; Score =11.0; E_value=2.5; Accession=PF00560.23; Description=Leucine Rich Repeat
  Pfam annotation: Domain name=LRR_1; Domain location=27-49; Score=4.4; E_value=43; Accession=PF00560.23; Description=Leucine Rich Repeat
  Pfam annotation: Domain name=LRR_1; Domain location=4-25; Score=2.8; E_value=84; Accession=PF00560.23; Description=Leucine Rich Repeat
  Pfam annotation: Domain name=LRR_1; Domain location=92-113; Score =16.3; E_value=0.11; Accession=PF00560.23; Description=Leucine Rich Repeat
  Pfam module annotation: Pfam domain module=FNIP::FNIP::LRR_1::LRR _1::LRR_1::LRR_1::LRR_1::LRR_1; Domain location=130-167::172-209::137- 156::158-183::200-222::27-49::4-25::92-113
NLVSLKTIDLQESRDLIEIPDLFMAKKLERVYLNHCKSLYQIHLNSKSLYVLDLLGCSSLKEFTVTSEEMIDLMLSHTAICTLSSPIDHLLSLEVLDLSGTNVEILPANIKNLSMMRKLKLDDFCTKLMYLPELPPSLTELHLNNCQRLMSLPKLPSSLRELHLNNCWRLVSLPKLPPSLRELHLNNFWRLMSLPKIPPSLRELHLNNCRRLVSLPKLPPGVKEVSAINCISLKTDITQRLVLQHMYQSRIPYLNKDPTYREDEYFFFPGDHVTNSKYGFHTEESSITIPYLPKSHLCGFIYCIILLEGSVLKDNRFSCAIYRDDMLISLDHRRIIGCEKLISDHRIISQECVDHLQEVLLSLVSGMCACGNKGIMTLLRDQTIRLWSDQNNNHKFVSSKILLGYTSFVGPLEWIPPNTSFLQGHSGLCLGLKHG

SEQ ID NO: 221883 - protein, 125 aa, Glycine max
  Coding DNA Sequence Number=SeqID_105105
MAVLTRKRRRMMAEAVAAVIAILSEDLMIKILVRVRVSNPFAIEVRVQAVEISGAGSPIHEEEFSHIILGHQGSHIQSHGGHERVSIATQYAPALAEEEKKKCIRWTLETIKVEVQAIKERVKCL

SEQ ID NO: 221884 - protein, 75 aa, Glycine max
  Coding DNA Sequence Number=SeqID_105106
MKHSILSSLAQVKGPEQARDSDEAQTQRAQANKQRAIAALPRGNLSLSFLLPGVIVLMERIENEVRGYQTQEARA

SEQ ID NO: 221885 - protein, 117 aa, Glycine max
  Coding DNA Sequence Number=SeqID_105107
MGKAEEVQEKVKADMEAMATMMEAMMSMKKIMEVNAVTIAATSTVAKAKIWEVGTAPMMCKIKTSTPSRHMACLPTIHHQMWRTLPIRMSITPLLYPLRANNPELSCTCLLNCGGDT

SEQ ID NO: 221886 - protein, 104 aa, Glycine max
  Coding DNA Sequence Number=SeqID_105108
  Homolog annotation: Hit_ID=Q1SPB9; Match level="QueryCoverage=75%, HitCoverage=13%, E-value=1e-08, Identity=39%"; Hit description =Transposase
MPMLDQFQPFIHDFIDNIVDVQADRNCGYRLVSDLLGMGADSWSLVRTYLLIELDKFSEDYIKLFGSTNKFKELRMSLHVDGLTKKSTTGRFFGASHNLYWSRL

SEQ ID NO: 221887 - protein, 263 aa, Glycine max
  Coding DNA Sequence Number=SeqID_105109
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=5e-34, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=23; ConfidenceScore=5.19e-01
LQRATRPCLKRTTRPHHKGPQALAFVGQHTLTFRGLHVLAFIRLHALAFRGLRVLAFRGLRVLTFRGLHVLTFRGLHVLSLRGLHVLSFRGLHVLTFKGLHALAFKELHVLVFRGLLALAFRGLHVLTLRGLHAFTFRGLQVLAVRGLHALTFRGLYALAFVGLHALTYRGLHVLAFIGLHSLTFRGLHVLTFRVLHALAFRGEPVLAFVGLHALTLRGLHILAIRGLHALAIRGLHVLAFVGLHALNFRGLHVLTFRGLHAL

SEQ ID NO: 221888 - protein, 185 aa, Glycine max
  Coding DNA Sequence Number=SeqID_105110
  Gene Ontology: Mol. function=ATPase activity, coupled to transmembrane movement of substances; Cellular component=integral to membrane; Biological process=transport
  Homolog annotation: Hit_ID=Q1RYK6; Match level="QueryCoverage=100%, HitCoverage=11%, E-value=7e-84, Identity=83%"; Hit description =Cyclic peptide transporter
  Pfam annotation: Domain name=ABC_tran; Domain location=1-149; Score =64.7; E_value=3e-16; Accession=PF00005.17; Description=ABC transporter
IEVHGKFSYVSQTAWIQTGTIRENILFGAAMDAEKYQETLHRSSLLKDLELFPHGDLTEIGERGVNLSGGQKQRIQLARALYQNADIYLLDDPFSAVDAHTATNLFNVTKTSFLQEYIMEGLAGKTVLLVTHQVDFLPAFDSVLLMSDGEIIEAAPYHHLLSSSQEFQDLVNAHRETAGSDRLVD

SEQ ID NO: 221889 - protein, 148 aa, Glycine max
  Coding DNA Sequence Number=SeqID_105111
QILEVGCEDSDPILMASNDNSWRSSDIVDGGGGGLGLWNQATDYLPGLHISRATDIKMVADKVSPHLPVWDATKKKDSKKTSTFGYDGSDNVEHHDFIQVLCPVTKYHFDDAYVCSTKDSTTTHLFNLHEAQQRRKVEEEDATVVAMK

SEQ ID NO: 221890 - protein, 85 aa, Glycine max
  Coding DNA Sequence Number=SeqID_105112
MVNIGDYIPYCRNLPFGGRARRDAKGASSHEENVWSRHQRLFEENIRKTKKRSANFENKGSRVIYARGRLILIANKIRLRSWTLK

SEQ ID NO: 221891 - protein, 92 aa, Glycine max
  Coding DNA Sequence Number=SeqID_105113
MRGYHMVTRTFGQPGANEPVGERRLTSSSVPFGILTREVRCHAGLPYVKSGDMQGYLMVTRTFRQPGENESVDTRRLTSSSTPFVVLTSEVK

SEQ ID NO: 221892 - protein, 353 aa, Glycine max
  Coding DNA Sequence Number=SeqID_105114
  Homolog annotation: Hit_ID=Q1T402; Match level="QueryCoverage=43%, HitCoverage=31%, E-value=2e-13, Identity=35%"; Hit description=RNA -binding protein Lupus La
SDLTLKWALAVDKESVDDTVCEKYNISKEKWAQFCQTRRDPSWEAIQKQNIAPHMLSRGEHPSRVHAIGTGVTIKQYFGLTPRTSYTSSSMGLEDLEQLTQQIRDQLEELITEKSQMQSQGLALPPKPKVDPSATCVSTKESCVDPLGNDPDTSDSEKCGLYIEENPPRLDALGRVYEGSIIVHNIPLLHDQVKVGVEEVRDADAPILIPTEESARAPTKSQFPSPSSSEMTMAATIAGFVPSRNVRDNANANNNNTVQTHQKSFKHNNSNTSSNGGHHPPQMSGPQGLIAPAGSHNYNSSPKEHQPRAEFLPNDHLSQRNSFRHRNGNGPHQRKDDHHHHNYGGRRFSVYVQ

SEQ ID NO: 221893 - protein, 154 aa, Glycine max
  Coding DNA Sequence Number=SeqID_105115
  Gene Ontology: Mol. function=helicase activity
  Homolog annotation: Hit_ID=Q9LTU4; Match level="QueryCoverage=92%, HitCoverage=10%, E-value=1e-37, Identity=51%"; Hit description =Helicase-like protein
MLSYLTNGQLLGKVVAYMHTIEFQKRGLPHVHLFLFLHLDNKYPSSTDIDEIISVEIPSHEDDPELYRLVENHMIHGPCGILQPNSPCMKEGKCSHFYPKQFQPQTLLDSNGYPDYHRRNNGHSISKNGVIIDNRYVVPYNPKLLKKISGTYKY

SEQ ID NO: 221894 - protein, 348 aa, Glycine max
  Coding DNA Sequence Number=SeqID_105116
  Gene Ontology: Mol. function=thiamin pyrophosphate binding; Cellular component=membrane; Biological process=electron transport
  Homolog annotation: Hit_ID=Q3KCN2; Match level="QueryCoverage=100%, HitCoverage=58%, E-value=1e-123, Identity=63%"; Hit description =Thiamine pyrophosphate enzyme
  Pfam annotation: Domain name=TPP_enzyme_M; Domain location=145-275; Score=144.8; E_value=2.4e-40; Accession=PF00205.12; Description =Thiamine pyrophosphate enzyme, centra
  Pfam annotation: Domain name=TPP_enzyme_N; Domain location=1-121; Score=24.9; E_value=3.3e-10; Accession=PF02776.8; Description =Thiamine pyrophosphate enzyme, N-term
  Pfam module annotation: Pfam domain module=TPP_enzyme_M::TPP_enzyme _N; Domain location=145-275::1-121
MAAFMAAGHAKFTGELGVCLSTGGPGATHLLTGLYDAKMDHAPVLAIAGQAETTARGASYQQEMNLDRIFADVANFVQEAAAPAQVQHLVDRGVRIAKAQNGVAVIILPKDLQDENWQPPQHAHGFTHSGPGYQRPKIVPYDEDLRRAAEVLNAGKKVAVLIGAGARGAAVEVVQIANVLGAGVAKALLGKDVLPDDAPFVTGSIGLLGTKPSWELMQNCDTLLMIGSGFPWTEFLPPEGKVRAVQIDIDPAMLGLRYPCEVNLHGDAAETLRALLPLLTHKADRHWQEAIAVQVRDWWALMEQRAMAPANPVNPQRVVWEMSPQLPDDAIVTSDSGSCANWFARDYR

SEQ ID NO: 221895 - protein, 259 aa, Glycine max
  Coding DNA Sequence Number=SeqID_105117
  Gene Ontology: Cellular component=membrane; Biological process =cellular response to starvation
  Homolog annotation: Hit_ID=UPI000052761D; Match level="QueryCoverage =99%, HitCoverage=33%, E-value=1e-104, Identity=74%"; Hit description= carbon starvation protein CstA
  Pfam annotation: Domain name=CstA; Domain location=1-150; Score= -119.6; E_value=1.6e-07; Accession=PF02554.5; Description=Carbon starvation protein CstA
MKIGVIVMLAGAIVLVRPEITVPAISIFGENGMGPVFAGPLFPFLFVTIACGALSGFHALIASGTTPKLIEKERQTRFIGYGGMLMESFVAIMALVAAISIDQGIYFAMNAPTAATGGTVEGAVAFVNSLGLTGVNLTPEMLTGTATLVGEESVVSRTGGAPTLALGLAHIMQQALGGQALMALWYHFAIMLEALFILTAVDAGTRVARFMVQDSIGAWFPKLRDVSRRPGVWICTAIMVAGWGAILILGVTDPLGGIN

SEQ ID NO: 221896 - protein, 83 aa, Glycine max
  Coding DNA Sequence Number=SeqID_105118
MNDYGVKRIEGKVKLTGHEIGESYDAYDEDDDPFLSFLDEVSHSHLVRLRRHVHLKIHRIAAQFGKAKTQFKSISVSLERKFG

SEQ ID NO: 221897 - protein, 1102 aa, Glycine max
  Coding DNA Sequence Number=SeqID_105119
  Gene Ontology: Mol. function=phosphoinositide binding; Biological process=intracellular signaling cascade
  Homolog annotation: Hit_ID=Q75HY6; Match level="QueryCoverage=98%, HitCoverage=94%, E-value=0.0, Identity=39%"; Hit description=Unknow protein
  Pfam annotation: Domain name=Nexin_C; Domain location=938-1077; Score= 78.3; E_value=2.5e-20; Accession=PF08628.2; Description=Sorting nexin C terminal
  Pfam annotation: Domain name=PX; Domain location=636-773; Score=59.4; E_value=1.2e-14; Accession=PF00787.14; Description=PX domain
  Pfam annotation: Domain name=PXA; Domain location=85-241; Score= -16.1; E_value=0.0014; Accession=PF02194.6; Description=PXA domain
  Pfam module annotation: Pfam domain module=Nexin_C::PX::PXA; Domain location=938-1077::636-773::85-241
MSSSKCLIPQDLEVLTVTSSSVWVNLPAAASLIIILRYLSLDFEMKRKAAAYNNKAGSTNVQSSKKPVENHKVIAKFEWRTKVNSPVVEDAIDNFTRHLISEWVTDLWYSRLTPDKEGPEEDLINLICTHLELFRAAHSKIEKQHTGSLTIESQDMELKIVLAAENKLHPALFSAEAEHKVLQHLMTGLMHVTFKSEDLQCSFFRYTVRELLACAVIRPVLNLANPRFVNERIESVVVNKTKVNKGVPAAQEASHTKPDEIQISSDDFSKTSDPSVTGVELVQLRNGPSKNAEPCAKNNARDNITKDPLLSIDARPSRTWNSLPANSQANDDQGLQQHRSGEWGDILDVISRRKTQALAPENFENMWTKGKNYKKKDGENQSNEHVSQHPVVGKLPKVDHMKAISGPKERDSNSKLILPPKRRHINSGHSSQFSVENTSINVDKNGSTSVTSYKDDESVASFKDDEHSHIYGQMSDSESSTSYTSEDNESSTVTGLDSPVTKVWDGKSNRNQAVSYVHHPLENFDHHGAKKKNKSHSRYPRLSRAQSGSQGSWPGGHKTQTWQEVERTSFLSGDGQDILNSSKSHINSEESSDDGDMESLGRLYSGAAASSSAYSISISDSCSLSVDPLKSSSAVDSFYKLRCEVLGANIVKSGSKTFAVYSISVTDVNNNSWSIKRRFRHFEELHRRLKEFPEYNLHLPPKHFLSTGLDVPVIQERCELLDKYLKNWDHQYSVTSRIDVGYKCAGKILDMSKLMQLPTVSESIEVWDFLSVDSQTYIFSNSFSIMETLSVGLNAKPFQKTKNTSNFSAPASDPVSFQRENCSAESKEAVLGARTNVEANGLRSKVNSTPLSLPKKSTHEPRKSFDNSSSNTDIQAQKSAPSPNNLQKTAKERDNSDQVSEVHHDASDAFPTEWVPPNLSVPILDLVDVIFQVHDGGWIRRKAFWVAKQILQLGMGDAFDDWLIEKIQLLRKGSVVASGVKRVEQILWPDGIFITKHPNRRPPSPSSPSQNSPHGNQPTQVSSPRLDDEQKQEADRRAKFVYELMIDHAPPAIVGLVGRKEYEQCARDLYFFLQELIDVLLGFIIPFEIISRAILAQAHGFN

SEQ ID NO: 221898 - protein, 40 aa, Glycine max
  Coding DNA Sequence Number=SeqID_105120
MFDSGYGRDLLPMWLPVLGVPPYCIFSLEEIEDATNNFDP

SEQ ID NO: 221899 - protein, 69 aa, Glycine max
  Coding DNA Sequence Number=SeqID_105121
MKRIADAKCREVNSDEGYWVMLKATYHLEDKMFLEGIGNDRKNEPQVQPGLRERSTRKVTTPGYLKDYV

SEQ ID NO: 221900 - protein, 230 aa, Glycine max
  Coding DNA Sequence Number=SeqID_105122
MEVDGEGGILNAYGDCLTKKLAVELMPITHHDFEWSCGPSWARCIENMCKLIWAGVGAGKLGGSHSRRKVNSSGDNLLIENEGGSFRGVGNKGEECDKMEEEIGLNLVLNLWGQAKNKKLKRNGGGRPMIRFTRSSNSKRKALTEDMPRSKLTVIGHPLKPSEGSTFHVEGSNSQAFVFWGQVVFENLGDVKDPTQGISTIKTQNFELHGVRRRKGNMRVIKFSVSLGDN

SEQ ID NO: 221901 - protein, 384 aa, Glycine max
  Coding DNA Sequence Number=SeqID_105123
MVMFHLSEGSEKMEANNNLYGSSNAIVSLDTPSWMQPVYPNLEKVQHYWVPFGTQQTMCPLLDNEGADKPKGRKKSESAMAFESALITSSKSSMDPSKGCHSPTIAWEKHIHLWTPLQMRQLISKCFEIGHVQGCQSITWGRKNGFKLNFDVEVPSRKQRVELVNHLCDWKTLFKGNKLIGKLDVSYARTPWNQTVGFDTTKASISGFFGKNLAKHKDSIQFIKLLDKKKKAWEKGVQAKLAKKTIAKVIEVLVDLNNSGGLQENAEQVPSPDASNVAKANELLHTTNPTHVPTQQEPSNEATSVQKDVLDVVVAITQQSEEIEKELRAYAEQQHIKNEKYKLSIVNHVVQPPPPVQQQPCILLAPPPEPTSISSPTSLPPPSS

SEQ ID NO: 221902 - protein, 231 aa, Glycine max
  Coding DNA Sequence Number=SeqID_105124
  Gene Ontology: Mol. function=sequence-specific DNA binding; Cellular component=intracellular; Biological process=regulation of transcription, DNA-dependent
  Homolog annotation: Hit_ID=Q9SFD8; Match level="QueryCoverage=56%, HitCoverage=68%, E-value=5e-21, Identity=41%"; Hit description =Nuclear transcription factor Y subunit B-9
  Pfam annotation: Domain name=CBFD_NFYB_HMF; Domain location=24-89; Score=58.4; E_value=2.3e-14; Accession=PF00808.13; Description =Histone-like transcription factor (CBFNF-Y) and archaeal histone
MAISLPINSNNGDRVPNLVLRDKSKMPITNMMKIMSQILLNNVQVSYDTMDMIQQSATKYINFVTRKAKDRCQSECRKIMNAEDLLWAIEELGFNDYVEPLTTFIQRYRNIEGVDLFTTHKEPISHIENHGPSLGPEPNLMSTLEMLHPPQPPQVNSSQPKFSIIPNTNLEMLYPNEMSSTKIHLVLVVQMMFSTTLMFLLSSIMINIEMIIEEIQLQLTIMAMDYDIGNK

SEQ ID NO: 221903 - protein, 450 aa, Glycine max
  Coding DNA Sequence Number=SeqID_105125
  Gene Ontology: Mol. function=kinase activity
  Homolog annotation: Hit_ID=Q5DK69; Match level="QueryCoverage=99%, HitCoverage=89%, E-value=1e-164, Identity=66%"; Hit description =Pollen-specific kinase partner protein
  Pfam annotation: Domain name=DUF315; Domain location=1-349; Score =631.3; E_value=8.3e-187; Accession=PF03759.4; Description=Domain of unknown function (DUF315)
MEQMKERFAKLLLGEDMSGGGKGVSSALALSNAFTNLAAAVFGEQKRLEPMPPERKARWRKEIDWLLSVTDYIVEMVPVQQKNKDGSTMEVMTTRQRTDLHMNIPALRKLDTMLIDTLDNFKDQNEFYYVSKDAEDSDRNNDTKWWLPTPKVPANGLSDAARRFVQYQKDCVNQVLKAAMAINAQTLSEMEIPESYIESLPKNGRSSLGDLIYRSITDDFFDPDQLLSAMDMSSEHKIVDLKDRIEASIVIWRRKMNQKDSSKSAWGSAVSMEKREIFEDRAETILLLLKHRFPGTPQSALDISKIQFNRDVGHAVLESYSRILESLAFTVLSRIEDVLLADQQTQNPSHSGTKSSISRNPVPKPEKSPTPTPKEEVDKSGSEAMTLSDFMGWNNDQGDSDAKKDHFADSDDFDKNIDNGKPQKLPNVVTDKKVSYLETLGGMRSPTSRH

SEQ ID NO: 221904 - protein, 811 aa, Glycine max
  Coding DNA Sequence Number=SeqID_105126
  Gene Ontology: Mol. function=sequence-specific DNA binding; Cellular component=nucleus; Biological process=regulation of transcription, DNA-dependent
  Homolog annotation: Hit_ID=P46607; Match level="QueryCoverage=99%, HitCoverage=99%, E-value=0.0, Identity=56%"; Hit description =Homeobox protein GLABRA2
  Pfam annotation: Domain name=Homeobox; Domain location=93-149; Score =84.2; E_value=4e-22; Accession=PF00046.19; Description=Homeobox domain
  Pfam annotation: Domain name=START; Domain location=263-489; Score =293.4; E_value=4.2e-85; Accession=PF01852.10; Description=START domain
  Pfam module annotation: Pfam domain module=Homeobox::START; Domain location=93-149::263-489
MGVNMSNTPPHTKDLFSSPVLSLSLAGIFRYAGEAAETSGMEMASDEVRQEDTADISSDNSGPVRSRSEEDFDCDDVHDGDDKDNDDKNRKKKRKYHRHTTEQIREMEALFKESPHPDEKQRQKLSQQLGLAPRQVKFWFQNRRTQIKALQERHENSLLKTELDKLREETKAMRETINKSCCPNCGMVTATIDASMSTEEKQLLIENAKLKAEVEKLRTALGKFSPRTTSPTTSSAGHDEEENRNSLGFYSVLFGLDKSRIMDVANRATEELIKMATMGEPLWVRSVETGREILNYDEYVKEMAAENSGSERPKTFIEASRETEVVFMDLPRLLQSFLDVNQWKEMFPCLISKAVTVDVISNGEGSNRNGAVQLGNMFAELQMLTPMVPTREVYFVRCCKQLSDEQWAIVDVSIDKVEDNIDASLVKCRKRPSGCIIEDKSNGHCKVIWVEHLECQKSTIHTMYRTIVNSGLAFGARHWIATLQLHCERLVFYMATNVPMKDSTGVATLAGRKSILKLAQRMTWSFCHAIGASSFHTWTMVTSKTGEDIRISSRKNLNDPGEPLGVILSAVSSVWLPVSTNVLFDFLRDEARRSEGILGPKFKDFFQLMLLLELEASWKIPFKVAEFHKSGSTTLCLLQIHIYSSSYLGSLWDIMSSGGSVQSVANLAKGKDRGNVVNIQREKIKKIQSKDNSVWILQDSCTSAYESMVVYAPVEFAGIQSVLTGCDSSNLAILPSGFSILPDGIEGRPLVISSRQEEKYTEGGSLFTMAFQILVNPSPTVKLTTESVESVNNLVSCTLRNIKTSLQCEDG

SEQ ID NO: 221905 - protein, 125 aa, Glycine max
  Coding DNA Sequence Number=SeqID_105127
  Subcellular localization annotation: CTP_CleavageSite=61; ConfidenceScore=5.80e-01
MASIVASLPPPLLLPARKYHPGNFPSSPFSLLSGRRNHVSFVVKASGESSESSTTLTVFKSVQNVVSFSSHSHPCLSFKETQKWDQPEDRLGLIGLGFAAIAAFWASTNLIAVIFATFSVLEMNT

SEQ ID NO: 221906 - protein, 160 aa, Glycine max
  Coding DNA Sequence Number=SeqID_105128
  Gene Ontology: Mol. function=RNA-directed DNA polymerase activity; Biological process=RNA-dependent DNA replication
MTSRIVEVKEIMGYNMGFFPFCYLGVRIFQGCPKKEHFQPIVDKIMLKLAKWKGALLSIIGHMELIVESIIQGDIYSRKLVTVVWATVGSDRLATCGSIFRDSRGSILGCFSLNLHVSRTLCAKCIGARNTIEIAHRRGWNKLWLKCDSSLVELMMLSSL

SEQ ID NO: 221907 - protein, 90 aa, Glycine max
  Coding DNA Sequence Number=SeqID_105129
MEGGGTNCVTETTHNGSPSPPSLLSLGVMDIIGLQDKYSERVLEKPFPLPWKCWSRHRRRNEEFAHHLARIKLSTPSPLFFILSLRDSSW

SEQ ID NO: 221908 - protein, 183 aa, Glycine max
  Coding DNA Sequence Number=SeqID_105130
MEFHQTDQVIRQFGYCQTIPPSPLNLDQLNKEDMRGRTDRLIPISPKSTYQQHDFYRNRPNRDQQTFQPIGFSTYTSQFSFHQVPYTSGIFASQSNMFVTYSMTPPFAYNSTPSMNCYRPTMLTQTRNNADDNDDNNNDGRSFGVCEDYDSQNDDDDDDCDDGVHHAHVSFSHRQISRHGDTI

SEQ ID NO: 221909 - protein, 53 aa, Glycine max
  Coding DNA Sequence Number=SeqID_105131
MKNPAAAFRWIRKITTVWRATTLWGAKHRGLGRGGFRNGDEGTWAVLCRKRRE

SEQ ID NO: 221910 - protein, 174 aa, Glycine max
  Coding DNA Sequence Number=SeqID_105132
  Gene Ontology: Mol. function=RNA-directed DNA polymerase activity; Biological process=RNA-dependent DNA replication
MVDAKVMRIFFILYGGSMRLFIFRKRFCGCKNLILSELILLSDRNSSCFHGSTIIIRRRSKVDTFKFEDGSWISNLDEMKSRVIEELFVDDHAYQELVVKGMYPTLDATSLEALGANISSQEFQSICIGAFKALGPNGFQVVYYQNQWDAIEEAKLVQNVFRVCRSKLHDDESS

SEQ ID NO: 221911 - protein, 130 aa, Glycine max
  Coding DNA Sequence Number=SeqID_105133
  Subcellular localization annotation: CTP_CleavageSite=67; ConfidenceScore=5.12e-01
MGIAPTKTPSGPKEVQQALGFPALVTGLCRPYRAPVPPSKFMSSWHRDRARKTPSGPGEVQQGLGVSSSDYGPFSVLRSACRPQQGHQSVAYDTWPTSRLPSPKPKISKSTRSVTNKSSGIQLKTLKKRY

SEQ ID NO: 221912 - protein, 57 aa, Glycine max
  Coding DNA Sequence Number=SeqID_105134
MSAFIFSCTSSTLPITLALARVRNGFMILSYPNFVRGPLLDDVRPFFGPREVLGTHH

SEQ ID NO: 221913 - protein, 326 aa, Glycine max
  Coding DNA Sequence Number=SeqID_105135
  Gene Ontology: Mol. function=sugar porter activity; Cellular component=integral to membrane; Biological process=carbohydrate transport
  Homolog annotation: Hit_ID=Q2V4B9-3; Match level="QueryCoverage=88%, HitCoverage=65%, E-value=1e-116, Identity=70%"; Hit description =Isoform 3 of Q2V4B9
  Pfam annotation: Domain name=MFS_1; Domain location=51-325; Score= -11.3; E_value=0.001; Accession=PF07690.6; Description=Major Facilitator Superfamily
  Pfam annotation: Domain name=Sugar_tr; Domain location=47-326; Score=- 45.0; E_value=1.8e-05; Accession=PF00083.14; Description=Sugar (and other) transporter
  Pfam module annotation: Pfam domain module=MFS_1::Sugar_tr; Domain location=51-325::47-326
MVVIFAYPLESVFQMWIGSPLDRADFWTAASVRIPNAKPCWRRSLRHVIVASLSSFLYGYHIGVVNETLESISIDLGFSGNTMAEGLVVSICLGGAFVGSLFSGWIADGVGRRRSFQLCALPMIIGAGMSATAKTLWGMLLGRLFVGTGMGLGPPVAALYVAEVSPPAVRGAFGALTQIATCLGLMGSLFIGIPAKDIVGWWRICFWVSVIPATMLALFMEICAESPHWLFKRGRTIEAEASFEKLLGGVHVKPAMNELSKSDRGDGSDSVKLSELICGRYFRGSVVAMILMDKLGRKVLLLGSFLGMVGKKNENSYIAESTSFKL

SEQ ID NO: 221914 - protein, 227 aa, Glycine max
  Coding DNA Sequence Number=SeqID_105136
MVYSRNRKQKGEIGPLKSGGGIGRENNIVTRKENWANSEDPVASKENGSPILKVGMGLKRWPRGTEITEKRMLEATNTWTIAKDMGVRYEAEEGKMVSKIAILEGKNRGAVERGLGGGVKWSSVHRIVVKDQEDLLCIQETKRDRVDKWACQALWEDSEICWAESPAINNAGGMLCLWNESTFSVERKIIGTGFVVLDSQTGIVMVIAWQNVQKTVHPVLLTIIIHY

SEQ ID NO: 221915 - protein, 62 aa, Glycine max
  Coding DNA Sequence Number=SeqID_105137
MGFPMSICWSLWLGGEERRRQESKKMNRVRRWGQGWIGGWIVKEEGRKAMVGTLLVALGSIG

SEQ ID NO: 221916 - protein, 100 aa, Glycine max
  Coding DNA Sequence Number=SeqID_105138
MDRKPKSSSSIVAIATRLIVPFDLLAKDLKKDAKKVARFSMLQNKLFRKGASEKKEKVKTLTKVKNNTGTLAMVLRSKRELLSINKELSNKFLSSSIPHS

SEQ ID NO: 221917 - protein, 173 aa, Glycine max
  Coding DNA Sequence Number=SeqID_105139
  Gene Ontology: Mol. function=oxidoreductase activity; Cellular component=mitochondrial inner membrane; Biological process=embryonic development
  Homolog annotation: Hit_ID=Q6K7S7; Match level="QueryCoverage=95%, HitCoverage=98%, E-value=3e-59, Identity=67%"; Hit description =Cytochrome c biogenesis protein-like
  Pfam annotation: Domain name=CcmH; Domain location=7-154; Score=0.2; E_value=1.3e-07; Accession=PF03918.5; Description=Cytochrome C biogenesis protein
MASEDDAVKKAMIVDARARNISHNVRCTECGSQSIEDSQADIAILLRKLIRDEIQSGKTDKDIYKKLEDEFGETVLYTPKFDMQTAALWLLPFKFVLIPEICSLKQLLIAGSAAGVWAYNRHKQKTNVHIMALNLVRGVPLTPKEKETMLDILTPPRSQGVRTPFWWRRWLGQ

SEQ ID NO: 221918 - protein, 376 aa, Glycine max
  Coding DNA Sequence Number=SeqID_105140
  Gene Ontology: Mol. function=catalytic activity; Cellular component =peroxisome; Biological process=metabolic process
  Homolog annotation: Hit_ID=Q9LW70; Match level="QueryCoverage=99%, HitCoverage=68%, E-value=1e-132, Identity=57%"; Hit description=Long- chain-fatty-acid-CoA ligase-like protein
  Pfam annotation: Domain name=AMP-binding; Domain location=1-311; Score=70.2; E_value=6.6e-18; Accession=PF00501.18; Description=AMP -binding enzyme
MQSIANKSSSQFFHLPLVLNKSSEKSRDDHSQNGGIHTDKILLDNFGRLSEDPALILYTSGTTGKPKGVVHTHKSIISQVEFLPKFSVRGVWQRWRESYPTDGSKAEDAITVFTGVPTIYARLIQGYHAMDPELQAASVSAAKNLRLMMCGSSALPLPVMQEWEAITGHRLLERYGMTEFVMALSNPLKGERKPGTVGKPFPGIQVKIITDEESVNENTGMGELCFKSPSLFKEYWKLPEATKESFTDDGFFKTGDAVTTDEDGYFIILGRNNADIIKAGGYKLSALEIESVIIEASLPDKDYGEIVGAIVVPQADVKLKRDQESKPVLSLEELSTWAKDKIAPYKIPTQLIVWDKLPRNAMGKVNKKELKKLLTI

SEQ ID NO: 221919 - protein, 146 aa, Glycine max
  Coding DNA Sequence Number=SeqID_105141
  Subcellular localization annotation: CTP_CleavageSite=82; ConfidenceScore=5.53e-01
MLELRNLLLSSLLMLRSSLLLLSTMANVPVLFFTLVKVFTFSFFSEAPFLNSLFCSMENLATFFASFFKSFASKSKGTINLVAMATIEEEDLGFLSMNFLTMVVKVGSPLAVFEGLTSMKAREEEQEEEVLILRLLNSWEEEGLEK

SEQ ID NO: 221920 - protein, 85 aa, Glycine max
  Coding DNA Sequence Number=SeqID_105142
MLEFSFHFLSPFFITSYALVCFLGNANSELVVTTFDHQLGPQSISANKEKVNNVEPIRKGMMVEWCGVGCKFFELHDLVLNIREN

SEQ ID NO: 221921 - protein, 62 aa, Glycine max
  Coding DNA Sequence Number=SeqID_105143
MSPKFIEFKLSQSKPLYITVILVVFNRIQKRKGRKESEKKVPGKRWQNLTQQLGIDQDKNQQ

SEQ ID NO: 221922 - protein, 494 aa, Glycine max
  Coding DNA Sequence Number=SeqID_105144
  Gene Ontology: Mol. function=transporter activity; Cellular component= membrane; Biological process=oligopeptide transport
  Homolog annotation: Hit_ID=Q2HU45; Match level="QueryCoverage=97%, HitCoverage=80%, E-value=1e-176, Identity=62%"; Hit description=TGF -beta receptor, type I/II extracellular region
  Pfam annotation: Domain name=MFS_1; Domain location=1-403; Score= -38.9; E_value=0.019; Accession=PF07690.6; Description=Major Facilitator Superfamily
  Pfam annotation: Domain name=PTR2; Domain location=1-387; Score =210.3; E_value=4.5e-60; Accession=PF00854.12; Description=POT family
  Pfam module annotation: Pfam domain module=MFS_1::PTR2; Domain location=1-403::1-387
  Subcellular localization annotation: CTP_CleavageSite=51; ConfidenceScore=5.14e-01
MALLCLTAMIPQSRPPPCNPATERCKPATAGQMAMLISSFALMSIGNGGLSCSIAFGADQVNKKDNPNNQRALETFFSWYYASTAFSVIIALTVIVYIQDHFGWKVGFGVPAALMFMSTFFFFLASPLYVKNKIQGSLITGLAQVIVVAYKNRKLPLPPRNSAEMYHHRKDSDLVVPTDKLRFLNKACIIKDIASDGSASNPWSLCTIDQVEELKAIIKVIPLWSTGIMMSVNIGGSFGILQAKSLNRHITSHFEIPAGSFSVVIVFMVFIWVALYDRVIIPIASKLRGKPVRISAKRRMGIGLVFSFLHLATAAIVENTRRRRAIREGHIDDTNAVLNMSAMWLVPQLCLSGMAEAFNAIGQNEFYYTEFPRTMSSIAACLFGLGMAAGNVLSSLIFSIVENVTSRGGKQGWVLDNINKGSYDSWAYVPTVDQLSNVSDENNSNEKVLIQLGNMSQVFKISENNDSKEEKLTELQVHNKKEKGRICAEDPMIA

SEQ ID NO: 221923 - protein, 587 aa, Glycine max
  Coding DNA Sequence Number=SeqID_105145
  Gene Ontology: Mol. function=transporter activity; Cellular component= membrane; Biological process=oligopeptide transport
  Homolog annotation: Hit_ID=Q2HU45; Match level="QueryCoverage=99%, HitCoverage=91%, E-value=0.0, Identity=70%"; Hit description=TGF -beta receptor, type I/II extracellular region
  Pfam annotation: Domain name=MFS_1; Domain location=36-518; Score =7.7; E_value=0.00014; Accession=PF07690.6; Description=Major Facilitator Superfamily
  Pfam annotation: Domain name=PTR2; Domain location=98-502; Score =253.9; E_value=3.4e-73; Accession=PF00854.12; Description=POT family
  Pfam module annotation: Pfam domain module=MFS_1::PTR2; Domain location=36-518::98-502
MEMEVELSSAQPKMGSQLISQPQRCGKGGLVTMPFIIANEALARVATLGLLPNMILYLMGNYNLHLGKATKILLLSVATTNFMPLPGAFISDSYLGRFLAVGLGSFITFLGMALLWLTAMIPQARPPACNSQSERCESATPGQMAMLISSLALMSIGNGGLSCSLAFGADQVNRKGNPNNQRALEMFFSWYYASSAISVIIAFTGIVYIQDHLGWKLGFGVPAALMFLSTFFFFLASPLYVKNKTHSNLLTGFARVIVVAYKNRKLRLPHKISDGMYHRNKDSDLVVPSDKLRFLNKACFIKDSEKDITSDGSASNPWSLCTVDQVEELKAIIKVIPMWSTGILMYLNIGGSFGLLQAKSLNRHITPNFEVPAGSMSVIMIFTIFIWIALYDRLIIPLASKIRGKPVRISAKRRMGLGLLFSFLHLVTAAMVETIRRRRAISEGHVNDTHAVLNMSAMWLFPQLCLGGIAEAFNAIGQNEFYYTEFPKTMSSIASSLFGLGMAVGYVLSSLVFSVVEKVTSRGGKDGWVSDNINKGRFDKYYWLLATLSAVNVLYYLVCSWIYGPTADQESKVTEENGSNEEELPLI

SEQ ID NO: 221924 - protein, 81 aa, Glycine max
  Coding DNA Sequence Number=SeqID_105146
  Gene Ontology: Mol. function=hydrolase activity; Biological process =metabolic process
  Homolog annotation: Hit_ID=Q6K7V7; Match level="QueryCoverage=63%, HitCoverage=22%, E-value=6e-10, Identity=55%"; Hit description =Isochorismatase hydrolase-like
MAEDWNRTALLVIDMQKDFIEDWSPVALKGGKDIVPNVIKAVEVARQRGILIVWVISNNTLSLSCLIYGLFLSNFMPTLMC

SEQ ID NO: 221925 - protein, 97 aa, Glycine max
  Coding DNA Sequence Number=SeqID_105147
MRDKDTKIEATLSKKATKSEGKEENLKQAQPNTHAQRASCAKRTYEGPKPTSVTINREQVQGKQTPPQNPPLLGVSFTPFLPPLFILIVKPSMAMSG

SEQ ID NO: 221926 - protein, 432 aa, Glycine max
  Coding DNA Sequence Number=SeqID_105148
  Gene Ontology: Mol. function=protein-tyrosine kinase activity; Cellular component=integral to membrane; Biological process=protein amino acid phosphorylation
  Homolog annotation: Hit_ID=Q84U00; Match level="QueryCoverage=29%, HitCoverage=39%, E-value=2e-55, Identity=77%"; Hit description=Ser -thr protein kinase
  Pfam annotation: Domain name=LRR_1; Domain location=41-63; Score=7.9; E_value=9.4; Accession=PF00560.23; Description=Leucine Rich Repeat
  Pfam annotation: Domain name=LRR_1; Domain location=65-88; Score =13.3; E_value=0.91; Accession=PF00560.23; Description=Leucine Rich Repeat
  Pfam annotation: Domain name=LRR_1; Domain location=90-112; Score =7.1; E_value=13; Accession=PF00560.23; Description=Leucine Rich Repeat
  Pfam module annotation: Pfam domain module=LRR_1::LRR_1::LRR_1; Domain location=41-63::65-88::90-112
MANPECKFLHSRLGCKKQVQRNLKDLCLHGTLALEIGKLVHIKSIILRNNYFYGDIPKEILQLEDLEVLDLGYNNFSGQFPFHDLATYPSLTTLLLDNNDHLASLTPEVYELKTFSELHVAEEQLTGATTREACVRITNNWHIGTHGDIASRRALLQEANGEKRGDDDTETLSPSPFPSTLSPFSEPFSPSESPSDSPISSPEVSPSPSPSLSNFFFTLSPSPSPEVAPTPDLSPPANPPMVVSTPPQSNWVSMPSPASSSNQGNANSSNPKQHTAIIWSTVGGFSFLILVSAIAFVCFRSNKVVTVKPWTTGLSGQLQKAFVSGVPSLKRTELEVACEDFSNIIGSLPEGTIYKGTLSSGVEIGVASSAVTSSQNWSKNMETQFRKKIEMLSRVNHKNFVNLIGYCEENKPFTRMMVFEYAPNGTLFEHLH

SEQ ID NO: 221927 - protein, 1633 aa, Glycine max
  Coding DNA Sequence Number=SeqID_105149
  Gene Ontology: Mol. function=RNA-directed DNA polymerase activity; Cellular component=chromatin; Biological process=chromatin assembly or disassembly
  Pfam annotation: Domain name=Chromo; Domain location=1520-1568; Score= 38.5; E_value=2.4e-08; Accession=PF00385.14; Description='chromo' (CHRromatin Organisation MOdifier
  Pfam annotation: Domain name=Isochorismatase; Domain location=29-186; Score=7.9; E_value=9e-07; Accession=PF00857.11; Description =Isochorismatase family
  Pfam annotation: Domain name=RVP_2; Domain location=635-754; Score= -55.3; E_value=0.02; Accession=PF08284.2; Description=Retroviral aspartyl protease
  Pfam annotation: Domain name=RnaseH; Domain location=1122-1241; Score= -28.3; E_value=0.025; Accession=PF00075.14; Description=RNase H
  Pfam annotation: Domain name=zf-H2C2; Domain location=1311-1348; Score=23.4; E_value=0.00028; Accession=PF09337.1; Description=His(2)- Cys(2) zinc finger
  Pfam module annotation: Pfam domain module=Chromo::Isochorismatase::RV P_2::RVT_1::Retrotrans_gag::RnaseH::zf-H2C2; Domain location=1520 -1568::29-186::635-754::862-1031::395-486::1122-1241::1311-1348
RPNWPKPLSLRSKSALAVAGADPLEMAEDWNRTALLVIDMQKDFIEDGRPMLVKGGKYIVPNVIKAVDVARQRGILIVWVVREHDPLGTDVELFRRHHYAAGKVGPTSKGSEVLQGAEINSLVVTGVQTPNCIRQTVCDAVALDYQPVTVIVDATAAATPDIHLVVYWCSIPRLKKGADVFDSIALQKRFLQYIRATKGQVPDNNNKKIHKSREYPNRMIFPYSPLQRHYQKDTNPTTLFIPLTSCSPIDTEEQTIAVQAQDAGPIAEPISQTREQEENAEATDQQVYQVVLSLPPMSDQPPLSSTKLEEILVALTTQQLTLSHKIDDLIQHISPVLHPQPSITSSIPRLYPIPAQQHRMKLEIPRFDGVDPIGWIFKVNQFFDYYGTPEHERLQIAAFYMEGRALSWFQLMSANAQFTSWPAFIQALQTRFAPSQYEDPIGTLCKLMQKGTVAAYLSEFEDIANRIVAHQPLTLTQAAGLAKLQEEKLLDSRPSPPPPRPCPPSTSFFPTIPLRNTNSLSLPSSLPSSSPHQPNPAPSPLPSPILRPQPPPPFKRLTSEEIASRRERGLCFSCDEKYHRGHRCASRVFLLLAEDGDTFPSPESPLISHPDPDPDPTLDPAHHPDPYPTHDPDPYPAQLSLNSMAGHLALETLRFIATISGNEVVLLVDGGSTHNFIQRQLVDHLGLPSRPTTPLHVMVGNGQQLDCDTICEAIPIIIQTHEFHVDLYVLPISGANVVLGVQWETWMLPLHPFRPFVLSSFRRLTRKLATPMYYHITLLADHNSTTQMIPPAIQTLLDKFATLFQPPQSLPPPRNTDHHIHLLPQAAPVNVRPYRYPHYQKKEIEEQVDSMLQKGLIQPSTSPFSSPVLLVKKQDGSWRFCVDYRALNALTVRDRFPIPTIDELLDELGGACYFSKLDLLQGYHQIRMHSDDIPKTAFRTHHGHYEFKVMSFGLCNAPSSFQATMNQIFQPYLRRFIIVFFDDILIYSRSMDDHLRHLDITFQVLFVNQFVLKLSKCYFAQPQVEYLGHLVSHKGVEPLPSKISAIQQWPTPHTTKAVRSFLGLAGFYRRFIQGYATLAAPLVKATTLDPFQWTPEAQLAFEKLKLALSSAPVLALPDFSIPFTVKTDASGVGMGAILSQKGHPIAFFSKPFSAKLLRSSTYVRELFAITAAIKKWRQYLLGHRFIILTDHRSLKELLTQAVQTPEQHMYLAKLMGYDYQILYRSGAHNQAADVLSQVPESQSHLSMILSVPCFTFLEELAQQLAHHDDYLQLCRNISEAPAVFEGFSLTDTFILFRNRIWLPRTLPIIPTGGHAGITKTLTRLSENFFWSGMRADVSTFVANCFKCQCTKYETKKMSGLLCPLPVPRQPWEDLSLDFITGLPPSNGHTVILVVVDRFSKGVHLGLSFTGDPPRGASSFPGQSIHTILLRALRRVQLPTKPYRQSSAKGLEPTTGKLSKRFFGPFQVVEHVGKVAYRLQLPAKAKVHPVFHYSLLKRFHGDPAAVPAAFPAAILTSQPSIAPLAILAARKASNATTEVLVQWQGLSPDDATWEDWIELRNEFHLEDKVLSHGPWNDTEEQTIAVQAQDAGPIAEPISQTREQEENAEATDQQVQLVKRPKRVVTKPSYLKDYV

SEQ ID NO: 221928 - protein, 680 aa, Glycine max
  Coding DNA Sequence Number=SeqID_105150
  Gene Ontology: Mol. function=protein binding; Cellular component =thylakoid; Biological process=ethylene mediated signaling pathway
  Homolog annotation: Hit_ID=Q1SC84; Match level="QueryCoverage=99%, HitCoverage=71%, E-value=0.0, Identity=65%"; Hit description=TPR Domain, putative
  Pfam annotation: Domain name=TPR_1; Domain location=174-207; Score =15.4; E_value=0.079; Accession=PF00515.18; Description =Tetratricopeptide repeat
  Pfam annotation: Domain name=TPR_1; Domain location=303-336; Score =18.1; E_value=0.032; Accession=PF00515.18; Description =Tetratricopeptide repeat
  Pfam annotation: Domain name=TPR_1; Domain location=503-536; Score =30.0; E_value=8.6e-06; Accession=PF00515.18; Description =Tetratricopeptide repeat
  Pfam annotation: Domain name=TPR_1; Domain location=632-665; Score =24.8; E_value=0.00031; Accession=PF00515.18; Description =Tetratricopeptide repeat
  Pfam annotation: Domain name=TPR_2; Domain location=174-207; Score =16.8; E_value=0.077; Accession=PF07719.7; Description=Tetratricopepti de repeat
  Pfam annotation: Domain name=TPR_2; Domain location=303-336; Score =22.9; E_value=0.0012; Accession=PF07719.7; Description =Tetratricopeptide repeat
  Pfam annotation: Domain name=TPR_2; Domain location=429-462; Score =3.9; E_value=11; Accession=PF07719.7; Description=Tetratricopeptide repeat
  Pfam annotation: Domain name=TPR_2; Domain location=503-534; Score =13.2; E_value=0.96; Accession=PF07719.7; Description=Tetratricopeptid e repeat
  Pfam annotation: Domain name=TPR_2; Domain location=535-568; Score =12.3; E_value=1.2; Accession=PF07719.7; Description=Tetratricopeptide repeat
  Pfam annotation: Domain name=TPR_2; Domain location=599-632; Score =13.9; E_value=0.57; Accession=PF07719.7; Description=Tetratricopeptid e repeat
  Pfam annotation: Domain name=TPR_2; Domain location=633-665; Score =7.5; E_value=4.4; Accession=PF07719.7; Description=Tetratricopeptide repeat
  Pfam module annotation: Pfam domain module=TPR_1::TPR_1::TPR_1::TPR _1::TPR_2::TPR_2::TPR_2::TPR_2::TPR_2::TPR_2::TPR_2; Domain location =174-207::303-336::503-536::632-665::174-207::303-336::429-462::503 -534::535-568::599-632::633-665
MLYGGFAESKINKIDFSGNGICPKGMRAVEFYSRNKRLDLFCPMTVLELLSFANRFCCEDMKSACDAHLASIVVNVEDALVLIEYGLEERATLLVGACLQVLLRELPNSLYNPKVAKIFCSFEVKERLANVGCASFLLYYFLSQVAIEENMVSKTTMMLVERMGECATERWQKALAFHQLGCVLLERNEYVEAQHCFEAALEEGHVYSLAGVARTKHKQGQPYSAYKLISSLIFEYKPEGWMYQERALYNMGKEKSFDLDVATELDPSLSFPYKYRALAKVEEKKIKEGIIELDRFIGFKLSPDCLELRAWLYVALEDYDSAMRDIRALLTIEPNYITSHGKIKGEYLLQLLNRGVQQKCQADCWMQLYQQWSCVDDIGSLAIIHQMLENEPGKSVLEFRQSLLLLRLNCQKAAMRSLRLARNHSSSMQERLVYEGWILYDTGYRKEALARADISIAKHRSFEAFFLKAYVLADTTLDPESSSYVIQLLKEALKCPSDGLRKGQALNNLGSIYVDCGKLELAKECYKNALAIRHTRAHQGVARIYHQKNQRKAAYDEMTKLIEKAESNASAYEKRSEYCDREMAKADLDVVTQLDPLRTYPYRYRAAVMMDEQKETEAVEELTKAIKFKPDLQMLHLRAAFYESMGDLSSALQDCQAALCLDPNHAGTLDVYRRIQRLNF

SEQ ID NO: 221929 - protein, 259 aa, Glycine max
  Coding DNA Sequence Number=SeqID_105151
  Gene Ontology: Mol. function=transcription regulator activity; Cellular component=nucleus; Biological process=regulation of transcription
  Homolog annotation: Hit_ID=Q1SP86; Match level="QueryCoverage=100%, HitCoverage=81%, E-value=7e-83, Identity=64%"; Hit description=Helix- loop-helix DNA-binding
  Pfam annotation: Domain name=HLH; Domain location=183-221; Score=2.7; E_value=0.076; Accession=PF00010.16; Description=Helix-loop-helix DNA- binding domain
  Subcellular localization annotation: CTP_CleavageSite=58; ConfidenceScore=5.46e-01
MAGNPNWWTMHPPSLIPPQYVFGSSSIPFNSSTQNQEPPQSLSQLLFTGLPGEEERIAFSPFQSKKLDEWNDQMLNIPSPIVPMPDVIKQEVSQSGSLYHHGHDQEFQVSGAPWSHMVPISSSPRSSVASFSSNNLLDFTYNKTDHRKNQLPDTSECNSTATAGVYKKTKSQPSSSQPPLKVRKEKLGDRITALHQLVSPFGKTDTASVLLEAIGYIRFLQGQIEALSSPYLGNGSKNMRNPQSVHGERNSVFPEDPGQ

SEQ ID NO: 221930 - protein, 114 aa, Glycine max
  Coding DNA Sequence Number=SeqID_105152
  Subcellular localization annotation: CTP_CleavageSite=36; ConfidenceScore=5.35e-01
MAEAPGTASHRSHVMSVFVFGVSSTRDMPLNFYSVSNSEEGSAAKTNSMASSGDKWIQTEQRWELDLLAILRGSAKITGESDSKMTINFICNGVVPTHPYFPIVGKIQSFKDLN

SEQ ID NO: 221931 - protein, 508 aa, Glycine max
  Coding DNA Sequence Number=SeqID_105153
  Gene Ontology: Mol. function=protein binding; Biological process =protein modification process
  Subcellular localization annotation: CTP_CleavageSite=61; ConfidenceScore=5.82e-01
MASAHGLAPIFKLGFVFSSVSPSQRKRHPLMFPASHCGFSLKFYGGLSARSCKFKNPSFVSAKHGSLRGFRALKSVEMDQYVTSNDEMSDGFFEAIEELERMTREPSDVLEEMNDRLSARELQLVLVYFSQDGRDSWCALEVFDWLRKENRVDKETMELMVAIMCGWVKKLIQQQHGVGDVVDLLVDMDCVGLRPGFSMIEKVISLYWEMGEKEGAVLFVEEVLRRGIPYVEEDEEGHKGGPTGYLAWKMMAEGDYRNAVRLVIRFRESGLKPEIYSYLVAMTAVVKELNEFAKALRKLKGFTRAGLVAELDLEDVELTEKYQSDTLADGVRLSNWVIQDGSPSLHGIVHERLLAMYICAGHGIEAERQLWEMKLVGKEADGDLYDIVLAICASQKESNATARLLTRLEVVSSPQKKKSLSWLLRGYIKGGHFNEAAETIMKMLELGFYPEYLDRAAVLQGLRKRIQQYGNLDTYVRLCKSLSDANLIGPCLVHLYIRKYKLWVVKML

SEQ ID NO: 221932 - protein, 123 aa, Glycine max
  Coding DNA Sequence Number=SeqID_105154
  Gene Ontology: Mol. function=transposase activity; Cellular component= membrane; Biological process=transposition, DNA-mediated
  Homolog annotation: Hit_ID=Q1SUE7; Match level="QueryCoverage=75%, HitCoverage=28%, E-value=3e-24, Identity=59%"; Hit description =Transposase, IS4
MPDYLAPFRRNIYRLRDFREGCGRPRGKEELFNYRHSSLRNVIERCFGVLKTRFPILKLMPSYPIRRQRLISIACCTIHNFIRMQNGVDTLFDQYAEQLMDMDEQWLSVEQQGVNENQTTEMA

SEQ ID NO: 221933 - protein, 132 aa, Glycine max
  Coding DNA Sequence Number=SeqID_105155
  Gene Ontology: Mol. function=acyltransferase activity; Biological process=metabolic process
  Homolog annotation: Hit_ID=Q1S6K6; Match level="QueryCoverage=98%, HitCoverage=35%, E-value=7e-32, Identity=60%"; Hit description =Phospholipid/glycerol acyltransferase
MESELKDLNSKPPTYNGNANSICDDRPLLKSEPPAFANSIVEMEKKLTTYVRRDVYDTMGHSEFPGKEKLLLDFALGTLLPIRGLHSLLYSDWRGGIGRLRSYEWVEENHHCFVWVCPLKSHALHFRLLLDP

SEQ ID NO: 221934 - protein, 84 aa, Glycine max
  Coding DNA Sequence Number=SeqID_105156
  Gene Ontology: Mol. function=sugar porter activity; Cellular component=integral to membrane; Biological process=transport
  Homolog annotation: Hit_ID=Q6QIL3; Match level="QueryCoverage=61%, HitCoverage=17%, E-value=3e-11, Identity=63%"; Hit description=NIP3
MWPMEHMMIITASPLVVAHPITVSGPCDFSFSIAVPIAANMRKNVPINSAPTWQKGRHAKAWQILVLGRKIQMHTQQNLKNPSG

SEQ ID NO: 221935 - protein, 90 aa, Glycine max
  Coding DNA Sequence Number=SeqID_105157
MEPAVNVCIHDFDDAKEESNKAASKDKHYFKINTRLLQQIKPCFKISSRSSLASKQRVSKSSKALMFVIDYQQRNSGLNSKVITLQNIIV

SEQ ID NO: 221936 - protein, 145 aa, Glycine max
  Coding DNA Sequence Number=SeqID_105158
MAQTLAANDMTDHLDRLILDLASENEIKCGDDHKGLASLIKAVVAARSRESTVRIYGLMNKSGYGSVTEPDEYVVEVLVSGLKSFGEEALAKELQHEYKIALAKLMWMDLTDRVGQTSACDCLIRDFKEKFIKGLHCNIGHSNAL

SEQ ID NO: 221937 - protein, 357 aa, Glycine max
  Coding DNA Sequence Number=SeqID_105159
  Homolog annotation: Hit_ID=Q012Y1; Match level="QueryCoverage=26%, HitCoverage=16%, E-value=5e-09, Identity=30%"; Hit description=[S] KOG1043 Ca2+-binding transmembrane protein LETM1/MRS7
MGIKDLDGVIMNFLRLISLLVCYILTIPIFKIPILKIQCFDFSYLECGILFVYPEFSSIRVYQCFMEVVTEEIGWLDFYGSYVQINCKEKRSKYNARQAEKEIISSVVFTVCYDVFSGFAHFNRSTQQSLDTASRSYLLRCESLNTADHAAFDNHTSYMGSINGPKLPLVFEVQQMPHDLTTEGCPKNNFQNSCIFNKAPISAITNKKTYEEDTCVDKSNPQHESFIKRYSIKLASTSADLWMGIVLLFIDIMVALEILVRQVHGCKASGSQRKRLNRTMTDIIVLIPVTILMLIPVTAVGHAAILAAIKKYMPCLIPSSFSSERLDVVKQIKRTREMGYQLHLAQFDLEDQPATTS

SEQ ID NO: 221938 - protein, 382 aa, Glycine max
  Coding DNA Sequence Number=SeqID_105160
  Gene Ontology: Biological process=intracellular protein transport
  Homolog annotation: Hit_ID=Q1SF28; Match level="QueryCoverage=97%, HitCoverage=53%, E-value=1e-157, Identity=75%"; Hit description =Epsin, N-terminal; ENTH/VHS
MGFVRMKAVCVLEAILRKKDDDHFSPVDSYFTENKDVVLRCSESPQASLRERTVKVLGLLGGGQPNSSMINSEKAVKTENATVAELPDLIDTGDSNDYHGNDDTLKGTSDQNIANLTSSTPLVDDLFGDFSGSIGASQEPKNGDPFADVSFHTSENKEHADDLFSGMTVGSDKQGDLKSHRQGNITEPQLFDIFASNSEQGNHKEPVSDLMAGLSMDENTSSTKQKGTSPSIHSESLFSGLNNHIPDNTSGGMLSSQPMGFNVNPMFPTGPMPYNMQPGFMLNQPYSSQPLNYSAMGTLLAQQQFLATMANFQHLSNVNMQDDGVAQMAGPNGRSPLPDIFQPNFQTQTPSSMINTSRKEETKAFDFISDHMTSGRDSRRMI

SEQ ID NO: 221939 - protein, 347 aa, Glycine max
  Coding DNA Sequence Number=SeqID_105161
  Homolog annotation: Hit_ID=Q1SF19; Match level="QueryCoverage=97%, HitCoverage=97%, E-value=1e-159, Identity=80%"; Hit description=This gene is cut off
  Pfam annotation: Domain name=Lung_7-TM_R; Domain location=1-249; Score=-155.3; E_value=0.092; Accession=PF06814.3; Description=Lung seven transmembrane receptor
MARSGDGYGVGVDESYRALPWLYLTFLSIWFFSACSWTVYTYKTRHSQWTLASVPLIKALQLMLSFLFWYSCFNFQACSLWMSFGVYVTGVLFQTAAFVSFLLISHGYCIMCERLSLNERRSTAALACVFYLTLVGYKACVPYFSVLLLLNYFISFYIIFHHISQNLLVLREQLSIIEHEDIQAMHDAVYKKYTMFKKFQGAMQIVATAETMIYMNIDDSSENYWLRLLLREWAQFCIFLYIGWIFRSQDLAPNFSVMPTTKCKGETLVPPTYSIEMDAGTFKEFSSHEWHIGVPTSTSHDESSKDEVLVIIQHPRAQRLRKLDGFSQNADCFVVSDLNANSPPCPT

SEQ ID NO: 221940 - protein, 161 aa, Glycine max
  Coding DNA Sequence Number=SeqID_105162
  Homolog annotation: Hit_ID=Q8L9B9; Match level="QueryCoverage=29%, HitCoverage=9%, E-value=2e-08, Identity=59%"; Hit description =Chloroplast nucleoid DNA binding protein, putative
MTRPAYIALQDTFRIEASHLKRASEFSLFDMCFDLSGLAKVKVSTPIHWACGLARAAPPPQPRVWILPLPGSVTFQSGSAVHLMNTMIMTLVLKALFDPTRVVVASIPALRREGAEGNDELIQTCQSINRTWSLVTHQGFLAFSCSVPFFSDPSQLDGHIS

SEQ ID NO: 221941 - protein, 561 aa, Glycine max
  Coding DNA Sequence Number=SeqID_105163
  Gene Ontology: Mol. function=zinc ion binding; Cellular component =nucleus; Biological process=chromatin modification
  Homolog annotation: Hit_ID=Q1SPG2; Match level="QueryCoverage=97%, HitCoverage=50%, E-value=0.0, Identity=61%"; Hit description=PWWP; Nuclear protein SET; Zinc finger, RING-type; Protein kinase C, phorbol ...
  Homolog annotation: Hit description=ester/diacylglycerol binding; SET- related region; Zinc finger, FYVE/PHD-type
  Pfam annotation: Domain name=PHD; Domain location=460-514; Score =38.5; E_value=2.4e-08; Accession=PF00628.19; Description=PHD-finger
  Pfam annotation: Domain name=PWWP; Domain location=246-330; Score =8.2; E_value=0.0021; Accession=PF00855.8; Description=PWWP domain
  Pfam module annotation: Pfam domain module=PHD::PWWP; Domain location= 460-514::246-330
MIIKRNLKSQMPSLKRVKLGDSVGENDECSYARKKRKTNNGYYPLNLLGDVAAGVIPVSFHGLLGAAGVVEKGFSAAWCNGVESNVKNEVVVEVKKKNEVQRPPLVRTSRGRVQVLPSRFNDSVIDNWRKESKSSSGGLRDCDYDEEFECKKEKFSFKAPKVCNNNQKKGKSEEKTGSKARKYSALCNSFERSKCLSSPGDGSLALRHSGAAAVEEDDEKGRFLEVEKVGLMGLKEKRNGLFGPEDFYAGDIVWAKAGRKEPFWPAIVIDPMTQAPELVLRSCIADAACVMFLGYAGNEDQRDYAWVNHGMIFPFMDYVDRFQGQSELSYYTPSDFQMAIEEAFLAERGFTEKLIADINTAASSNGYDDSILKAFQKVSGSNQYAGYHFLNQVLYKGARKFLKKSLIYRSKDLFDKKETRPCEACGLSLPYKMLKKTKDSSPGGQFLCRTCARLTKSKHYCGICKKVWNHSDSGSWVRCDGCKVWVHAECDKISSNLFKNLEGTDYYCPTCKAKFDFELSDSEKPQPKVKWSKNNGQLVLPNRVTVLCNGVEGTYFPSLHS

SEQ ID NO: 221942 - protein, 130 aa, Glycine max
  Coding DNA Sequence Number=SeqID_105164
  Gene Ontology: Mol. function=zinc ion binding; Cellular component =nucleus; Biological process=chromatin modification
  Homolog annotation: Hit_ID=Q1SPG2; Match level="QueryCoverage=90%, HitCoverage=11%, E-value=2e-60, Identity=92%"; Hit description=PWWP; Nuclear protein SET; Zinc finger, RING-type; Protein kinase C, phorbol ...
  Homolog annotation: Hit description=ester/diacylglycerol binding; SET- related region; Zinc finger, FYVE/PHD-type
  Pfam annotation: Domain name=SET; Domain location=1-112; Score=85.7; E_value=1.5e-22; Accession=PF00856.18; Description=SET domain
MSCNSEHDFNPKQVLEYRGEQVRRSIADLREARYRLEGKDCYLFKISEEVVVDATDKGNIARLINHSCMPNCYARIMSVGDDESRIVLIAKTNVVAGDELTYDYLFDPDEPEENKVPCLCKAPNCRKYMN

SEQ ID NO: 221943 - protein, 103 aa, Glycine max
  Coding DNA Sequence Number=SeqID_105165
  Homolog annotation: Hit_ID=Q1SPF8; Match level="QueryCoverage=50%, HitCoverage=7%, E-value=2e-17, Identity=80%"; Hit description =Proteinase inhibitor I4, serpin; Protein kinase
VGILGNAADFYKDGSNGSSLDNLDRRQMMIAFDMRCVGFIMAKMVMRELMDPLIFAKFKLFLKKPLECLKRIQAFFDGKRKLVDLNALDTHTHSLIAGHKPLS

SEQ ID NO: 221944 - protein, 42 aa, Glycine max
  Coding DNA Sequence Number=SeqID_105166
MAEQVYRHSNLRHSLSKQTPIVKSLQTDPEWTQVAIRTFPMA

SEQ ID NO: 221945 - protein, 137 aa, Glycine max
  Coding DNA Sequence Number=SeqID_105167
MGFPLPAVTYLAKNLSGQGSKKFKVVSQWGLLSWEPDLDIWGKTNSCVKVSVSGRTSILFHKACATMMIWKQRAKLVMATARWALKHPVYGIVILRLGTYTNRPNVSKLCSFISSMNPSILISVIQENKLLASVPCF

SEQ ID NO: 221946 - protein, 90 aa, Glycine max
  Coding DNA Sequence Number=SeqID_105168
  Subcellular localization annotation: CTP_CleavageSite=68; ConfidenceScore=5.11e-01
MTAMLISPWGSISWSVSFRHRDRAHKTPGGPGGAQQGPGVSSSNYGPLDRAHKTPSGPGEAQQGPGVSSSGYGPLSVLQGTRPPSKFMPS

SEQ ID NO: 221947 - protein, 79 aa, Glycine max
  Coding DNA Sequence Number=SeqID_105169
MTGPLDESISCFLIKVDPWVLVPITFRGLHVLAIRGLHVLTIRGLHALTFRGLHVLTFRGLHALAFRGLRILTFRELKL

SEQ ID NO: 221948 - protein, 76 aa, Glycine max
  Coding DNA Sequence Number=SeqID_105170
MGLMEAMEVMRLIYKRILCRTIPVPWWEADWLLFHSHYRERLKIDSVTSRNLCLKPVSDSMGYIEASQTMVIPHKG

SEQ ID NO: 221949 - protein, 95 aa, Glycine max
  Coding DNA Sequence Number=SeqID_105171
MRKLIKERMENKVVNLVGLNKVVSGIKWMNGMKYRNGNNGSYRAPNEVIPKREVDFLELWFERTRVEMIGRKESLFPARATHKGCESPLIQPGCS

SEQ ID NO: 221950 - protein, 98 aa, Glycine max
  Coding DNA Sequence Number=SeqID_105172
MRGYRMVTRTFRQPGANEPVDARRLTSFSAPFAIQGQRVRWQAEIPYGHPHISSIEGNEFDGFTLIVRKHSCPTTREILLCWVGTIECNGVGFRWWGY

SEQ ID NO: 221951 - protein, 402 aa, Glycine max
  Coding DNA Sequence Number=SeqID_105173
  Gene Ontology: Mol. function=exonuclease activity; Cellular component= intracellular
  Homolog annotation: Hit_ID=Q9FNE7; Match level="QueryCoverage=97%, HitCoverage=99%, E-value=1e-134, Identity=59%"; Hit description =Exonuclease-like protein
  Pfam annotation: Domain name=Exonuc_X-T; Domain location=132-276; Score=-16.7; E_value=0.028; Accession=PF00929.14; Description =Exonuclease
  Pfam annotation: Domain name=zf-C2H2; Domain location=13-37; Score =14.8; E_value=0.26; Accession=PF00096.16; Description=Zinc finger, C2H2 type
  Pfam annotation: Domain name=zf-C2H2; Domain location=76-99; Score =6.8; E_value=1.9; Accession=PF00096.16; Description=Zinc finger, C2H2 type
  Pfam module annotation: Pfam domain module=Exonuc_X-T::zf-C2H2::zf -C2H2; Domain location=132-276::13-37::76-99
MDCRIESAETHRNKCAACFRQFNKLEHLVEHMRISYHSVHEPTCGICRKHCRSFESLREHLIGPLPKQECRDIFSYRGCKFCLKVFESPNSRRIHQEKCQLSGTNAGIIGRFSNLGLRDNLAIGGGARGPQVVALACKMVGGGSDGSLDLCARVCLIDEHENIIFHSYVKPPIPVANYRYETTGITPEYLRDAMPMRHVQRRIHDFLCNGEPMWTIRARGGRARILVGHGLDHDLESLQIEYRAEKISSSISRINNKDGCHTSNHRFISTHSNIDFEFILNNQGHCKIPSTDENKQAEQLTQVLNTGISWASFCFGAHIHISRYDIQTGIQDPYEDCIATMRLYMRMRSQAHRVQEYPLASDPQNRNNFASWRQSEIERMSPEQMLEISRSDYYCWCLDSLY

SEQ ID NO: 221952 - protein, 113 aa, Glycine max
  Coding DNA Sequence Number=SeqID_105174
MAAEWRRKRERRRHFKEKMSLEEAHHHRRPWIRAWRKKEMNEGRGREEHKILCSKRALKSEIIGPNLGPWAQKSTLRFMRTLGPSSAALAQSSWSLLLMVLVIGPFLGRIASV

SEQ ID NO: 221953 - protein, 113 aa, Glycine max
  Coding DNA Sequence Number=SeqID_105175
MWLPPKPWNEKPRGLVGKNTAETNSEGLCGAAIACSRSKRSLSQRLCETETNMLAIITKYQEELNLASAHEHRVAEEYAQVYAGKEARGRVIDSLHQEATMWMDRFALTLNES

SEQ ID NO: 221954 - protein, 66 aa, Glycine max
  Coding DNA Sequence Number=SeqID_105176
  Subcellular localization annotation: CTP_CleavageSite=48; ConfidenceScore=5.42e-01
MTKEVIHDHNSAAPRLRFSSSPSSSVKSHLVQGKLAQASYLFRTEGISSARRVTCLGLNFLLAQAS

SEQ ID NO: 221955 - protein, 70 aa, Glycine max
  Coding DNA Sequence Number=SeqID_105177
MEELLQKGVHGKERQRQELEKSQDKKKYYKSKENKSLMSTWEDLGDTLFNEDEEEANLCLMANTTFEKSK

SEQ ID NO: 221956 - protein, 221 aa, Glycine max
  Coding DNA Sequence Number=SeqID_105178
  Homolog annotation: Hit_ID=Q1SKD7; Match level="QueryCoverage=85%, HitCoverage=53%, E-value=2e-16, Identity=28%"; Hit description =Ankyrin
MAPRKLASKRSRKDKAAEGTSSAPEYDSHRFRSAVHQQRFEAIKGWSFLRERRVQLKDDEYTDFQEEIGRRRWASLVTPMAKFDPEIVLEFYANAWPTEEGVRDMRSWVRLLGYPLVLEEGQECEYGQRRNRSDGFDEEAIAQLLCIPGQDFARTAVGRRVRIMRTNMTTLTQIWMTLLLSNILPSDHNSDLPLPKCQLVWRPTRHPWTQISPTGPWDFPR

SEQ ID NO: 221957 - protein, 161 aa, Glycine max
  Coding DNA Sequence Number=SeqID_105179
MASKRGILTSTLLKVSTRSKSSSTFFAGMDLEGKGRGIYLGAESVLALSSILAPTSVYFGSSMSLLMVLDGGTYILLKLNVAGGNLLHQLLQGRIIPQILMVSPTKIIGAGVRIILLLLRSEWLSRLHGRNIHLLDDQKHNRYHISAIAQWLATSQGMSTL

SEQ ID NO: 221958 - protein, 150 aa, Glycine max
  Coding DNA Sequence Number=SeqID_105180
MVWRLLSTLLLLYSAAIKIQEAKDSIDEEDPRPTSSTWSYITMLDLGASINVMPTSVYRLFHLGDLKPTGSNPPISLPLAVNLPLLSIVQLPSLELKPLPKNLNCAYLDNAQKRPFIISSSLSLEHEDKLLHVLRGHKRPLGGHLLTFLE

SEQ ID NO: 221959 - protein, 158 aa, Glycine max
  Coding DNA Sequence Number=SeqID_105181
MSYDTILPRKRPVTRAMSKKLQEDSARAVEEGPRVLMNLRCSFPCSGLVASNDSSWRSLMANGGGRRGLGVLGEGLWEKKETKWPARLAQMKFCSPGRVDPTQTHLGELWAKSAPTYFTAFFENVISHTPDVTLEIPTVETWTHDFQAYSPNLKAIQR

SEQ ID NO: 221960 - protein, 125 aa, Glycine max
  Coding DNA Sequence Number=SeqID_105182
  Subcellular localization annotation: CTP_CleavageSite=22; ConfidenceScore=5.46e-01
MAESSKKRKGSSASASTSRAHRSEATSASTTPIPPSLSSSPDSTLTSEIFGIKMVIDQSLFHDLTKLPSDGVPFEGTLNDDWKFDFSAHDARQLVGTNNADMTGRLLAGSLAFESRILHYLIVRI

SEQ ID NO: 221961 - protein, 201 aa, Glycine max
  Coding DNA Sequence Number=SeqID_105183
  Gene Ontology: Mol. function=protein tyrosine/serine/threonine phosphatase activity; Biological process=protein amino acid dephosphorylation
MSFGFLRKVLNEQTSSFSLVLERPTSPFPIQLLHKMNDLEIVFNRGRVPIATWNKTLLASNLQPSSESCGNAGFLMFNSKFLKPNGSKLLSNQNQHIITHGERNIVTEHTTQLACVFTEEVCGDGDWAHGSFPLEEYIQALDRSKDEMYYNHSLGMRYSKGVTAVLNFQSGTEAENWGINAKSINESCQRKNILMINYPIR

SEQ ID NO: 221962 - protein, 439 aa, Glycine max
  Coding DNA Sequence Number=SeqID_105184
  Gene Ontology: Mol. function=RNA-directed DNA polymerase activity; Cellular component=nucleus; Biological process=RNA-dependent DNA replication
  Homolog annotation: Hit_ID=Q1RW99; Match level="QueryCoverage=99%, HitCoverage=66%, E-value=9e-51, Identity=27%"; Hit description=RNA -directed DNA polymerase
MALKIDVRKAFDTLDWNFLFYALEAFGFNQIFCQWIKLMAWQQGSLLARGCVRQGDPLSPPLLIGRISSQQRDIQVNSEWSLTSEKGLMHLMTLLSQYGEASGQWISLEKCRSDFFRAFSLEIGSSLRDILGIGKGSLPFHYLGVPIFQGRPQASYLMPVVDKIAAKLTSWKDMLKKKLVQVSWAKLCTPIASRELRVRPLQDINKAAMLRLGWLLVTSDGAWASLARAKFSTWPGIRPQLDTVMENLGWHLGNGSAISFWSDRWLITTILESLDIPQEMRPMLKAKVSDFIFEGPWNIPMDFQSHYPEVVNEVTQVVIPKSVNIWQWLSSKIGLGLDLTSPLSLISITNLKFGSQNVLTAVAISGNFSKGTMLPNINEFNLLNSLMVKGHPKKQIHIKQVLWIAPSPGWIKVNTDGAAHGSPGVAASGGLFRDSRGQF

SEQ ID NO: 221963 - protein, 106 aa, Glycine max
  Coding DNA Sequence Number=SeqID_105185
MGGNNRNRRREKWIKGLAHERRLSDKVGSHCAWTIMDSKLEVWNMSILNCKWKSHKYRWQDNQFWFGICMKNWVVEGSLLFRGCNWRQVKWFGNCGALNATSKDWT

SEQ ID NO: 221964 - protein, 89 aa, Glycine max
  Coding DNA Sequence Number=SeqID_105186
ELEPEEPAVAAEGEDELTPPEPFYFDSDVHMAQEEETSTDQMPEPSPASVPEETQPSAPVMEPEQPIQDSSAALTLDLNEDQSQDEHDV

SEQ ID NO: 221965 - protein, 50 aa, Glycine max
  Coding DNA Sequence Number=SeqID_105187
TLPEQDVTTSHVTSAFCSPCLHALTVVKQFTAAFCKLQIYKSFPGCQDIS

SEQ ID NO: 221966 - protein, 414 aa, Glycine max
  Coding DNA Sequence Number=SeqID_105188
  Pfam annotation: Domain name=zf-CCHC; Domain location=110-127; Score =29.3; E_value=1.3e-05; Accession=PF00098.13; Description=Zinc knuckle
MSLEELVGTLKVHEQELQQDERSERNKSLALNSQRTSRSYRLERKPPEACPKLSKLKTAILKNPRKNLMKMNSPSFHERFAKCGKTKGDPNGRTPQKEYSRIRKINTSFIVCYGCKKLGHFKSECPELEKSLDKKKKEKKREPKWSQQCCKTDETCDNKGANENLQNHNQGMKQSSLAAKRKRLLWTTEEEKVLKKTGLWWEWDQGWKFKLYLHKKTDQSSIEKLKTLMKKRQAEWVKSQGPKCLFTPNEDEEEVNLCIMVDPTFEESKSDQEDEINLDNPKSLKKTYHELQPNSSILSKAYKNLQKDFKRLSKDDMQLEKTLQDKVEVSLDKYTQACKACETFEQKEFKLCFKNEAIAKEKSALLGNFQELENKLKALQNDQNELNKLHDHQSKELFFSHPSHVYLIFSQFSK

SEQ ID NO: 221967 - protein, 339 aa, Glycine max
  Coding DNA Sequence Number=SeqID_105189
  Gene Ontology: Mol. function=RNA-directed DNA polymerase activity; Biological process=RNA-dependent DNA replication
MAASDHAILRDHTYAPTKRSLLELTTQDAILAQKKLLSQQLEALTETLYKLPQQLQAVRGCHICGGTHESGLCMVKDEASNEVNYMGSHNHQGFHQRGPPGFYQSDNFLQDHDWRYYPSNNFNQRGSPYQHPSQGPSHQEKPPISIKEMLLSFIQETRANTQETKAFIQETRSHQKSTDATIRNLEIQIGQLAESIAEKPTETFAVNAEMKPKKDCKVIFTEREEEEKKTEEDVCDEEGEKKKETKRNEEKAQQWEKYSQVEIQQESILQVNTPPHQLIVKEERHGKHEKALSVILSLIATTSLAIMWKVLPEYTSFMASLTKRRKCKEDVFYVTFMPP

SEQ ID NO: 221968 - protein, 57 aa, Glycine max
  Coding DNA Sequence Number=SeqID_105190
  Gene Ontology: Mol. function=protein binding
  Homolog annotation: Hit_ID=Q1SWI6; Match level="QueryCoverage=91%, HitCoverage=28%, E-value=6e-10, Identity=49%"; Hit description =Leucine-rich repeat, plant specific
MLDFCFGLGIIIIPTVATGMESSATTLLPTFFSFTSTLQILIMQIGKLIGDGALVER

SEQ ID NO: 221969 - protein, 192 aa, Glycine max
  Coding DNA Sequence Number=SeqID_105191
  Subcellular localization annotation: CTP_CleavageSite=40; ConfidenceScore=5.04e-01
MATSQQEDATVSTTGVHQPNKEVQLVSKTKKRIAKFDIAEATKVKTKVMSTVATRWRQFKSTLTSKFVFAKSEGQQTQDVVTKYGLDPEAWKQFEETRLTPNWEGIRKRAQSIQKHNDCPHVLSRGGYDLLKKKLLDQKRKRIQEEALLSENAASLDEPPSPIKRHVKWKVARTRAVGNMTSESAQEIADKI

SEQ ID NO: 221970 - protein, 483 aa, Glycine max
  Coding DNA Sequence Number=SeqID_105192
  Homolog annotation: Hit_ID=Q9SJX7; Match level="QueryCoverage=68%, HitCoverage=62%, E-value=3e-08, Identity=27%"; Hit description =Expressed protein
  Pfam annotation: Domain name=DUF647; Domain location=46-476; Score =129.7; E_value=7.8e-36; Accession=PF04884.5; Description=Protein of unknown function, DUF647
MDVFSKSGFNNDFSPFWPLMSRYVLGDDSQLQAFLVEEDRSTPNRFQDLHSSDESLSWLPEIIKDFVLPAGFPGSVSDDYLDYMLLQFPTNVTGWICHTLVTSSLLKAVGIGSFTGTTAAASAAAIRWLKNFRAYAFVGLKGWHWSCWTLIHWYGNHEVGDLEAFLMMIPSNGECMRTSLAVLEGLCSMPCFPIGNMQIKSGSRETSYTSDISCSIFDLTTQLYPAYFLPLASLGNLTKAVARGLKDPSFRVIQNHFAISGNLGEVAAKEEVWEVVAQLVGLSLGILILDTPGLVKSYGVISLTWLSMRLLHLWLRYESLSVLQFNTINIKRARILVEALIKLYASEKYILMVNQQTEDLRFYVSFKGKNINAMKKKYKKLKKQQLEELNQSSSLRKCCFSLMIGKVGATNVSVLRSVWQSFWLSENWDSDDNVRDQIATSLMELEEKFEDFIQKLKDAEWDTQQLNLKVPKEIFIDDNTNSL

SEQ ID NO: 221971 - protein, 111 aa, Glycine max
  Coding DNA Sequence Number=SeqID_105193
  Subcellular localization annotation: CTP_CleavageSite=52; ConfidenceScore=5.67e-01
SLLYNKEKNKMKDSKNTSGKDVSFTSRISQPLTNSSQALRTASTSSSGGLVRARVLSAILNRLAHISEFRLSAGVLSEHVQLIFFQILPRTYPMSVALSEHSLSQQIGLAR

SEQ ID NO: 221972 - protein, 66 aa, Glycine max
  Coding DNA Sequence Number=SeqID_105194
MWVPIGPNIDRFCIRKEVEGGSHDTMRIWKKPLAPSLWTKRHSCGGVMDRNSEPCPPSDPPQGQHI

SEQ ID NO: 221973 - protein, 138 aa, Glycine max
  Coding DNA Sequence Number=SeqID_105195
MILKQICKNKSKKLNSRLPVMCNRLHSAYCSEDGVPRGSSGDPRRQCEVPILWHDLTHGYFIVGPVQVIEVMSSEEDPEEDPEELPPKPAVDALDFPEGDEDPLPKVDSPKDVMWASEADSTEESGPEGIATGGGSSS

SEQ ID NO: 221974 - protein, 117 aa, Glycine max
  Coding DNA Sequence Number=SeqID_105196
  Subcellular localization annotation: CTP_CleavageSite=83; ConfidenceScore=5.41e-01
MPPKVSSSSGRGGRSGTKGKDVILALPEPITKKATTSSSGSPTQTGSSTQKGKLEGSLTQITTVKPESSTQESLKPTTTKQTVADYAWSIQTLLALEDIGLTRVPKLAKKTWAKMAS

SEQ ID NO: 221975 - protein, 111 aa, Glycine max
  Coding DNA Sequence Number=SeqID_105197
MAPKKLSTKRSRRDAAAEGTSATPEFDSHRFRSAEHQQRFEAIKGWSFHRERRVQLRDDERGSAGHAVIGEGSVDSWRWEAPAEAPSDTEEARMDEEMTDLLGFLGGSRAT

SEQ ID NO: 221976 - protein, 57 aa, Glycine max
  Coding DNA Sequence Number=SeqID_105198
MSKRLQEDWARAIEEGPKVLMNRRPRAKRKISVLSATSAFSQAKLETGAKPNFTYSC

SEQ ID NO: 221977 - protein, 318 aa, Glycine max
  Coding DNA Sequence Number=SeqID_105199
  Gene Ontology: Mol. function=protein binding; Cellular component =integral to membrane; Biological process=protein amino acid phosphorylation
  Homolog annotation: Hit_ID=Q9ZTJ9; Match level="QueryCoverage=99%, HitCoverage=79%, E-value=5e-57, Identity=35%"; Hit description=Hcr2 -0B
  Pfam annotation: Domain name=LRR_1; Domain location=115-137; Score =12.2; E_value=1.5; Accession=PF00560.23; Description=Leucine Rich Repeat
  Pfam annotation: Domain name=LRR_1; Domain location=138-160; Score =15.2; E_value=0.24; Accession=PF00560.23; Description=Leucine Rich Repeat
  Pfam annotation: Domain name=LRR_1; Domain location=162-184; Score =8.1; E_value=8.8; Accession=PF00560.23; Description=Leucine Rich Repeat
  Pfam annotation: Domain name=LRR_1; Domain location=186-208; Score =14.8; E_value=0.32; Accession=PF00560.23; Description=Leucine Rich Repeat
  Pfam annotation: Domain name=LRR_1; Domain location=19-41; Score =14.0; E_value=0.54; Accession=PF00560.23; Description=Leucine Rich Repeat
  Pfam annotation: Domain name=LRR_1; Domain location=210-232; Score =6.4; E_value=18; Accession=PF00560.23; Description=Leucine Rich Repeat
  Pfam annotation: Domain name=LRR_1; Domain location=234-256; Score =11.4; E_value=2.1; Accession=PF00560.23; Description=Leucine Rich Repeat
  Pfam annotation: Domain name=LRR_1; Domain location=258-280; Score =13.5; E_value=0.78; Accession=PF00560.23; Description=Leucine Rich Repeat
  Pfam annotation: Domain name=LRR_1; Domain location=282-304; Score =17.4; E_value=0.052; Accession=PF00560.23; Description=Leucine Rich Repeat
  Pfam annotation: Domain name=LRR_1; Domain location=43-65; Score =15.0; E_value=0.28; Accession=PF00560.23; Description=Leucine Rich Repeat
  Pfam annotation: Domain name=LRR_1; Domain location=67-89; Score =13.3; E_value=0.86; Accession=PF00560.23; Description=Leucine Rich Repeat
  Pfam annotation: Domain name=LRR_1; Domain location=91-113; Score =12.9; E_value=1.1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=115-137::138-160::162-184::186-208::19-41::210-232::234 -256::258-280::...
  Pfam module annotation: Domain location=282-304::43-65::67-89::91-113
  Subcellular localization annotation: CTP_CleavageSite=55; ConfidenceScore=5.16e-01
MSHNSLNGTIPPQIGSLSNLNTLDLSTNNLFGSIPNTIGNLSKLLFLNLSDNDLSGTIPSEIVHLVGLHTLRIGDNNFTGSLPQEIGRLMNLRILDIPRSNISGTIPISIEKLCNLSHLDVESNDLSGNIPLRIWHMNLKHLSFADNNFNGSIPKEIVNLRSIETLRLWKSGLSGSIPKEIWMLRNLTWLDMSQSSFSGSIPRDIGKLRNLKIFRMSKSGLSGSMPEEIWTLRNLEKLDISMCNLIGSIPISIGALVNLTLLSLHENQLFGHIPHEIGKLVNLQILYLGRNNLSGFIPPEIGFLKQLGQLDLSDNFLS

SEQ ID NO: 221978 - protein, 82 aa, Glycine max
  Coding DNA Sequence Number=SeqID_105200
MDPIMPTWKVREWRRRGVMNRHVAIRDGLFHQGGPGPREFGDDTRSNSFAVGVSDLLTTIPHFSLFALSIGVLVFRVRLMVC

SEQ ID NO: 221979 - protein, 62 aa, Glycine max
  Coding DNA Sequence Number=SeqID_105201
AKVTITKLNEERRRTTQEKDLLLRQEELDNLLFRISQISQISPLGVHSWLLEDAISNKYLLI

SEQ ID NO: 221980 - protein, 125 aa, Glycine max
  Coding DNA Sequence Number=SeqID_105202
MNLRGREVEISDPMCPLCNNSEEVAAHLFFNCMGGFPKEQKDHFMQHSRRNATRTKDIRWSYWWIALTRTIWQHRNKVVFDNQTFNASKLMDEALLLVWSLLKAMEKDFDTHFNQWSSNLTHAFV

SEQ ID NO: 221981 - protein, 467 aa, Glycine max
  Coding DNA Sequence Number=SeqID_105203
  Gene Ontology: Mol. function=transporter activity; Cellular component= periplasmic space; Biological process=transport
  Homolog annotation: Hit_ID=Q2KWU2; Match level="QueryCoverage=99%, HitCoverage=90%, E-value=0.0, Identity=78%"; Hit description=ABC transporter, substrate-binding protein precursor
  Pfam annotation: Domain name=SBP_bac_5; Domain location=22-396; Score= 265.9; E_value=8.3e-77; Accession=PF00496.12; Description=Bacterial extracellular solute-binding proteins, family 5
QHHRRRGAEHGGGPGWLPENGTVAPLLAKSVDLSEDGLTYTFKLRDGVKFHNGAPLTSADVLWSWQRYMDPKTDWRCRSDFDGRNGLKVTDVSAPDAQTVVMKIDRKSAVFLDSLARTDCGMTAILSKDSVNADGSWKQPVGTGPYQFKEWKRGEYVLLTAFKDYVSPGAGDKPDGYVGAKRPLADEVRFLVVPDPSTAKAGLVSGAIDASQITITDVAELKNNAAVSVMSPHDATKHTLLFQTQDPVLKNVKLRQAIAAALDIPQVVAAASEGLGQLNNSAVYAGSAYYQEAEKRTYKYDPARAQQLLKEAGYKGEPIVIYANKRAHVPSYQVAVIAQAMMQAVGINAKIEVLEWATQLDRYNTGKYQISSFTFSSRIDPALSFEQFAGDKSKQPRKVWDDPAAQKLIDESFLESDPAKRQKLFDQLHALMLEQTPLLVLYNGADAWATNKRVQGFSVWEGKPRAW

SEQ ID NO: 221982 - protein, 63 aa, Glycine max
  Coding DNA Sequence Number=SeqID_105204
  Gene Ontology: Mol. function=protein kinase activity; Biological process=protein amino acid phosphorylation
  Homolog annotation: Hit_ID=Q06ZR4; Match level="QueryCoverage=75%, HitCoverage=87%, E-value=2e-18, Identity=91%"; Hit description=Open stomata 1
MDLPIMHDSDRYELVRDIGSGNFGVARLMRDKHTEELVAVKYIERGEKCISINQPMIGLSRRD

SEQ ID NO: 221983 - protein, 100 aa, Glycine max
  Coding DNA Sequence Number=SeqID_105205
MPLCTTLSCQPRVATWNSRERSNNDIFGVVEENGSIVGEDEEGGIYIGEEVVRGVLVTGRGEFEPVASGSGGGAREEGAIFLFVVVNGGAWAVPHSYSKR

SEQ ID NO: 221984 - protein, 187 aa, Glycine max
  Coding DNA Sequence Number=SeqID_105206
  Gene Ontology: Mol. function=protein serine/threonine kinase activity; Cellular component=cytoplasm; Biological process=response to abscisic acid stimulus
  Homolog annotation: Hit_ID=Q940H6; Match level="QueryCoverage=62%, HitCoverage=32%, E-value=6e-61, Identity=97%"; Hit description =Protein kinase-like protein
  Pfam annotation: Domain name=Pkinase; Domain location=1-178; Score= -8.8; E_value=4.9e-08; Accession=PF00069.15; Description=Protein kinase domain
VILTPTHLAIVMEYASGGELFERICNAGRFSEDEARFFFQQLISGVSYCHAMQVCHRDLKLENTLLDGSPAPRLKICDFGYSKSSVLHSQPKSTVGTPAYIAPEVLLKKEYDGKHVWLTDGERPTRMVNIILYMLNPISDQLDQKINFSFSQDENLKSGKWKSFSSENSLFPSCVCVGGWDHLKEES

SEQ ID NO: 221985 - protein, 102 aa, Glycine max
  Coding DNA Sequence Number=SeqID_105207
MSSESRESVVQVPEGVVAEEDSEATNLKSAEFCFASQICYSLQPHLHRSSTRVSKESWMVGLLWEALHRSCFHLHRTWLLLDLLVLQHYSTLALEVVKGVAR

SEQ ID NO: 221986 - protein, 42 aa, Glycine max
  Coding DNA Sequence Number=SeqID_105208
MEQSLELGQEMRDFDDSAVQHDSNDDNHHDASSSARVILGVA

SEQ ID NO: 221987 - protein, 71 aa, Glycine max
  Coding DNA Sequence Number=SeqID_105209
MKDNPSSPKNTHLHAIQEININFVDAPLQRSLSPITFTNRDFKGINLVNQDDPVVVSIIIANFMVSKVIIN

SEQ ID NO: 221988 - protein, 207 aa, Glycine max
  Coding DNA Sequence Number=SeqID_105210
  Subcellular localization annotation: CTP_CleavageSite=29; ConfidenceScore=5.18e-01
MAAHATTTGVSVYLGLPLYLFFCLLHGSNAASLVGLSASLLLVALLFSLSNFVPESRHFFHLDVALGLFVQLVHAIEGFFAQSVHELVGPLGEEHVMKCYLWVKISGSQGHAVRSVGRVLHTKAFDEGVKDASKCSSGSVVPSYCSRLSGFHSKVRKCVSGVLFALGASDMSFQMIVSICVYHNCQMRMGAFKKGLAFEARPGANHG

SEQ ID NO: 221989 - protein, 389 aa, Glycine max
  Coding DNA Sequence Number=SeqID_105211
  Gene Ontology: Mol. function=RNA-directed DNA polymerase activity; Cellular component=intracellular; Biological process=RNA-dependent DNA replication
MKFPTLIGKIVTVKEDQKQAQQCYTESLKVAPYPPTKEPAKPHPTAAEDLHDDTSDRGPKPIEELVKLQLGPKPRQCMQLSRDLTSHELGNAVKEEVDKLLNANFIREANGKWRMCIDYTDLNKACPKDAYPLPSIDRLVDRAFKFQVLSFLDAYSLYNQIRMHVSDREKTTFIIEDENFCYRIGQNVEVYVDDIIVKSQSIAQHVADLEEVFGKLRKYNMCLNPEKCTFEVGGGKFLGFIITHQRIEANPDKCTTILEIHNLANIQQVQKLNDRLASLSMFLLKLAEKVKPFYKLLKKIEPFLWDETCKQTFLAFKKIIATPPVLSRPKPEVPLLLYLSKAYKFVSSTLIQEERKHHLPIYFTSRILHDTEKRYHMIEKVALALITSA

SEQ ID NO: 221990 - protein, 55 aa, Glycine max
  Coding DNA Sequence Number=SeqID_105212
MIGLNLEDDDSTLDTYHTPFSTHMPNINGQEEAHGYTTELPFSRVSTFTVYIEED

SEQ ID NO: 221991 - protein, 104 aa, Glycine max
  Coding DNA Sequence Number=SeqID_105213
MTKGVEDDVSLNASRGMLPPWLTKGAEDDVSLCASTGSFAPGWRKVQITIRYPRLPPDFPGLTEIVCTDNRLGISACHRTRRLWMTKGAEDDVSLYVSTGSLPP

SEQ ID NO: 221992 - protein, 98 aa, Glycine max
  Coding DNA Sequence Number=SeqID_105214
MVIRTFRQPGANETVDAQKLTSSSAPFVNQEGNEPVDTQRLTSSSAPFVIQRRDSKSGDMRGYLMVIRTFPQPGANELVDPQRLTSSSAPFVIQRQVV

SEQ ID NO: 221993 - protein, 66 aa, Glycine max
  Coding DNA Sequence Number=SeqID_105215
MEHETFLATWLAEIDSSPNGLRFSNLQPQPRLINHEKPMLCRWHKLNPLKIKGRRFALDSAKDYFP

SEQ ID NO: 221994 - protein, 98 aa, Glycine max
  Coding DNA Sequence Number=SeqID_105216
MSLATLFGKKLQEHEMELMRLHQHEENDKKNKGIALKASSSSIQEKSDKEDLNEIEEDDDFRFFVQRFNIFMRNRKSKEIKYQSKEEWRKFLLSPKML

SEQ ID NO: 221995 - protein, 326 aa, Glycine max
  Coding DNA Sequence Number=SeqID_105217
  Gene Ontology: Mol. function=sulfate adenylyltransferase (ATP) activity; Cellular component=intracellular; Biological process =sulfate assimilation
  Homolog annotation: Hit_ID=Q8SAG1; Match level="QueryCoverage=99%, HitCoverage=64%, E-value=1e-167, Identity=89%"; Hit description=ATP sulfurylase
  Pfam annotation: Domain name=ATP-sulfurylase; Domain location=1-313; Score=493.2; E_value=3.1e-145; Accession=PF01747.8; Description=ATP -sulfurylase
MYVEIYKHPKEERIARTWGTTAPGLPYVEQTITNAGNWLIGGDLEVIEPIQYNDGLDHFRLSPAELRAEFTRRNADAVFAFQLRNPVHNGHALLMTDTRRRLLEMGYKNPVLLLHPLGGYTKADDVPLDWRMKQHEKVLEDGVLDPETTVVSIFPSPMHYAGPTEVQWHAKARINAGANFYIVGRDPAGMSHPVEKRDLYDADHGKKVLSMAPGLERLNILPFRVAAYDKTQGKMAFFDPSRPQDFLFISGTKEYKNRKHFINQMASFRHQGCLTKWVEQNMRTLARNKESPPDGFMCPGGWKVLVEYYDSLVLSSNGKVPEAVPA

SEQ ID NO: 221996 - protein, 834 aa, Glycine max
  Coding DNA Sequence Number=SeqID_105218
  Gene Ontology: Mol. function=protein serine/threonine kinase activity; Cellular component=integral to membrane; Biological process=protein amino acid phosphorylation
  Homolog annotation: Hit_ID=Q6XAT3; Match level="QueryCoverage=99%, HitCoverage=96%, E-value=0.0, Identity=62%"; Hit description=ERECTA -like kinase 1
  Pfam annotation: Domain name=LRRNT_2; Domain location=1-34; Score =17.3; E_value=0.014; Accession=PF08263.3; Description=Leucine rich repeat N-terminal domain
  Pfam annotation: Domain name=LRR_1; Domain location=111-130; Score =12.7; E_value=1.2; Accession=PF00560.23; Description=Leucine Rich Repeat
  Pfam annotation: Domain name=LRR_1; Domain location=135-157; Score =18.9; E_value=0.019; Accession=PF00560.23; Description=Leucine Rich Repeat
  Pfam annotation: Domain name=LRR_1; Domain location=192-213; Score =10.9; E_value=2.6; Accession=PF00560.23; Description=Leucine Rich Repeat
  Pfam annotation: Domain name=LRR_1; Domain location=216-238; Score =13.7; E_value=0.68; Accession=PF00560.23; Description=Leucine Rich Repeat
  Pfam annotation: Domain name=LRR_1; Domain location=240-262; Score =8.7; E_value=6.8; Accession=PF00560.23; Description=Leucine Rich Repeat
  Pfam annotation: Domain name=LRR_1; Domain location=264-286; Score =16.9; E_value=0.071; Accession=PF00560.23; Description=Leucine Rich Repeat
  Pfam annotation: Domain name=LRR_1; Domain location=288-310; Score =9.8; E_value=4.1; Accession=PF00560.23; Description=Leucine Rich Repeat
  Pfam annotation: Domain name=LRR_1; Domain location=312-334; Score =7.5; E_value=11; Accession=PF00560.23; Description=Leucine Rich Repeat
  Pfam annotation: Domain name=LRR_1; Domain location=336-358; Score =16.1; E_value=0.13; Accession=PF00560.23; Description=Leucine Rich Repeat
  Pfam annotation: Domain name=LRR_1; Domain location=360-382; Score =14.8; E_value=0.32; Accession=PF00560.23; Description=Leucine Rich Repeat
  Pfam annotation: Domain name=LRR_1; Domain location=384-406; Score =17.0; E_value=0.068; Accession=PF00560.23; Description=Leucine Rich Repeat
  Pfam annotation: Domain name=LRR_1; Domain location=39-61; Score=4.7; E_value=38; Accession=PF00560.23; Description=Leucine Rich Repeat
  Pfam annotation: Domain name=LRR_1; Domain location=408-430; Score =8.6; E_value=7; Accession=PF00560.23; Description=Leucine Rich Repeat
  Pfam annotation: Domain name=LRR_1; Domain location=432-453; Score =17.2; E_value=0.06; Accession=PF00560.23; Description=Leucine Rich Repeat
  Pfam annotation: Domain name=LRR_1; Domain location=63-85; Score =15.3; E_value=0.22; Accession=PF00560.23; Description=Leucine Rich Repeat
  Pfam annotation: Domain name=LRR_1; Domain location=87-109; Score =15.7; E_value=0.17; Accession=PF00560.23; Description=Leucine Rich Repeat
  Pfam annotation: Domain name=Pkinase; Domain location=507-772; Score =117.0; E_value=5.3e-32; Accession=PF00069.15; Description=Protein kinase domain
  Pfam annotation: Domain name=Pkinase_Tyr; Domain location=507-772; Score=88.3; E_value=2.3e-23; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::Pkinase::Pkinase_Tyr; Domain location=1 -34::111-130::...
  Pfam module annotation: Domain location=135-157::192-213::216 -238::240-262::264-286::288-310::312-334::336-358::360-382::384 -406::39-61::408-430::432-453::63-85::87-109::507-772::507-772
MAMKASFGNMADTLLDWDDAHNDDFCSWRGVFCDNVSLTVVSLNLSSLNLGGEISPAIGDLGNLQSIDLQGSKLTGQIPDEIGNCAALVHLDLSDNQLYGDIPFSLSKLKQLEFLNLKSNQLTGPIPSTLTQIPNLKTLDVRGNNLTGTVPDSIGNCTSFEILYVVYLVFGIWDISYNRITGEIPYNIGFLQVATLSLQGNRLTGEIPEVIGLMQALAILDLSENELVGPIPPILGNLTFTGKLYLHGNMLTGSIPPELGNMSKLSYLQLNDNHLEGNIPNEFGKLEHLFELNLANNHLDGTIPHNISSCTALNQLNLSANNFKGIIPVELGHIINLDTLDLSSNNFSGNVPASVGFLEHLLTLNLSHNHLDGPLPAEFGNLRSIQILDLSFNNLSGIIPPEIGQLQNLMSLIMNNNDLHGKIPDQLTNCFSLTSLNLSYNNLSGVIPSMKNFSRFSADRDFFESCCCMPHAWNYDIVGHGPPKLVILHMDMAIHTLDDIMRSTENLNEKYIIGYGASSTVYKCVLKNSRPIAIKRLYNQQAHNLREFETELETVGSIRHRNLVTLHGYALTPYGNLLFYDYMANGSLWDLLHGPLKVKLDWETRLRIAVGAAEGLAYLHHDCNPRIVHRDIKSSNILLDETFEAHLSDFGTAKCISTTRTHASTYVLGTIGYIDPEYARTSRLNEKSDVYSFGIVLLELLTGKKAVDNESNLHQLILSKADSNTVMETVDPEVSITCIDLAHVKKTFQLALLCTKKNPSERPTMHEVARVLVSLLPSPLSKILAPPAKKFDYAHFVIEKGQQRKVEEQKPQQDNILPNAQWFVRFGDVISKST

SEQ ID NO: 221997 - protein, 66 aa, Glycine max
  Coding DNA Sequence Number=SeqID_105219
MEKHSTLNEGKPEASGSKKRKTREEIGSKAYLRGEGNECGNGGACGNKKEKTQNGRRGIFLVSILK

SEQ ID NO: 221998 - protein, 69 aa, Glycine max; identical to SEQ ID NO: 179084
  Coding DNA Sequence Number=SeqID_105220

SEQ ID NO: 221999 - protein, 55 aa, Glycine max
  Coding DNA Sequence Number=SeqID_105221
MEEPLGIPLSIDFQVQAIGQFAQATCAPEFGLPRPFNQRLLVLHVGGGVVKRRVK

SEQ ID NO: 222000 - protein, 127 aa, Glycine max
  Coding DNA Sequence Number=SeqID_105222
MIAVMKVTIETMVVVTTTRKMMMLLVATMIIVIGRSDISNGGGGRNNVAMVVATTILYRIHKSLVMLFLHFGKVWEVFVVKRRDRWGNWYGFVRFIGVQDAHSLEKRLDDIWTGTTKMRVNIPKYIK

SEQ ID NO: 222001 - protein, 132 aa, Glycine max
  Coding DNA Sequence Number=SeqID_105223
  Gene Ontology: Mol. function=RNA-directed DNA polymerase activity; Biological process=RNA-dependent DNA replication
MDPKDQRKTTFTCSFGVFACRRMPFELCNAPVTFQRCMIAIFLNLVGKYIEGLFLVTISSRGIEVDKSKVDVIKNLPPPVNEFDLEIKYKKGNENVVADHLSKFNNSEVTIKEAEIQEEFPNEKLLAVQQRP

SEQ ID NO: 222002 - protein, 58 aa, Glycine max
  Coding DNA Sequence Number=SeqID_105224
MEKSITSTSSATGSASRPLGYLALTTRLCKFHAWLGDNPIFPREMEAAGVGADAGVGD

SEQ ID NO: 222003 - protein, 321 aa, Glycine max
  Coding DNA Sequence Number=SeqID_105225
  Gene Ontology: Mol. function=RNA-directed DNA polymerase activity; Biological process=RNA-dependent DNA replication
MEMKPYFLSLISAHQFAGMDHEDPYTHLSTFYELCGTMGIPEDVEQAIRTIDAFVSNNYQARHNKQSVQIHKVLDVIFVEATIQVVNVLSNKSYTNNFSQGWRNNPNQNFGWRQEASSSNRQPPNQKQANFSPIHERMQSLKTPWRSSCKVGEIIQIRTLDGDKKQDAKLEDTLEKFMQASLTNKKNSEASIKNLETLERWKAINTRSGRIIGSGVDDNLAKEEQVDGGKLNKGKKNDSESEEETNKKERVSSLSSYANKERQFSHCMEIFNRWQINIPFLEAVEQMPTYAKFMKEILNNKRKKYIGKETIELEASCSAII

SEQ ID NO: 222004 - protein, 303 aa, Glycine max
  Coding DNA Sequence Number=SeqID_105226
  Gene Ontology: Mol. function=monooxygenase activity; Cellular component=membrane; Biological process=electron transport
  Homolog annotation: Hit_ID=Q0H212; Match level="QueryCoverage=99%, HitCoverage=65%, E-value=1e-152, Identity=85%"; Hit description =Abscisic acid 8'-hydroxylase
  Pfam annotation: Domain name=p450; Domain location=1-299; Score= -23.2; E_value=6.4e-10; Accession=PF00067.12; Description=Cytochrome P450
MITTFLEMKTFTFNVALLSIFGKDENLYGEDLKRCYYTLERGYNSMPINLPGTLFHKAMKARKELAQILAQIISTRRNMKQDHNDLLGSFMSEEAGLSDEQIADNIIGLIFAARDTTATVLTWIVKYLGENTSVLEAVTEEQESILRAKEESGEEMGLNWSDTKNMPVTSRVIQETLRIASILSFTFREAVEDVEFQGYLIPKGWKVLPLFRNIHHSPDNFKEPEKFDPSRFEVALKPNTFMPFGNGTHACPGNELAKLEILVFLHHLTTEYRWSLIGAKNGVQYGPFALPQNGLRITLYPKK

SEQ ID NO: 222005 - protein, 74 aa, Glycine max
  Coding DNA Sequence Number=SeqID_105227
MELFQTKTTLLGNRTTLPTKQKTREKMQDKIRMGGQNEENEKNQRAAVIRTRRFPAYLTAIAFPFTYAPLLACI

SEQ ID NO: 222006 - protein, 110 aa, Glycine max
  Coding DNA Sequence Number=SeqID_105228
MKKWWGYAPSSFADLVFAGKRIETGLKRGKFDHPALMNEKTGANEEDENEEGNHVEVVIPTWPNFAPAQQCHYSANISCSHYPPPSHPQRSSLYQPQSLLAAHPVPKHHL

SEQ ID NO: 222007 - protein, 904 aa, Glycine max
  Coding DNA Sequence Number=SeqID_105229
  Gene Ontology: Cellular component=cell surface
  Homolog annotation: Hit_ID=Q5G8W8; Match level="QueryCoverage=97%, HitCoverage=84%, E-value=1e-152, Identity=59%"; Hit description=Gp21
  Pfam annotation: Domain name=Carboxyl_trans; Domain location=202-576; Score=-294.0; E_value=0.092; Accession=PF01039.12; Description =Carboxyl transferase domain
MADTKLGGVYYEVDIELEKALEKVAKLDNTLDGMGNSAVKAGKQISIAERSMSSLSRVATALTAVLSVQQVAAYADAWANVNNKLANAVRPGEQLASVTERVFNVTQQTRSSLDATASLYARLERATRQYGTSADDLAKLTTIINQGFVVSGATAQEAENAIIQLSQGLASGALRGEEFNSVNEQGNRLIVALADSMDVTIGQMRNMAAQGKLTTDAVVNGLLSQGASIGQEFARTTATIGQSLEVAGNNITRFIGSSATVKAAVAVFNSAVITLTENLDSISTAVLAVSAVMGSRYVGALAAATAQQIANAAAAYRVATAQGAMTAAAAGARGVMALIGGPAGAATLAAAAIFYFYQKAQQARQEANNLADSAANLAAKFKDMSATEVGASIARLRETIPSLTDSVEDAQKTFDNTVYRVRDLRKEIDNWGTGTTRGRQASEALSGAIDQQNIAAESLEKAQRRLSQTQSAIILGQAQLTTGLKTGIDLLSRETTAAGDAAGMMSHFAKSINQAASAKERFNSTSLIITRPKDIQDYLDNQQEQIDLQSEFNEKKRAQLKAEMDIRNLAKKDGSTNSDQIERDVQLARERAGVTFDQQKAEENRRKAQQQSEQQDKRSASSAESVSQKLESLRQQSELSADSTTEMSRAQAVLQAQLSLGKGATQEQIALAGKYRGEIWDTSAAIRAQAAAMKLIPEQAENTRYKQDVADLKTALEQKTITQQQHDAAAEQMEQQHQVNLARIRATQNAGVTSLQEAQGAIDPVQALANENAKKLALIQEFETAKGQITLNGLALMNAANTQYEQQRIAAQWEIYRNQSAANSLLADAVDSLQGGATNAITGLLNGTQSLSEAFANIGSTILNSVVSGLVEMGLQYVKNMLMGQAAASAALGATATQATAAAG

SEQ ID NO: 222008 - protein, 86 aa, Glycine max
  Coding DNA Sequence Number=SeqID_105230
  Gene Ontology: Mol. function=tagatose-6-phosphate kinase activity; Biological process=galactitol metabolic process
  Homolog annotation: Hit_ID=Q2NWM3; Match level="QueryCoverage=96%, HitCoverage=26%, E-value=7e-33, Identity=77%"; Hit description =Putative tagatose 6-phosphate kinase
VIAAQPHAIARQANLIRQMPQRIAELGRRLAGIAAELIDLVGRRLHQYRRAARFGLPQRGLQNPGMGGTDGKDPDRHTGLVLLDKL

SEQ ID NO: 222009 - protein, 155 aa, Glycine max
  Coding DNA Sequence Number=SeqID_105231
  Homolog annotation: Hit_ID=Q2C3B7; Match level="QueryCoverage=27%, HitCoverage=9%, E-value=8e-08, Identity=67%"; Hit description =Putative permease
AGGGGGQRQLLLDLFQQRADAGQGGAQVGRDQHNADDQQNGAGMQSISAAWHDALIDVNAYVPTNRRYPIASVGKMARADKGMTRRDGGGAAFAFLAARTSALRASRPSWHFTFSPFRFLAFRSVSIRKSESHLLPGDAGNLRTAAHASEYRKAT

SEQ ID NO: 222010 - protein, 58 aa, Glycine max
  Coding DNA Sequence Number=SeqID_105232
MANALSLDKPIGTITSMEKQHINMGIDDMMYQLSKQLANVIKPMVHIEFQQAEEFENV

SEQ ID NO: 222011 - protein, 517 aa, Glycine max
  Coding DNA Sequence Number=SeqID_105233
  Homolog annotation: Hit_ID=Q1ZY19; Match level="QueryCoverage=93%, HitCoverage=80%, E-value=6e-14, Identity=23%"; Hit description =Fgenesh protein 60
  Pfam annotation: Domain name=DUF247; Domain location=24-507; Score =93.6; E_value=6.1e-25; Accession=PF03140.6; Description=Plant protein of unknown function
MAGDDEFDRWISPIEMTLNTLTNKKVRGNSIVDIPEHLKKSNMKAYKPKVVSIGPLHRKSSRELLYMKEIKWQCMLSLLHRLNPTDDQKVVPPKRLKDCGEVILKYDEAVRACYMDPIELDRHELAQIMLVDGCFLLELLLITNDKQLNGEPKSKFPVKVSKREEFLSDLKLLENQIPLFIIDLLYLKLFGQKSEGIPNIINGYALYLFGCSSGRPIISPNRAHLLELTHWFLTSRQIEAKPDQERSAPETVVELTIDPPDHEHMESMDIWLRERDERDKKVSKETTPKLERCAARLQAAGVKIKTFYGKNRSSSKLEKDPVSVMFGCKEKFEQGVLEIQSLCITEETELQWRNFIAWEQTRSAEKTWEQTGTPATEKKFSQYALLFKGLVCCEYDIELLKSAKVLKVHDENKWSNEKVNKFIHDIAEGIQIDASADPKFCEMINDLNSCDKGCCRFIMFKHCCRILLTKARKFCRYLYRLLMRDYCSTPWQTLGVMAAVLLLFLTIAQTVLAAIAL

SEQ ID NO: 222012 - protein, 180 aa, Glycine max
  Coding DNA Sequence Number=SeqID_105234
  Subcellular localization annotation: CTP_CleavageSite=86; ConfidenceScore=5.08e-01
MARWIQSTTNSLIALAVGRRQNLALRQRKKNESLLEKSGFRPFQNATQSTTIWGSKIRFQLMSSIHRDNPFGKGSNMDELDQMNDSASARESDERPSDIRKTGVLNCGNDHDGNESENLCGLCTPNFGVTNHRRRFLSLYILATKHQRPCLPELQLEKPSASTATLEKPSTAVKSVPLPA

SEQ ID NO: 222013 - protein, 122 aa, Glycine max
  Coding DNA Sequence Number=SeqID_105235
  Homolog annotation: Hit_ID=Q2HUL7; Match level="QueryCoverage=48%, HitCoverage=4%, E-value=9e-14, Identity=58%"; Hit description =Integrase, catalytic region; Zinc finger, CCHC-type
MTCLRVDSCDWGRLGGFSFGRGGMEINGINGGELEEVSGLLDRLLFGRQRSRKWEKGMHGVVDNEPSQLSDDVYVQKHHYVQGYKVGFSCPQTSKYTISNGYELEIEDLENGKLMTLIGKTI

SEQ ID NO: 222014 - protein, 313 aa, Glycine max
  Coding DNA Sequence Number=SeqID_105236
  Gene Ontology: Mol. function=nucleic acid binding; Cellular component= membrane; Biological process=DNA integration
  Homolog annotation: Hit_ID=Q1T1E6; Match level="QueryCoverage=59%, HitCoverage=29%, E-value=1e-57, Identity=63%"; Hit description=Zinc finger, CCHC-type; Peptidase aspartic, catalytic
MDVNNAFLHGVISEDIYMSQPSGFIHPYFPNHICKLHKALYGLKQAPRAWYQELKSFVVAYGFFNAKSDSSLFIYKQDHVFAYFLVYVDDLLLTGNDVIFLAKFKAALATKFSLKDLGTSSHFLGVELLPTANGMFLSQQHYIWDILQKDWGGDTNDKKSTGAYIVYLAPNAISWSCKKQSTFARSSIEAEYRIIGLIASELLWLQQLLLELGIKLTKQPTIFSDNIGATYLCANPIFHSRMKHLAIDYHFVRDIVAKGELKVSHVPSSHQLADLLTKPLSWPRHEFLITKIGVVTSSSILQGHISDKFKHSI

SEQ ID NO: 222015 - protein, 63 aa, Glycine max
  Coding DNA Sequence Number=SeqID_105237
MENRWAQRKWIRVEVDEKLSTCSHGFAHEELSIPQGHDNNSLYNVYAAHRLQTNADPLRIYPL

SEQ ID NO: 222016 - protein, 187 aa, Glycine max
  Coding DNA Sequence Number=SeqID_105238
  Homolog annotation: Hit_ID=Q6KA74; Match level="QueryCoverage=69%, HitCoverage=20%, E-value=2e-27, Identity=48%"; Hit description =Ankyrin repeat protein-like
MAKSSKDPMTSQERVEEKISVVLDRRDVSFRETPLHLAVRLNDVAAARAKASVSVDISLHNAVGWNPLQEALCLRASDIMQVLVRLHHCAAWAKWCRRLPRLVVALRRMRDFYMEISFHFESSVIPFVGKIAPSVIQFFKGCSLVSSVVFGRSCCKRENSERMKEVFRRSCRGGILQHKRISNSFIK

SEQ ID NO: 222017 - protein, 116 aa, Glycine max
  Coding DNA Sequence Number=SeqID_105239
MEGNDANRLHGPPNYATLTPQHCTQNFTLNNETIEGHQRHRDRILTHVDSSQVFNSIFPLYYSKLHLSNNTNSPNTSSNSNNNNTNADEANALLEDRTQKRMFFNRESARRSSRPC

SEQ ID NO: 222018 - protein, 263 aa, Glycine max
  Coding DNA Sequence Number=SeqID_105240
  Gene Ontology: Mol. function=hydrolase activity; Cellular component =intracellular; Biological process=protein kinase C activation
  Homolog annotation: Hit_ID=Q5FAL7; Match level="QueryCoverage=99%, HitCoverage=79%, E-value=3e-77, Identity=40%"; Hit description =Putative Putative Pentatricopeptide (PPR) repeat-containing protein
  Pfam annotation: Domain name=PPR; Domain location=112-146; Score =10.2; E_value=0.47; Accession=PF01535.11; Description=PPR repeat
  Pfam annotation: Domain name=PPR; Domain location=178-212; Score =13.4; E_value=0.19; Accession=PF01535.11; Description=PPR repeat
  Pfam annotation: Domain name=PPR; Domain location=41-75; Score=43.2; E_value=8.9e-10; Accession=PF01535.11; Description=PPR repeat
  Pfam annotation: Domain name=PPR; Domain location=76-110; Score=1.9; E_value=4.4; Accession=PF01535.11; Description=PPR repeat
  Pfam module annotation: Pfam domain module=PPR::PPR::PPR::PPR; Domain location=112-146::178-212::41-75::76-110
MKPRLSEDNFVTCALKDMYAKCGCLEQSRNIFDRVNEKDEAVWNVIIAGYGIHGHVLKAIELFGLMQNKGCRPDSFTFLGVLIACNHAGLVTEGLKYLGQMQSLYGVKPKLEHYACVVDMLGRAGQLNEALKLVNEMPDEPDSGIWSSLLSSCRNYGDLEIGEEVSRKLLELEPNKAENYVLLSNLYAGLGKWDEVRKVQQRMKENGLYKDAGCSWIEIGGKVYRFLVSDGSLSESKKIQQTWIKLEKKKAKLDINPTQVVCS

SEQ ID NO: 222019 - protein, 50 aa, Glycine max
  Coding DNA Sequence Number=SeqID_105241
MFSLSRYPTDISDCEKMKNKKVVAAGISLSEAYALSKQHLLSETSAHLAS

SEQ ID NO: 222020 - protein, 80 aa, Glycine max
  Coding DNA Sequence Number=SeqID_105242
MDTHLRMIGDPLNRVQQVQSPEADVLFFFNSFICLRDCDGRRFRSPTVGEPTARNHGHSNVYVILWEKKLSAFSKLGRWM

SEQ ID NO: 222021 - protein, 104 aa, Glycine max
  Coding DNA Sequence Number=SeqID_105243
MKLVQKVETASNNLKDYEEPEICVHCKADWDLQDLDKSAYKKRYFKPKDKNALMSTREELDNISSGEEIEEEEEANLCLMTNTTSEGSDFESDEEVNIKNLETL

SEQ ID NO: 222022 - protein, 72 aa, Glycine max
  Coding DNA Sequence Number=SeqID_105244
MDEIPEAFDITLVDKSSNLKVVLLQMTMLGVVVALTLMPTPKSPTLEPTPPSVEPTLSPPPTQPLPPPQVQD

SEQ ID NO: 222023 - protein, 178 aa, Glycine max
  Coding DNA Sequence Number=SeqID_105245
MAMKVAIEQNLKEAPQLDLDAINTRKQKRLATATTDEDRGLNSFGIAKKIQKKIMNEQLLFRRKRLWPKLLFPQKEQKLSNQLLHKESIISSTIPRCIKTRDTKANPKIGEKEWTIPFTGNKENSASSSIDSEFTNATSISHLPNRPFDTPKPRPPPSPIHFEKFRRSVQLKETLTNA

SEQ ID NO: 222024 - protein, 275 aa, Glycine max
  Coding DNA Sequence Number=SeqID_105246
  Gene Ontology: Mol. function=hydrolase activity; Cellular component =nucleus; Biological process=ATP synthesis coupled proton transport
  Homolog annotation: Hit_ID=Q1SUQ2; Match level="QueryCoverage=100%, HitCoverage=38%, E-value=1e-144, Identity=93%"; Hit description=Beta- lactamase-like; RNA-metabolising metallo-beta-lactamase
MELIRKRLKDHGIFVPSRLKVFRTRKKFMAGPFEVEPITVTHSIPDCCGLVLRCSDGTILHTGDWKIDETPLDGRVFDREALEELSKEGVTLMMSDSTNVLSPGRTTSESVVADALLRNISAAKGRVITTQFASNIHRLGSVKAAADLTGRKLVFVGMSLRTYLDAAWKDGKSPIDPSTLVKAEDIDAYAPKDLLIVTTGSQAEPRAALNLASFGSSHSFKLTKEDTVLYSAKVIPGNESRVMEMLNRISEIGSTIVMGKNECLHTSGHGYRGEL

SEQ ID NO: 222025 - protein, 79 aa, Glycine max
  Coding DNA Sequence Number=SeqID_105247
MYKDKWTQPWPMGSKIYPEVHENPQAFFSSSSPILLEPLAHGSGKHLDRISHNHNEIQDISISSLKENLGETLGPIEIE

SEQ ID NO: 222026 - protein, 452 aa, Glycine max
  Coding DNA Sequence Number=SeqID_105248
  Gene Ontology: Mol. function=argininosuccinate synthase activity; Cellular component=chloroplast; Biological process=arginine biosynthetic process
  Homolog annotation: Hit_ID=Q1T0B7; Match level="QueryCoverage=99%, HitCoverage=100%, E-value=0.0, Identity=77%"; Hit description =Argininosuccinate synthase
  Pfam annotation: Domain name=Arginosuc_synth; Domain location=83-448; Score=611.7; E_value=6.4e-181; Accession=PF00764.9; Description =Arginosuccinate synthase
  Subcellular localization annotation: CTP_CleavageSite=9; ConfidenceScore=5.03e-01
MAQLKASPLCSTPATAPSLHTTGHLLYHQFWKAKPSSFKELGLRTSIGATKLKVIKAAARSDTEVVSESTKGGGLRGKLNKVVLAYSGGLDTSVIVPWLRENYGCEVVCFTADVGQGIKELEGLEQKAKASGACQLVVKDLKEEFVKDYIFPCLRAGAIYERKYLLGTSMARPVIAKVRFELTFFALNPKLNVVAPWREWDITGREDAIEYAKKHNIPVPVTKKSIYSRDRNLWHLSHEGDILEDPANEPKKDMYMMSVDPEDAPDQAEYVEIGLESGLPVSVNGKRLSPASLLAELNEIGGKHGIGRIDMVENRLVGMKSRGVYETPGGTILFAAARELESLTLDRETIQVKDSLALKYAELVYAGRWFDPLRESMDSFMQKITETTTGSVTLKLYKGSVIVTSRMSPFSLYREDISSFESGQIYDQADAAGFIRLYGLPMKVRAMLEQGI

SEQ ID NO: 222027 - protein, 184 aa, Glycine max
  Coding DNA Sequence Number=SeqID_105249
  Gene Ontology: Mol. function=hydrolase activity; Cellular component =nucleus
  Homolog annotation: Hit_ID=Q1SUQ2; Match level="QueryCoverage=89%, HitCoverage=22%, E-value=1e-58, Identity=68%"; Hit description=Beta -lactamase-like; RNA-metabolising metallo-beta-lactamase
  Subcellular localization annotation: CTP_CleavageSite=29; ConfidenceScore=5.31e-01
MATCTSLSLCPHTFCCRHRPHPTRRSLASCSLSPSSLPDTDGPKVLRKRSRRIEGPRKSMEDSVQCKMEEFYEGQDGPPLRVLPIGGLGEIGMNCMLVGNYDRYILIDAGELTLIYAWIAYFSYDELGVQKIIPDTTFIRKWKHKIEAVIITHGHEDHIGALPWVMLSSRKCWLKKTLLSTSSL

SEQ ID NO: 222028 - protein, 177 aa, Glycine max
  Coding DNA Sequence Number=SeqID_105250
  Homolog annotation: Hit_ID=Q9LSQ5; Match level="QueryCoverage=27%, HitCoverage=25%, E-value=5e-09, Identity=63%"; Hit description=1,4 -benzoquinone reductase-like; Trp repressor binding protein-like
MKIPTDLPAKCPAFPKSRRKALNEAAIIPKIVGKAKIKPLALESSFGVMIDISGAIYSVGMLIFPTDYIHGIGIHRKLKFPKTKELYPSRLSHCGVFVFFSASSPICAFLVAKQQPLVRVTPSRQSYRHCHVVSASHKRVLCVVLFASFMHRHMLETGSFYINTCTGCNMFEEGCCR

SEQ ID NO: 222029 - protein, 769 aa, Glycine max
  Coding DNA Sequence Number=SeqID_105251
  Gene Ontology: Mol. function=ATP binding
MKQVNDVDLTEIQGGEVAITNWHSCNGPEFVFQLHLKSESSRELQANARMRFVYLPFTKGKENIERVLEKLKSDGFVISEDFQSFSRVSVRRLGRLLPDARWTLLPFMDFRNKKGIKAQILKRCSQRKLMEVSSLHCPRRLQKYLRKLLGFQTDLAHHNPFTAALKNFGNKFSEKEKDVTVEIRKATKVLTLLKLQMEYQDWILQMHHQYDEEADSGEDQPVIIVGPANEKALGISSDVIRVHQVLNRKEKSWKRGQKIKVLKGACAGCHRTTIYATIEYFLLEGFEGDAGGEARIICRAIDIPDENGSFLSVGDEDASLEIRGSLSLPISVIDSGKVIAVESIEWENRLTKKQQKSTSIYLPGANHYENLETNGVVSVESIEWENRLYKKQQKSPSINLSGANHYEHLEADGVPVIKMPIVKYAGQPPCTDKGIIDLQEPSLYHENSLIEFFLNYDKELFDSICKLAERIQKVESHLNNSNEKKAETEQEMVKLLEKVEPYQLSIMDSSFTKDELMTKIRSMENSPYSVLCSLSKREKPPNYFLEDLIGVVALIGTVQRPELSRILAEYLGEAKMLGLIYRSFDTASSLEKYNQKGEIDYERALHAEAAALGKAISNRFHVICFEDIRPYTGWLHDDSQRRLALPNPRIANGETPEGFIGYAVNMVDLDINSLQIMTASDFGLRETVLFNLFKKLQVYNTRENMVAARTCIEDGAVSLDGGILSENGILSLGYGSLSLSDKYCLLHLLYVYNHFCVELLEHDAYCLTR

SEQ ID NO: 222030 - protein, 142 aa, Glycine max
  Coding DNA Sequence Number=SeqID_105252
MPISPCERVAPTRHPVDPEEPNRALGFPALVTGLCQSYRMPVPPARSCHRDIGIAPARHPVDPEKSNRVLGCPALITGICQFYGVPVAPSKVIRPPTNQAFIKKYCAPRQTQGETPQQPGDGRQRATDAPPPPLEFTSAHPQ

SEQ ID NO: 222031 - protein, 60 aa, Glycine max
  Coding DNA Sequence Number=SeqID_105253
  Gene Ontology: Mol. function=transferase activity, transferring hexosyl groups; Biological process=metabolic process
  Homolog annotation: Hit_ID=Q1RXI0; Match level="QueryCoverage=65%, HitCoverage=8%, E-value=3e-10, Identity=75%"; Hit description=UDP -glucuronosyl/UDP-glucosyltransferase
MAGEKGKKMRQKIVELKKKAEEATTPSGCSFINLDKFIKEDTVFHCVPYSNDSATKQNRE

SEQ ID NO: 222032 - protein, 115 aa, Glycine max
  Coding DNA Sequence Number=SeqID_105254
MRVSRCIVTCLVPVLFSASILATQLGSPSAIGIADHHHDHDQLKHSSTMDNIGSRRGRTLQIAGSRLPDCMHACGSCSPCRLVTVSFACASLTDESESCPMSYRCMCDNKSYPIP

SEQ ID NO: 222033 - protein, 63 aa, Glycine max
  Coding DNA Sequence Number=SeqID_105255
MHYIIWARDSYWAKKEEEGSAGEGAIGGETTGGGGNSPVDHQAEGLICQCIRVNSLIVVECGN

SEQ ID NO: 222034 - protein, 92 aa, Glycine max
  Coding DNA Sequence Number=SeqID_105256
MAPEDFIQRVAWPGVQPSIDGGVIPLALEMLQMTELTLIMLPYCEVMKYESKNKSEETKDQAESFDDAKGLHESYASQRFTQDKAIRDIQDG

SEQ ID NO: 222035 - protein, 81 aa, Glycine max
  Coding DNA Sequence Number=SeqID_105257
MENNWTLKQNRKQQSLVLTFNLELVFKTERSKPNGIAFTCSPTQIEQRSSTHITHRKKEIDPHTQRKKAQSRLKIAREGET

SEQ ID NO: 222036 - protein, 79 aa, Glycine max
  Coding DNA Sequence Number=SeqID_105258
  Gene Ontology: Mol. function=RNA-directed DNA polymerase activity; Cellular component=mitochondrion; Biological process=DNA integration
  Homolog annotation: Hit_ID=Q1SFL1; Match level="QueryCoverage=93%, HitCoverage=6%, E-value=5e-26, Identity=69%"; Hit description =Integrase, catalytic region; Peptidase aspartic, catalytic
MQDDNWVKAMQEELDQFQKNDVWKLVELPKRKKVVGAKWVFHNKLDENGKVMRNKARLVAKGYSQQEGIDYKETFKIWE

SEQ ID NO: 222037 - protein, 175 aa, Glycine max
  Coding DNA Sequence Number=SeqID_105259
  Gene Ontology: Mol. function=nucleotide binding
  Homolog annotation: Hit_ID=Q5VNG4; Match level="QueryCoverage=98%, HitCoverage=35%, E-value=8e-67, Identity=75%"; Hit description =Putative auxin-independent growth promoter
  Pfam annotation: Domain name=DUF246; Domain location=1-126; Score= -142.7; E_value=2.5e-06; Accession=PF03138.5; Description=Plant protein family
MVGVLYNWRRLPLHLGPLTSVKAFKSTLQLGKYMVGTREWQVRKETLLEPSDLQFFQNHSSQMAALDYLVSLESDIFVPTYDGNMAKVVEGHRRYLGFKKTILLNRKLLVDLIDRYHDGILNWDEFSSAVKEVHADRMGGATKRLVIPDRPKEEDYFYANPEECFELSDVMLSST

SEQ ID NO: 222038 - protein, 88 aa, Glycine max
  Coding DNA Sequence Number=SeqID_105260
MAGIRLLLLSLMVGGKNVVTGEGKRKDSGKINGRQNWWKRREQHSKMPVSYSHMVGKGSLGKASREVSMVFVYFREGIGKRTKGKKGT

SEQ ID NO: 222039 - protein, 475 aa, Glycine max
  Coding DNA Sequence Number=SeqID_105261
  Gene Ontology: Mol. function=nucleic acid binding; Biological process= DNA modification
  Homolog annotation: Hit_ID=UPI0000673696; Match level="QueryCoverage =99%, HitCoverage=50%, E-value=1e-158, Identity=61%"; Hit description= COG5519: Superfamily II helicase and inactivated derivatives
  Pfam annotation: Domain name=Prim_Zn_Ribbon; Domain location=15-50; Score=66.7; E_value=7.7e-17; Accession=PF08273.2; Description=Zinc -binding domain of primase-helica
MVLSQLGIDVPRSPRQHAPCPACGGKDRFRFDDKGRGSFFCNQCGAGDGLDLIQKVNQCGTTEAARMAADVLGIDYRVTETDQKAASQRRQQLDEQRHQHEQQRQQKEAAEAEQRRECFVSHYQRLSAQTTSGESEYLIARGLNGFTLPCLSDGAILLPLVDESGGVAAAQTITQQGEKKVLYGSAKRGAWHIVNQPQEVKEIIIGEGLATTLTAHLIRPYALAVVALDAGNLPTVAETMRRLYPNAAIIISGDNDWHEPGEIDDNGKPKVNGGKIFADKAAEAVNGAVSLPPTHYKADWDDYRQQNGLEAATAAFNDSLYQPQGESMGAQLEVIEGGKTAASDPDVLKPRIESRQDGVYWVEPNTDKQTGEIINRESWLCSPLQVIGTGRDDKDQFLILRWQAWGSDSETTQAIPLADIGEREGWRTLKAGGVNVTTKSGLRAILADWLQRNGSREVWRVAHATRVAMRRLYHA

SEQ ID NO: 222040 - protein, 672 aa, Glycine max
  Coding DNA Sequence Number=SeqID_105262
  Homolog annotation: Hit_ID=UPI000067369C; Match level="QueryCoverage =36%, HitCoverage=87%, E-value=1e-91, Identity=71%"; Hit description =COG3561: Phage anti-repressor protein
  Pfam annotation: Domain name=AntA; Domain location=22-107; Score =91.5; E_value=2.5e-24; Accession=PF08346.2; Description=AntAAntB antirepressor
NDFATIVPVISGQIGGRETNIVSAKALHKALGVGNDFSTWVKLRIDEYGFTLGADYVVFDSSDFRNQSANIEQAERGWVTKRGGDRRSKDYGLSLGMAKEVAMVERNEQGRAIRRYFIQCEEALQRSVPEIAAQYRRQLKARLSAANMFKPMCAALDVARAEQGKQTLSRHYSNESNMIARIVLGGLTAKQWAQVNGFQGEPRDGMNSSQLEHLTYLESTNITLIDMGMAYDQRKAELMRLSQRGEAMIAVQSKRFPLAGLLMNASPENLTKPDIHLAKSLALCLTMCKAMMRKAVSYTGIAGYHKQAKNRLPSLQSSDYPQPALAKSGVRIGVLVMLSATFDAPSVFFCVVNLTHPFFGDMVIIRVAHEVMVGWMGAEKSAPVSDNAGYANPVQSTTSEIGVSGDGIKYQLSEAATMATTLTQTTPKFEFRFLALSRADMMAKPCRVSVEATSEKEARRVLAPHFILSLAARLPVHQEAIIGNENAPTPNTPENISRDRLLRAQAGLLHLLTEVIPLISDEKQRHEIMKHVNTSVSIQRPQTVAVLTQQQSPLNSVSIDIHNADKYAHQLAEIYNGSVHAALMEHDPKAAVRIATLFAELCSTTDRAGMRITRLSSQFAHGANLKKARAVLSILLETMPGTDVNEDYTWLINLAHGTVHDTIQALEAAVDA

SEQ ID NO: 222041 - protein, 138 aa, Glycine max
  Coding DNA Sequence Number=SeqID_105263
  Gene Ontology: Mol. function=DNA binding; Biological process=DNA recombination
  Homolog annotation: Hit_ID=UPI000067369E; Match level="QueryCoverage =99%, HitCoverage=39%, E-value=1e-62, Identity=83%"; Hit description =COG0582: Integrase
  Pfam annotation: Domain name=Phage_integrase; Domain location=1-110; Score=-13.0; E_value=0.0092; Accession=PF00589.13; Description=Phage integrase family
MKMRRPHVVPLSIQAKSLLEEIHQLTGRGRYVFPGRNDAGKTMSEASINQVIKRIGYDGKATGHGFRHTMSTILHEQGYNTAWIETQLAHADKNSIRGTYNHAQYLDGRREMLQWYADYMDALENGENVVHGSFGKRA

SEQ ID NO: 222042 - protein, 122 aa, Glycine max
  Coding DNA Sequence Number=SeqID_105264
MFSITNVLIYYGTQSDIRVKSDCGMHLLRVSVFNFDCLDIFLDSIEHPSKKLLSFEFSTSFHFQFGVSPYITGLNQTLVYKVDAILLRKGPITRTMSKRLQEDWARAAEEGPRVLMNLRVDF

SEQ ID NO: 222043 - protein, 103 aa, Glycine max
  Coding DNA Sequence Number=SeqID_105265
MLVFRKNYVFVEWDVSQPTLRWEGDARAHGCVFHGRKMRGVATNVYSRKTLEKLERCGLRTLSVKGLGVVFAHGEGCFPSSNVFLNCDKEIRPMQFFQKGRIK

SEQ ID NO: 222044 - protein, 67 aa, Glycine max
  Coding DNA Sequence Number=SeqID_105266
MHHVPLGNDQVKVGIKEVQDVDACIPIPAKEMKKRLSFEVQKVTVELSSTVGLSAHPPLSAALTHLA

SEQ ID NO: 222045 - protein, 212 aa, Glycine max
  Coding DNA Sequence Number=SeqID_105267
  Gene Ontology: Mol. function=ATP binding
MVLFEMQNMWDSTPDTDLLLELPEEYTFETALADLIDNSLQAVWSNGEDKRKLIRVNLGKSKISIFDNGPGLDDTDENSLVKWGKMDASLHRSSKSKAIGGKPPYLMPYFGMFGYGGPIASMHLGRRASVSYKTKHVKKVYTLHLEREALLNTSSSQLTWKTGGGIRDPLANEIRDSHGSFTKVEIYEPKIKDVHINRLPSHLKDLYFPYIQ

SEQ ID NO: 222046 - protein, 68 aa, Glycine max
  Coding DNA Sequence Number=SeqID_105268
MGAENVSKTEQLRSSEALLLPCERSGVRSADSAQAGRRSKKMVKFAVKWGINKPGEAKGLRVRRKKRE

SEQ ID NO: 222047 - protein, 446 aa, Glycine max
  Coding DNA Sequence Number=SeqID_105269
  Homolog annotation: Hit_ID=Q2QY97; Match level="QueryCoverage=57%, HitCoverage=80%, E-value=2e-13, Identity=23%"; Hit description=F-box domain containing protein, expressed
  Pfam annotation: Domain name=F-box; Domain location=29-76; Score =20.5; E_value=0.0061; Accession=PF00646.23; Description=F-box domain
  Pfam annotation: Domain name=FBD; Domain location=361-408; Score =27.4; E_value=5e-05; Accession=PF08387.1; Description=FBD
  Pfam annotation: Domain name=LRR_2; Domain location=180-204; Score =16.1; E_value=0.099; Accession=PF07723.3; Description=Leucine Rich Repeat
  Pfam module annotation: Pfam domain module=F-box::FBD::LRR_2; Domain location=29-76::361-408::180-204
ARMNMQDAGSRDNQQKRAKSNNEEDYEGDLINKLPDGIPVAILSKLPINEAARTSILSRKWRYLWTFFCGTLEFDGSPIMKDMKKDIKKAAGRQLQTAMEIMYDAERQTYTTWINELLSSLKSSTLQGLKFWFHVGTGCDVDKWIHFAIQKKVQKLELYFGHTFEYVLPLHLFKLESFNSLHVLRLKSITVTEEMLEYLLCRCPLLKTLSLVNSGVPKTMKVSGPSLKLKCLELVRCWELIKLEIFAENLMSFKYYGSHLDTEFKSVPCLVEATFGGSFVEFTRESFLPQIKVLKLDITQNEPQVLFRLSQLPKLKNLKHLELVACVDDGITLACALLLKATHSLWRFTLKMLNTKPSFRTERKFTMESRCNLKELELVGFCGAACEVELVMYILENAAELQKIIIDTRLPTKPKLRPLGEQCKTWDHEENRKRARGLQEKIPPWI

SEQ ID NO: 222048 - protein, 248 aa, Glycine max
  Coding DNA Sequence Number=SeqID_105270
  Gene Ontology: Mol. function=transferase activity, transferring glycosyl groups; Cellular component=cytoplasm; Biological process =nucleoside metabolic process
  Homolog annotation: Hit_ID=Q9FKS0; Match level="QueryCoverage=96%, HitCoverage=54%, E-value=3e-81, Identity=61%"; Hit description =Uridine kinase-like protein
  Pfam annotation: Domain name=Pribosyltran; Domain location=90-217; Score=-13.2; E_value=0.08; Accession=PF00156.17; Description =Phosphoribosyl transferase domain
MAHDPPYAKFVKPAFDDFILPSKKYADIIIPRGGDNLVAIDLIVQHIRTKLGQHNLCKIYPNVNVIQSTFQVTALSFLQDLQPLLTTNLNITDFTGSGTWSWLLAIYRETSYHTYSGESMENALRACCKGIKIGKILIHREGGDETQLIYEKLPKDISERHVLLMDPVLGTGKTASQAIELLIKKGVPESRIIFLNLISAPEGIHCVCKHFPHLKIVTSEIEEGLNDQFRVIPGLGEFGDRYFGTDDS

SEQ ID NO: 222049 - protein, 839 aa, Glycine max
  Coding DNA Sequence Number=SeqID_105271
  Gene Ontology: Mol. function=nucleoside-triphosphatase activity; Cellular component=membrane; Biological process=cell division
  Homolog annotation: Hit_ID=Q1T099; Match level="QueryCoverage=80%, HitCoverage=99%, E-value=0.0, Identity=77%"; Hit description=AAA ATPase; DEAD/DEAH box helicase, N-terminal
  Pfam annotation: Domain name=AAA; Domain location=574-759; Score =280.8; E_value=2.6e-81; Accession=PF00004.19; Description=ATPase family associated with various cellular activities (AAA)
  Pfam annotation: Domain name=AAA_3; Domain location=574-700; Score= -9.7; E_value=0.0037; Accession=PF07726.2; Description=ATPase family associated with various
  Pfam annotation: Domain name=AAA_5; Domain location=574-706; Score =23.0; E_value=3.1e-05; Accession=PF07728.4; Description=ATPase family associated with various
  Pfam module annotation: Pfam domain module=AAA::AAA_3::AAA_5; Domain location=574-759::574-700::574-706
MYIALPLKVKWLLSGSEPMTSDGKEMRGNKIGMMKISQNRFYSHPYYIVEGLRHAFVHLFQVQLLSSNPLISCGISFSCHFWLSLAPSGLQTRVPCYLISMIPSLICLLFTLLLQIAVMFYGVTVIVFYICGVTDLKEEFKHFWGQPLCIAVWVDNYAQVGPSNGSRGKVVLLFDDNPLSKIGVRFDKPIPDGVDLGGACEGGQGFFCNVTDLRLESSAVEELDKLLIHSLFEVPFTLPCSLRMLYNHFGFNLTIRSIFGYFFQVVFSESRSAPFILFMKDAEKSIVGNGDSHSFKSKLENLPDNVVVIGSHTQNDSRKEKSHPGGLLFTKFGSNQTALLDLAFPDSFGRLHDRGKEAPKQNRTLTKLFPNKITIHMPQDEALLASWKQQLDRDVETLKIKGNLHHLRTVLGRCGMECEGLETLCIKDQTLTNENAEKIIGWALSHHLMQNSEAKPDSKLVLSCESILYGIGILQSIQNESKSLKKSLKDVVTENEFEKRLLADVIPPSDIDVTFDDIGALEKVKDTLKELVMLPLQRPELFCKGQLTKCPSSVPTLKERKKKEVESADYPCKGILLFGPPGTGKTMLAKAIATEAGANFINISMSSITSKWFGEGEKYVKAVFSLASKISPSVIFVDEVDSMLGRRENPGEHEAMRKMKNEFMVNWDGLRTKETERVLVLAATNRPFDLDEAVIRRMPRRLMVNLPDAPNRAKILKVILAKEELSPDVDLDAVASMTDGYSGSDLKNLCVTAAHRPIKEILEKEKKERAAALAEGQPAPALCSSGDVRSLNMEDFKYAHQQVCASVSSESVNMTELLQWNELYGEGGSRVKKALSYFM

SEQ ID NO: 222050 - protein, 111 aa, Glycine max
  Coding DNA Sequence Number=SeqID_105272
MKVFGAWDLSKFRKQDTGSKRAIMFSMSKCRYQKLYMTKNMILEISRYNVGAGETTVPNEITHQRKKRVRPLFGKPSIKGRHVSLPNIWHVGPTHLPRHLLARFNEAHPIK

SEQ ID NO: 222051 - protein, 76 aa, Glycine max
  Coding DNA Sequence Number=SeqID_105273
  Homolog annotation: Hit_ID=Q1T098; Match level="QueryCoverage=66%, HitCoverage=8%, E-value=4e-10, Identity=62%"; Hit description =Forkhead-associated
MARIMDPLASEIETPSPSNAPTSYGFESQPKLETDNMPSTSGTAKKLLIQISHQDTVIRICEINKYHAEVESVFNS

SEQ ID NO: 222052 - protein, 96 aa, Glycine max
  Coding DNA Sequence Number=SeqID_105274
MDGEVNQKMEDSHHQRGGEDANEAITRTEDVVDVPGVEEGANVDANDEIGADAETIIATTIDVNDEVGAKEDIVVENTTKGVPQESIIEGEFVAIE

SEQ ID NO: 222053 - protein, 90 aa, Glycine max
  Coding DNA Sequence Number=SeqID_105275
MQLWCLPCHRLHRNSECRASAYVFLSVTNSLRRESSLSLPLAASLVATVAVGVENVVVAISLVCLQKNLLCGIFNNGFYIFVVSVWECQI

SEQ ID NO: 222054 - protein, 450 aa, Glycine max
  Coding DNA Sequence Number=SeqID_105276
  Gene Ontology: Mol. function=nucleotide binding; Biological process =fatty acid biosynthetic process
  Homolog annotation: Hit_ID=Q7XYY0; Match level="QueryCoverage=99%, HitCoverage=100%, E-value=1e-178, Identity=72%"; Hit description =AKIN gamma
  Pfam annotation: Domain name=CBS; Domain location=289-427; Score =91.3; E_value=2.9e-24; Accession=PF00571.18; Description=CBS domain
  Pfam annotation: Domain name=CBS; Domain location=52-236; Score=34.9; E_value=2.8e-07; Accession=PF00571.18; Description=CBS domain
  Pfam module annotation: Pfam domain module=CBS::CBS; Domain location =289-427::52-236
MAMATMEEIPQSPEAKLGMRVEDLWDVQEAQLSPTEKLNACFESIPVSAFPLDPSNTEIEIKSDATLADAVKILAGHNVFSAPVVDVEAPEDASWIDRYIGIVEFAGIVVWILHQSEPTSPRTPSTPSSARAIAAAANGAAFALELEALGLGSAATTAGNFFEDLTSSELYKNTKVRDISGTFRWAPFLALERSNSFLTMLLLLSKYKMKSVPVLDLGSGAIDNIITQSAVIHMLAECAGLQWFESWGTKKLSEVGLPLVTGNQIIKLNQSYKSSIFIHNGKCSELGEVYYFIFPLQVYEDEPVLQAFKVMRKKRVGGVPVIERETKKAVGNISLRDVQFLLTAPEIYHDYRGITVKDFLTEVRSYLEKNKNASPMLNEYVTCKKDCTIKELIQLLDQEKIHRVYVVDDDGDLQGLITLRDIISRLVHEPRGYFGDFFDGVLPLPANSRV

SEQ ID NO: 222055 - protein, 525 aa, Glycine max
  Coding DNA Sequence Number=SeqID_105277
  Gene Ontology: Mol. function=transcription coactivator activity; Cellular component=nucleus; Biological process=chromatin modification
  Homolog annotation: Hit_ID=Q1T094; Match level="QueryCoverage=80%, HitCoverage=79%, E-value=1e-140, Identity=60%"; Hit description =SWIB/MDM2
  Pfam annotation: Domain name=SWIB; Domain location=310-385; Score =79.3; E_value=1.2e-20; Accession=PF02201.9; Description=SWIBMDM2 domain
  Subcellular localization annotation: CTP_CleavageSite=70; ConfidenceScore=5.33e-01
MNNTNNINNINTNPTKNAATPSFFTNPGAPSIPMNHPQPHLLSQTQPQPQGATSHFHGHFQLSQPQTHVVAQQQHQQQQPHPHPQVHNNANTNAHVAAPTPPKRANQKPPSRPQGSSNATQSSAFKTMELTVAPPRKKRSFPGNLIPEKVAKLVPESAIYAKLLELETQIDSALARKKIDVQANVRNPRCVRKTLRVYVYNTFSNQVKVETGKNGVEEPSWALRITGRVLEDGNGKDSVAEGISTKEYPKFSAFFKKITIYLDQGLYQDNHVVVWDSAHSAAAQQRDGFEVKRKGDKEFTAVVRMAMNYSPDKFVVSPQLARVLGVEFDSRCRIIAALWHYVKAKKLQSPNDPSFFMCDASLQRVFGEEKMKFSVASQKISQHLSHPQPIHLEHKIKLSGNGPAGSTCYDVQVDVPLPLEKDMSAFLASTERHKDIDTFDELISDSIKKIHEHHRRRAFFLGFSQSPAEFINALIASQSKDLKLVAGDVSQNTENERRAEFYNQPWVEDAVIRYLTRKNARSDAP

SEQ ID NO: 222056 - protein, 62 aa, Glycine max
  Coding DNA Sequence Number=SeqID_105278
  Pfam annotation: Domain name=SAP; Domain location=22-55; Score=23.6; E_value=0.00071; Accession=PF02037.17; Description=SAP domain
MVRNFGRDLVEGSNSQTTTRDFHHLTVERLRALLKSKGLSTKGKKASISTVLTYMHTKVALR

SEQ ID NO: 222057 - protein, 372 aa, Glycine max
  Coding DNA Sequence Number=SeqID_105279
  Gene Ontology: Mol. function=hydrolase activity
  Homolog annotation: Hit_ID=Q8VX11; Match level="QueryCoverage=99%, HitCoverage=74%, E-value=7e-88, Identity=42%"; Hit description =Diphosphonucleotide phosphatase 1 precursor
PKLVAVSNFISFVNPKVPLYPRLAQGKSWDEMTVTWTSGYDINEAIPFVEWGPKGKTQVQSPARNIDIQSKKYSFKSSPYPGQDSQQRVIIFGDMGKSYDLWKVKMKSYTESFDLWNDVEEDYEVSLLPENQEGEGKYMPICWKSMKGMQVLNLMSEFEMQKMKESETIKGYSDRLLGITNKVRLLGTTFVDSKIVEKILVIMYATDYGMFRFCIADTEHDWREGSEQYKFIEHCLATVDRQKQPWLIFAAHRVLGYSSDFWYVYGHVHNNERTCPIYQSRYSGVVNGTIHVVAGGAGSHLSNFSQVTPKWSLYRDYDFGFVKLTAFDHSSLLFEYKKSSDGKVYDSFTISRDYKDVLACVDDSCEATTSAT

SEQ ID NO: 222058 - protein, 123 aa, Glycine max
  Coding DNA Sequence Number=SeqID_105280
  Homolog annotation: Hit_ID=P93004; Match level="QueryCoverage=40%, HitCoverage=18%, E-value=4e-11, Identity=80%"; Hit description =Aquaporin PIP2.7
MAMTVGHFQLLSLQRSTRNAGGVIDEDKDHATEGPSMPRRPTPSHALVCFLWPMTVAMVTVGKNKVEQRDHASTNHLMGSHHRGRVDEKQIWIQQLRDSNNKPGAIRILDSRILCQYSAPKHK

SEQ ID NO: 222059 - protein, 68 aa, Glycine max
  Coding DNA Sequence Number=SeqID_105281
MDDSFSFTFQILQPSEGPTSLSAPINASIDDARLLILNGNCGMAFVRTWVPRGAPKDLHAFFPLFQLC

SEQ ID NO: 222060 - protein, 913 aa, Glycine max
  Coding DNA Sequence Number=SeqID_105282
  Gene Ontology: Mol. function=RNA-directed DNA polymerase activity; Biological process=RNA-dependent DNA replication
MAREKQFFKEKKKAIRKAGKSKHIFEEPLMAGDRPSRLIQGNLFHGLPNEDSYAHLATCIEICNTMKIVGVVEKFLKKYFLESKIAEEKAEISSFHQLPDESLGEALDCFCGLHRRTSTHGGKIKLKTPDEAMKLIVNMAASDHVILRDKAYTPAKKKTLNKLPQQFQFLQPASSLVKPVGGCTLCGGAHESSMCMTQEDAPKEFNYMANPNRQGFHPGNNFNKDQGGLSNQPPNQGPNLYERTAKLEDTLIEFIQVGQLAKHMAEKSTGNYMVSTEKNPKEEWKVVLARSKRNESLEKEERVEGVVEDVSDEEVEDERKKNKANNEEKELRDEKNKLEIAIPFGEALQQMPMYTKFLKDLLTKKGKYINNESIVRIGNLRIIPTRITLQLADKSITRPYDVVEDVLVKEADLAMRCFTVHSPLEKALMNAIECLTNEEEKDLRSYSTTEKPKVELKVLPPHLKYVFLEANDAKPVVISNDLSSAKEAQLVEVLKKYKVAIGWHIFDLKGISPSYCMHKIMMKADYRLGKQSQRRLNPSMKEEVQKEVLKLLEARLIYLISDSAWVSLVQVMPKKGGMTMIHNEKNELIPTRTITGWRMCIDYHKLNDATRDDHFPLSFMDQMLEWLIRQAFYCFLDGYSGMPFGLCNAFATFQRCMLAIFVDQVEKCIKVFVDDFSVFGFSFDFCLSNLELVLQRKVLNDAQLNYATTEKELLAIVYALEKFRSYLIGSKIKDKKGCKNLVADHLSRLVNEEVTQEEQEIRDEFPDESLLSVSEWPWFAYIANFKVARIILDDLNWHQRKKFLHDAHCYVWDDPHLFKLGVDNLLKRYVTKEEARSILWHCHNSPYGGHYSGDRTVAKKVLGHYNVRHKVTSPYHPQTNDQVEVSNRELKKILEKTIASSRKAWVVKLDDAL

SEQ ID NO: 222061 - protein, 39 aa, Glycine max
  Coding DNA Sequence Number=SeqID_105283
MEVEGRDLLAEGRKASETEQARKRVWPTRPLSGSIAISR

SEQ ID NO: 222062 - protein, 122 aa, Glycine max
  Coding DNA Sequence Number=SeqID_105284
MEVDDGGQSLNIATIVDLQPLVIHYPAVLRVSRRGVHRLNYSIRLHIFDCEWARQLGLKLYKEKLELEVFLHKFPIMISFHFLLDSTKLRNLRASKPCAPSLLEDDKPSHKPSGMGTNQLGS

SEQ ID NO: 222063 - protein, 74 aa, Glycine max
  Coding DNA Sequence Number=SeqID_105285
MSVTMLLKEETYIEEASQTLYYSRTTRDHDQWPLVMQSYPPRALDRRLQEDWARDAREGPRVLMSLRVDFGPMG

SEQ ID NO: 222064 - protein, 224 aa, Glycine max
  Coding DNA Sequence Number=SeqID_105286
MRGTSFVVQVEGTSTWVVVTENKRGYISCESVLVKGTSTRLFKENKGGYIPCGSLLVKDFTRLKRNLKDHRPLGDWMSSCDLGNLQEGNITVAEYAAKFEELVRYFSHYQGKDGESSKCVKFLNGLQPEDEDSRDKAAYYRSTGPMKNKKNGSQNRDKPYLTPPKQYGPKATIRVFTLNGAEASKSKDLIQVEWRRRKGDWRRHFKENMSQEQAHHHRKSWIRA

SEQ ID NO: 222065 - protein, 83 aa, Glycine max
  Coding DNA Sequence Number=SeqID_105287
  Gene Ontology: Mol. function=RNA-directed DNA polymerase activity; Biological process=RNA-dependent DNA replication
MSELTLRSSRLSRVDEVIYGLVDTRTQVCGLLIKFQPCFPNMARLNPWRLQNPIPPNFFFTESLSQLSQFIPLVDAPFDPPPK

SEQ ID NO: 222066 - protein, 106 aa, Glycine max
  Coding DNA Sequence Number=SeqID_105288
MFMKGITNDCRRMIYASTEGNYFNKTTTQVKTIIEDLAASERTVETNWSNPLKEAFTKFPKVVITNHKSAEAVIKSMETQIGQLAKQLQTSSIGFSASTEENPNGH

SEQ ID NO: 222067 - protein, 72 aa, Glycine max
  Coding DNA Sequence Number=SeqID_105289
MVSIEDSSSRESVRGEHEVGESIVAPTLVAVAEVAASRPKKCSTLKEKCFPSPITFLEYMWVDEEVGTYFSQ

SEQ ID NO: 222068 - protein, 116 aa, Glycine max
  Coding DNA Sequence Number=SeqID_105290
MAAQEPTMSELAAGQGVKRYKALIRSCPNHGYSEYSQISKFTKGTTHECKRMVNASIGSNFLNKTTIVVKKIIEDLVASERNMDYGRTIPQKGIYQLNGQDKWLAIQQRTITKQMQ

SEQ ID NO: 222069 - protein, 55 aa, Glycine max
  Coding DNA Sequence Number=SeqID_105291
MEKVIEKNVKHEGEIVVSDASLETLASVRRGWWCCDSMSGWTTGGGVSEVCGGVV

SEQ ID NO: 222070 - protein, 245 aa, Glycine max
  Coding DNA Sequence Number=SeqID_105292
MKVIQVPKIDKSPIPWNKRRVVEFNVENGMKTLRITVNNEEKGASRIIKPFEKIEAVNKMKQTLAMIADLKVRGQAKTSLSQVVFALGHAFGNHSLVTTEISTGRPTKQELKHIENSLLEAWLNGNDLPDQNESLDGDMCSKETEWATLRNKENGGSTRRRKTSRGGVTLSFEAQDPLEEVNLGTNDEPRMTKDEYVMPIVDMLVDATAKHGVLTFMDGHSGYDQIFMVVEDMYKMALSWISWDI

SEQ ID NO: 222071 - protein, 181 aa, Glycine max
  Coding DNA Sequence Number=SeqID_105293
  Gene Ontology: Mol. function=RNA-directed DNA polymerase activity; Biological process=RNA-dependent DNA replication
MDQNSTKTMSQLAKEGKLISKIFLSKEKPYPHIRRYQPSQKIQVVSKYPLLFAVCQLERNSLTLELNLTPLSTLERIRHMEVKETQITIQLVDHSIRIPHGVVENMLVDVGKFSLLADFVIMGIEEDLDIPLILERPFMNTNNAIISIVEGNFKIRVDGEEITFDVFQAMQHREDKGASSK

SEQ ID NO: 222072 - protein, 50 aa, Glycine max
  Coding DNA Sequence Number=SeqID_105294
VKLKSITYNGLLISVDDVVVAVDGPIDGGGTRLDNSGSVGLFSGEKGEEG

SEQ ID NO: 222073 - protein, 100 aa, Glycine max
  Coding DNA Sequence Number=SeqID_105295
MVWELMHRGGTGLERKKLTNPTVPFENSVRDGRVVSSFPVKISPPLWCLFRTTAAITVPRAASCRGAMHRWHRGGVPPSVVAYPIGALFGKLGHLGLFQL

SEQ ID NO: 222074 - protein, 140 aa, Glycine max
  Coding DNA Sequence Number=SeqID_105296
MPSRLFCQIDNRYSNGNYYVIEGGGDLYKRGFMTPLLKCLSRDQSTIGETPFRLSYGSDAMILVEVRESSLQNINFIEKENNEMHSESLDLAEETIKEVHMRAKLYQRRVEKKMQQLSQADKLLGKRLGTKEMWKSQEIY

SEQ ID NO: 222075 - protein, 72 aa, Glycine max
  Coding DNA Sequence Number=SeqID_105297
MQHKPKVQKASAKERNSERSEHRRDGGTGWQWQNNDNIGKCEKKKWEKNGKQKREEAKAGRMNINKGAGHVD

SEQ ID NO: 222076 - protein, 214 aa, Glycine max
  Coding DNA Sequence Number=SeqID_105298
  Gene Ontology: Mol. function=nucleic acid binding
  Homolog annotation: Hit_ID=Q2HSY3; Match level="QueryCoverage=66%, HitCoverage=64%, E-value=2e-16, Identity=32%"; Hit description =Nucleic acid-binding, OB-fold
  Pfam annotation: Domain name=DUF223; Domain location=39-135; Score= -2.8; E_value=0.0052; Accession=PF02721.5; Description=Domain of unknown function DUF223
MSRKENLISELHTRKGTWKIVVRITDLWQARKQNSKQTIEMVLIDQTGSKIGATLWQELFTELRDKLQCGSSYLIQNLRIVDNQSEYRVSPAPYLVYFLKTTSVKEIHRPEIPSNIYLITPFRDIISGLAPRHTLVDIVGVVADFIDVKTDNPPHRMTVRLRDNSNCDILITVWEDYAIQLDDAIDKNLMLQEPLVVMLTLGKIKDATSVSGVG

SEQ ID NO: 222077 - protein, 64 aa, Glycine max
  Coding DNA Sequence Number=SeqID_105299
MEGGCQGLRVRLSKCNRRHEANRVRYRKRRAKWGRPKQFTGLKFSSNPTSLENGPCKPVGPDPV

SEQ ID NO: 222078 - protein, 185 aa, Glycine max
  Coding DNA Sequence Number=SeqID_105300
  Gene Ontology: Mol. function=nucleic acid binding; Cellular component= chromatin; Biological process=DNA integration
MDNQPEEDKVHTRNSLKHTMLLSKIKPKHIDDELPKGKSVVEARWVFRNKLDEIGKAKGYLQQEGVDYTKTFALVARLEAIRILLPFVAHHGMMLYQMDVKSTFLNGLIKEKQKDKGIYIHQTKYMKELLKKFKMDDTKPMKTPMHQTIVLGLDEDSKQILLEIKWKERAPVKDVTSLVDAWFLG

SEQ ID NO: 222079 - protein, 156 aa, Glycine max
  Coding DNA Sequence Number=SeqID_105301
SRLPQRSFEMMDWGKFFHQILEEDYEDSALIKMFLLVWGFGGKQRQLMAATGGRGGGEGGVRVWVASGEEKRVKIHDSLCTKSRSAGQFSLSTIPSRVGIALSVPFAGVTTWTLGSLSFIITSATRMLIGAGLSGVAWTTWGWFYFLAIVLGLGDF

SEQ ID NO: 222080 - protein, 275 aa, Glycine max
  Coding DNA Sequence Number=SeqID_105302
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=93%, HitCoverage=16%, E-value=7e-79, Identity=55%"; Hit description=Chromo
WEEEDEPALQPGPPDEVLVGNGNALTVEGLIQDLEVKIQGHTLKLPVHLLPVSGADLVLGAAWLAIIGPHLSNYSTLTLKFYLGNQFITLHGERPSLPQQAQFNHMRRMQHTHAIAKLLTLQYSRLDGPQDPLLDIPVDMEPELVMILYTYRLVFDVPSGLPPSRTHNHSILLVEGVGPVKVKPYRYPHSRKNQIEVMIVDMLKEGIIAPSASSFSSPIILVKKKDDTWRFYTDCRALNAITIKDSFPIPTVDELIDELHGAVYFSKLDLRSGYH

SEQ ID NO: 222081 - protein, 131 aa, Glycine max
  Coding DNA Sequence Number=SeqID_105303
MQVRQALLKITGYGMNGKQTMFAFALAPSTSVVVFASIPPVEIMDCIVELVEAKLHDESRMIQRCFDDNKGDDKNLKGQSKNEFKMYKIESRKNEFKMFKIESRTLQDSRIKLPRIKIKIQDSRFKNQEKT

SEQ ID NO: 222082 - protein, 89 aa, Glycine max
  Coding DNA Sequence Number=SeqID_105304
MPRPCFFFFFLIFLLNFTKSFQYMKVEPLSLVSSSLFIGNEGTWLIYSFPRRAGYFTPKLFGGPGEPEASRATGVKQLNSANKNQNVSK

SEQ ID NO: 222083 - protein, 47 aa, Glycine max
  Coding DNA Sequence Number=SeqID_105305
  Homolog annotation: Hit_ID=Q9FJF3; Match level="QueryCoverage=91%, HitCoverage=5%, E-value=1e-09, Identity=70%"; Hit description=Serine protease-like protein
MSHYDILESYVGSTEKALEAIFYSYKRYINGFAAILDEDEAANVSSM

SEQ ID NO: 222084 - protein, 621 aa, Glycine max
  Coding DNA Sequence Number=SeqID_105306
  Gene Ontology: Mol. function=identical protein binding; Cellular component=cytoplasm; Biological process=negative regulation of enzyme activity
  Homolog annotation: Hit_ID=Q6WNU4; Match level="QueryCoverage=99%, HitCoverage=79%, E-value=0.0, Identity=53%"; Hit description =Subtilisin-like protease
  Pfam annotation: Domain name=PA; Domain location=222-325; Score=99.1; E_value=1.3e-26; Accession=PF02225.12; Description=PA domain
  Pfam annotation: Domain name=Peptidase_S8; Domain location=32-452; Score=7.1; E_value=3.7e-07; Accession=PF00082.12; Description =Subtilase family
  Pfam module annotation: Pfam domain module=PA::Peptidase_S8; Domain location=222-325::32-452
VWPESKSFSDEGFGPIPKRWRGICQTEDKFHCNRKLIGARYFYKGYEAGSGIKLNASEVSVRDYEGHGSHTLSTAGGNFVAGASVFGFGNGTASGGSPKARVAAYKACWPDTFFGGCFDADILAAFEAAISDGVDVISMSLGSEDPPEYFQSSISIASFHAVANGITVVGSGGNSGPSPGTVSNNEPWMLTVAASTTNRDFASHVTLGDKKILKGASLSEHHLPSNKMYPLISAVDAGTKYAAVNDTPFCLNKTLDPEKVKGKILVCLRGVNGRIEKGVIAASLGAVGMILANDKDSGNEVLSDPHVLPTSHVNFASGSYIYNYINHTKSPVAYISKAKTELGVKPAPFVASFSSRGPNLLEPAILKPDVTAPGVDIIAAYTEAVSPTDEASDTQRTPYYAFSGTSMSCPHVAGLVGLLKAFHPDWSPAAIKSAIITSATTKGNNRRPILNSSFVNEATPFDYGGGHIRPNHAVDPGLVYDLNTADYLNFLCSRGYNSSQLKLFYGKPYTCPKSFSLADFNYPTITVPRIHPGHSVNVTRTVTNVGSPSMYRVLIKAPPQVVVSVEPKKLRFKKKGEKKEFRVTLTLKPQTKYTTDYVFGWLTWTDHKHRVRSHIVVNIQH

SEQ ID NO: 222085 - protein, 317 aa, Glycine max
  Coding DNA Sequence Number=SeqID_105307
  Gene Ontology: Mol. function=identical protein binding; Cellular component=cellulose and pectin-containing cell wall; Biological process=negative regulation of enzyme activity
  Homolog annotation: Hit_ID=Q1S4Q1; Match level="QueryCoverage=94%, HitCoverage=42%, E-value=6e-63, Identity=41%"; Hit description =Protease-associated PA; Proteinase inhibitor I9, subtilisin propeptide
GRRCWIDFGLDNSGLEILADLHLLPASNVGFVDGNYIYNYIRITKSPVACISRVKTELGVKSAPFVAPFSSRGPNPLEPTILKPDVTSPGTDIIAAYSEAISPIEQDSDKRRTPYITLSSTSMSRPHVAGLALLLKSLHPDWSPAAIKSAIITSATTVDNTRRPILDSTLVNEATPFDYGAGHIRPNRAADLDFSRLKLFYGKPYTCPKSFSLADFNYPAVTVAQLDPGHSLRVTRTVTNVGSPSTYRVHSKAPPQVAVPVKPRKRRFKKKGERKEFRLTLTLKPQTKNATDYVFGWLTWTDHKHHVMSPNAVNLEH

SEQ ID NO: 222086 - protein, 434 aa, Glycine max
  Coding DNA Sequence Number=SeqID_105308
  Gene Ontology: Mol. function=catalytic activity; Cellular component =cytoplasm; Biological process=ubiquitin cycle
  Homolog annotation: Hit_ID=Q6K6K7; Match level="QueryCoverage=79%, HitCoverage=83%, E-value=1e-134, Identity=70%"; Hit description =Putative Ubiquitin activating enzyme
  Pfam annotation: Domain name=MoeZ_MoeB; Domain location=265-355; Score=-18.3; E_value=0.037; Accession=PF05237.3; Description =MoeZMoeB domain
  Pfam annotation: Domain name=ThiF; Domain location=121-259; Score =149.0; E_value=1.3e-41; Accession=PF00899.11; Description=ThiF family
  Pfam annotation: Domain name=ketoacyl-synt; Domain location=123-315; Score=-98.7; E_value=0.054; Accession=PF00109.16; Description=Beta -ketoacyl synthase, N-terminal domain
  Pfam module annotation: Pfam domain module=MoeZ_MoeB::ThiF::ketoacyl -synt; Domain location=265-355::121-259::123-315
MEVVLKELHADLQSLSQSLPDPSHHDLLRKVFLPLQFSLHIPIPSMKPKIPSCFAHENFIRLSDSVMIQLRVEDLAKLAEAAPVRRSKVEDMSAEVVDSNPYSRLMALQRMGIVDNYERIRDFSVAIVGVGGVGSVSAEMLTRCGIGRLLLYDYDKVELANMNRLFFRPDQVGMTKTDAAVQTLSDINPDVVLEASFETFMSSLKNKSLRPNKQGSGVDLVLSCVDNYEARMAVNQACNELSQTWMESGVSEDAVSGHIQLLIPGETACFACAPPLVVASGVDERTLKREGVCAASLPTTMGVVAGLLVQNTLKLLLGFGQVSPYLGYNSLKDFFPTMQMKPNPQCSNVACLERQEEYMLAKPARDAAAKAKMEAEAPSTEEVPLHEENEWNISVVDDIELDSPDTRSSDNSRSKKCWHLNLHGPIFCGLEQLG

SEQ ID NO: 222087 - protein, 203 aa, Glycine max
  Coding DNA Sequence Number=SeqID_105309
  Homolog annotation: Hit_ID=Q1PEH3; Match level="QueryCoverage=38%, HitCoverage=29%, E-value=1e-16, Identity=59%"; Hit description =Cytidine/deoxycytidylate deaminase family protein
  Subcellular localization annotation: CTP_CleavageSite=12; ConfidenceScore=5.28e-01
DNLNPEPATCPKSNRVGVHSFSMNNCDWRLGFRNRFSLLLPFLTARQILAKRHRFLSPRPCRLLQTQRVGACLVSQDGVILGIGYNGFPRGCSDDKLPWAQDWESFEDKVPVSVVSFVHSLLLIETLIIEVNAILNTNHASAAGQVSSTALSITLSLKFLMQVPLELVGLGSSSSMDSFASWEMNGSGMEKGRERGDATSRRR

SEQ ID NO: 222088 - protein, 49 aa, Glycine max
  Coding DNA Sequence Number=SeqID_105310
MGNVRIHWNRDMSKLNPYGYAQSQSMWIGYWAKPKLKVPCLTEDLVEEK

SEQ ID NO: 222089 - protein, 428 aa, Glycine max
  Coding DNA Sequence Number=SeqID_105311
  Gene Ontology: Mol. function=zinc ion binding; Cellular component =plastid; Biological process=peroxisome organization and biogenesis
  Homolog annotation: Hit_ID=Q9SR44; Match level="QueryCoverage=96%, HitCoverage=96%, E-value=1e-165, Identity=65%"; Hit description =Putative amino acid permease
  Pfam annotation: Domain name=Aa_trans; Domain location=31-415; Score =390.5; E_value=2.6e-114; Accession=PF01490.8; Description =Transmembrane amino acid transporter protein
  Pfam annotation: Domain name=Trp_Tyr_perm; Domain location=31-409; Score=-264.5; E_value=0.015; Accession=PF03222.4; Description =Tryptophantyrosine permease family
  Pfam module annotation: Pfam domain module=Aa_trans::Trp_Tyr_perm; Domain location=31-415::31-409
MSMNPEEQQHQCQIKWKEKDINDWLPITKSRNAKWWYSAFHNVTAVVGAGVLGFPYAMSELGWGWGVTILLLSWICTLYTAWQMIEMHEPEPGKRFDRYHELGQHAFGEKLGLWIVVPQQLMVDVGINIVYMITGGNSLKKIYDILCDDCEPIRRTYFIMIYACVQIVLSHLPSFNSIAGVSFAAAVMSVGYSTIAWITSLHRGVQQGVKYSSRFSSDAESVFGFFGALGTIAFGYAAHSVILEIQATIPSTPEKPSKIAMWRGMVVAYAVVALCYFPVGILGYWAFGNSVEDNILLSLEKPRWLIVAANIFVVVHVTGSYQVFGVPVFDMLESFMVKWMKFKPTWFLRFITRNTYVCEYAFPLSYKSTYRFLLPCIMWLVLYRPKIFSWSWCANWFCIVCGVLLMVLAPIGALRQIILEAKDYKFYS

SEQ ID NO: 222090 - protein, 834 aa, Glycine max
  Coding DNA Sequence Number=SeqID_105312
  Homolog annotation: Hit_ID=Q2QXB9; Match level="QueryCoverage=41%, HitCoverage=27%, E-value=4e-31, Identity=29%"; Hit description =Expressed protein
MFGHKRFSRFLLSLPRVQLRPGVEGFLAVHLVPSESPEPCESSSVASTMSGAKNKEKGCAATPKVNGEDKSKVKGADEKFSIAPIRERSSDDKSKPVQPSPSQGRSNEEYVDGESSSPVLVEKHVCQPPNKLQKSSVACDKVVDVANAQHSETQLPPKDNKDSETKMDSLKVTCQKSSVEDIVRCEDAGHKSMEKHTTSENHSAGNDQSMVEDNVIANYESGDFEAKNKCEDPTRMEVDEVVHSPSSSPVDGSPVVQTPGASPKTNNRTPTFFSWIRSWWPFGRSNEKYDDLIALQNKAVSHVEGSKLSELDQTVSQSEEPKLSELDQDVSHAEDSKLSELDQTVSQFEEPKLTVLDQTVSHSAKPELFSSASFWNNMESFIFAPKGSLLFSQSRSREDVVHKLQNGGPLVLRSLPKEDILQLVELLITEKKWLEENPSKTFPFKLIRPVQKKSSVNQSHDVNGLRSLFIGRTSQSNLQKSLEHDVEKHNQSIAHSQVSAPTMETKYTERSRNDILEDCKKLVSEMLREHPEGYNIGSFQRLFVDRYGYHLDIQKLGYQKLAALLQIMPGVKLESTYIFPSVPAVCDSDLETSILKTQATTDIHAASNSDSESSESAPKDDNMESLWCEVGPVSINNSDKSGLELKPSQKTIELDTSKSKHPDYEPVVSDDEFSASEGDDSCLTQSAQQRKPKCNEQDSSFWQAMDLWHSSKEEENSGKKSNNVDSLDISLAEILDSSTESTRDTLSQIPSSKYRENNGKKSDNVDSLDTSLADMFNSSSTESTTGTLSKIPSSNYREKQRSHKNYSFVADPVLPNKEKLVDDLKKADESKMQN

SEQ ID NO: 222091 - protein, 123 aa, Glycine max
  Coding DNA Sequence Number=SeqID_105313
MMPSPMLLPVPLPSSLMNNISTHNSILCCDFKDVNLSNQRGTSLLCSARRQIRYQDGDDADSDEEYGHNEQISKLESYSQSAKGEVLVVHALVDQEKLMCLSSRKMFPKKNLVATHLRGSHHA

SEQ ID NO: 222092 - protein, 236 aa, Glycine max
  Coding DNA Sequence Number=SeqID_105314
  Gene Ontology: Mol. function=two-component response regulator activity; Cellular component=nucleus; Biological process=two -component signal transduction system (phosphorelay)
  Homolog annotation: Hit_ID=Q8H7S7; Match level="QueryCoverage=91%, HitCoverage=32%, E-value=2e-70, Identity=59%"; Hit description =Putative response regulator 10
  Pfam annotation: Domain name=Response_reg; Domain location=12-125; Score=93.8; E_value=5.3e-25; Accession=PF00072.14; Description =Response regulator receiver domain
MAPAAAEFPVGLRVLVVDDDATTLKIIEQMSIRCRYRVTTCTEATVALNLLRERKGCFDVVLSDVHMPDMDGYKLLEHVGLEMDLPVIMMSGDSTTSAVMKGIRHGACDYLIKPVREEELRNIWQHVVRKFWNDSKEQDNSGSMEDSDQNKRGNDDAEYTSVADAAVVKAPKKRSSLKEEDIELESDDPAASKKPRVVWSVELHQQFVSAVNQLGLDSMNLLQYFLSIAFIFSFSN

SEQ ID NO: 222093 - protein, 415 aa, Glycine max
  Coding DNA Sequence Number=SeqID_105315
  Gene Ontology: Mol. function=two-component response regulator activity; Biological process=two-component signal transduction system (phosphorelay)
  Homolog annotation: Hit_ID=Q8H7S7; Match level="QueryCoverage=50%, HitCoverage=27%, E-value=6e-20, Identity=33%"; Hit description =Putative response regulator 10
  Pfam annotation: Domain name=SSDP; Domain location=128-361; Score= -97.2; E_value=0.03; Accession=PF04503.4; Description=Single-stranded DNA binding protein, SSDP
MTWVEVIARILQICSFFPFYFLEGHKFRLYLKRLTGVAQQQNGMLNTVPGPIESNLGTNGRFDVQALAAAGHVPPETLAAIHAELLGHPTNNIMSTVDQTTLLQASIQGLKHSHAGHAVAYGQPLVKCPSNIGKNFSPSILTVNDTSSGYGAWLSSNNTIGLVRPNNSVERVGIQNNNMLILEHQQRQQPQQKQQQQQQKQQQQLQQQSLIHDRSCSINVQPSCLVVPSQSSETFQAINSPASVNQDCSFAWNAIIDYSLLPQKSNNSFSASQFPGGDTKARGVLYGYTTPSSCSTSSSNGNIQQLQNSTLTFGAARPLPSLLPMTDRKDPYGFKSGDLLDQVCFRNLGFVGKDSCIPSRFVENEIESSVSDFTQMKVNVDISGNRQKEEPNIPKVSHPIIERYPSRDHSSVFAE

SEQ ID NO: 222094 - protein, 161 aa, Glycine max
  Coding DNA Sequence Number=SeqID_105316
MGRDGLISGLNEKLERVTVHGWNNISICIGGTKPPEDVPFAREGARLRSRLSNPETHTEATTLVTLINLKRKPKNEREHHKIEEENQRRSELEARNERRDYELDFAPYFAMEKTNSPEMETSSLEKVREVLGEGASMTTKKCETCERLRVSIFPLSKWVKQ

SEQ ID NO: 222095 - protein, 87 aa, Glycine max
  Coding DNA Sequence Number=SeqID_105317
MIIIFPNGVVHALLLSKDLKLYEIIMTMASTLTYLPSLEVTSTQTYLPSPEVASTQTYLPSPEVASTLTYLPSPEVASSKNSTACIK

SEQ ID NO: 222096 - protein, 211 aa, Glycine max
  Coding DNA Sequence Number=SeqID_105318
  Gene Ontology: Mol. function=DNA binding; Biological process=DNA integration
MDQQTKKNGLKQVESSLGMFLSLMISLVATMLPTPSIGTTSTMMPTIELEARNAHVDENFASSMPRNPEVTNRASVNDYANHVLPTHAGLAKRPPNVVGPIGLPNVTSFVSPTRGVNKLKSMERPMYKKPYPEWVDCMIPLPKRYKTPYFSTFSGEDDKSTMEHISWLIYCSEWPQPKVTIADLMNMRKMVEKSKIDFIERFRKARSRYSM

SEQ ID NO: 222097 - protein, 1091 aa, Glycine max
  Coding DNA Sequence Number=SeqID_105319
  Gene Ontology: Mol. function=RNA-directed RNA polymerase activity; Cellular component=nuclear RNA-directed RNA polymerase complex; Biological process=electron transport
  Homolog annotation: Hit_ID=Q9ZRY7; Match level="QueryCoverage=96%, HitCoverage=97%, E-value=0.0, Identity=55%"; Hit description=RNA -directed RNA polymerase
  Pfam annotation: Domain name=RdRP; Domain location=513-858; Score =526.3; E_value=3.4e-155; Accession=PF05183.3; Description=RNA dependent RNA polymerase
MSKTIQMHGFQSNVSAEEVKKFLEKHTGHQTVHAVEVWQHKGDPTTHVDVQFTDRKSVETILLLVTQHLSYSDYVLNATEINHDIFPKPRNFPHRMDDIVVHFGCQTSKDKLSVLWEHPNVSVKFGSRLRKMYIFFNYLTMDYKLQISSESISRIELRHSDDLTKKFLLFQLRGAPMIYEKDVSKSKYFKEACDNHWFRGVDFTPSSSIGQSSTLCFELPQSIEVPKFNQHYRNYSEVDDSIFTLEKHLGFSSNFKFVPIVIPPEGFNLPYKILFKINSLIQHGCLPVLAIDINLFHLVDPRRVRLEYIESALHKLDQMKECCYEPAQWLEKQYNKYSTNSLVPLSSAISLDDGLVYVHRVQVTPSKIYFCGPEVNLSNRVLRNYPEDTDNFLRVSFVDEDMDKLHSADLVPRSSSTDVDRETKLHERVLSTLKNGIAIGDKKFEFLAFSPSQLRDNSVWMFASRTGLTASDIRKWMGEFHEIRNVAKYAARLGQSFSSSRETVSVGEHEIEIIPDIELRRGETKYCFTDGIGKISSELAQEVAKKCGCRDNNIPSAFQIRYGGYKGVVAIDPTSSTKLSLRKSMFKYKSENTKLDVLAWSKYKPCYLNRQIITLLSTLGVKDRVFRKKQREILNQLKMISTKPLMELQLKTRILVKKGRALLGCLDETRTLKYGEVFVQIAHQRNKQIHAMPSLSSNRYGGNKSKHIVKGKVVVAKNPCLHPGDVRILRAVDVPSLHHMVDCVVFPQKGRRPHPNECSGSDLDGDIYFVSWDPDLIPPHQENPMDHAPSQVMNVDHDVTLQEVQEYFAHYIVEDRLGIVASAHTVFADKDPEKAMSPACTELAKLHSIAVDFAKSGVPAEIPQHLRVEEYPDFMEKPDKPSYQSNSIIGKLYREVRNVAQHKNLNKTFTRRVARQSYDPDMEIDGFEKYTATACEYKNMYDFKLGNLMDYYGIETEAEIISGNILKMSKSFNERKDLEGINHAVMSLRKETRSWFNVMVNKSNSQGRDAYAIASAWYLVTYHPRYWGSYNQGLNRGHFLSFPWCVHDTLIQIKKDKDKLMYLKITVESNSEEPIIFRAMLLFRILEVAWI

SEQ ID NO: 222098 - protein, 159 aa, Glycine max
  Coding DNA Sequence Number=SeqID_105320
MVKKFGKFLKKSEDRKFSKSSKKIESNNNNFKCFKCEAQRLVVLKNKLKSDLRKYIPKLASIESELDKLKQENEKLVSSYKATDCDCSCTSFNMDDYMFLQTKLENFKKDHYAESLKLQTELSYLTDLFGKLNKEKSDLNHMLSVQKHTTDKIGLGYNK

SEQ ID NO: 222099 - protein, 185 aa, Glycine max
  Coding DNA Sequence Number=SeqID_105321
  Pfam annotation: Domain name=DUF1723; Domain location=62-98; Score =9.0; E_value=0.043; Accession=PF08330.1; Description=Protein of unknown function (DUF1723)
MSTTNNSQSRPNKYGDGSNDESSSSSSSFSNNQDDQEHPVALGGFINFLKAHTGHFYLPPYADDSIAMNTFVFPFGFMIITLLDVATILGLPIDPTLGNSLQIKFTTSGLAHFFIEAIFGILDYVGALWNLPTVDHVFLDWLKMDPLGNLEAKLSQPTHRREGDARLTGASSKEGKYAESPPTFI

SEQ ID NO: 222100 - protein, 187 aa, Glycine max
  Coding DNA Sequence Number=SeqID_105322
MKNVHGIDHGNITEALQNLPCPSIAKIGEKVAAQLAQASCCFLQKKLTVAPSQTHKRLKVGSISTPIHSLASSAPVVSDGYLIDDHFSHVEQFMSVDVPFYLAMLKSIRLSFAKLAKAPTISNATRQLLNHIRMTIADLIFNHNMHQRRYHFVVANLEQLRQLQTQKSTYTANFQATRAERQADLVK

SEQ ID NO: 222101 - protein, 108 aa, Glycine max
  Coding DNA Sequence Number=SeqID_105323
MKARGQEETLVSQIALALNQAFNKHMSVTIEKSIILTDSANHTPVEMMDACEKIDQAPEDKEEENGGAILDIMSLTTLKKLGRGDLGILQFDQEVVHHKLTSRSTTIN

SEQ ID NO: 222102 - protein, 242 aa, Glycine max
  Coding DNA Sequence Number=SeqID_105324
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=100%, E-value=1e-24, Identity=27%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RTTRPRHQRAARPRHRGLHVLAFIGLYALTFRGLYVLAFRGIHVLAFIGLYVIAFRGLYVLAIRGLHVLTFKGLHALAFRGLHVLTFRGLHVLAFKGLHTLAFRGLQAHDFRVLHVLAFRGPHRTAPPRLQKAARPRLKGLHVLAFRRLHALAFRGLHALAFRGLHVLAIRGLHVLPFQGLHALALRGLYVLLFRGQHTLAFVGLYGLTFRGLYVLPFRGLHVLAIRGLHALALEDYTSSPS

SEQ ID NO: 222103 - protein, 197 aa, Glycine max
  Coding DNA Sequence Number=SeqID_105325
  Homolog annotation: Hit_ID=Q5XM22; Match level="QueryCoverage=58%, HitCoverage=89%, E-value=2e-18, Identity=38%"; Hit description =Resistance-like protein HAAS-2
MLDDVSSLLHLPVIGDLRAFEPLHVDDAVQMLVDLLMVSAESARAETAQCRGPYIRLQWVHDIYERRCQAGHWAAASATNVHVVYLEALRDLSMMERYAWGVAALVHMYDQLNDASMSHSRQLGGYITLLQCWIYEHFLSVTDSTADQEYDEDSPRACRWIATKKTVKSIRTPSYREHLDRLRISDVCWIPYGEHRE

SEQ ID NO: 222104 - protein, 71 aa, Glycine max
  Coding DNA Sequence Number=SeqID_105326
MNAKRREYMVGVLSKRRILMRHGELQGNRDTTTYSTIFDHNIQSTVQGMAQVLCIGKHLHRVIGSNGCSPN

SEQ ID NO: 222105 - protein, 95 aa, Glycine max
  Coding DNA Sequence Number=SeqID_105327
MPPLPQTFRVNVDGSFLPDLGNIGSDGIIRDCSCNWLSSFRAYNGIGDVVKAEILGLHTSREANLMAHSLVALGVHQGLPLCTSLANLLVKDSHV

SEQ ID NO: 222106 - protein, 51 aa, Glycine max
  Coding DNA Sequence Number=SeqID_105328
MHRGLVGAGNVSCVGRRKAKGRMGEGGVHSGSGRKVARKNARASGIVNEKL

SEQ ID NO: 222107 - protein, 48 aa, Glycine max
  Coding DNA Sequence Number=SeqID_105329
MGLRRWDRWTNSVRDGRNMEGEASLTYASSFSKVVSKGDDKLKIVYTS

SEQ ID NO: 222108 - protein, 77 aa, Glycine max
  Coding DNA Sequence Number=SeqID_105330
MINSVQDFGGYRGNVLKNIGCIDVPSIGSCWICRKIDQSQLAIFVFNRQGLRILVELLMSELGGSEKRWQSPPRVLK

SEQ ID NO: 222109 - protein, 384 aa, Glycine max
  Coding DNA Sequence Number=SeqID_105331
  Gene Ontology: Mol. function=succinate dehydrogenase activity; Cellular component=membrane; Biological process=electron transport
  Homolog annotation: Hit_ID=Q6D5S1; Match level="QueryCoverage=98%, HitCoverage=39%, E-value=1e-144, Identity=67%"; Hit description =Putative NADH:flavin oxidoreductase
  Pfam annotation: Domain name=FAD_binding_2; Domain location=1-363; Score=175.1; E_value=1.7e-49; Accession=PF00890.14; Description=FAD binding domain
SKELFYEETLKGGKFKNNPVLLREFVERAPEAIEWLAAKDIELSDITITGGMSIDRTHRPEDRSAVGGFLISGLVKNVNQRNIEVLLETSVAEILFENGAVTGVKVVDEYNDSRILNAKSVIVATGGFSANREMVVKYRPELDGFVTTNHKGATGSGIAMLQKIGAETVDMGEIQIHPTVEQTTSYLISEAMRGGGAILVSQAGKRFYNEMETRDKVSAEIIALPEKSAWIVFDEQVRANNKAADEYIAKGFVISAPTPHELAVKLNMDQETLQSTLGRYNEFVINQKDEDFGRATALRHPLNQGPFFAIRIAPGVHHTMGGVTINTETAVLDAQKQVIPGAWAAGEVVGGIHGANRIGGNAVADIIIFGIKAGRNAAKLALGN

SEQ ID NO: 222110 - protein, 321 aa, Glycine max
  Coding DNA Sequence Number=SeqID_105332
  Gene Ontology: Mol. function=RNA binding; Cellular component =membrane; Biological process=thiamin biosynthetic process
  Homolog annotation: Hit_ID=Q6D5S0; Match level="QueryCoverage=97%, HitCoverage=97%, E-value=3e-92, Identity=57%"; Hit description =Putative thiamine biosynthesis protein
  Pfam annotation: Domain name=ApbE; Domain location=1-299; Score =183.6; E_value=4.8e-52; Accession=PF02424.6; Description=ApbE family
MTSDAGVHSYSAVLMGSPILLKLFEDNPTLASQVFRLIKQQENLFTVNRAESEVMAINHAAGRHPVVVSAPVFALISVAHAVSILPDSAFNFTIGPVVKRWKIGFQGREVPPAAEIEALLRLTDPHQVVLDAEQHSVFLPLPGMEIDLGAIAKGYIADVVQAFLRQQGVAQALINLGGNVQTLGSPPHQPQGWGIGLKKPFGRDDELLGTLQVQGKSVVTSGIYERYFERDGRCWHHIFDPRTGYPLDNALLSVTVIADRSLDGDIYTTLLYGMGVEQGLAYLAGQPDIDAVFVTRDRQIICSPARHFRFSQLDFSWQLRH

SEQ ID NO: 222111 - protein, 371 aa, Glycine max
  Coding DNA Sequence Number=SeqID_105333
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q8ZKD8; Match level="QueryCoverage=96%, HitCoverage=69%, E-value=1e-119, Identity=60%"; Hit description =Sensory histidine kinase in two-component retgulatory system with DcuR
MAAIRGAEADFRLIVISGLQNIGFYLRIIFHVQQAEDHMQLIHELVRALTQGINIVYHAGQTLHQLADFGLVPEGADRADNASLTAHRHGVAQQQSAIDVELLIAPCATAVEHFLQMLVDHRGIINARGTHHAAAHFIAQQLARRLIDQRHLALIVHRHHAFLDGVKDRLALLKQGGNFVWLEAEQDTLQHAHQNEGANRAGKSADQNGPQNAPATLVDLVGDRLQRDADSHHANLPLLGVIHRGKHAQRFGQRALIHGDILVAAQRRFDVRADKVFAHQLRITVRIADAIHVGDADKQQMVALFHRFGDGLDSGPIGRQAQRLLNFGGFRQRARYRHGFILQLAARRGANLEEIKHVYAQQHQHNHRAEH

SEQ ID NO: 222112 - protein, 488 aa, Glycine max
  Coding DNA Sequence Number=SeqID_105334
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q8ZKD8; Match level="QueryCoverage=98%, HitCoverage=88%, E-value=1e-175, Identity=64%"; Hit description =Sensory histidine kinase in two-component retgulatory system with DcuR
  Pfam annotation: Domain name=HATPase_c; Domain location=374-481; Score=111.3; E_value=2.9e-30; Accession=PF02518.16; Description =Histidine kinase-, DNA gyrase B-, and HSP90-like ATPase
  Pfam annotation: Domain name=PAS; Domain location=166-268; Score =41.8; E_value=2.3e-09; Accession=PF00989.14; Description=PAS domain
  Pfam annotation: Domain name=PAS_4; Domain location=172-273; Score =30.7; E_value=5.2e-06; Accession=PF08448.1; Description=PAS fold
  Pfam module annotation: Pfam domain module=HATPase_c::PAS::PAS_4; Domain location=374-481::166-268::172-273
MAVARTLAKSPEIQQALRLPPDRAAIQPIAKAVEESNHLLFISITNMDGIRYSHRNPELVGKHFIGPDIEPALRGNENVSVNQGSLAKSLRVFTPVYDAQQRQIGVVAIGISLEAVTDQINQSRWSILWTILIGTFAGAVGTFILVRVLKRILFGLEPYEISTLFEQRQAILNSVKEGVVAMDDQGEVTLVNQAARQLLSDKMGSSVVSTARIYDASVIDQHLQEVLNGGRARRDEELNVNGRLLLSNTVPVRSQGRIIGAVCTFRDKTEISQLMQRLTGMVNYVDALRERSHEFMNKLHVILGLLHMKNYAQVEAYILKTANNYQTEIGFLLEKIKSPVIAGFLLSKINRASDCGHRLTISDASYLPDSGNEQQMAALITVVGNLVENALDAMSEQTEGEIHVMLHYQNGWLTCEVSDDGPGIAPQHLATVFDKGFSTKGEDRGVGLFLLKQQTEHLGGSVSVESEPGVFTQFLVQLPWDGGTKPHD

SEQ ID NO: 222113 - protein, 211 aa, Glycine max
  Coding DNA Sequence Number=SeqID_105335
MAKCLTVAVEASSSQFTFFNGRLDMMSDGESGVCKINSNGEVMLKAQQPTNFLSLISAHQFASAGNEDPYTHLSTFYEQYGTMGIPKGEEEVVYLRLLPLSLTGKAKAWLQSHPNQSLTSWSIVEEKFLIDFSLHLDVAQLSIFCNDLKPKFRLNQSKLHPQIPLVGLAWLKTTIALSTLISCLARDLDIDALPDSSVALSAFSGGCALAH

SEQ ID NO: 222114 - protein, 55 aa, Glycine max
  Coding DNA Sequence Number=SeqID_105336
MALLHLRSMCAWLRRHLLKLFMIELMLKERLKGGRALGIISSRKKEVAKQKGEKK

SEQ ID NO: 222115 - protein, 84 aa, Glycine max
  Coding DNA Sequence Number=SeqID_105337
  Gene Ontology: Mol. function=transferase activity, transferring hexosyl groups; Cellular component=integral to membrane; Biological process=metabolic process
  Homolog annotation: Hit_ID=Q1STE0; Match level="QueryCoverage=98%, HitCoverage=21%, E-value=5e-22, Identity=53%"; Hit description =Aldehyde dehydrogenase
MTAGVPMVTWPIFADQFFNEKLGDSIACDAVEKAVKRIMIGEEAIETRNKAKVLSHLARQSIEEGGSSYSDLKALIEELSSLSH

SEQ ID NO: 222116 - protein, 479 aa, Glycine max
  Coding DNA Sequence Number=SeqID_105338
  Gene Ontology: Mol. function=transferase activity, transferring hexosyl groups; Cellular component=integral to membrane; Biological process=metabolic process
  Homolog annotation: Hit_ID=Q1STE0; Match level="QueryCoverage=99%, HitCoverage=97%, E-value=1e-156, Identity=56%"; Hit description =Aldehyde dehydrogenase
  Pfam annotation: Domain name=UDPGT; Domain location=21-469; Score= -77.3; E_value=1e-06; Accession=PF00201.9; Description=UDP -glucoronosyl and UDP-glucosyl transferase
MSNEVRSLHVFFIPFLAHGHIIPTIDMAKLFAGKGLKTTIITTPLNVPFISKAIGKAESESNDNNVIHIETIEFPYAEAGLPKGCENTNSITSMHLYPAFFKALGLLQHPFEQLLLQQHPNCVVADVMFPWATNSSAKFGVPSLVYDGTSFFSICANECTRLYEPYKNVSSDSEPFVIPNLPGEITMTRMQVSPHVMSNKESPAVTKLLEEVKESELKSYGMVVNSFYELEKVYADHLRNNLGRKAWHVGPMFLFNRVKEEKAHRGMDASINDEHECLKWLDTKEPNSVVYVCFGTTTKLTDSQLEDIAIGLEASGQQFIWVVRKSEKDGVDQWLPDGFEERIEGKGLIIRGWAPQVLILEHEAIGAFVTHCGWNSILEGVVAGVPMVTWPIAYEQFFNEKLVAEILKIGVPVGAKKWAAGVGDTVKWEAVEKAVKRIMIGEEAEEMRNKAKGFSQLARQSVEEGGSSYSDLDALIAEL

SEQ ID NO: 222117 - protein, 229 aa, Glycine max
  Coding DNA Sequence Number=SeqID_105339
  Pfam annotation: Domain name=GerE; Domain location=137-194; Score =52.7; E_value=1.2e-12; Accession=PF00196.10; Description=Bacterial regulatory proteins, luxR family
  Pfam annotation: Domain name=Sigma70_r4; Domain location=136-184; Score=6.6; E_value=0.053; Accession=PF04545.6; Description=Sigma-70, region 4
  Pfam module annotation: Pfam domain module=GerE::Sigma70_r4; Domain location=137-194::136-184
MKKHSEDILYYSSDKLAALGLESLLTALPVGCRAHELWSLSTVISQCEKLRPRLLVFIFHENMPLSGTFKVLYALQQQFPAMQVLVLTRRLLPMMHALSRYLPGLSVLDLKSSHTALCRCLLACIAGGIPQLQEGADILLPDRQLRVLLMLAWGYNTEQIGNRLGISHKTVNAHKLNALTRLQVKSKNDMADLFMVIDELRMLVGWLRLHRNGKLSDLAYHSLEELLEA

SEQ ID NO: 222118 - protein, 80 aa, Glycine max
  Coding DNA Sequence Number=SeqID_105340
MPNPAKFITETSISRLARVTSTNWGNKARVNGGVGIECELLRCLLEWTFVFIFAMNLDVSLPPSLQEKQHSTLVIWEQLH

SEQ ID NO: 222119 - protein, 96 aa, Glycine max
  Coding DNA Sequence Number=SeqID_105341
MEEEKGVPNYDELTCKGERAAWFKLGLRFSSSAAKDDVPKPSSSFLSKFVKASSESKKQAQLQSIHDNLKKSLLLSLGFRAGIGTTIEVEDEVGAE

SEQ ID NO: 222120 - protein, 194 aa, Glycine max
  Coding DNA Sequence Number=SeqID_105342
  Homolog annotation: Hit_ID=Q1SP02; Match level="QueryCoverage=92%, HitCoverage=38%, E-value=8e-25, Identity=37%"; Hit description=IMP dehydrogenase/GMP reductase
MYEHLNDASQASTRQLGGYITLLQCWIYEHFPTMHTSVVHDAYDEGSPRACKWLTGKAHMTGIKGAPYRRRLDALTVTDVCWMPYGEHRGVRGFDLISSYTGQLRWGQIVVYVRPERVLRQFGYLQTVPPPPVCDSLTGDDIDDQWLHFSDHLLPSGELCVVPGQVAPDYMEWFFRISHPFFTRTEETAASRHA

SEQ ID NO: 222121 - protein, 324 aa, Glycine max
  Coding DNA Sequence Number=SeqID_105343
  Gene Ontology: Mol. function=protein-tyrosine kinase activity; Cellular component=integral to membrane; Biological process=protein amino acid phosphorylation
  Homolog annotation: Hit_ID=Q2HVC0; Match level="QueryCoverage=93%, HitCoverage=36%, E-value=1e-120, Identity=70%"; Hit description =Protein kinase
  Pfam annotation: Domain name=Pkinase; Domain location=1-295; Score= -30.2; E_value=9.2e-07; Accession=PF00069.15; Description=Protein kinase domain
  Pfam annotation: Domain name=Pkinase_Tyr; Domain location=2-293; Score=-80.2; E_value=1.5e-07; Accession=PF07714.7; Description =Protein tyrosine kinase
  Pfam module annotation: Pfam domain module=Pkinase::Pkinase_Tyr; Domain location=1-295::2-293
MGEDSYGKMYRGQLKNGSLVAIRCVEMKKRHSTQNFVQHIELISKLRHRHLVSAIGHCFECSLDDSSVSKVFLVFEYVPNGTLRNWISDEHARKSFSWTQRIGAAIGVAKGIQFLHTGIVPGVYSNDLKIEDVLLDQNLVAKISSYHLPLLSNMGKVRRGNSSSGLKNSSNSKSVKQEDKSDIYNFGVILLELILGRQIKTVNDADAFRDLFSLSIFNINHVQFYDPASVNCIMRQLQASLGGDEEGRRGVVDPAFRKACLDQSLKTMMEICVRCLVKEPADRPSIEDVLWNLQFASQVQDAWRGDSQSSEGSPGSESRGLPFH

SEQ ID NO: 222122 - protein, 61 aa, Glycine max
  Coding DNA Sequence Number=SeqID_105344
  Gene Ontology: Mol. function=transferase activity, transferring glycosyl groups; Biological process=metabolic process
  Homolog annotation: Hit_ID=Q60FE9; Match level="QueryCoverage=87%, HitCoverage=11%, E-value=1e-12, Identity=75%"; Hit description=UDP -glucose: chalcononaringenin 2'-O-glucosyltransferase
MINFQDKKGLIIRGWAPQVLILEHEVIVGISDTLWIGFNVGSNNCWGANDHLACGCKAILQ

SEQ ID NO: 222123 - protein, 296 aa, Glycine max
  Coding DNA Sequence Number=SeqID_105345
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=68%, HitCoverage=25%, E-value=9e-52, Identity=69%"; Hit description=Chromo
MAIEGMVRDLPVTMQGHKLVLPVYLLVEQFYVNGNLLHCKESSLPSLLSLNTIISKGSKLVKVKPYRYPDSQKEQIEKMVKEMLQQAFGIGSPNSTATHLICQIVKMLIWLNRGFLGLIGYYRRFIKSYASIAAPLTNLLKKDGFMWDDTVGQAFTKLKQAITSAPVLGLPNFSQIFVFETDALGSGVGVVLSQDGQPIAFFSKKLIPKMQKQSAYAREFLAIIEAIAKIRHYLLGHRERNLATDTLSKVMLMARSEPHCLLQPLPIPSQVWEDITMDFITGLPLSFGYCHHGGRG

SEQ ID NO: 222124 - protein, 172 aa, Glycine max
  Coding DNA Sequence Number=SeqID_105346
  Gene Ontology: Mol. function=transferase activity, transferring hexosyl groups; Cellular component=integral to membrane; Biological process=metabolic process
  Homolog annotation: Hit_ID=Q1STE0; Match level="QueryCoverage=99%, HitCoverage=35%, E-value=7e-60, Identity=66%"; Hit description =Aldehyde dehydrogenase
MGLEASGQQFIWVVRKSIQEKGEKWLPEGFEKRMEGKGLIIRGWAPQVLILEHEAIGAFVTHCGWNSTLEAVSAGVPMITWPVGGEQFYNEKLVTEVLKIGVPVGVKKWTRFIGDDSVKWDALEKAVKMVMVEEMRNRAQVFKQMARRAVEEGGSSDSNLDALVRELCSLSH

SEQ ID NO: 222125 - protein, 116 aa, Glycine max
  Coding DNA Sequence Number=SeqID_105347
MARTKKSSQMMSEEAKKNADKIVNSLEEHASQGSFVTHGCQDALTAAIGRPEHLSRVYSAGVGVTIKHYFGPASRGTHTSLSMAPEDLEQLTQKIKDRLEDSITQKMTQQLMMFLS

SEQ ID NO: 222126 - protein, 705 aa, Glycine max
  Coding DNA Sequence Number=SeqID_105348
  Gene Ontology: Mol. function=endopeptidase inhibitor activity; Cellular component=membrane; Biological process=aromatic compound metabolic process
  Homolog annotation: Hit_ID=P76578; Match level="QueryCoverage=92%, HitCoverage=39%, E-value=0.0, Identity=65%"; Hit description =Hypothetical lipoprotein yfhM precursor
  Pfam annotation: Domain name=A2M_N; Domain location=281-544; Score =283.2; E_value=5.2e-82; Accession=PF01835.9; Description=Alpha-2 -macroglobulin family N-terminal region
MKPFRLAALSLALLTALSLSGCDNSGEPQAVSAADKGAADSAKKPDSAQLATLKEKSQGKALTLLDASEVQLDGAATLVLTFSIPLKPDQDFSHSVHLVDKKSGKVDGAWELAPNLKELRLRHLEPKRELIVTVDPTLIALNDATLGSSFEKTIATRDIAPSVGFASRGSLLPGKVVAGLPVMALNVDNVDVNFFRIKPESLSAFVSQWEYRNSLSNWESDELLKMADLVYSGRFDLNPARNTREKMQLPLGDVAALKQPGVYLAVMKQAGTYNYTQPATLFTLSDIGLSLHRFPTQLELFTQSLASGDPLADVSLQLLDEKGQQLASGSSDSEGHLRLAANAKGKLLLATSKGQTSLIDLNRPALDLAEFPIDGPQGYDKQFFIFGPRDLYRPGETVIVNALLRDADGKPLPPQPVKAEVVQPNGEVAQTFVWQPENGVYQQRFALPASAMTGKWTLRINSGDNQPRSWPFNVEDFLPERMALSLKSNAQPLSPDANVTFDVEGRYLYGAPAAGNELQGQLFLRPAREAVAALPGYQFGDITEELKRSLDDVDEKLDDSGRLQLRVESSWAESHSPLNLILQASLLETGGRPVTRRATQAIWPAAALPGIRPLFNSESVYDYRTDRYNDEPTVPENSLAEFDVVYANAQGEKLAAQDLDVRLIHERRDYFWSFSDSEGWQSRYDEKDLQEEQQRISIAAGGSQK

SEQ ID NO: 222127 - protein, 65 aa, Glycine max
  Coding DNA Sequence Number=SeqID_105349
MKKSFNMIGAIDDSKETFKLGVQIVDLRFDQVREKSSHLEMVLMDGKICCHLDLVLLDNVIIAPL

SEQ ID NO: 222128 - protein, 492 aa, Glycine max
  Coding DNA Sequence Number=SeqID_105350
  Gene Ontology: Mol. function=4 iron, 4 sulfur cluster binding; Cellular component=nucleus; Biological process=regulation of transcription, DNA-dependent
  Homolog annotation: Hit_ID=P36979; Match level="QueryCoverage=63%, HitCoverage=92%, E-value=1e-153, Identity=79%"; Hit description =UPF0063 protein yfgB
  Pfam annotation: Domain name=NDK; Domain location=4-138; Score=313.4; E_value=4e-91; Accession=PF00334.9; Description=Nucleoside diphosphate kinase
MAIERTFSIIKPNAVAKNVIGAIYNRFESAGFKIVGAKMLHLTKEQAEGFYAEHKGRPFFDGLVEFMTSGPVVVSVLEGENAIQRHRDLMGATNPDNALAGTLRADYADSFTENATHGSDSAESAAREIAYFFAENEVCPPDVVQLCALVEPGSARALPENIMSEQIVTPSSASPVVVSPKNEKINLLDLNRQQMREFFVEMGEKPFRADQVMKWMYHYCCDDFEQMTDINKVLRGKLMQRAEIRAPEVAEEMRSSDGTIKWAIRVSDQLVETVYIPEADRATLCVSSQGFNRNLRVSEIIGQVWRAAKIIGAAKVTGQRPITNVVMMGMGEPLLNLYQRVPALDKLGDMIDVALAISLHAPNDTIRDDIVPINKKYNIEAFLAAVKRYIGKSNANQGRVTIEYVMLDHVNDSTEHAHELAALLKETPCKINLIPWNPFPGAPYGRSSNSRIDRFSKVLMEYGFTTIVRKTRGDDIDAACGQLAGDVIDRTK

SEQ ID NO: 222129 - protein, 194 aa, Glycine max
  Coding DNA Sequence Number=SeqID_105351
  Gene Ontology: Mol. function=penicillin binding; Cellular component =peptidoglycan-based cell wall; Biological process=peptidoglycan -based cell wall biogenesis
  Homolog annotation: Hit_ID=UPI00005F79D1; Match level="QueryCoverage =99%, HitCoverage=26%, E-value=4e-46, Identity=51%"; Hit description =COG4953: Membrane carboxypeptidase/penicillin-binding protein PbpC
MQQVNHLLAGHLPARGVPGDPRPATVSAVSICWPGGQPLPAGDENCRQRRYSWVLNQTVPPTLLAPGQEGVNGLRQRFWQNSKGLRVAADCPDAQSRERVMWPLPLEPWLPPGERRAQRLPPVDVTCPPLNQGDSAPLLVTGVINGQRVQPLPGRAGYAALVVFKRAAGGACCGKKQRLAGAARARSLSAGGDG

SEQ ID NO: 222130 - protein, 135 aa, Glycine max
  Coding DNA Sequence Number=SeqID_105352
  Gene Ontology: Mol. function=quinate dehydrogenase (pyrroloquinoline -quinone) activity; Cellular component=outer membrane-bounded periplasmic space; Biological process=quinate metabolic process
  Homolog annotation: Hit_ID=Q59086; Match level="QueryCoverage=91%, HitCoverage=19%, E-value=6e-32, Identity=54%"; Hit description =Quinate/shikimate dehydrogenase [Pyrroloquinoline-quinone] (EC 1.1.99.25) ...
  Homolog annotation: Hit description=(NAD(P)-independent quinate dehydrogenase)
MAENSARPGKGLSLWSVLFGLVLLAIGLFFAIGGGKLVALGGSWYFLIAGIVMLLSAIQFFRRKSSAVTLFILVFAGTLIWALYDAGWQFWPLVSRLMVPAGLMVLAFITWPALHVPAASDRGLHRQATAADPGR

SEQ ID NO: 222131 - protein, 151 aa, Glycine max
  Coding DNA Sequence Number=SeqID_105353
  Homolog annotation: Hit_ID=UPI00005F9183; Match level="QueryCoverage =42%, HitCoverage=86%, E-value=1e-17, Identity=57%"; Hit description =COG1198: Primosomal protein N'''' (replication factor Y) - superfamily II helicase
MREQPVNVFLTEQGQEVIRYALFYICWYGSYARYAALHFCYKRSAKRAASATSRYRKPSFDDVFRAIMHAPAGDQAVTVGTEIIYGTARLQHLQRLLAVGTAGQRGEMTLAVRAIEALFAVSERLLTVRAWGEHDDSGIVAEDRDKPDVTP

SEQ ID NO: 222132 - protein, 73 aa, Glycine max
  Coding DNA Sequence Number=SeqID_105354
  Gene Ontology: Mol. function=pectinesterase activity; Cellular component=cell wall; Biological process=cell wall modification
  Homolog annotation: Hit_ID=Q9FM79; Match level="QueryCoverage=91%, HitCoverage=18%, E-value=1e-17, Identity=65%"; Hit description =Similarity to pectin methylesterase
MCIFVFQNLVDKDADKRQAVALRVDGDKAVFYRVRLVGEQDTLLDNTGIHYFYRSYIQGSVDFICGHAKSLFH

SEQ ID NO: 222133 - protein, 173 aa, Glycine max
  Coding DNA Sequence Number=SeqID_105355
MGETHEVPNHNLADFEPCLGYATEGQAVGGIPLPNTLEGPQIHPQPQPLHFAVGRVPPAMVEWEKLDYLEERLRAIEGGEYYAFANLEELFLVPNIITPLKFKVLDFDKYKGTTCPKNHLKMYCRKMGAYAKDEELLIHFFQESLTGVAVTWYTNLEPSQVHSWKDLMVAFVR

SEQ ID NO: 222134 - protein, 100 aa, Glycine max
  Coding DNA Sequence Number=SeqID_105356
MALGSKRVLNPLMMKATYQLKTTPLFFKSFWTSSMDCHHQKGGDCRQRIKLNVLMMPKGYMFLKACQRVTCFSKLYSRQRNQRYSRWMIKTVSRVLGRVY

SEQ ID NO: 222135 - protein, 85 aa, Glycine max
  Coding DNA Sequence Number=SeqID_105357
MVGYVPSSFADLVFADERIEMGLKRGKFNHPAWTNEKTGANEEDEKEGETHAVTAIPIRPSSPPAQHHHYSANISHSHYPPPIYP

SEQ ID NO: 222136 - protein, 89 aa, Glycine max
  Coding DNA Sequence Number=SeqID_105358
NVYTDNHSGISARQRDSKVSMTDLVSAEDDVNLRMSTGLSTAIDEGRRMTIICLCVPSDTTVSEWQKGQYDRDCGAADKSKALAPTYPQ

SEQ ID NO: 222137 - protein, 89 aa, Glycine max
  Coding DNA Sequence Number=SeqID_105359
MVILRPLSFRGSESSGGRRQIMVILHTVLPSRGDRVRWRPETNYGHYAPFHPSPIVSDGTQRQIMVILCLVLTKRNEFDSIRMMLVVRC

SEQ ID NO: 222138 - protein, 132 aa, Glycine max
  Coding DNA Sequence Number=SeqID_105360
  Subcellular localization annotation: CTP_CleavageSite=72; ConfidenceScore=5.57e-01
MKCVFGQRFSTLEFGAMRSDCLVQFSSLTTFRSPMNCVFVQMSFTFEFGAMRSDCLMQFPFLTLLRSPMNCVFVHVSSTLEFGAMRSDCLVQFSILTLFRSPMNCIFVHVSSTFEFGAMRSDCLVQFSILTL

SEQ ID NO: 222139 - protein, 165 aa, Glycine max
  Coding DNA Sequence Number=SeqID_105361
MGDFAQATHEAGQTYGWDCAIVCCYSCCRRKGLTYCYCYSCSPTSSCGACLGGCSCMLPALDGFVVVPSSTIVAPLLSVGVATASALGASYRLDHKTFCLIRSPVHLDWGAKCYGFCQSLSLENFGDSKGEWTTEPRDFSQGGVLGGGGRQMEGYYSHCLESRAP

SEQ ID NO: 222140 - protein, 102 aa, Glycine max
  Coding DNA Sequence Number=SeqID_105362
MYKTKGVEPNSKVEMNKRYEQDALELRYINSLGINPCHQFSAGSTEPWHHSMTLNKKGGGHLVMQSYPARALGRRLQVDWARDPREGPKVLMSLRVDFEPMG

SEQ ID NO: 222141 - protein, 217 aa, Glycine max
  Coding DNA Sequence Number=SeqID_105363
MSSFLFDYATSMGGSDSEGSIEQPLMDREVISIGSSSSLDARRGAVDSKSSSLEKVKASCHTSGGSSHLRGRVRPSVASGEPFLVTMILPPVAFGGVRRGSGNGDARAFAHVRCSHSAGSPSSPLAIVGCRNLPFSGGAKRLLGWAKGASSKERKRMESPPMVQESFMQGEGISTLRACHKGLDKGVSLTPTYSSIAMRKSDLKERVVKVLDLETTS

SEQ ID NO: 222142 - protein, 375 aa, Glycine max
  Coding DNA Sequence Number=SeqID_105364
  Gene Ontology: Mol. function=nucleic acid binding; Cellular component= intracellular
  Homolog annotation: Hit_ID=UPI00006607D7; Match level="QueryCoverage =31%, HitCoverage=47%, E-value=6e-11, Identity=29%"; Hit description =UPI00006607D7 related cluster
  Pfam annotation: Domain name=G-patch; Domain location=218-262; Score =66.4; E_value=9.5e-17; Accession=PF01585.13; Description=G-patch domain
MSTTNHPMRGKRTSNERKQCQEEKKLKRQCKNNQMAHGRGSVFYFSLTDRKKIPLTLSLRLFVSPPRLMLFLAMDESPANRESKSEEEEEDDGYMGDLSQFLPSDALEPAKLSSSKKTNVNDCSCNYNCGCRDMKNVDVAVTIVFADRIFKLCACNIHSDDISLYTMQISSKKDPSVNSSKNWLKTLNWQERRKLERERKQQEEDEQTLAKVEAPIPQSNIGFKLLKQMGYSPGSALGKQGSGRAEPVGIEIRRSRAGVGLEDPHKEKRKKEEIMMDRKRRKEEDLMKEFGSRQKSQWQSRRVIINYNKAKAALDQLENRVIVEPQKNDDVAEGEEEEEEEITEEDLHDVLMKLRDEFNYCLFCGCQVSKHQIYF

SEQ ID NO: 222143 - protein, 81 aa, Glycine max
  Coding DNA Sequence Number=SeqID_105365
MVHWQVVVVVMVDVAINGRDEDQWMHDSIIFEEADMNKENEDELGMNEEHVDCFDTFNTSQRKMQGSCISKHEEMLMRCMI

SEQ ID NO: 222144 - protein, 119 aa, Glycine max
  Coding DNA Sequence Number=SeqID_105366
MVHRIIEADMPKDEYLDAFLTQANLYTNDDVILCRVFPMSLKGATMTGQADDESLQKLRDRFGGIVIQIHNLNPEVALHFILLALQSGKFMDSLCKKTPSSMDELYERAKGYIQMEEIS

SEQ ID NO: 222145 - protein, 111 aa, Glycine max
  Coding DNA Sequence Number=SeqID_105367
MEVVPNIPNPHWLCISAVLGEKNCFREENPSRGASVTLPRRFREQIRQGFSSFFTVLHTFFVLSSFFNGFHLHFVHFRFSFLPFLTSFNRSFKPLSRLINDKMNFNRSFAL

SEQ ID NO: 222146 - protein, 174 aa, Glycine max
  Coding DNA Sequence Number=SeqID_105368
MLKKGHKISKAIIMARLFRKDCLTRPQEREVITPTSLDDYLVGVLRIFQLHLVLESSDTCCRGEGGFILQNIVPYPLIASNDRGDDGDPMLWLRRTQGDALTSPSLVLTPLGVEGGRITMIEIDSLTREAMKGRTLRGGGRFLYQYGAKPSTSLRNRIRYQRHYDKYPPRRNHQ

SEQ ID NO: 222147 - protein, 91 aa, Glycine max
  Coding DNA Sequence Number=SeqID_105369
  Subcellular localization annotation: CTP_CleavageSite=71; ConfidenceScore=5.02e-01
MQEHDITSLIRVTARVAPMQENNTTSPVHKTQRPSFGSLNAALQACQNPGQTRPCPRLVKPKGYKNIKNPRSTLGKHSHKTQGTLLDKLTP

SEQ ID NO: 222148 - protein, 124 aa, Glycine max
  Coding DNA Sequence Number=SeqID_105370
MKVELVTIDEVQEMIRIREEATKLRAARRYNTKGLVKPKVRPWEREESKEFSDCVVLNSLKREKGDKRIQAISPSFFWKREKRNTKRIQANKVWKPKNSESFWQRKKKKKKKKFKKMFKKIQRL

SEQ ID NO: 222149 - protein, 101 aa, Glycine max
  Coding DNA Sequence Number=SeqID_105371
MESSTTAKAVRGGKVPRCNCTDNPYRLQIPKRLVEIQDAKSKSFVNHATVSYFHRKKMITMHSLIARTEEKQLTAATAYDKPINMMQAPGTSTSVKFYKCY

SEQ ID NO: 222150 - protein, 136 aa, Glycine max
  Coding DNA Sequence Number=SeqID_105372
  Gene Ontology: Mol. function=hydrolase activity, acting on glycosyl bonds; Biological process=carbohydrate metabolic process
  Homolog annotation: Hit_ID=Q84K13; Match level="QueryCoverage=55%, HitCoverage=17%, E-value=9e-20, Identity=60%"; Hit description =Putative polygalacturonase
ENNGTVVKKKREIACEIETAGGDIKLGPTAVLEALHVPNRPPKRFGVGCFPISATAEILDRQDDLPWWNIAKEASTGWCSYWKGRKLKPGGGGGGETSKGGFGGKDCGAASYMGLEGRSGVRRKSLMPQIETTEAS

SEQ ID NO: 222151 - protein, 487 aa, Glycine max
  Coding DNA Sequence Number=SeqID_105373
  Subcellular localization annotation: CTP_CleavageSite=20; ConfidenceScore=5.38e-01
MVILPPSTPKGVRTSDGDVRASPCVRRSHSIGSPSSPLSLLAMSGVFNKLFDLDLNNFCYFKDRFFKVLVTDVVANGFFDDKAILEQLSTSLDARAILFVPLESDPLVALDDKFCTLSCQFKPLMKQVEPTDGTVPPSTVPPVIGERGQPVDEIGSIVGIVKVAPNARFYVLTKRKLDDDTGVQATGLTLGLGHPPSLQDVSPAPRVVEAPASTVIVVATPAPPPPHDTPATGVGAMATSVGSIATSSSNVATPLLSAGVETTNAPLMPPLPSLAPPVPPFIVLAAAVPSSSSHPHVSLDHLYDSLWGANYKPKKKTPTGFVSSCDRNLIQSVGVQNTMNSAKVFLLRSLAILKENGQRHQETLRKVLSFETEVGSVLPKLLFTRLDGDELSAHCKGLWEEKNDLAGKVEGIAAERDELAKVVVDLKAWLKESKSRLEEFELWAIRQARFFTKDLDLGLFDLFKDVKDGVLLDEEDIAAEEEAGEEA

SEQ ID NO: 222152 - protein, 123 aa, Glycine max
  Coding DNA Sequence Number=SeqID_105374
  Gene Ontology: Mol. function=nucleic acid binding
MDVLGSARQHTSLQEKSFHDLPRLLQTIHEFLPGMFIEKEILPMPLQEGETIEGFMKSHHLFWIFRPCIDGFQYGKSVVQVDGIWLYGKYKGALLVIVAQAWISFLKNLKRHVTLQDGQIDMS

SEQ ID NO: 222153 - protein, 257 aa, Glycine max
  Coding DNA Sequence Number=SeqID_105375
  Gene Ontology: Mol. function=cysteine-type peptidase activity; Cellular component=nucleus; Biological process=proteolysis
  Pfam annotation: Domain name=Transposase_21; Domain location=99-257; Score=160.1; E_value=5.6e-45; Accession=PF02992.5; Description =Transposase family tnp2
MCDTLESDLKNFLYPVCKKSLTLLSTVLSMVNMKARYGWSDKSFTSLFKVVQEMHKCPRCGISWYKVTNDDKCSNDESAKKRLPQQRFKRLFANGDDAKDFTFHANGRNYDGMLCHSDDFSQWKKINHFYPNFRKEARNLRLRLGANGMNSFGSLSTNHTSWPILLVIYNLSPWLCMKRKYMMLSMMILGPRQPRNDIDVYLSPLIEDFRKLGDEGVKVFDGNQNETFKLCAMIFCTIDDFLAYGNLSGYSVKGHRA

SEQ ID NO: 222154 - protein, 279 aa, Glycine max
  Coding DNA Sequence Number=SeqID_105376
  Homolog annotation: Hit_ID=Q9AVH2; Match level="QueryCoverage=71%, HitCoverage=100%, E-value=2e-62, Identity=49%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCESNELYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 222155 - protein, 117 aa, Glycine max
  Coding DNA Sequence Number=SeqID_105377
  Gene Ontology: Mol. function=unspecific monooxygenase activity
  Homolog annotation: Hit_ID=O04892; Match level="QueryCoverage=80%, HitCoverage=23%, E-value=2e-28, Identity=58%"; Hit description =Cytochrome P450 like_TBP
  Subcellular localization annotation: CTP_CleavageSite=50; ConfidenceScore=5.36e-01
LQGEQASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 222156 - protein, 186 aa, Glycine max
  Coding DNA Sequence Number=SeqID_105378
  Homolog annotation: Hit_ID=Q7CQB7; Match level="QueryCoverage=39%, HitCoverage=98%, E-value=2e-14, Identity=55%"; Hit description =Putative cytoplasmic protein
NVCAQGHSTKEIMMSDEDFVTSRDTQALADEVACLKMMVTLILKGMGQADAGKVIINMERYVQSALADKPQAEVFSNTIRQIKTAYRHDACRDTSPPALAAAPEYEWQTDCLLTGSVPARAAPVPNAIRCSAAVRHPLQGGPNSATFPTLFAGQKAAPCPPALPARATVTDVRSHKCPDAQSRQSA

SEQ ID NO: 222157 - protein, 230 aa, Glycine max
  Coding DNA Sequence Number=SeqID_105379
  Gene Ontology: Mol. function=pyridoxal phosphate binding; Cellular component=cytoplasm; Biological process=arginine catabolic process to glutamate
  Homolog annotation: Hit_ID=P77581; Match level="QueryCoverage=80%, HitCoverage=45%, E-value=2e-88, Identity=82%"; Hit description =Succinylornithine transaminase
  Pfam annotation: Domain name=Aminotran_3; Domain location=58-230; Score=32.5; E_value=3.3e-13; Accession=PF00202.11; Description =Aminotransferase class-III
MPEPGCHLHPLSAVRPKMAQQTPHFGEISAEKWLCHCRFHVTISDQWMMPVYAPAAFVPVRAEGFTLWDQQGKEYIDFAGGIAVNALGHAHPALQQALTEQAGKLWHTGNGYTNEPILRLAKQLIDATFADRVFFCNSGAEANEAALKLARKVAHDRFGAEKNGIVAFTNAFHGRTLFTVSAGGQPAYSRDFAPLPPAIQHATFNDLASAAALINDQTCAVIVEPIQGEG

SEQ ID NO: 222158 - protein, 72 aa, Glycine max
  Coding DNA Sequence Number=SeqID_105380
MEEEAHEDEEMADLLDFLGREWRHVTGRSPDSSHTFCLDRCVSIYISLLSMMLEILEPCRVLRLGTSSKVYM

SEQ ID NO: 222159 - protein, 97 aa, Glycine max
  Coding DNA Sequence Number=SeqID_105381
MLVITVEVEWVMTGKDESRVVTWWWALASARRSLTLTSIGEERRESAVRVYTESPMRWALEEGSLCRSKLHDESRLIQGVLMITKMMTKSSKVKITS

SEQ ID NO: 222160 - protein, 91 aa, Glycine max
  Coding DNA Sequence Number=SeqID_105382
  Gene Ontology: Mol. function=protein serine/threonine kinase activity; Cellular component=nucleus; Biological process=protein amino acid phosphorylation
  Homolog annotation: Hit_ID=Q84XZ6; Match level="QueryCoverage=69%, HitCoverage=17%, E-value=6e-24, Identity=81%"; Hit description =Mitogen-activated protein kinase 4
MSELIGSPDDTSIGFLRSDNACRYVRQLPQYPRQQFAARFLSMSPGAVDLLEKMLVLDPNRRITGYSTFNIGAYVTNDVKTHFLHRSRIQH

SEQ ID NO: 222161 - protein, 577 aa, Glycine max
  Coding DNA Sequence Number=SeqID_105383
  Gene Ontology: Mol. function=kinase activity; Cellular component =mitochondrion; Biological process=protein amino acid phosphorylation
  Homolog annotation: Hit_ID=Q2HTV1; Match level="QueryCoverage=84%, HitCoverage=78%, E-value=0.0, Identity=67%"; Hit description=Protein kinase-like
  Pfam annotation: Domain name=ABC1; Domain location=224-350; Score =136.9; E_value=5.5e-38; Accession=PF03109.7; Description=ABC1 family
MGWGTPVISNPEPKTIYFLYSFLLVETLEGLHVLFTRQAAWKYFIPWGPLTQDTNFSHTIDMYTKDNFYSCYLNRRASSTANRSNCPCGELAWTQGKWAEAESFPTRDSLYVHAQDGHVYLTAALLAAIEIFILFLRAAYLVILFCPCIAMAPLVGFFGTQFRKTWIHVVRVTLEKAGPAFIKWGQWAATRPDLFPRDLCDELAEFQTKAPSHKFSYSRKCIENAFGHKLSEIFENFEEEPVASGSIAQVHRATLKYKFPGQQTKPVVVAVKVRHPGVSEAIKRDFILINLVAKISSFFPNLKWLRLDESIQQFSVFMMSQVDLSREAVHLSRFIYNFRRWKDVSFPMPLYPLVHPSVLVETFEQGESVLHYVDQPEGHEHFKSTLAHIGTHALLKMLLVDNFIHADMHPGNILVRVGKSKSTLLKSRPHVIFLDVGMTTELSKREREYLVEFFKAIALQDGRTAAECTLRLSKRQNCPDPKSFIEEVDKSFELWRSPEGESVHTADRMQQLLEHVRRCKVNIDGNVCAVIVTTLVLEGWQRRLDPEYDVLHALQALLFKADLAESLSYAIEGLVAP

SEQ ID NO: 222162 - protein, 68 aa, Glycine max
  Coding DNA Sequence Number=SeqID_105384
MAVCGGYWWLWVMENKIGTLEMERKHSSHARCGIKDRNGQVVDTCFLKLQTKFREDPTVNEGGTAFLP

SEQ ID NO: 222163 - protein, 121 aa, Glycine max
  Coding DNA Sequence Number=SeqID_105385
MDSHVVFVASVTLVENPGAPLYRLAIEPQCGGCGTASFRQNYCIEVASNQLAWANQVSSSISNQLAWASYNSLRQVCTFRADAILPRKGPITRTMSKRLQEDWARAAEEGPRVLMNLRVDF

SEQ ID NO: 222164 - protein, 98 aa, Glycine max
  Coding DNA Sequence Number=SeqID_105386
MGGKKGEKVKESTMIEAEMKAQKNPSIQGMHSSLNPPFFDFSKLRIHKQGDNEKMSKFEKYMGMLQRKKEEPPIEKLTWVVLHQRRTSKFQSFEEDPS

SEQ ID NO: 222165 - protein, 107 aa, Glycine max
  Coding DNA Sequence Number=SeqID_105387
MVDGTTAKEKQKLEECLHDLDFPKEVIVGKDEKPIIINSSLTKFEEEKLVKVLKANKDSIGWHISDLKGISPSYYMHNINLEDDCYRNLPHDGMAKENKGGVIEKRK
